United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 19

SEQ ID NO: 76381 - DNA, 492 bp, Glycine max
  Peptide Sequence Number=SeqID_193159
atgcatgcatgcttccctgtgccgcagatcaatgcagtgggcctcttgcttcacttggggtatgccaatgttctaatgcacggccttgagcctgaactgagcaatgatctgcggagtagaagtctgatccgggcgctgtgttctatgcagccggacccctacctgtctttcgagcatgaggtggcatttctggaggcccatttgggccatttgggcggaggagggaacgcgtatgtcctgggagacgcgctccacggcctgcgctggcacgtctacgtggcgtccgactgcggctggccggcagctgcgcgcagggattcctccgcagaccactccatcgaagtctgcatgaccgacttatgccccgtcaaggtgggcactgtcatcatgctgatctattgtagcggtcatcagcggttcatttgctccaccgtggcatgcagcctctctgtccactgtggctgcatgcatgccctcttacctctggcttga

SEQ ID NO: 76382 - DNA, 399 bp, Glycine max
  Peptide Sequence Number=SeqID_193160
atggaagctgcaatgggtgtcatcgcagggctggcatgtcagctgaacccctcgccgcaagccagaggccattcgagcgcgcacagtgacgtgcagattctgccagatgacacagtctatgtcctaacagatgacaggaggatagtggggacggcagaggtggtgcatattgggcctggcacacggttccacggtgctgagcttgaggggtttggtgttatttgcgggctcaccatcacagacgcaactggggctggacaccagaaggcatggttgagcgacacagatgaagtcagagcaggcagaacacccttggaagcaattgggggcaatcagatggtggcagttcccgagaggtgccttcgctttctgaggcgcccaccggcggctggagagtga

SEQ ID NO: 76383 - DNA, 213 bp, Glycine max
  Peptide Sequence Number=SeqID_193161
atgcagagactaacatcgtcttatgcaccctttgtcaatcgcggccaacgagcccgttcacacgcggagatttacgtcgtccttcgcgcagtcgatctctgtcagtacttacccatgaagttagggggcaggcagaaatacccaagtggttatccgtataaacaatcttttgctatccgtaagactcaacgcatgatagcatgtaaagactaa

SEQ ID NO: 76384 - DNA, 516 bp, Glycine max
  Peptide Sequence Number=SeqID_193162
atgaagtttgggggcaggcggaaatacccaagtggttatccgtatacacattcttttgctatccgtaagactcaatgcacggtagcatgggcaaacgagcctgttgacgcgaagagactaacattgtcacctgcaccttctgtcatcctgacccgggcaaacgagcccgttcacgcgaagagaccgacatcatcttctgcaccttttgccatccagggacagcgagtcgggtggcaagcagagataccttatggtcatcagcgcctttcatcaaccgaggggactgaattcaacaatatcaggatgatgggtgtgaaaatagtaaccagcctacttggaccttccagggtgttccaacagaaggcggtgccttctggtggaagcaacccagctcgcctgggcgagctaggcggagggaaagagggcagagcaaattcgttcaaccctcctgacgtttccgtgagcgattttgtgaggattcttcatcgttcttcgttgttcttcggtattcaaccg

SEQ ID NO: 76385 - DNA, 818 bp, Glycine max
  Peptide Sequence Number=SeqID_193163
ccatacccttcctgatggaggtgctagtaccagtggatgttctgggccagagcgacatcctgcctcccaggattgcatccctggtcaagagcgccaccacttcacccacatcgtcagtcagcgaccccccagagtcagaactagaagctggcggcgtgcaggcatcaggcagaatgagccctggatcaagcgcggcagcccaggacagccagaaggcgagcaactttgtggagacgctgcactttttcggggtgtttgatgggcacggcggcgctgagggcgcgctgcactgcgcacagactctccatcagcgctttgtcgaggccattctggagcacacctcccccggaggcttgcccccgcctgcagcagagcagatggagaccagcatcgccagcactgcagccacctctgttgaggctgcagcggaggcagctgcttgcggagtggcccgcggcaacgtggctgaatctgctcctagaaatgtgccgaaacccgctgcggctgacgctgacaccgatagcaacagcagaagcatgcaacaactaggcagaacggagaaatttgctgcatcttgcacccgtctttgtcctgcttggaggattttttgtcctgaacatctaatttgcatatctgtgcgcagcgacagcgacgcatttatggtggcggcaatagaggaggagaatgctgcggcggcggcggaaggggcggagtcccaaaacgagaacaccattgcctgctccgcacagcactttgagactgcgctgactgacgccttcaaccgcaccgacgaggagtttggcaaggctgacaatgct

SEQ ID NO: 76386 - DNA, 210 bp, Glycine max
  Peptide Sequence Number=SeqID_193164
atggatatctgtgaagatactgacattcctgtaatattgggaagaccattcatgttgaccgcaagctgcatagttgagatgggtaagaggaagctggagttgggttttgaagatcagaaaattgattttgatttatttgttgaagacaagcctactccagaacaaaatgtttgcttacaagtaatggaaggaggtcaagaggttctgacg

SEQ ID NO: 76387 - DNA, 993 bp, Glycine max
  Peptide Sequence Number=SeqID_193165
cgccgcaatcagaaggtggtggaagagacgccggcccctaatctgccgcaggccacgcgtgaagcgctgctggcttcagcggtgcggctgggcgagctggttaattaccgcagcgccggcaccgtggagtacatctatgacgccgcgcaggacgcgttttatttcctcgaagtgaacacccgcctgcaggtggagcatccggtgaccgagtgcgtcaccggtcttgacctggtggagtgcatgctgcaggtggcggcggacgatgccatcgactgggatcgtctgcagcaggcaccgcacggcgcatcgattgaggtgcggctgtacgccgaagatccactgaaaaacttccagccgagcccgggcgtgttaacccacgtcagcttcccgccgggggtgcgcgtcgacggctggatcgagaccggcagcgaagtgacggcgttttacgatccgatggtagccaaactgatcgtgcatggcgaaacgcgcgacgccgcgctggcgaagctgcagcaggcgctcgacgctacccaactgcacggcatcgccaccaatctcgattatctgcgtcagatcgtggcgaccgacgccttccgcagcggcaacgtctggacgcgcttccttgacggctttacgccggcggccagcgtcatcgaagtgctgcagccgggcacgttcagcagcattcaggactttcccggccgcctgggctactgggacatcggcgtgccgccgtccggcccgatggatgacttcgccttccgcctggccaaccgtatcgtcggcaaccacgccagcgccgccgggctggagttcaccctgcagggcccgacgctgcgcttccacagcgatgcactgatcgcgctgaccggtgccgactgtccggccgatctcgacggcagcgcggtcgactactggcagccggtggcggtgaaagccggacaaaccctgacgctgggccgcgcgcagagcggctgccgcacctatttagcg

SEQ ID NO: 76388 - DNA, 654 bp, Glycine max
  Peptide Sequence Number=SeqID_193166
ggtctggtgaagggttttgccttgcaaaccttcccggtgatgcttttagtctatgggggaacttctttgaggcaaagaaacaaatgatggctgatgccaaggtttgcggggctgcttggtttagccattgcttaagtttttccatgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggtggatcatcatgcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 76389 - DNA, 539 bp, Glycine max
  Peptide Sequence Number=SeqID_193167
atggctatcgcgcataccatcctcactcgggacctcaccgacgagctcggttcccatggtggcgtggccgctttacgcggagcagaaaatgaacgtggttctgctgtcggaggagcttggggtgccggtgtgcatggcggaggaggagggagaagttgtgcaaagagaacatggatgagggttttgatatttaaagcctcagctagtggcaatctagaggcaaagcgtctacacaagcaaatgtgttgtcactgtgttgattctctctttctccttattcttctctttctcaaaaacactatctttgtctctgttcttgcaattgatttgtttgacgcggacaagtatatagatgatgatcaacttgttgtgaactttaagaaacaggaccctgatttgagatggcttgacatcatggagtcctgggaatcacttactgcaagatctccacaacttttgcaagggacatccatctatattgttggtgattcaaccgaaatcaatcaaaaaggggctcaaaagctagcaactgatctcgg

SEQ ID NO: 76390 - DNA, 198 bp, Glycine max
  Peptide Sequence Number=SeqID_193168
atgctgtggctttgttatatttggctggtgggtcttcttttgttgcttgtttccttggtgagtgcaattcttatgaagaaactatctcatctaagaaatatgttagaaagttctgctgatagtgtcaacaataatcccgtttttggtggaagccagatgtcgttggggccatcctctcccttttcaaaagttccttaa

SEQ ID NO: 76391 - DNA, 411 bp, Glycine max
  misc_feature (14)..(14): n is a, c, g, or t
  Peptide Sequence Number=SeqID_193169
atggcttcaaatgntgccatcaaacttcaagaagcaaaggactccattgatcaacacaaaaacatgtttcctaagtttcctacaagctccatatggagctacatcatgtggtatcaagagcatcttcatctaggtgatgttcttttgcttcctctatcttttggttcggtcaattcactttatttccttgctattcatcttattctccatatgataacaaaagatgatgacaaaggtgatgacaaaaagctcaaaggtcattcaaagaatgagttcaagatgttcaagatagaatcaagaacacttcaagattcaagaggaaagttgaattcaagaatcaagattcaagagatcaaggttcaagactcaagaatcaagaaaagactattcaagaatcaagaaaaagcttaa

SEQ ID NO: 76392 - DNA, 198 bp, Glycine max
  Peptide Sequence Number=SeqID_193170
atggcatttatagttgctcctcttctttggaaacaacaccttcatagatctagagaagtatttgaaaggtggagacctaagtcgcacatgtttcatcttcctgttggtgaatgcataatcaccttggaagatgttgctcttcaactcagtttacgcgttgatgaaaaaccagtcattgacccaacatattatgattga

SEQ ID NO: 76393 - DNA, 153 bp, Glycine max
  Peptide Sequence Number=SeqID_193171
atgtcagggcagagaaggtcgtcaagaacttcaaagttcactgagattgagattaatgaacttgtgtctaggttacaagttctgcttctgcaagggaaccaaagaggcaactcaaggttgattgattccataacgtcctctactctagcttga

SEQ ID NO: 76394 - DNA, 295 bp, Glycine max
  Peptide Sequence Number=SeqID_193172
ctgggttgcttccagaagcaacccagctcgcgtgggcgagctaaggtcgcctgggcgagctgggcggcaacctcctccccctttttcctataaaaaggctgaagggggctattctaaggatccctcagccccctggctatgtatttcagccgttttgggtgaaaaaaattgtttccgtgaagaaaatccaagccgaggtgcttccgtaacgcttccgagatgtttccgtaagcaaatccgtgaaggttttcgtccgttcttcatcgttcttcatccgttcttcgttcttcaacgg

SEQ ID NO: 76395 - DNA, 264 bp, Glycine max
  Peptide Sequence Number=SeqID_193173
atggcggatgcaagggaaaaaactaaggctagcactaaggggggcgacgcgagagctcacgggtgtgtctttcatgggaggaagatgcgcggagtcgccaccaacgtttattcgaggaaaacgtcggaaaaaccggaaaagggtgtttcccttgctcctacgtattcctcaattgtgataaggaaatcagacctacgtagttctttgaaaaggggcgaatcaagtgattctttttacttggaaggtggtcatttaaggcgctag

SEQ ID NO: 76396 - DNA, 1602 bp, Glycine max
  Peptide Sequence Number=SeqID_193174
atgagcgattatctcaaagagaaaggaggtcccaggttggttatcatgggagagaccaaacaacttgttacccttttgacacgatttcaagcggcaatgaaaatgatcaaggacatagtggaaaaaagtagatcgagtaaaaagagcaaacgattactgaggaaaaccctcaagaatatgactcctctgctgcaggaaatcaatcaatacaatgaacacttggaaccaccccgagaagaaatcaacactcttatgaaagaaaaagatgcagtggaagagcttgtgtgctattcctgctccaggagtatttggtggaccaaatttctctcttggcttccgctctacggggacggactttggcataacaagaataatccccttgctgcagatgacaaccaagttaagtatatcaaaaacacactgtatgaggtgaaagaggttcttgagcttctagacatagagaattttcagcagaaacttaaaggtgttggatcaccaatcaagtgtccttttggtgttcctgaaaaccctggattcactgttgggttgaatccactgttgagcaagttgaagatggaggttctcagggacggtatgtccacccatttgttgactggtttgggtggatctggtaaaacaactttggctacaaagctctgtagggatgaagaagtcaagggtaaattcaaggaaaatattttatttttcaccttctcacaaacgcctaagttgaagaatatcatagaaagactatttgaacattgtggataccacgttcctgagtttataagtgatgaagatgcaattaaacggttggaaattttgctgcggaaaattgagggaagtccacttttgttggtcttggatgatgtttggcctggatcagaagccctcattgagaaatttcaattccagatgtctgattataaaattgtggtgacttctagggttgcatttcctaaatatggcaccccatatgttttaaaaccacttgctcatgaagatgcaatgaccctattccgacatcatgctctcttggaaaaaagcagttcacatattcctgacaaagaaattgtccaaaaggtgcttattttgctttctgacattgggagtaatctgtaccagtcctttgtgtctgaagccattgttgatttagagagtacaaagttgtgttttgactcctcaaaccaatattatggtagattacttgccacttgggcacccaatgttgtgagatattgcaagggtttaccgcttgccgttaaagtgattggtagatcactcagtcatcggcctattgagatgtggcaaaagatggtggaggaattgtcacaaggtcattctatacttgattctaatattgaattacttacatgcttccaaaagctcttgcatgttttggaagataatcccaacaacaaggagtgcttcatggacttggggttatttcctgaagaccaaagaattcctcttcctgttcttattgatatatgggcagtgttatatggatttgatgatgacggcatagaagcaatggacatcataaataaattagactccatgaatctggttaatgtcttactagcaaggtacaatgactag

SEQ ID NO: 76397 - DNA, 135 bp, Glycine max
  Peptide Sequence Number=SeqID_193175
atggagggtagagttaacctagggttaaaaagtgagaatggtagtgatatgagtggaaaagtgacttgtgggaaagcttgggctgagcaaatggggaaaatgagtgaccaaagtgaaggcaaaagtcatttctag

SEQ ID NO: 76398 - DNA, 300 bp, Glycine max
  Peptide Sequence Number=SeqID_193176
atggacatcgagttagagcaacttgatgtcaaaattgcctttccctatggaaggctagaggaagacattttgatgcaacaacctgaaggttttgaggataaagtaaggaatcatcaaggtggtggtataagagattcaatgagttcattgtcttctatgggtatatcagaagtccatatgactcgtgtttatcttagcaagttggaggagggttcccacatctatctactactctatatggacgacatgcttattgatggaagctttcttgagaagtttctatggagggtggatctttga

SEQ ID NO: 76399 - DNA, 351 bp, Glycine max
  Peptide Sequence Number=SeqID_193177
atggctctggtgatgggtcccttccttgggaggactacatcaaattgtgaggatgaactcgtgcagtaccatggtttgtctgctttcaagaagcataactcgcctaagttttgcggagcctctgatcccgaaggagctaagctccaattttttgaagttgagaagatcttcaaagcgatgggatcctacgaggagcataagatggtatgccaaattgtaccagaggaaggagtcatttcttgggacgcattcaaggcaaaattcttggagaagtacttcccaaaggatttgcgcaaggagaaggctaaggaatttctagagttgaaacaaggaaacataattgtaggataa

SEQ ID NO: 76400 - DNA, 476 bp, Glycine max
  Peptide Sequence Number=SeqID_193178
gctagaatcatgagtgagatagaggaagttcaagaacagatgaaggcagacatggaggccatgaaagaccaaatgaccaccatgatggaggtcatgatgagtatgagaaaaatgatggaggtcaacatggctatagtcgctgccacaagtaccgccactgaggtggactcgactcacccatctggtatcaatcaagtccagagcaagcatcatttcctaccatatggcttgcctcccaactatgcaccacccaatgttgcatatgcgctcgaggataatgtcgacaactccactcccatacccattgagagccaacaaccccggtctggtcatgcacaggtccctcagcccatgggggagacacatgaagtacctcgagaccacgctctagtcgactttgagcctcacctcggatatgccactgaggggcaagcatttggtggcgtacctctgccaaactctttggggggccctcg

SEQ ID NO: 76401 - DNA, 1480 bp, Glycine max
  Peptide Sequence Number=SeqID_193179
atgggaatagcaacaccttcttcatcgcttccttccattctctctcactcgaagacacaacaacaaatacatcattcgaattcttctatgtcccaagattaccaccaccaccaccaaggaatcttcagcttcccgaatgggttcgaaagatcggcggcggccactacgatgactcaccaagaccctcaccaacagcagattcggagggacaaagtgagggtgcaaggcttcgagccaccgccgtcgcatcaaactttggtacctatagaggaagacgaatcgggaagcctcccggtgtacgaaaccgccgggatgttatcggagatgttcaatttcactcccggcgccacggaattattggaacagcaacagcagcaacaacaaccaatggcgacgacgacggccagggcagtgggcagtggtggcagcgagtggtacggaaacagacaggggatgttaagcaatttgggaccgttgggagattccaagaatcatcatcatcatggcagtgtgaatagccgtgacagtagcagcagcagcatagttcagaatcagcatcatcatcatcacaaccaccaccatcatcaaatgtcgagcattaatgcggactcagcagctgccatgcagctttttctcatgaaccctcaaaccaccagatccccttctccccctccacctcctcctccttcttcttctactctccacatgctgcttcctaatactttccctcctggctcaggagggtctttcggtcaattcacgtggctccccgacaccactcaagaaggaggaccgagtacagtcgtggaaggccctggccacggtcacggtcaaggcctttctctgtccctgtcctcctccatagaagccgcaaaagcggaggaactaaggatgggggatagtgggtttttgtattacaatcaagcaagtggaggaccctcttcctataagagtactcttgggggtcatcaccaccaagcattgttgggacaagcccaccagggaaatgttgggtttggagcagcatcatcgtctacatcatcattaggtgttgtgaatgcgttgaggaattcaaaatatgccaaggctgctcaggagttgcttgaagagttttgcagtgttgggagaggccagttcaagaagaacaagtttaacagacaactctcaaaccctagttccaatcttggaggtagtggcggtggtggcggcggcgcttcttcgtcttcatcaaaggatattcctcctttgtcagcagctgataggattgagcatcaaaggaggaaggtggataggagatacagccactactgcgagcaaatgcacatggtggtgaactcattcgacatggtgatggggttcggcgcggcggtgccatacacggcgctggctcagaaagcaatgtctcgtcactttaggtgcctgaaggatgcaataacagcacaattgaagcatagttgtgaggtgttgggagagaaagatg

SEQ ID NO: 76402 - DNA, 102 bp, Glycine max
  Peptide Sequence Number=SeqID_193180
atgaaggagattggacctccattccgtgaggccacacccaaatcgattgtgaagaagggaatccccactccagaatggggaatgaagatgacacaatattga

SEQ ID NO: 76403 - DNA, 573 bp, Glycine max
  Peptide Sequence Number=SeqID_193181
atggcgtttaagaaaacgctagcccagcggcttctcaacatcacaaaaatctccaattaccgcatttcctcctccgtagtccgttccccgaacccgacaaaacctgacattgctccggatcccggagacagccgcaggttcctccacaagagggcctccgtgctcccgccggagctccgcccgccgctgcccgccggcagcctcctccagaggctccgggaaatggacattgcgcggagccggatccggctagacggtctcgctccgccggagactgaacaaacggtggcgccggaacacgtgaggaaggtgctcagagcggtgcaaatcgaaacggtgaaatcgaagctgagaaaaattccgcagagttgcataagctattcagagttcattcgaatgtgcagtgagaattgctctgatcaagagcaagcaatgagcgttgcgaagatgctcgacgagtcagcatcggttattatcatcggagacgtcgtgttcctcagacccgaacaggaaaatgaaagtttgttgtttgcaaacgtgaaaaggattgattctctacgtttgagatggtaa

SEQ ID NO: 76404 - DNA, 198 bp, Glycine max
  Peptide Sequence Number=SeqID_193182
atgaatgaagacaatgaagatgaatctagtgtgcttgaaaatattgattgttctgatgcatttaatacttatcaagtgtttgttacccatgatgacgttttgcattggactcgttctgttgcgtatgatattggttttgtgattgtgataatgaggtcagacacaaatattggaaagagaggaagaacctcgatttag

SEQ ID NO: 76405 - DNA, 779 bp, Glycine max
  Peptide Sequence Number=SeqID_193183
taaccctgtgctgaaacgaatttcatctgacatttctaatgtcccaaaagacactctttcccacatcatcgaccttgttctcaagagcaacgaggaaagaggccgccgagagatgaaatccattgttctaaagctcctcagggagaacaacagccttccaagctatgcgcgatcaaccgacatatgcaatgacacgatctacagatcatgccgaagctgcttggattcattactgtctctattcaagcaggctgcagaaccagacaaaccgagtgaggaccgtgatcctatagcaaagtgcatagctctcgaagctgataacttatcatggttgcttgagattttagttgacaaacaagccgctgatgagtttgcattgatgtgggcaaaccaacaggaactggcgttgctacacacgaagctgccaaccatgttgcgctaccatgttagctgcctttctgggaggctgtatgttggcatcggaagaggggagctgttgccgtcgaaggacacacgccggttgttgttacagacatggctgcagcctctgatgaatgactacaactggctgcagcatggatgcaggtcgtttgataggaaacttgtggaggaaggaattgggaggactattctgaccttgcctcttgagtatcaacagagcattttgctttcgtggttggggagtttcttgaaaactggtgatagctgtcccaatcttcagagggcatttgaggtatggtggaggagaaccttcattaggccatatgtggagaaccaag

SEQ ID NO: 76406 - DNA, 330 bp, Glycine max
  Peptide Sequence Number=SeqID_193184
atggacactgtcatgatttctcatgggattgggaatatggtcaaactaatccttatacaactagggcaatcctctcatgctgaactcgtgcttgaggttaagatggcaggttctgcaaaacatcatgctatagagttcagttttgggatgaagggaatgcatcaagatctcatatcagctaggaatatggccaaatactccttgttttcttggccactaatctcttacttgtttgagggagcacttgctgctgcactaacatgtgatttgttctcaagaatcttgtcttggactatttgtgttgaggctaagttaggtgtattgcattga

SEQ ID NO: 76407 - DNA, 4197 bp, Glycine max
  Peptide Sequence Number=SeqID_193185
atggaagtacttccttgttctggtgttcagtatgctgggggatctgattgctctcagccaagtttaggaacaacttttgtaaaccagggagaaagtggtgatcaggctaaattggaagatgatcaactgaatgactcattacgaacggaagggcctcagctagaaagacaaggccaaacgcaacagattgtttgtgaacccttgactaatatagcttgccaatgtggtggatcttcatgttgtgactgccaagtggaaggccagaaggaatccattagtttccatgatgttgaagatgatggaataaacaagccttgcttagcctttgaaaactctggctctattccagatacaaatgaaagtgaatcaccaaatggtagtagggaagtagagctgtcattttctgaacccacctggctgaagggagatgagcctgtggcattgtgggtcaagtggagagggaactggcaggctggtatcaaatgtgcaagggctgactggccattatcaactttaaaagcaaaaccaactcatgaccggaagaaatattttgttatattttttcctcacacaaggaatcattcttgggctgatatgctgcttgttcgatcaatttatgagtttccccagcctattgcacacaaaactcatcaagcaggattgaaaatggtaaaagatttgactgttgcacggcggtttataatgcaaaagctaaccattggtatactgagcattgttgatcagcttcatcctaatgccttgctagaaactgctcgtgatgtgatggtttggaaggagtttgctatggagacttctcgttgtaacagttattcagattttggcagaatgcttctaaagttacaaaatagcatagtgaagcactacacagatgctgactggatacaacattcatcttactcttgggctgaacgatgccagactgcaaatagtgctgaattggtagagctactgaaggaggaattgtctgattctattttgtggaatgatgtcaatgctctttgggatgcactggtgcaatcaacattaggttctgagtggaaaacctggaagcatgatgtgatgaaatggttttccacatcaccttccttttctagcagcaaggatatgaatcaaatgacctctgatgggttgttcccaaatacgcatgctacactggtggaaacaaaaggttcatatcagcaaattactcttgaaactgacccaggtttctataggagtcaggacatattgaatacattagcagctgagacctctacacacaaagatattaaggaggtacctgtggcaactagtaatttgaccaataaatggaatgaaattgtagttgaggctactgattctgagatgttgcatggaaatggaatggagtcaacacctatgaatgagatggctggtaaaaaaattgtagaacctggtgctaagaatcggcaatgcatagcttatgttgaagcgaagggaagacaatgtgtgagatgggcaaatgacggtgaggtatattgttgtgcgcatttgtcatctcattttttgggaagcttagggaaagccgaaaaacctgtttcagttgatactccaatgtgtggaggtacaactgttcttggtactaagtgtaagcatcatgcccttcctggctcttcattctgtaagaaacatcgtccccatgctgaaacaaatgagatctcaaatttaacccataatacactgaagagaaaacatgaagaaaatcacattggttcagggggcttgatcagcaaagacatggtattgataaatgctgaaagttcattgcaagtagaaccagtgcctgccattgatggtgattccttccttggaagaagcaacttagatgagaggcctgccctttctggcaatgatcagattgcaatggaggtacttcactgtataggttctcctccttatgatgacaaggacccctgtttggaagaaccaaagaggtatttcttgtattgtgagaagcaccttccaagctggctaaaacgtgcaagaaatggaaagagtaggataatatcaaaagaagtgttcacagaaattttaagggactgctgctcatggaagcaaaaggtgcacctgcataaagcatgtgagcttttttacaggctattcaaaagcattttgtcacaaagaagcccagcttctaaggaagttcagttcaagcaggctttaactgaagcctcaaaagatactagtgttggggaattccttatgaagttggttcatagtgaaaaggagagaattgaattgatctggggattcaatgatgacatagatgtatcctcactcgtggaaggtccacctctcgttccttccacagataatgacagctttgataatgaaaatgtcattaagtgtaagatttgctgtgcaaaatttcctgatgaccaaactcttggtaaccattggatggacaaccataaaaaggaagcacagtggctgttcagaggttatgcttgtgccatttgtctggattcttttacaaacaagaagctattggaagcccatgttcaggagagacaccgtgtgcaatttgttgaacagtgcttgcttctccaatgcattccttgtggtagtcattttggaaatatggagcagttatggctgcatgttctatcagtccaccctgttgaattcaagccactgaaagctcctgagcagcaaactttgccttgtgaggactctccggaaaatcttgaccagggaaattcagcttctttggagaataattctgagaatccaggtggtttgcggaggtttgtttgccggttttgtgggttaaaatttgatttactacctgacctgggtcgccatcatcaagctgctcatatgggccgcaatttaggtaccagccgctctacaaaaaggggagttcgttattatacgcatagattaaaatctggcagacttagccgtcctagatttaaaaatggtttggcagcagcatcatttagaattaggaatagggctaatgctaatttaaagagacacattcaggcaacaaagtcacttgacatggtggaaagaaagataaaacctcatgtaactgagacaggaaatattggtaagttggcagaatatcaatgctcggcagttgcaaagattttattttctgagattcagaagactaaaccacggcctaacaatcttgatatcttgtcaattggtcgttctgtatgctgtaaagttagtcttaaagcctcactggaggagaaatatggaattttgcctgaaaggctctatttgaaggcagcaaaactttgcagcgatcataacattcaggtgggttggcaccaggatgggttcatttgtcctaggggttgtaaggttttgaaggaccaaagggatctctctcccttagcatctcttcctaatggtttcctaaagccaaaatcagtaattttatcagatcctgtttgtgacgagttggaggtggatgagtttcattacatcattgattcacaacatttaaaagtagggtccttacaaaaggttactgtcttgtgtgacgacataagctttgggaaggaatcaattccagtgatttgtgtattagatcaagatattctaaactctcttcttaggcatgggtccgttgaggaagatataaatctctctaggccttgggagagctttacttatgttacaaagccaatgcttgatcaatcacttagccttgatactgagagtctgcaactaagatgtgcttgctcattttctgcctgctgtcctgaaacgtgtgatcatgtctacctttttgataatgactatgatgatgcaaaagacatatttgggaaaccaatgcgtagtaggttcccatatgatgagaatggtcgaataatattggaggaaggttaccttgtgtatgaatgtaaccagatgtgcaaatgcaataaaacctgtccaaacagaatattgcagaatggaatacggattaaattggaagtctttaaaacagaaaagaagggatgggctgtaagggctggtgaggctatccttcgtggaacatttgtgtgtgagtacattggagaggttttagataagcaggaggcacaaaaccggcgcaaaaggtttacatttcttcacaatgtagtttcttttagcagtgttgttaaatggtggcactatggccgccatggcagttttgctgccaaccgccattgttaa

SEQ ID NO: 76408 - DNA, 165 bp, Glycine max
  Peptide Sequence Number=SeqID_193186
atgaaggcaaaaagggagagggggttcaagtcccgtgcccaaattaaagcacgaaacaacaaagggtctctaggggtattttttttggtgaaagacacaggaaaagatttggatttccacaaagaactgaaaggtgcaactgcaatgcaaggtgagagaaactga

SEQ ID NO: 76409 - DNA, 675 bp, Glycine max
  Peptide Sequence Number=SeqID_193187
atggcagaaattaggctcacaagggttgagcaaggccaaaccaagattaagaatgttccaatagctgtcaccccagaagggttttggtgctgcccttcccctgtggtgtttcagaaaagcctcaaaactcagaatactctcaataaacacaaaccctcttcaccacccccaccaaaaaccagtgttcagaaaaagcctgtgcctgtgtctgtgtctgtgccagtgtgtgagagaagaactactacacctgccccttcaggattggtgctttctgatgaaaaacaatgtgcaactgctccagaaaggcctccaccacctaccgccacatctgtggctgctgcagagagggcacccaggcaaaaaattgaatctttgccaaagaaggttgctattgagtttggtgaacctggaacttgtgatatgaaagtggttttgttgggaaagcagggattttgtgtcaagttgagtgtgcacagggatgttttgacccagaagagtggtttcttttctgaaaaactctccgaacaatcgggtttgtcgtgtctccaaatcggtgactgcgaggatgtggagatatatgttgaaactgttggtcttatgtactgtaaagagatgaagcagcggctaatgaagcaaagtgtttcccgcattcttcgaatacttaaggtattgtaa

SEQ ID NO: 76410 - DNA, 1882 bp, Glycine max
  Peptide Sequence Number=SeqID_193188
ctttcctgataaaaaaagagacgggaatgataatccatataatcatcttgaggcctcagatcgaacaaaccaggatacagggtacctcacggaatgcgttaaacctaggaaaaaacaaacccctacaagtgatcttcaacatagtttgaagcaagagattctactattagagaaaagactacaagaccaatttgaggttagatgcacgttagaaaaggcacttggatacagacctacatctcttgttaattcgaatgaaacgatactgcccaagaaaattgatgttgacatacagttctgctttatgtatactactagactgatggtgaaaatgtttgaggctaaatcatgccatccaacgtccaaattaattaaagaaattgcggtgttagagttagaagttgtgtatttggaacaatatcttctctccttgtatcgtaaagcatttgatcaacaattaccctctgtagctccattcaccaaggaggaaaaagtaaagtctcctccatcaacacctagagcaagattagttgaagtatctaagcctgaagtgttaaccaaaagaggaagctctgcagtacaatcaattgatcatgagcttgatactctacaaaaggaatatagtggatatgaacatgagacgctaaggaaagaatacaatgtacatcaaccagaaggaaagcgtttagactcaagtgtatatcgttgccactcctcgttatcccagtgtacaacatttacaacaagagtatctgctccagccgcagaagtattaaccgaatctctgcgcacctgccattcccaaccattgtccatgatggagaataatcagcctggcagacatcttggtacccgaatatctgatcatattccagatacaccaaataggctttctgaggatatggtcaaatgtatatcggctatatattgcaaactcgcggatccatctacaacaaatccaggcctttcatctcccagttcatccttgtcttcaactagtgccttttctattgcagatcaagtagacatgtggagtccaggtttgaggaataattcctcattcgatgtacggttagacaatcctttccatgtggaaggactcaaggagtttagtgggccatacagcaccatggttgaggtatcatggatttacagagaaaatcagaaatttggtgataccgagcagttgctcaagaatttcaggtcacttatttgtcaattagaagaagtagatcctgggaagttgaaaaacgaggacaagttagctttctggatcaacatacacaatgctttggtgatgcatgcatttttggcttatggaattccacaaaacaatgtgaaaagggtattccttctgttaaaggctgcatataacattgggggtcatacaatcagtgcagacacaatacagaacactatactcaggtgccggttgcctcgccctggacagtggtttcgcttgttcttttctccaaggacaaaattcaaagctggagatggacgacaagcatacccgattgagcgtcctgagcctcttctacactttgcactctgttcaggaaaccattctgatccagcggtacgcatatatacacccaagagagtgcttcaagaactagaagttgcaaaggaagagtacattcgagctacctttggggtacgcaaggaccagaaaatactttttcccaagcttgtagagtctttcgtcaaggactcgggtttgtgccctgctggtaccatggagatgatccaaaagtctctacctgaatctctaagaaagagtgtaaagaagtgtgacctcgcaaaatccaagaagagcatagaatggattccacacaactttacttttcgatatctcatacctaaggagcttgtaaaataa

SEQ ID NO: 76411 - DNA, 201 bp, Glycine max
  Peptide Sequence Number=SeqID_193189
atggttcaattgatatactcctttggtttgcttataggagtctggttttgtagaagcgtggcaatagaagagaatgaaggagagaaagggaggaacttctggtctctttggttggtctctagcatggtagaaaggtgcatggtgaagaggaagagaatggcttccgggagggatggaggaggagggaagggtaagggataa

SEQ ID NO: 76412 - DNA, 762 bp, Glycine max
  Peptide Sequence Number=SeqID_193190
atgagatggtacaaacatcgtcagaaggtcaacctcgtaagggatcacgaagaagagaaaaaaccattgaagccaccgaaacccactaacaaatctggaatcccaataccaaatggctcacccaaggcagcacctagacaggagtactattatatgtcagcaagatcattggctgggagtggcactccaccctggggaatctacatgagagctgctaaaagtggtccttcagccatcgaatcgatcgatgactcttcttccgatgacgaagcacctcctgcttcctcaaataattctgcatcccaagctatgccaatcccacgttctgttgctggaagttatggaacatttctagcagctgctgttaatttgcctctcaagggtaatgctttgaggcaaggatacataggatatggtggaagaaaacttttgcaggagtacgagaaacatagtacatttggtcaatggctgggatggctcatggctgctatctatataagtggtcgagttcctcaaatatggttgaatattaaaagaagcagtgtggagggcttaaatcctttcatgttcgtcttcgcattggttgctaatgtcacttacgtgggaagtattcttgtaagaaccacagaatgggaaagcatcaaagctaatatgccatggttattggatgccataatatcgcaatacatctactacagatactttcgaaggagagaagcaaaagatgattataaagaagcgggaaaagttgctgcatcttga

SEQ ID NO: 76413 - DNA, 850 bp, Glycine max
  Peptide Sequence Number=SeqID_193191
atgctaggacactctttagtctttacgcttgaagagcagcgaaacgagtctcgagcagatcgtagggagcccacaatgcgtccaaagggcaaggcctgccggcgtcaagcctggcccacggcttccctttgccactccaatgcagcaggctcacgggcccggggtgaaggtctcggcaaagcccgcggaagttatctccgccgagcccgtgctggttccaccggtggtccaccgccgcaattctcccggcgaacaccagcaggaacggcggcactccatccactcctcgatctcggtcgtgtactcgccctcgcgccattgccggaggtcgatcaccattacgcccgtgttgaagtagcacggtggcctccggcggttagcgaggacaagcgacagcgaggggttggaccagaacgagggcgtgaagtacgccgagaagttcgcggagcagtactccggcgcggcgagcaccgccgtgccagagagcggtgtctccgcgagcttcgagatgtcgtcgacgaggatcaagtccgagtcgaggtagacgattttcgcgacgcagggagggaggaggcggatggaggtggagatgaggcgcgaaacggcgtcgtcgtcgaaggggtagatttggaaattcaggtaggggaaggaggtggtgtgttgcagaacggagaggattgcggccatggaacctcggaggtaggaaacgtcgagggtcattgccacgtggacagcgttgtcggggcacgtgtggtttgggttcgggtggtggcggagggtggcgcacgtgggggagttgtagaattttggagcttctttgaaacgctgttgttgggtggtggtggcgctg

SEQ ID NO: 76414 - DNA, 1161 bp, Glycine max
  Peptide Sequence Number=SeqID_193192
atgaatgaagtctttcaagttttggcttcttcaaacgttttatatctctccctctctctcactgtcattacatactcaaatcccacatcgctcaacaccaaaggcgcaatggcaccaccttcattcttcttcgttttctttttcatcttaatattctcatgcaccagcgccaccaccacccaacaacagcgtttcaaagaagctccaaaattctacaactcccccacgtgcgccaccctccgccaccacccgaacccaaaccacacgtgccccgacaacgctgtccacgtggcaatgaccctcgacgtttcctacctccgaggttccatggccgcaatcctctccgttctgcaacacacctcatgccccgaaaatgtgatcttccacttcgtcaccgcagcttctaaatcttcctccgccgcaaagctaaaccaaacgctaaccacctccttcccctacctgaatttccaaatctaccccttcgacgacgacgccgtttcgcgcctcatctccacctccatccgctcagcactggattgccccctcaactacgcaagaagctacctctccaccctcctccctccctgcgtcgcgaaaatcgtctacctcgactcggacttgatcctcgtcgacgacatctcgaagctcgcggagacaccgctctctggcacggcggtgctcgccgcgccggagtactgctccgcgaacttctcggcgtacttcacgccctcgttctggtccaacccctcgctgtcgcttgtcctcgctaaccgccggaggccaccgtgctacttcaacacgggcgtaatggtgatcgacctccggcaatggcgcgagggcgagtacacgaccgagatcgaggagtggatggagctgcagaagaggatgcggatctacgagcttggctcactgccgccgttcctgctggtgttcgccgggagaattgcggcggtggaccaccggtggaaccagcacgggctcggcggagataacttccgcgggctttgccgagaccttcaccccgggcccgtgagcctgctgcattggagtggcaaagggaagccgtgggccaggcttgacgccggcaggccttgccctttggacgcattgtgggctccctacgatctgctcgagactcgtttcgctgctcttcaagcgtaa

SEQ ID NO: 76415 - DNA, 525 bp, Glycine max
  Peptide Sequence Number=SeqID_193193
atggaaatactgacttcacttgtagctacaacattaactaatacgtctaaatcttcgaagattgaaaataccttagcaaggaacccgaattggccaagaatgcgagtgcttacaatatctagcatgatcacgttacgtttcaaaacaaagctagttgacaaacaatgccttgcccatatcccttatcttagggttgcgaggtgtacaaccaagtgcgggacgtttgcgtcttcctactcaacggcttcacgctcccgccggagaaggagctcgtcgtctacatccagtcgctggcatcatcgttcgtcttttgcggcgcggccctccgctttgctaacgttgacgtggccaaggccaaagcccggcaccggtgggacgctgcagctgacggcggacacgcaatctctgtcggttgaatatctggcgtcgttgtcgtcgctcgacatggcggcggagaagcaaatcgaaggactggtgatgaaggttggagaggatctcttcaatttcatgcaatcgttttgttaa

SEQ ID NO: 76416 - DNA, 217 bp, Glycine max
  Peptide Sequence Number=SeqID_193194
tctttggttcaacgatcaagctgctaaaatcatgaaaggagtctttgtgctttcttcaagaattgacaaaccattttgtaagtacgatggtttcactacacgaaagtgtgtagcgaaggtttacatcaatattgtggacttatcattggttgaaagtgtgaggattccatacatgaaaaatttacctccatattacattttggatgcatgtggttcg

SEQ ID NO: 76417 - DNA, 339 bp, Glycine max
  Peptide Sequence Number=SeqID_193195
atggtggactacacaccttcaagctttgatgatatggtcttcaccgatgaaaggatcaaaggtgaggatgaaggagaagcccgtgctgtgactgccattcctatacagccaagtttcccaccaacccaacaatgtcattactcagccaataaccaaccttctccttacccaccgcccagttatccacaaaggccatccctaaaacaaccacaaagtctgtcttccgcacttccaatgacgaacatcacctttagcacaaaccaagagcaccaaccaagaaatgaattttgcagcgagaaagcctgtagaattcaccccaattccagtgtcttatgctga

SEQ ID NO: 76418 - DNA, 1983 bp, Glycine max
  Peptide Sequence Number=SeqID_193196
atgaatctctttcctatgatcacaacaacaatcttcactttgattatgttatgtagcatgtcagtggtggttcatgttcagggaaagcaaccttacgttggtttggccacaacagcatgtggccaaacgggaaattcaaactctatgcgtggctacacttgcaatggcgtgaatcctagttgccaagcttacctcaccttcagggctcaacccctttacaacactgttccctcaatatctgctttgttgggttcagactcatctcaactttctgtggcaaattctgtttctgaggatggaacctttgaaacaaacaagttagtgattgttccaatcaattgctcttgttcaggtaacaacaacaaccagtattatcagttcaacacatcctacgaggttgaaagaggggactcgtattttgtgatcgctaacaacacttttgaaggcctttcaacatgtcaagcattgcaggaccaaaacaacattcccgaaggagacttaatgccgggaaatgaactcattgttcctcttcgatgcgcttgtccctcgaagaatcaaactgagcaaggtgtcaagtacttgttgagttaccttgtggcttctaatcacattgtttggctcattggtgaaagatttggtgtcagcagtgagacaattgttgaagctaatactctttcttctcaacaaccaataattcatccttttaccacacttcttgtacctcttcaagacgagccctcgagtaatcaaacttctgagccatctccaccaccatcaacacctccacctccgcctctatcttcttctagtggaagatcaagcaaaacatgggtgtatgcagtggtaggagttgttggagctattgcattaatatcatcagtcctttgtgccatcgttttcaggacgcgttatctcaagggtggtaataaaaggaaagatgattctttgattgtgtctgatagttttgtggctgtggctattgagaaaccacaagagaagaagttggaagaagaagaatctgaaaatttggcagagatcatatctggcataagtgaatcatttaaggtgtacagatatgaggaactgcaaagtgcaacgaatggttttagtcctagctgctgcatcaaagggtcggtttatcgcggtttcatcaatggggatttggctgcaataaaaaagatagatggtgatgtgtcaaaggagatagagcttttgagcaaagtgaaccattcaaatgttatacgtctttctggggtttgttttaacgggggctattggtatcttgtttatgagtatgctgctaacggatacttgagtgattggatcaacatcaagggaaagtttctgagttggacacaaagaattcaaattgcattggatgttgctacaggacttgactatcttcatagtttcacttctcctcctcatgtacacaaggatctgaagagtggtaacattcttctggatagtgatttcagggcaaagatttcaaactttaggcttgcaaggtcagtggaaagagagggtagtgagggtgatcaatatgtgatgacaaggcatattgttgggacaagaggatacatggctccagagtatttggaaaatggtcttgtgtctacaaagcttgatgtctacgcatttggggttttaatgttggaaatgctcactggaaaagatgttgctgatgtttatgcagaaggaaatattgcgaatttgtttgatgttttaagcgcggtgcttgacgaggaaggtgaacatttgagattgagtgagttcatggatccctctttgaaaggaaattatccaatggaacttgctgtgtttgtggctagaatgatagaaacttgcataaagaaagatccagcaagtcgacctgacatgcacgagattgtgtcatctttgtccaaagccttggattcttcattgagatgggaaacgtctatggaaaggaagtttagattctacaaagggttcctcaattag

SEQ ID NO: 76419 - DNA, 3428 bp, Glycine max
  Peptide Sequence Number=SeqID_193197
ttgttgacacaagtagttcggtacttggatcccttaaccaaggtctgggatttgattcccggcttggacatggagtgacaagaggaggtatcactttaccccaaaaatgggccaatccggatgatttgacggatattgagaaagaagaaattggtcgggcaatagcactctctctttcagaggcagataagaaagggaaaaaagttattggccttatgtttttgcctcacaaaaccccagaggacgactctgaatctgaagatgatgaactgtgtccacttagcgacgaggaagctgaatctgttggtgaagttcagcaagatgaagatgaccatcatgctaaaattcaacaggatgaagacaaacatcttgatgaagttcaacttgaggaagatgaacaacttgccagggcaattcaagaaagtttgagcattagttctcctcctcgatctgagactgattctttatttcaaccttttgcacacttatttccacctgtatacagaatctgttctggctgtaatgctgagattggccatggaagatttttgagttgcatgggaggttattggcatccagaatgcttttgttgccatgcttgcaaacttccaatcactgattatgagattccaccaaattcagctggtctcattgagtatagagcacatcctttctggctacaaaaatattgtccatcgcatgagcgtgatggtactcctcgctgttgtagctgtcaaagattggagtcagtggataccaaatatctgttgcttgacgatggtcgaaagctgtgcctggagtgtcttgactcagctatcatggatactcatgaatgccaacctctctatgtcgaaatacaagagttttatgagggtttacatatgaagatagagcagcaagttccgatgcttttggttgagagacaagcactgaacgaggctatggagggagagaagaatggtcatcatcacttacctgaaaccagaggactttgcttgtccgaagagcaaactgttcccactattttaaggagaccaaggataggagcaggataccagctcatagatatgataaccgagccttttaggctggtccgtcgttgtgaagtgacagccatacttgttttgtatggccttcctaggttattgactggatcaatcctggctcacgaaatgatgcacgcatggcttagacttaaaggctatggcaatctgaggccagaagttgaagagggaatttgccaagtcttggctcatatgtggttagaatcagagattattcctggcactggggatgaaggtgcatcatcatcatcatcatcatcatcatcatcctcatcatcctcatcgccttcgtcttcttcatcatcaaagaagggtaaacgttccgactttgagaagaaactaggtaagtacttcaaacaccagattgagtcagatagctcagcagcttatggagatggattcagagagggtaaccaggctgtggctaagtatggacttagaagaacccttgaccatatccgattgacaggaagtcctacagttaaaaccgtacttctggaggcctccctccctctcttcccggagctccctctctccctcttccttggcggagggagaggagtcgcagtccttgctggcgagagcctcccggacgagagggagctccagggaaggatggctaacaataataatttaaggttccattttctgaatttctcgagcgaacttcgcccagttctagggttccccactgccatgtaccaggccgaattaacctccgaacaggttctgaggagggacatcccatgggagacctacatgtccaccaagctcatctcagggacgagccttcagctcttaaggcgctacgatcaccgaccagaaagtcacagagcacagttgctcgatgatgatggtccctcttatgttcgcgtgtttgttcgtgttttgcgtgacattttcaaggaagatactgtggagtatgttttggcactgatagatgaaatgcttgctgcaaacccgaagagagcaagactgtttcatgatagtgcccttgctgatgaagatacttatgagcctttcctaagttattatctccttcctctgttcgttggcccttcttctcctcctccccagtcaccgttctccaccgtgcgctgctgccggaggcgatttccggcggtgtcgttacctctctttacttctttttcttcttcttccctccacttcctcctcctcctctgtcccaacccttccctctccaaatccaaaccaagatctgacagaaaccaaatcagcaacgacgctctcttcagcatgttctgtgccactcgtaacgccttctccacaccgtggaccccacagcttcaaccacaccgtgtcctgcatgatctgaaaagaaatcactgtgatcggaaggtcaaacgacacgcacaggtgcaactgcaggtcgtggaagcactggtatggaatcctggaccatcagaaagccctactgcgatcaacccatgtggaatcaattcatatggacaacactttgtgcctcgtaatgttcatatcagagaagcatcaaatggaaagaagccatttaccactattgatgatgttttaataggattggtaaaatggctttgtgaacagttgaagaaaccttctcatcctattcgtggagtcccaactgctatcaattgcctagcaacactacttaaggaacctgtggttaggtcttcctttgttcaggctgatggggtcaagttacttgtgcccttgatttcgccagcatccactcaacagtcaattcagccagcaattgaatatttggctacttcaagaacccttccgcgacttattgatgttgtcaggagttctacaaaagagaaggtggttagagttgttgtcttgactcttaagaatttgatgtcaaaagggacattgggtgctcagatggttgaccttcagctggcacaagttgtcctgagtttaaaagcacaagcatggagtgatgaggccctgaattccttggaagaagggcttaaggataatatcaagagactaagttcttttgatatgtacaagcaagaagttctccttggccatctggattggtctcccatgcacaaagatcccatattctggcgagaaaatataaacaactttgaagaaaatgatttccagattctaagggtcctactaacaattttggacacgtccagtgatccaaggactctggctgttgcttgctatgacctttcacagtttatccagcatcattctgctggacggatcattgtgtcagacctcaaggcaaaagaacgagttatgaaactaatgaatcatgaaaatgttgaagttactaaaaatgcactgctctgcatccagcggcttttcttaggtgcaaagtatgcaagcttcttgcaggtttaa

SEQ ID NO: 76420 - DNA, 207 bp, Glycine max
  Peptide Sequence Number=SeqID_193198
atggcgcctcctctcacatcttctcctttatcttccgccatggttcaaaagaaggacctcattgaagctcaaagatccaacctccataaaagcttctcaagcatgtttccatcaagtgatatcagagtacaagagcttcaaaagctagatttgatttcctatggttcaaatttcttgttcttgttcttgaaccatgaattgtgttga

SEQ ID NO: 76421 - DNA, 944 bp, Glycine max
  Peptide Sequence Number=SeqID_193199
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagaagcaatttcagattctgaaaaccagcacattcaagaggcagctcacatatggagcatggctaaacaattgggagctacaggaggagagaagcagaatataatcattaaaaaacttcagtatatagaagaaagggacaaggcagaagcggaaagaaggcgagatagcagaagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76422 - DNA, 339 bp, Glycine max
  Peptide Sequence Number=SeqID_193200
tacattcattgttcttttgaattggataactgctgtactgttgttgtatgcaaagaagatcttttgcaggacttagaggcagtagtaattccagaggaagaacctcaaccttctgaggcatcttctacttttcctattgcagaacattatcatttagatcctattgaagattacatcatggctgaagaaccaagaagagttactctagaagattattcaagttccaataataatttgtttcatggattaccaaatgaagacccatatgcatacttagccaattacatagaaatctgcaatactattaggttggctggagtgcctgaagctgcaatctga

SEQ ID NO: 76423 - DNA, 642 bp, Glycine max
  Peptide Sequence Number=SeqID_193201
atgaaggtcacagctcttaaacaaaccagccacgatatgattgcacacataggtaaagctcaggcagcagtggaagaattgaagaggttccttgtggctgaatcgttggaggaagtgaatagaaagctagataagttctatatggttctcatcttgagaagtttacattcagactttgatcacgttcgtgatcaagtcttagctggagatcaggttccatcgatggattctctcatcactaggctgcttcgtgttccccatgcattgaaagaagaaaatccggctgatgtagtggagacgtcagccatggctgcacctcgtgggagagggggaggacgtaacagtagaggaagccgtggtgggagaggtggacgtcctcaatgcacatattgcaagaggatgggccacacacaagagacttgctactccttgcatggcttccctgacaaagtagctcagcttaaatctgagaaatccagcagccagacttcatcttcctctgtaccatgttattcaacagcatgtatttctcaatctattgatggtctcagtccttggatacttgattcaggtgcctctgatcatatttctggtaacaagtcttcctttacatccatttcttttccacaggggatcctctag

SEQ ID NO: 76424 - DNA, 264 bp, Glycine max
  Peptide Sequence Number=SeqID_193202
atgagtcatgggcgtttatatcagaaacgagtgaagaacgcttttgagaagaacgtacgcacgcgcaggttcagcgaaggggacttggtgctgaagaaagtctcccaagctctgaaagacagaggaaagtgggccccgaactacgaagggcctttcgttgtaaagagggctttctccagaggggccctggtgctcgccaacatggatgacgaggagctaccttcacccgtgaactccgatgttgtcaagcgatactacgcttaa

SEQ ID NO: 76425 - DNA, 552 bp, Glycine max
  Peptide Sequence Number=SeqID_193203
atgaccaccttcggccagggcaagctctcaaaaagcttcaatgtcaagaaaatgctgaacaaactcaaagccatcgcctccacaccatatctcaagatgaaattcccaaacttgatgggagatatcgtaattgtcaagccaagaaagactcaccgcacccctcatgaatgcggcagtcaagtcatgagtgtggatgaaggacccctagtccgaaccctaaccgtctatgaagctagtaggggagatcaaaatgacatattcaatgtagatctgcgtgatgacactgtcggcaaaggctcaaagcctattgaagaacttgccaagctacaactcagatgcaaacttgggcaatgtacgcagctaagtagggaccttcctagccacaagtacaaacacatagccgaagtcctctgcaagaacataaatttgtttgcatggaaattatgtgatatgtgtcgcaacctacccttcggcgggagggcgacgcgtgactcgcgggatgcgtgttccacgaaaggaatacgcgcggagtcgccaccaacgtttatttga

SEQ ID NO: 76426 - DNA, 177 bp, Glycine max
  Peptide Sequence Number=SeqID_193204
atggatgacatggggttgaatcaatttagatttttcaacatggttcatgacatattggtcaaggtgaaactggaagtaacaagaacatcaaccgtcctaaatgtgtttggcagtagacgaagcagtgataggaaaatgcaaggatcacccatgagcgaacatggtgggatcctctag

SEQ ID NO: 76427 - DNA, 177 bp, Glycine max
  Peptide Sequence Number=SeqID_193205
atgtgggagcaagccattggtcagtttgctcaagcgacctgtgcttctgagtttggacttccaagactgttcaataagagattactcctcttgcacgttggtggggagagaagtgagttatcaagaataggatgttggacaaatggcctcagttaccttaagaaaaagaggggttga

SEQ ID NO: 76428 - DNA, 705 bp, Glycine max
  Peptide Sequence Number=SeqID_193206
atgaatgtaggagctcttatctcaggccagatcacatctatggcccagtctaactcctttagacttgggttccctgctcttatcatagctctatgtaggtccagaggggttgcttctcatagcctagtcttcgaacgcttgagcccggtcattaacttggcctatattaggaagaattgttggaaccctgctgatctgataattactattagaggggctaggagagtgagggcaatgccagctgaggctccttccacatctgcagctcctccttctaccccatcttctgcagactttcaatgtcttgaagccatgcttcaaagcatacatcaagggcagattgttttattacaaagtttacagctagtagcacctccaaactctatctcttctattgagcagtttaatgaatggagggaggataagtcatctgagacttccactctagagcccctgatcagaaggaagagggtagttgaaacacaagaagctgtagccactttcgagaaatctcttgaggccatttctgagccttcaaaactagtggcagatacagcttcaattcagcaggcagctgacccctccactcctgaggatcagactacaccggtcctgtctctgaacacctctcctccagctacccctgtgcttcacttaacaaatgaggaggatgttcagacacaggatactcaggacatatcatag

SEQ ID NO: 76429 - DNA, 645 bp, Glycine max
  Peptide Sequence Number=SeqID_193207
atgaatatggaaagggaagggaataaaatgaagagcactaggagagaaatggagaagaagtcagagataggtttagtcattgaagagctttctatgatagccatagttaaacctggtgaaaatcatgactctgctcacatccccaccaagcttttcctctcgatttgttacttggttctacaagttcttgataagattgggccaacaatggctgtcttgagacaggacgtgtaccagaatattaagacattggaactgatgcaggaatcaaatccctcattgcactcgaatttggttgagatattgaagtcagaagcaaccgaaggcaattcttggaaagggtcaagctgcagtaaggcccttgtttggctcactaggaccctggatttcacctcgctgttgttacaaacactagcaaatgatcctgaaaagagaatggaacaaatagttgaagaggcttatgatgtggctctaaaactggtacctgaaagtaaaacattcgtgaatattcttaaaactgaagatgaaaactatgacaccctaaaggagaaaatgcagatgctggtttctctgtttgtgccttttcttgaggatatgcattgtattctgagattgtacaacttggacaagctaaagtcaacctga

SEQ ID NO: 76430 - DNA, 222 bp, Glycine max
  Peptide Sequence Number=SeqID_193208
atgtggatggtctacaaggttcataactatactcctcttactataggatgcttaccaagtcaacatttagatccaactatgcctaaatttttctggtttactgtaatatttcccacttgtttgattgttgctgagccatttttggatgcgaaacggacctccccagaagataaatatagatcacacaatgaagtaccaccaaatgggtatataggaatctaa

SEQ ID NO: 76431 - DNA, 141 bp, Glycine max
  Peptide Sequence Number=SeqID_193209
atggatacctcaaagccctacactggggcaatgaggggcaccgtgcatgaacctcaagttccctgctacaaggtcatgacgaaagacaacgattggtacctcaaagccctacactggggcaatgaggggcaccgtgcatga

SEQ ID NO: 76432 - DNA, 453 bp, Glycine max
  Peptide Sequence Number=SeqID_193210
atgttggtcatcatcagcaagtataaagaagaattagatttggccaccgcccatgagcacaaggtggcggacgaatacgcccaggtgaaagacgccataactaagcgcgccccgaggcatccctatcgcaccagatccaagtctaggatgatgggtgacctagaggaagtacaggaacagatgaaagttgacatgtcggctttgaaagaacaaatggcttctatgatggaagtcatgttgggaatgaaacaactaatggagagtaacgcgaccaccgctgccgccgctagcacggctgccgaggcagacccaattctcctgattgctatgcaccatcccgttccaaacattgtgggacgagggagaaacacatcgggcatgtcaacgacccccatctggggtacaaccgaggtgcttacccctacggtttaccacccaactacacaccactga

SEQ ID NO: 76433 - DNA, 441 bp, Glycine max
  Peptide Sequence Number=SeqID_193211
atgtctagggtttctagagagagaaaggtccaagttccagagagttttgagagattttgctatgcgaagatttgcagagaccagagcttgaagcaggagccgatgcatgctttgttagggtcattcaatagtggaaactggtctgactctaaagtccttgatagtgcagggctaagttttcgtgctttcacgaggaatcgggtattgtatatggatagatctcccacaggcaatttagttcctctggacctagaaattgaagctacattgcgaaggaacagggccgagaggataaggaaacttctgcaagacagaacagttgcatccattcttgaggaggagactcatttctctgacttattatcacctgattcaccatcatcaagggaatccaccactcaattacctaaagccattaccatggcaaaagagcatgactag

SEQ ID NO: 76434 - DNA, 699 bp, Glycine max
  Peptide Sequence Number=SeqID_193212
ggctttgacggcataatgatcggccatccgcagcatgcctaccatctggagttcacgcagcatcgcggggtgcgggtcgggcaggcgccgacgcaggatcatctgctggtgttttatctgcctgatgagaacgcatggcgagccgcgtgcgagcggatgcgggcggcaggattcctggtggtcaccgcttataacccctattgggatagggcggggcaaacctttgaagatcctgacggctaccgggggtatccgtcaggcgctggtcgccggtttctgcgcgctcttggtctggcgagcgaacagatccggcagcatatccagttggtcggccttgacgtgaccgccgatcagaccggccgccaggttgcccagcgcgctggcgcagaaccacagccccatcatttgcccgcgcattctctccggcgccagcagcgtcatggtggccaggccgatcgggctcaggcacagctcacccagcgtcagcatcaggatactgcccaccagccacatcggcgatacgccggcgccgccgttgctcagcacattctgcgcggccagcatcatcaggccgaaaccgccggcggcgcacaggataccgatcacgaacttggtaatgctgctcgggcgcacgttattgcgcgccagtgcaggccaggcccagctgaacaccggcgccagcaggatgatgaacagggc

SEQ ID NO: 76435 - DNA, 375 bp, Glycine max
  Peptide Sequence Number=SeqID_193213
atggctgaagagccaagaagagttactctggaagattattcaagttctaatgtgccacaatttttcaccagcattgataagttatggttgcatgatgtaccatctgtgggggagctcatgaatctggatgttgtattcctattgaagaacaccccactcatgaagtcaattacacgggaaatcagcccaaaaacaattttaatgcaagaggattttcaggattccaacatggctagcaatataatcaacaacagggacaatggaggaaccaccctggaaattagttcaatagagatcaaggtggaccatccacaaggccacaacaacaagggcctagtctctatgatcgcacaacgaagcttgaagatactctag

SEQ ID NO: 76436 - DNA, 234 bp, Glycine max
  Peptide Sequence Number=SeqID_193214
atgtctcctaattcaagtacaaggaagaatgtcacgtcaaactgtctttgttattattgtagaagagctaccattcgaacaacaaggacggcaaagaataatggaagactgatttatgtttgtccattacgacaaattgaacatgggtattttgtgttgtgcaacaagatgcagatcgatgtaatttcttttcgtgggttgatgaagacattgatgttggtgcaactgaaataa

SEQ ID NO: 76437 - DNA, 414 bp, Glycine max
  Peptide Sequence Number=SeqID_193215
cttggagggattgatgggaacccggtgttgagaggaacgaggataagggctacgtgggagtacgtgagctcagttgaaggtgggcaactggggatggtggatttatgtgtgatttgtggatgtggagagtcgacttgcaccatcgcccgatcgccacctagtaccacatatgacggagtggtacctggagatatgtcgcgggggtcaggagaccttggggacgtcaggcgagctcctggcagtcaaccgataaaagaacaaagaccacaaagcaaggaggcttgtgtggtggttggccagctatggatcttgagtgatatttggaatatggcctctggtaatcgattaccaagggaagttgagatggcctctggtaatcgattaccaaggggggtaatcgattaccatgcttag

SEQ ID NO: 76438 - DNA, 156 bp, Glycine max
  Peptide Sequence Number=SeqID_193216
atggattggacgcatgaacttgaggatgatgaaggccatgagagcatcatccacagaagatggttcaaggaaaatttgtcccaaatttgggggagttattatgaaggtataaaagctaagtgcctaagaaaaagggcaagtatggggaaggaatga

SEQ ID NO: 76439 - DNA, 474 bp, Glycine max
  Peptide Sequence Number=SeqID_193217
atgaagcttttgtgggcatacagaacagcatacaaatcccccacaggacttactcctttccagttggtctatggaaaatctggtcacctacctattgagttggaacataaagctttttgggcattaaagtttctgaacttcaactcaaatacaattggtaaacataggaagctccaactccatgaattggaggaactgagggttcaagcttatgagaattccaagctttataagcaaaaagtaaaaatctatcatgacaaaaagctatcaaaaaggaattttcagcctgatcaacagctgaaatccaagtggtctagaccattcatcaccaaagaagttatgccacatggagcaatgatatcggaggacccaaccaccaaaaagacatggaccgtgaatggcagtagaatcaaacactacctaggtggagatttcgagaagataatcattgttgtccagctgcaagaggcttga

SEQ ID NO: 76440 - DNA, 258 bp, Glycine max
  Peptide Sequence Number=SeqID_193218
atgttctacggagtacctgtcacctccagcaagggcatcaggccccctactaatcgagctttcatcaagaagtactgtgtctccaggcaggtgcagggcgaaacaccacaacagcctggggatggccgacagcgggcaacagacgcaccgccatcacctctagagttcatctcagctcatccacaaaaagctcaagacgttaaagaagcgctactaggaggcaacctagtaccttttaaatctctgcttgttatttga

SEQ ID NO: 76441 - DNA, 219 bp, Glycine max
  Peptide Sequence Number=SeqID_193219
atggttctcatgtactatgcaagtcatcaattgacagaaaagagtgatgtgtacagttttggagttgttctactagaattgatttctggaaaaaagcctttgtcatctgaagattatggtaacgaaatgaacattgttcatttggtggtcatgatcgagcttagcaaaactactagaaacgttggtggcagagtagcttgtggtaagtattttacctaa

SEQ ID NO: 76442 - DNA, 237 bp, Glycine max
  Peptide Sequence Number=SeqID_193220
atggggagagttaacttagggttaaatgtgagaatggtagtgatgaaagcttggacagagcaaatgagaaaagggaatgacaagtgtgaaagaaaagagccatttctaggaaaatgcttgtgcattgctagtcatgggaagagtagtacatttcgggtttcaggcatttctagcagatcccaacggtcaaaatgtagatttatgtaccaggaacctccagtaaaattttcaaggtga

SEQ ID NO: 76443 - DNA, 192 bp, Glycine max
  Peptide Sequence Number=SeqID_193221
atgttaccatcgtcatcatcgttaatgtgcaacatcagccatggcgaaagcaatgaatgttgtagctatcatggtagtaacaacaacaacaactactatggtgacaacaacaacaatgacaatcacagtggtgaccgtaatgattgcagcgatggtcatagtggtgaagatgagttaattgagatattttag

SEQ ID NO: 76444 - DNA, 1461 bp, Glycine max
  Peptide Sequence Number=SeqID_193222
atggaggttgaggtttgcatgaacgtttcgtgcaagaatggctatgcgagagaatggaagaaggggtggcctctgcgatcgggtggattcgctagactctgccacaagtgcggtgctggcaaaggaaaccttatgctgttgcgtagagatgttgaagctagtgaatccatccgttggcctcgagcagagagagatggcatagattcatgtattggtccaaacaggcaagaggatagaagattttcaaatgtggtgaaactgtctggtcattcattaaattttacaacattggatcataacagaccaacatgggagacacaaactatgcacaaatcaagttcactgaatatgtctcttggaacctcatcaggaaattctgtccagccttctgctttggacattgcagaaaggagacttgaggataaagcatccttttgtccctttcctcaagggcaaagatctctctccatatctaaatcattgatggatgggataaccatgaatctggaagatagcaaaggtgtgatttctcaggaacgcgttgcccggccacctgctaatgggaaacccaagaatctgttacattttcgatactggcctaggattacaggtcaagagctggagaaattgtcgggagatttgaagtctactatagtgccattgtttgagaaggtattgagtgccagtgatgcaggtcgaattggtcgacttgttctcccaaaatcttgtgctgaggcttactttcctcctatttcacagtcagaaggtcttcctttgcagttcaaagatgtgaagggaaatgactggacatttcagttcagattttggcctaataacaatagtaggatgtatgtattggagggagtaaccccttgcatacaggccatgcaattaaatgctggtgatattgtaacatttagtcggatagatcctggaggcaaatttgtcatgggttacagaagggcatcagattctatggatacacaagttgatgcctctacttttgctcactccaatggttttgcaacaaaggaagcaaccttttctggtgcaactgcaaatctgcactcaggaaaaagttatcctgatcttctccagacaaggaatggaaatggcgaaccttacttaaatggatgttcagaacatttgcgttttggtactggaactgctgattgtctacaaactgaaaattgtgagatggtaaacaatgatttgctgcagcaaacaatttcagtttctgagaagactctaaatattgcaccaaagagtaagaggttgctgacacataatgaagatgctgtggagttgagaattacatgggaagaagcacaagacttgcttcatccaccacctagtaccatgccaagtgttgaaacaattgaggacaaagaatttgaggaatttgaggaacccccggtttttggaaaggggactacaatcaatgaccccccatctgggtaa

SEQ ID NO: 76445 - DNA, 174 bp, Glycine max
  Peptide Sequence Number=SeqID_193223
atggttatgacggcagcgataattgttgcagcaatcatggtgatgctggtcatattggtggtggcatgtgtaaatgatcaaggcgacgacaacaacaatgacaatcatggtggtggttgtaatggtagtagtgatggtcatagtgatcatgatgggttaattgagatattttaa

SEQ ID NO: 76446 - DNA, 321 bp, Glycine max
  Peptide Sequence Number=SeqID_193224
atgaggttaggaaggagtgcagagtgtagaaagaacaagggtttctttttgagtttcgttgatggtgggtttcatatcacaatttgggttgtgcccttcagatcgtctcgcagcagatccaacactagtcttggtggctcggtcccgtcaacctcatgtagcggaccgccttgtcgaatatccgtcgtaggatcttctgcctcctccgccccacaaaccttcgtcgtagtcacactagcatctcgtcacactcgcacaaccatctccttgcacgtaagttcacgtgggcttggatttggagttcacgttcgacttccttga

SEQ ID NO: 76447 - DNA, 471 bp, Glycine max
  Peptide Sequence Number=SeqID_193225
atggcttttcaggtctttgagctctgcatcagagaaaatgagttcaatggacttagaaaatattccagtaaccagcaaagatttcaaagttgtatggcttctacatattctaaaaagcgaagaattatggaaaaacttgattcatcagctggtgccacaaccaagcatccaaggcactgttctggatgcacttgcattctgtgcattcagcccccaagtggaaaaggaagacataagccaacatgcacgaccgtgaggcgccaattcaagacccttatgaagcgtaagaagcaacgcgaatcagatgctactcaaaatgatcagattcatcacagtgatgagggagatacccatggtgcatcaagagagggtgcaattgcaagtaacttggagaatgagggaagcctcaacagaatggatgaactcggtacaggacaaatagaccttaatagtcatccggatcatgaataa

SEQ ID NO: 76448 - DNA, 320 bp, Glycine max
  Peptide Sequence Number=SeqID_193226
gcttcttactccaacgaggatcattcacttaccatcatcagaagatgaattccaaaccacccttcgtgcctccaagaagcattttgagaagatcaacgtcaaacactaacgcctcaaggtggacaaaatattttagcttaaaagggaggtccactttagggttgtgcaatagtgaagatgtcattctattactcacactactattgagcatggatgggagtaaggctaaaatgattaacaatcagagaggtagattggagttgttcattaggcaatggaaatttcgtgtgtcttgcattcatcgaaagaggaaactttaa

SEQ ID NO: 76449 - DNA, 312 bp, Glycine max
  Peptide Sequence Number=SeqID_193227
atgagggcgagccctggtgcagcggtaaagttgtgccttggtgacttgttggtcatgggttcgaatccggaaacagcctctttgcatatgcaaagttacgaaaatgatgttacctccatggagaattatgcaatgaagttgcagaatcaagatgtgacaaaagcaaacctcaatgagttctggggagagggagcaaaggagagacagatccaaatccacaccgccattgagataccaaacattgtctgcaattattgttccatcttgtgttgcaacagacatcagatcaacgcaaaaacaaacacactctaa

SEQ ID NO: 76450 - DNA, 255 bp, Glycine max
  Peptide Sequence Number=SeqID_193228
atgaaacatgattcacggaaaaggaaaggttaccttgatggaatgaggacacatctggccccattacaagccataaaaacccttagtgatccaccgaagatgcaaagaggccagtcaaaggatcaaggaattgaagtcatggagagtgttggaatgcttggaacttacttgagaaaaattttgcttaagaatggaataattttatttgcttggggacaagcaaagtttaatttgggggattttgataactgctaa

SEQ ID NO: 76451 - DNA, 1346 bp, Glycine max
  Peptide Sequence Number=SeqID_193229
tagatgttttgatgaatttgtaagagaaattcaagactcccttggactcattggagagttacttgacctggtaacagacgtgttggggggattttctatcgccactgatttggtggatgagatctcggagcaggacgtggatgtgaccaatgacattctcgtcgatggcaagcttagtgcactcagaataaagaacaacgttgggggtcaaggtggttcgatggctagactaaacgaaccaatgttgtatgacaagattcagggatcatacatcttagagaaagattgggagattaagttgcactacctagggaaagtttggtttctgctgatgggcttggagtgggaagtggttgaaaagaaggtcatggatggaaagaaagaaatcttgaagattattttaggaacttgggctctcagtttggaagctttgtcgtggtggacacaaagacctcaaactttagaagattggactgtgcgagagtcctccaaaggacttctactagaaataatctctgaaaggaaaaggatctcaatcaatagcaacatttatgatggtagagttattaaggaaatgccatatccaattgttggcacacaaggaattattttccagagcaacatgggtcatcttttgaaagtgatggagaatggagggaggaaaactttagaagattggactatgcgagagtcctccaaaggacttctactagaaataatccctgaaaggaaaaggatctcaatcaatagcaacgtttatgatggactaggggctctttccttgaactccaaatgctccttagatgctatgagcttctacaatggtgaggaagaggagggaggctatgtcccaggtttcaaaggtagaggtgccgacgaaatgaaagacaaaaccagggaagtcgaaaaaggtgtgggggttggtagcaaaaaagtggtggtaggtaatgagttgggtcctagatatgggccaacctgcgaggtccaatctgaggctggatgcttaacatacaattcttttgggtcgctaatgcctaagaagaaatgggatttgaatcagtcccactcccacgagcttcctcttcttgtctcctttgtaatgagtgattctattctgcgagggagcaaccccaatattcatcgacgtcgtaactgcaaaactccggtgactccacgtgaagggagtgagggtatagtggctgagtcagtaagcgaaagaaaaggggaagcatcaacaaacactactggtgggaaagatagccaaagagttagagctactagagaatcgagtaaaggcaaaggaacaaaactttggtctttattgggaacgaataggtggcaagatg

SEQ ID NO: 76452 - DNA, 412 bp, Glycine max
  Peptide Sequence Number=SeqID_193230
atgtctaacacagtagtgaatatctatgatgtccttatagctagaatgcaatcctttgctgtgaaggatgaggtattctgcttgtttgagggagcccttgacaatttgggcaacttgagacaacaatatggattggccaagtcaaccaatgaagtattgttggtcattgaggcttacaaagcattgcgtgacagagcaccctaccctgctaatcacgttgttggccatctcagtgggagctttgctttcatagtttttgacaaatctacttctaccctctttgtggcctctgatcaatatggtaaggtacctctatattggggaattactgctgatggctacgtagcatttgccgatgatgcagaattgcttaaaggtgcttgtggcaagtcacttgcttctttccctcaag

SEQ ID NO: 76453 - DNA, 3062 bp, Glycine max
  Peptide Sequence Number=SeqID_193231
tgagtgctgcttactcttttgatggaactctcactcttgtggtattaccagtagagcttacacaattgccacgccttgagaaactctatcttgataataacaggctaactgttttgccacctgagcttggtgagctaagaagcttaaaagtgctcaggattgacaacaacatgcttgtctcggtgcctgcggaactgagacagtgtatgcagttggtggagttgtcattggaacataacaagcttgttaggccacttcttgacttcagggctatggctgaattacgggttcttaggctatttggaaatcctcttgagtttcttcctgaaattttgcccctccacaaacttcgacacctttctcttgcaaatattaggattgtggcagatgaaaatttgagatcagtgaatgtgcaaatagagatggaaaacagttcttatttcggtgcatctaggcataaactaagtgctgtcttctctcttatattccgcttttcttcttgtcatcaccctttactagcatctgcacttggaaagataatgcaagaccaaggaaatagagtgtttgtaggtaaagacgagaatgcagtgcgacagcttataagcatgataagtagtgacaactgccacgtggttgaacaagcctgctctgctctttcatcccttgcctctgatgattccgtggcattgcatctgatgaaagcggacatcatgcaaccaattggaacagttctaaaatctgcaggtctggaagaggtacaaaggctagctctgttagctgttgggaatttggccttcagtctggaaaatcgccgcatacttgtttcttctgaaagcttacgagaacttctcttacgtctggctgttgcaactgagccacgtgtttataaagctgcagctcgtgctttggcaattcttggagaaaatgaaaacctgaggcgtgcaataaaaggaagacaagtgggaaagcaaggacttcgcatactctcaatggatggaggaggaatgaaaggtctagcaactgtacaaatgctaaaggaaattgaaaaaggaactggaaaacgaatacatgagttgtttgatttaatatgcggcacatcaacgggaggaatgctagctgttgcacttgggattaagttaatgactttggaagaatgtgaagatatatacaaaaatcttgataaactgatcaaacacttggaatcagggaagcttgtttttgctgatcctgttcccaaggacaacgaagctgctacttggagagaaaaattagatcaactttataaaagttcatcacagagttttagggttgttgttcatggatcaaaacatagtgcagaacagttcgaaaggctattgaaggaaatgtgtgctgatgaagatggagatctaatgatagattctgctgtgaaaaatgtgcccaaagtttttgttgtatcaactttggtgagcatgatgcctgcacaaccattcgtatttcgcaattatcagtaccctgctggaacacctgaggtggctcttgttgcaacatcagatagctccgggatcaatgtattagcttcacctataggtgaacaggttggctataagcgtagtgctttcattggaagctgtaagcatcaagtatggaaggctatcagagcatcatctgctgctccttattatcttgatgatttctcggatgatgtcaaccgctggcaagatggtgcaatagtggctaacaatcctacaatttttgccataagagaagcacaacttctgtggcctgatacaaaaattgactgtctggtttcagtaggatgtggttctgttcgaactagggtacgaaaaggaggttggcggtatctggacacggggcaggtgttgattgagagttcatgctctgttgatcgggtggaggaagctttaagtacattgctacccatgcttcctgagatacaatattttcgtttcaatccagttgatgaacgctgtgatatggaacttgatgagacagatccaactaactggctaaagttggaatctgcgattgaagaatatatacaaaagaatcatcacgcatttgaaaatgtgtgtgaaagattgcttcttcctttccagcatgaggagaagtggtcagaaaatctgagatctaaattacccaagacagaggaatcacttaagggtgccgatggccccaccttagggtggaggcgtaatgtactacttgttgaagcttcacataatccagattctggaagagtgatccaccatgcccgggaacttgagtcattttgtgctcgtaatggcatacgtttatccctaatgcagggtttgtctgggattgtaaagacagtgccatcaacaacattcccaactccatttcaatcacctctgtttacaggaagctttccttcgagtccctgcatgtttagccctgatcttggtcagaggattggacgaattgatctggtcccacctttaagtttagatggtcaattagggaaagcaattgcatcgcctccaatgtctcctcgaggacttagacagctctctttgcccgtcaaatcattgcatgagaaattgcagaattcaccgcaagtgggtgttatacatttggctcttcaaaataactcagatggcttaattgttagttatttttgcccgtgtggatggaagcctgatgctattgtccttttatttagttggcacaatgatgtatttgttgtggctgaacctggagagctcgctgagaaatttctacaaaatgttaaattcagtttgttgtcaacaatgaggagccatcgcagaaagggcgcatctctcctggccaatatttctactatttctgatttagttgcctttaaaccttatttccaaattggaggcattgtccaccgttatctaggccgtcaaacccttgttatggaagatgatcaagaaattgcttcatatatgtttcgtaggactgtcccttctatgcacttatcccctgaggatgtacgatggatgggattcttttatctggttgtgtatagggatgatgccttgtataggagaataatgcattggggacagaactag

SEQ ID NO: 76454 - DNA, 237 bp, Glycine max
  Peptide Sequence Number=SeqID_193232
atggtggtggtgacgatgattgatgtggttattgtggcgactgaaacaatgagtaagggttttcgggagagtaatataaatgctggtggaggtcttccatgggaggtgaagactattgcaatggggaccactatggcaacgacagcatgtgtgatcgaggccgtactcgaatcaaataaacatttaaaaacgcagtatctaggaagtgatcctaggtcgtctcccaacgagcaatag

SEQ ID NO: 76455 - DNA, 1050 bp, Glycine max
  Peptide Sequence Number=SeqID_193233
atgatgcaggctggacccggcggcatggcccaacaagcgaaccagcaatacgcacagcaacagcaacaacaacaacaacaagcctacatgatgatgccgccgcagcctcagccccctcagatgtgggccccatcggcccagcctccgtcccaatcggtagctcctccgcaacccaccagcgccgatgaggtccgtaccctctggatcggcgatttgcagtactggatggacgaaaattatctctatacctgtttcgcacacaccggcgagctggcttcagttaaagtcattaggaacaaacaaactagtcaatcggagggatatgggtttattgagtttactagtcgagctggtgccgagagagtccttcaaacatacaatggcaccattatgccgaatggcgggcagaacttcagattgaactgggcaacttttagtgcaggtgagaggcgtcatgatgacagcccggatcacaccatatttgttggagacctggctgcagatgttacggattatcttctgcaagagacatttcgggcacgatatccttcagctaagggggccaaagttgtaattgataggttaactggacggacaaagggctatggttttgttaggtttggagatgagagtgaacagatttttgttgggaatttggatcctaacgtcacggatgatcatctgagacaagtttttgggcagtatggggagttagttcatgtgaagattccagctggcaagagatgtggatttgtccaatttgcggacaggagctgtgcagaagaggcactgcgggttttgaatggcacacttttaggcggacaaaatgttcggctttcatggggccgaagtccttcaaacaaacaggctcaaccagatgcaaaccagtggaatggtagtggtggtggtggatactatggatatgcgcaggggggctatgaaaattacggttatgcccctgctggacaggatcccaatatgtatggcagttatcctggctatgcaaattaccaaccaccccagcaaccgcagcaaataggatatagctaa

SEQ ID NO: 76456 - DNA, 3378 bp, Glycine max
  Peptide Sequence Number=SeqID_193234
atggattgcaacgaggctccctctccttctccctctctccattcttcgtcgcttctgaaggacatttccaacttcacaacccccagacgcccccctttctctctcaccgccgccaaatctcccgccacccaattcttcaccgcctccaaacacggcacctcctccttccaccgccgccccaacaaatcatccaccgccgcctccaagaaactcaaggccttccaattggagcagttccagtcctcccgcaaggctcaaatcaagaaggaacactccctcaaatccctctccaagtccctctccgtctggctcaacttcctcctccaaaaccctacctcctgcggctgccacctctcagcctccaatgccgcccccgctcccgccaccaacggcaagcgacacggcgctccgggaacctctgttgtcggcgtcgattccacttggcgaactcccaagcgccagaggaagacctggtccactaagaaaagtgccgccactgcagcggaggttcctgattcctcgttttcgcaactcagtgattctctcaaggacgtgtgcagtttcgacgatttgaagcagcgaatgagggtttatctcagcctcgcagcatgtaaagagatcttccatcaaatgaatcgcgtcaccaagactattgacgaaggaaggctcaatatgaaggcgcattgccctatagtaactgatgtaggcttgaagactaaggccacgagaattctcatgtgttataatcctatttggctgcggattggattgtatataatttttggtggtgactccttggtgttgaatggtgatgttgattctgatcaggatgttgtgttcttgaaaatggtcattgacaagctatttttttcacatgagggtttagctaaagagtatgcttataataagatggttgaaagtgtatataggtcgggttactatgagaatttggggaatgtgattttgaagagaattttgttacttgtgcttgtcctggataaagctaaatgccagagttacctcccactggagtacggtattgatgggttggatggggaatttctatcgtctgatgtaatgcatggagaaggcaatcttctaacacatttggtgattttaggttacaaattatctcatcaacaggaacctattgttgagtatgattttagggtcagagatttatttgtagatctccaagatggattgaaattgtgtagagcaattcagctcttgcagcatgattcttcaatcctcatgaaaatcgtagttccctctgatactccaaagaaaaaattggcaaactgtggtcttgtcctacaatatattaggcattctggtgggtcactacttgatgaagatggcatcatgattgtggcagaggatattgttaatggagacaaagaacttacactttccttgctgtggaatatgtttgttcatttgcagctacctcttttggttgataaaacaagtctagttggggaaatttcaaaaattcgaggatttgacacggatctcataaacaatgcaaattctagttctatggaattgcttttgaattggattcaggcagtttgtgacaattatgattgtgcaattgacaattttcattcccttgttgatggcaaagctatctggtgcctacttgattattacttccagaaagaacttcataattcctgttcattgaaggaagttaataagaaaagtggcaaggcatcaattatgtcggtgaatgaatattcagatgcactatataattttatattatcccaaaagttgactacattactggggaacttcccagaggtgcttcaaattagtgagctacttcaacataatggtgcttgcagtgatcgaagtgtggtgattttgttggttttcctagcaaaccaattatttgttaagaaaaatttggatcacttaaatttccataagctcttgggttatgactgccaaagtccaaaccatagacatttgaggttgctgcgatgcctttcaaattctgaatcaatacaaaagcctgatgcttctgatgtgcatggaaatgaagatggtgcgagaaaattcaaggctatccaagcttggtggcaagatatggctgaaagaaactgtatcaacaaacctgctgtctctaatttgcagagatccagtaccactgaatgcagcaccaacattagaagagaaaatgctgcaagaacaatacaactgcatttcagaggattggttgcacggcgcaagtttctgaagatgataaatgctgttacctttttgcaaactggtttcagagcttggctacaagtgaggcaagggtcagtctgcatgatgttatcaactgttcaagtctgtgactcttcatgtgaaatattgaagcaatcagaaacatataagagatatgccatgcttttcattcatagacattcatttttgaggttgaagaggtcagcacagcttatccagcaagcagttaggagttggctctatcggaggcatcagcaagaatgtagtacaagtcctgatctcatgatttcagatatggtggcagctactattactgttcagaaatttgtccgtggttggctggcacgatctagatatattcatcagctagatcagaaagagaaatctttaaattgttcccaacagaaagtcacttttgatcttcaaacaaatgcagcaattatcattcagcttgcatggaaaaggttcatatgctgcaaatctactcagaagcaacacctgcttgcaactaaaattcaacgaaatttccgtaggtggttgttgagaaaaagtttttcaaatcaaattcaagctgtcatcaaaattcaatcttattttcgaaggtggagatgtgtaaatgcttttcagcacttcaaaattgagtataaggcagctgttgtcattcaatctttcttacggggatggtttgcacgaaagaatgcttgtgcgcatagtaatcacctctttgctactaaaattcaacgaaatttccgtatgtggttgttgagaaaaagttttttgaatcagattcaagctgtcataaaaattcaatcgtactttcgaatgtggagatgtgcgatggcttttaagcacttcaaaatcgagtttaaggcaactattgttattcaatctttcttacggggctggtttgcacgaaaggatacttgtgcgcgtagaaatcacattgttgaaattcaagcattgtcgtggttggctagtgaagcgggacttcttgttccaaagagatgctgcagtaaagatccagtgtgctattcgaagcttgaagtgtcagaaggctctcaattgcctgaaagatgctgctttggagattcaatgctttataagggggcatttaactcggaatcagctattaggtag

SEQ ID NO: 76457 - DNA, 369 bp, Glycine max
  Peptide Sequence Number=SeqID_193235
atggagtgggacggcgaggactggagtgatttgacgtccaagaagacaagatcaagaaaggtgtttgacgaagctcatggtcatggtcatgggttgagactagggaaagtgcaaaaggagaaactaatgggatcgctaagagcttctcctgatgccaatgggaaggtgaagataaagatttcaaagaaagagtttgaagaattgttgttgaagcaagaaaaacatgttaataacaagaagcaactagggagagcttctgcagaacaagttctgctgcgcttaataaacgccagagataatgatgctcgtcacagattctggacgcccgtgctagagagtattcctgagctagaccaccgtgttaaataa

SEQ ID NO: 76458 - DNA, 1314 bp, Glycine max
  Peptide Sequence Number=SeqID_193236
atgaaccagcagaatcaaggatcaggccctccattgaatgttccaatgaaacgaaaacgtggccgaccacgaaaagaagaaagtgtagttcaaggggcgaatgtgcctgtaatgcctggttctaacaatgtgttgaactccaaccaaacagcaggtacaacaactgtttgtgatgatgaaatggtggggaaggtagtcactggtgtcattgatggcacttttaatgctggatatcttcttagtgttaaggtggcagacactgatgctttcttaagaggccttgtgtttgtagaagaccaagtttctccagttaatgtagaaaatgatgtggctccacatgtcaaaatgattgaaaggaaagaaattccaattccagttgttaacccacaggcagagatacatggttctgttccctcatcagtgcaatgcaacaagcaatcttttgagccagaattacagcaggtgcctatgtctgaagagcaagtgctaccaactgagatccattctggcatctcgggtttacttgagaatcaatcttcctctactttgatacccaattccatttccagtgaaggaattccacaggggatacaagagcccgggcatgtgaatcagtctacctctatcttgtcagagttggatcatgacaaaactgttaaacaaggggaaacattgcatgaacttgatgcttccacacaggtaaaagaatctagtgctgatggaggagaaacaaaagtctcggaagcagtatctgaactcatcaacctagttccaccaattgaaaacaccaatatggagctcggaacaggacagcagactctgccttatgtgcagcagctgaatgaaccaaatatatcaaatattgaattcaacctgatccctgtatctgctgaacctgaagccttgtcatgtgagcagactactaaaactgttaattactttgtggagaagcaggagttgccaaaaactgatgtgctagaagatacaaagacaaagcttgctattgagacttcaagcaatgttgacacctcaaactcaaacggaaaaccaagtactgatgttgttagcattcctgttgtgggatcaaaccatagacttgacaccagccagcctgaatccatgccatctgaacaggttggtaaatctgttccttctgagtccaagttctcatctgaaggacatgatttgtgggggaagagagatccccagaactgtagctcttttggtgacatcaataaggtggatttcaatcaacctactgaatctttagccaagtcaatagaatctgagaaacagattggatcagacacttga

SEQ ID NO: 76459 - DNA, 543 bp, Glycine max
  Peptide Sequence Number=SeqID_193237
atggatatgtttaagcagaatcagaagaagaaaaacactggccggaaaaagattgagatcaagaagcttgaaaaggctagcaacaagcaagtgacgttctcaaaaagaagaacaggactattcaaaaaagccagtgaactctgcattttatgcaatgcttatgtagccataattgtgttttctcctgctgacaaattgttctgctttggccatccagacatcgactccataattggtcgctatctcaaaggagacaacaacgcagagtttgaaccagcagcaaagtcatcaaaagaaaaatcagtgtcatatgaggagtgtaacagacagtacgaagcggccacaaagaagttggagttggaaaagaagaacttggcacaaactgagattttggctaagggttggaacagaaggtggtggaacgatcccattgatcagatgagtgagcaacagttggagcagtttatgatgtccatttacgagttaaggaaaaaactgacagaaagaacaggtgaattgatgatgcttgggaccatgacgtag

SEQ ID NO: 76460 - DNA, 342 bp, Glycine max
  Peptide Sequence Number=SeqID_193238
atggcgtgggacggggaggactggagcgatttgacgtcgtccaagaagacgacctcaagtcatggtcatgggttgagtttagggaaagtgcagaaggagaagcttatgggagcgctaagagcttctcctgatgccaatgggaaggtgaagataaagatttcaaagaaagagttggcagaattgttagagaagcaacaacagaaacaggttaataagaagcaagtagggcgagcttctgcggaacaagttttgctttgcttaataaaagccagagatgatgatgctcgtcacagattatggaggcccgagctagagagtattcctgagctaggttatagttga

SEQ ID NO: 76461 - DNA, 399 bp, Glycine max
  Peptide Sequence Number=SeqID_193239
atgggaaactgttgcaaggcagcatcatcaatggagtgggatggcgaggactggagtgatttggcgacgtccaagaagaccagcttgaggaaggtgtttgacgaagctcatgctcatgttcatcatggtcatgggttgagtttaggaaatgtgcagaaggagaagctcatgagatcgctaagagcttttcctgatgctaatgggaaggcgaatataaagatttcaaagaaagagttggtggaattgttggagaagcaacaacaaactaataagaagcaagtagggagagtatctgcagaacaagttctgcttcgcttaacaagggctagagatcatgatgcagctcgtcacggattatggaagcccgtgctagagagtattccggagttaattagttga

SEQ ID NO: 76462 - DNA, 354 bp, Glycine max
  Peptide Sequence Number=SeqID_193240
atgggaaactgttgcaagccggcatcatcaatggagtgggacggcgaggactggagtgatttgacgtccaagaagacgacctcaagcaaggtatttgacgaaggtcatactcatggtcatgggttgagtttagggaaagtacagaaggagaagcttatgggagctctaggagcttctcctgatgccaatgggaaagtgaagataaagatttcaaaacaacaacaggttaataagaagcaagtagggcgagcttctgcagaacaagttctgcttcgcttaataaacgccagagatcatgatactcgtcacagattgtggaggcccgtgctagagagtattcctgagctaggttag

SEQ ID NO: 76463 - DNA, 1302 bp, Glycine max
  Peptide Sequence Number=SeqID_193241
atggcacaatgggattggtgtttgttcttgttcgtgttaatgagagatggcatgaattaccgtatattactggactctgcaaaaagttgtatattggcttcttctgttcccagaaggcaacaattcttgataaggtgtgtgggaggctccattgatcatagacatagagacatgcaagccctaaggtctcttgaggttgactctcagactgttattcgagcaattactcctgcccttgatcctaccagacacaaaggccaggcaggaaatatagctgttattggaggttgccgtgaatacacaggtgctccatattttgctgcaatttcagccttaaaaattggtgcagatctgtcccatgttttttgtacaaaagatgctgctccggtcatcaaaagctacagtcctgagttgattgtgcaccctgttttggaagaatcttataatgtcggggaggaacacaagagttccatagcaagcaaggttcttgctgaagttgataagtggttggagagatttgactgtcttgttgttggcccaggccttggcagagacccatttcttctagactgtgtgagtgaaatcatgagacatgcaagacgatcaaatatcccaatagttatagacggggatggactttttcttgttacaaataatcttgaacttgttagcggctatgccttagctgttctaacaccaaatgtcaatgaatataagcgtctagttcagaaagtactaagttctgaagtaaatgacatagatgctcctcaacaactgctatctcttgccaaacagattggtggtgttactatcctaagcaaaggaaattctgatctcataagcgatggtgacacaggcagtcaaatcagtgagtgtctatggttctcccagacgttgtggtggccaagtgtagctgtcttcttgacatgggcacgtcaacatattttggctgctgattcaaattcgaatcacagttgtaaaaatccaatagttttgggatgcatagctgggtctgctatattgaggaaggcggcatcacttgctttctcgaataagaaaagatccacagtcactggtgacatcattgaatgcttgggcagaagttttcttacaaaatccggcattaccttcctcagaacttttcttcaaattacggggagcacagagggtctgagtaaggcaatgccggattcaaatgctgaaaaaatacagcaccttctaagaacccatcaagtgagcctgccaaaggagaagatgggagagagaagtgtgcgacgactactaccaggacaaaatagataa

SEQ ID NO: 76464 - DNA, 450 bp, Glycine max
  Peptide Sequence Number=SeqID_193242
atgtcttctcctaagaactcatcacaacatgaagctgaagccattccagtttttgaagctattaggagggctaagcgcttaaggttgtttgagccgtctctgggtgttcttgggtttgttgttgtaactgtctttgtgatttgctgcttcttctattcggataacggatactttgcttcaagaatcgggttcttggagcaaccacagaggtttgcttggttgtggataaaagggtctacagaaccacccagagttgagtttcttggagaaaagggtggtgggtgtgatttctttgatggggaatgggtttgggatgagagttaccctttgtatcaatcaaaagattgcagctttctggatgaaggttttcggtgttctgagaatggacgacgtgatttgttttacaccaagtggaggtggcagcccaaaggttgcaacttgcccagctga

SEQ ID NO: 76465 - DNA, 975 bp, Glycine max
  Peptide Sequence Number=SeqID_193243
atgcagttatatcatcatccgttggatttggacagccagagggtgagatttgcattggaggaggagggtgtagattatacatcccaccatgtcaatccgataactggcaagaacttggattcctctttcttcaagatgaatcgccatggaagggttccggttttccaaaatggctctcacatcatttacaatactattgatataatccaagagtccaaaaatcttgacattgctgctgaaattgcagttgtagacccttgttttgaaaaccttataattgagtggtacatagaaagaattgctgtggtttcctcaggggctgagagtatcagcgccagtagcagggaagtgattgaatggatgcagaagatacaagactgggaccccaaaattttcacactttcacacatacccgagaaataccgcctttatgtttccaagttcataaggcaagtggcaattgctcgcatgtccgagtcacctgaattagcaagtgattaccataggaagttgaaagaagcctacgagactgaagagaaattgaaagaagcagatgttttgagaaggagcaaggatcatttggttagactgcttgatgaggtggagaggcagctgagtgaaacacctcatttggcaggtcaagagtttaccatggctgatgtgatgcttgttccagtattagctcgtttagaactcttggatttagagaatgagtacataattggaaggccaaacattgctgagtactggattttggttcagcaaaggcttagttacaaaaaggtgattggaatggtggtgatgctaggtgctggtaaaagatgggtaaatttctttggattctatgcaggggaagggatgcttgtcaaagtggccaggctgcaaaagattttgtggctgagtattgaaacaattcatgcattgcaatcttcatctatcaaaagaattaaggaaaggatagtatgttcatactga

SEQ ID NO: 76466 - DNA, 479 bp, Glycine max
  Peptide Sequence Number=SeqID_193244
atggctcccaagaagaacaaagcgaccaagattcctagtatcaacagtgaagatgattccaaaatggtctttcctaagaacaccttcatccctgggagatgtgcaaacttctatagcctccaagaagagggatttcacattaaataccccttcaagcatgatgtgaccacaatttctcattcattgtgcatctaccctactccaagattcttcttcactcatcatgtgcaaccaatcattgaagaagaagaccttgggtttgcaattgaggtatttgacccccaccttcaagagcttatgatcaatgtacttatttcacaagtaggttgggaaccttcacgatctccatctctttcacgtgcttcagatgctcttattgatctatctttagattctgaatcatttggtgatgagtttctattgaaagtttatgagcattttgctggtgctaagcaaaagaaggagaagaagtttaaaag

SEQ ID NO: 76467 - DNA, 219 bp, Glycine max
  Peptide Sequence Number=SeqID_193245
atgacatcaagaatttttaacgtcaaaaactttttcgatgtgaaagttatttaccttgggggtttgttttttttcctacaaagcgttgccctgttaggcacgttccttggaatggcgacacgtgacatggtggggattggacgcgcccacggtgtgccgccacgtgttgcaccctgcacgcaggcgccctgggtcgccccctgctggcaggcgcgttga

SEQ ID NO: 76468 - DNA, 411 bp, Glycine max
  Peptide Sequence Number=SeqID_193246
atggttgccttcattaggcagtatcagtccaattctgatatggctccggatagaatgcaactacagaacatgtgtaagagggagcatgaatctttcaaagaatacgcccaaaggtggagggatctagcagctcaagtagcatccccaatgatggaaagagagatgataaaaatgatagtagacacgttatcggtgttctactatgagaagatggtgggttacacgccttcaagatttgccaatttagtttttgtcgatgaaaggatcgaagtgagtcagaaaagaggcaaatttgattatcctgccttgatgaataggaagcttggggcaaatggagagaataagaaggagggaggaacccatgctctgactgttgttcccacatggccaaatttcccaccagctcaataa

SEQ ID NO: 76469 - DNA, 1520 bp, Glycine max
  Peptide Sequence Number=SeqID_193247
atgctggctctgaaccttcctccacttggccctctccaactccgaagagggggcgtcgttttaagtctggtacccgagctgctgggtttgaatactttcttggcactagtggaaatggtactgatgtataccaaaaagatggggatgagtcctctactttgacagattctgaggaggaatctgacgattcatcagttaataattatttgggtttctcacggaatggtagtgatctggggataaacagaagaataatggaattggaaactgagcttcgtgaggtaaaagaaaagctatggatgcaggaagaagaacatgtagatggatcatctaggggatcaagaagtgagaatactgaagatgtttataccaaaattaatgcatatgaacaagaactgatgactgtgaatgagaagttaagactttcagaagaagaaattactaaactgaagattgagcttgaaaaatacagactcttcaatacagaaaatttggaggctggttttgagtcatcatcaatgaaagaacacatcaatgaaggaggggaagccctggaacacaagactatagagcttgagggaagcattgatggtgtggataaggaattgtttgaccaaaatggtgagatcgagacacttgtgagggagctaagaattaccaaagaaaatctcaaagcttcagaaatgcaaattacttcactgaaatttgaggccaataaatcatctgaaagaattcagcagttgcatgatcagcttgagttggctcgtaaagacatttctacatggaaaaccaaattcaatagtgagaaaagagagagcaccaaactccatgaaagacttgcaaggttaaggactagtctatcagaccgtgaccatgagatcagggatttgaaaacagcagtatctgacaccgagcagaaaatcttcccagagaaagctcagttgaagtctgaaatgtcaaaggtgctggacaaacggactcatttagaggaacggatcagagaatgggaaagtcgaggccgttgttttgaagacgagatcagaaggatccagtccgaaaaaatggagacagaggaggcacttaagggtgagattcaactattaaaggcagacatagagcagagagagagcaacataaaagacctcaacacaatccttgatactttaaaactagagaaagataatctccatgtagaagtctattcactcaaggaagaggtgaactccagagatggtaggattgagcacctgaacacccatttgaaccaacttcacatggaacatgtacaactgattgctggaatggatgaggcacagaaacaagtggaagaactaaaatcaaaagcaaagcaacttgaggaagaggtcgagaggcaaaaaaccgtgattttagaaggagaagaagagaaacgcgaggccatacggcagctatgtttctcactcgagcactatagagatggctataatatgcttcggcagcatgttatgggacacaaacgggttccagttttggctgtctaa

SEQ ID NO: 76470 - DNA, 714 bp, Glycine max
  Peptide Sequence Number=SeqID_193248
atggatgatcacatgaataaagctttgcaagaaaagccaatcttaataggtcttgaggatttgtaccaaggaatccctgatgaatccgttaacctcacctttcaacacctggctgaagtgaaaacatcagataagagaaaaccaacaacaacaacaacaacaccttcacgctccatagccaaactacctagtcttgatttcaccaaaggcttgcaagcttctaatcaccaacaccatgaacactatctacaagactttggccatggtgaaccatcaccattgggtcattctggtcattttattagccatgctagtggtggtgcacaaagacaaagccctcgactcatggctggaaatgatcatttggggcatggaatgagctttgatggtgtgagtgttgcttcaggaagaggtagccgacggcgccgacccgggattcctcactctaagatttgcacaatttgcaatacctatgtttatatcttccggactagatgcctggtgtgcggcagggtttactgcaggcaatgtgtagaaagaggaatgggggagatgatagaaggaagaaagtgtattgagtgccttggattgagattcagccaaaggcaaaagaataatatactaacttttgtctacatgggaagaaataattgcatgctgatcaagagactttcaagtgatcctggtctcacttacttttcagatagcctatag

SEQ ID NO: 76471 - DNA, 259 bp, Glycine max
  Peptide Sequence Number=SeqID_193249
gtacatagaaagagcagggaaggtagggtgctgtagttggaggtatccaaatacattaaaacaggctgagctcaagtgtgctgagaaaggaccaaggagaagcgtaaggcatggtcacagtgggatggcaaactcaacaagatcacgaagtcctattagccctagaaggactcataatgctattggtagcaatgaacactcttttgtcatgtcctcatccttttctcccttctcacctcattacaacctcccattataa

SEQ ID NO: 76472 - DNA, 273 bp, Glycine max
  Peptide Sequence Number=SeqID_193250
atggataaagttgatatctttgtccctcatcctctcacaaacgcatgtttgcttattcaactttcaccggaatgtgggtgcaagccattggtctgtttgctcaagcaacctgcgctcctgagtgttgacttccaagactgttcaatcagagattactcgtcttgcacgttggtgggggaatcctctacaacaagagacccacggtctcttaatcccttttcagaaataagaagaagagaagaagaggtctctcgtaaaagaggtagattgtaa

SEQ ID NO: 76473 - DNA, 147 bp, Glycine max
  Peptide Sequence Number=SeqID_193251
atggcagcttctggggttcattcttgcaagcaaatgaggaggttggaatcgaggaagtctcattcttggtggtgggatagtcacattagccccaagaattctaagtggctttttgaaaaccttgaagaaattgaacatcatttatag

SEQ ID NO: 76474 - DNA, 330 bp, Glycine max
  Peptide Sequence Number=SeqID_193252
atgggcccaattttgtcagagccacagagacccctcgtgggaggatgtgcggaaaaaggcacaggccatccagaagcaaaacactgccccccacgtgttgtctcgcggggatttgttggaggagcaggcgtcacatggttcctttgtcccccatggacgtcaggatgtcctgactgctgccatttgggtgacctgaacaccctggtcgtgtgcgtgctgctggagtcgcgagcgtccgctaagcgcaacactcctgggctaagcgcgaggaagactctggaagaagatgagttgtacaggttcgctaagtgcaccacttcatctctctaa

SEQ ID NO: 76475 - DNA, 306 bp, Glycine max
  Peptide Sequence Number=SeqID_193253
atgccgtattttttgcatagtgtcatcgacattgtccttgtcgactcagagacttgcttccaattctcgtatgtcacgtcgaccttatcacaagcgacaattcccaaatatgttcttaatttcttcttgtggggaccgtcggtcttcccgatagcaggatcgacgtggaccaccggtctctcagccccaactggtctagtcgccaatgatcttagctgtgtggcttttcttgttcgcttcaaggtagacgatgactatgatgctatttcagtaggaggaggaggaggaggaggagagctgggctga

SEQ ID NO: 76476 - DNA, 471 bp, Glycine max
  Peptide Sequence Number=SeqID_193254
atgggggccaacgtcactgtgaattgtgttcatcctgggatcgttagaaccagactcactagagagcgtgagggcttactcacagatttggtgttctttttggcttccaagctcttgaagaccattcctcaggcagctgctacgacatgttatgtggccactcatccaaggcttttcaatgtctccgacaagtactttgctgactgtaacgaaatttcaacctcaaaattgggatctaactcaactgaagctgcaagctgtaattctatatccggggataatacaaaattataccagaaactttcggcagaggttgacacatattctatgggaatgagctttccagtgctagtcattgcaggtgctagaggttcccttgtctctttggaatcctgtcaagctatggcctcaaaacttctcaattatgcaggggcagtccagtatgatcagggggagcttcacaaattgtga

SEQ ID NO: 76477 - DNA, 978 bp, Glycine max
  Peptide Sequence Number=SeqID_193255
atgggtaagagaagtgttcaaaacataaagggaagtgcacaatttcgtctaagtcaagatcatgaatttttgtatggcagtgacgataatgataataatagtgatgtcaacaatgatgacaatagaaatattagtggtgatcacgatgacaatggtgatagcgaaggtggtgacaatgacgatgtagtcatggtaacagtgttcacggtggcagctaatggtagtgacgttagtagtggtggtggtgatgatggtcgtattagtagtggtggtggtggtgacggtgacgaagttgatattagtggtggtgatagtggttgtagcaatgttagtggtgttggtggcgatgacgatagtgatggtagtaacggtggtggggtgatggtgatagcagtattggtggtggcaacaagtaatggtgatgtggtggtgatagtggttgtagcaatgttagtggtgttggtggcgatgacgatagtgatggtagtaacggtggtgggtggttccgacgacattggtgatgattatggtgacgatgatggaggtgatattgttggtagtggtggtgttggtgacaatgatagtgatagtgacattgatggtgtagtagcaatgtcgatggcaacgatggtgtcagtgactgtggtgttagtggtggcaccaagtggtgacaccaagtggtggcagtgtgatggtggtgttagtggttgcgacaacattggtggttgttgtagtagcgatgatggagatggtaatggtgataatgatgatggcggtgacggtgatggtggcaataatggtggtggtagtaatgttggtggtgatggtgatgttggtgaaaatggtggtggtggtagcaatacttgtggttgtggtggaggtactttaggtagcggcggtgacaatggcaacagtggtggtggtgatagtggttatgatggtggtagcggcgacaagagaaaaatgtcatcttcaaat

SEQ ID NO: 76478 - DNA, 561 bp, Glycine max
  Peptide Sequence Number=SeqID_193256
atggggaggggtaagattgagatcaagaggatagagaactcaagcaacaggcaagttacatactcaaagagaaagaatgggatcctaaagaaggccaaggaaatcactgttctatgtgatgctcaagtttcgcttatcatctttgctgcatctggaaagatgcatgactacatcagcccttctaccacgttgattgacatattggagaggtaccacaagacctcagggaagaggctttgggacgccaagcatgagaacctaaacggcgaaattgagagactcaagaaagagaatgacagcatgcaaattgagctcaggcacttgaagggtgatgatatcaactctcttaactacaaggagctgatggccttagaggatgccttagaaactggtctagtcagtgtccgcgagaaacagatggatgtatacaggatgctcaggagaaacgacaagatcttggaggaggagaacagggaacttaattttctctgggtacgtaatacattatacacccactgtttaatacatggttgcttttccaaaacactgccaacaccatga

SEQ ID NO: 76479 - DNA, 387 bp, Glycine max
  Peptide Sequence Number=SeqID_193257
atggaaaacatgcatgcgtcaagaaaagggggttgggttggaaccgggtcaaggcgactcgacccgacccacgattacgcaacaaggttggaaaaccctagttgcctcgcacagaaaatgacacagtcaatgcggaaaccaccacggagggtggcgccctacccatggcaccactggtgcaagatccagcagcgtgaggccaccatagggccaatggcggcacggcagcgacaacaatggaggtttcacggtggcgcaaacaaaaaagagagaaaagaaaccatgaaaaacgaaagtgatagggcttttaacgccatcggcgaaggacccacaggcacgaagcgaccatgggatagcggcaaatggtggctacaacatggacagtga

SEQ ID NO: 76480 - DNA, 684 bp, Glycine max
  Peptide Sequence Number=SeqID_193258
atggacaaggtgaggttggtgtacggcctagtcatgaagatggacatagacttgggctcaatcatttcaggccagatatctcagatggcccaatccaactcctctaggttgggctttcttgcccttatcgcaacattatgcgtagccaaaggggttgtatctaattctttgacttttgagtccctaagcccagccattaacttggcatacatcagtaagaactgctggaacccagtggatccttccatcacattcccagggtcccacaaggccaaggcctgggctcctatagatgctccagctccaatacctccacctccagcacccataccgggttcagctggcccttctgtgcccagcaatgatacgattatgcctatgctgcaaagcatccaccatggcctttgcctggtgatgcagagcatgtggcttggcccggagtctagccttcctttttggggggagatgaggctcatgtggcccaggagccacagacacaggccactgaagacactccaaaggctagaggaggctaaagataccccaaagactgaggcagaggccggggaagctactgagaagacttcaggcgcagtaaaggctgatattgacgatgactatgtagcagacgtcactgcggcgcaggggacttgggatccatggcccactccagctcaggattga

SEQ ID NO: 76481 - DNA, 213 bp, Glycine max
  Peptide Sequence Number=SeqID_193259
atggtcgaggaactcgagttcgtgatccaagacgagggccattttgcgttcctcctcgaaagagggctgtgcgatgggactcttcgcggaggatctgagtcggagaacggcgatttgagtgcggttaggcatcagaattcaaaacagacccgatgggattctctacacgctttgcgaaactccatggaggcggcgtggtttgtcctccactga

SEQ ID NO: 76482 - DNA, 891 bp, Glycine max
  Peptide Sequence Number=SeqID_193260
atgttggaaaaactacgaaacaaacgcatagtgtttgctggggactcaattgggagaaaccaatgggaatcactcttatgcatgctctcttctggagttcctaacaagcaatcaatctacgaagtgaacggatgcccaattacaaagcacaaggggttcttggtgttcaaattcaaggattttaattgttcagtggaatactatagagctccatttcttgtattgcagagccggcctcctactggagctcctgaaaatattaggacaactctgaaagtggatacaatggattggaactctgagaagtggagagatgcagatatcctggttcttaacacagggcactggtggaattatgaaaaaacaataagagggggttgttatttccaagaaggaatggaagttaagttggaaatgcaggtagaagatgcttacaaacagtccattcaaacagtgttgaactggatacaaaatacggtaaatcctatcaagacgcgggttttctttcgtactttagccccagtacacttcagaggtggggattggaaaaacggtggaaactgtcatttggaaacactaccagagcttggctcttcattggtgcctaatgacaactggtcgcaattcaaaatagccaatgttgtcttatctgctgcacacgcaaatatttctgaaacaaagaagttcgttgtgttgaatgtaacccagatgactgctcatagaaaagatgggcactcgtctatctattatctcggtcgtagtgcgggccctgtgcatcatcgtcgccaagattgcagccattggtgtctgcctggtgtacctgatacatggaatgagctgctttatgcactgttgcttaaacatgaaactgctcacagagggaacttgtaa

SEQ ID NO: 76483 - DNA, 363 bp, Glycine max
  Peptide Sequence Number=SeqID_193261
atggggggttttgtacatctcagaaaggtgtggtgtggctatgcagacactactcttgttcttcttcatatgctctctgacactaatctcactcacagggattacatcaatttccaccttttctttttggcactgcttctcttcttaccaggtagtatatctgacgaaagcaatggtgatgttgctgttgatcaataccaccggtatctgtatgtggagaacaagaagcgtagcagcaaaagcaatggagctgtcttgctgcagtgcatttgtggtacaagtgtgataatcgatggaagcaatggggatattgcgactgatcattatatacgctacctgagaaacaggaaccgtcgggtttaa

SEQ ID NO: 76484 - DNA, 1248 bp, Glycine max
  Peptide Sequence Number=SeqID_193262
atggtgtccttagtgaagtacacagcattgcctctgaccagccctgattcctctagtcatgttccaaggcctcaactctgcgcgttaccttctgtccacaatgttcaacaaagcacccaaccctctctctcttccctcaaacctctttacatttcatccactcagaactttgcattcagaagaaggagggttccagagtgccaggcctatgaagcagataggtctcggcctctagagcttaacattgagctccctgatgaagaagcagggatagaagctactcagaggattaaaattggtttgtattttgctacctggtgggctttgaatgtggtcttcaacatatacaacaagaaggttctcaatgcttttccttacccatggcttacttccactttgtcccttgctgctggctctctcatgatgctaatctcatgggccaccaaggttgctgagctcccaaaagttgatttccaattctggaaggccctctttccagttgcggtgttacatacaattgggcatgttgcagctaccgtgagtatgtccaaagttgcagtttcatttacccacatcatcaagagtgcagagcctgcattcagtgtcctggtatcaaggttcttgctaggggaagcattccctgggcaagtttacctttcactggtgccgattataggaggttgtgcgcttgctgctgtgacggagctcaatttcaatatgattgggtttatgggggctatgatttccaatttggcctttgtccttcgcaatatattctcaaagaagggaatgaaagggatgtctgttagtggaatgaattactatgcttgtctttccatattgtctctattgattctcacgccttttgccattgctgtggagggcccaaagatgtgggctgcaggctggcaaacagccttgtctgaaattggtcccaattttgtttggtgggtagctgcccagagtgtcttctaccatctgtacaatcaagtctcttacatgtctcttgatcagatttctcccttaacattcagcatagggaacacaatgaagagaatttcggtaattgtctcttctatccttatcttccacacaccaattcagcccgtcaatgcccttggagctgccattgcaattcttggtaccttcctttattcacaggagaccccattcggtgattatatccccctacagaagttcggcaacattatatttgtccttcatccgaagaaaacttatatgttctag

SEQ ID NO: 76485 - DNA, 669 bp, Glycine max
  Peptide Sequence Number=SeqID_193263
atgcttgaaagacattttttttcacttgaaactgtgcgggtgctgattgttgatgagattttgacttcatattcatcttgccataaccgtcagacagtctttgccagtgcatccataccacagcacaaccgatttattcatgactttgtgcagcagaaatgggcaaagatatctgataccaaaagaaaattacaaaccctgttatccttgatacaatctgatgcgcctgagtttggcattatatttgttgctgagcagtctgagaagtcaaaaaaggctggaaaggctccatcaacatcccttctgattgactttttgaagacatcataccaaggtgatttagatattctcctccttgaagacaaaatgaatttcaattcacgagcagcttcactgttggaggttagaaaaggaggtggctatcttcttgtagcaacagatatagctgctagggaagttgaccttccagaaatgcctcacatttacaactttgatctaccaaggactgcaatagattatcttcatcgagcagggcgaacttgtagaaaacccttttctgacatcaattgtactgttaccagcattatagttccagatgagcgatttgttctgcagagatatgaaaatgagttatgtttaactgtgaagagcttattccataaaccttga

SEQ ID NO: 76486 - DNA, 1359 bp, Glycine max
  Peptide Sequence Number=SeqID_193264
atgggggtagtgcagttgagagacctagatatggaaagaaggaacccaaggacagtgttggcagttatactaggtggaggagctggaacccgtctcttccctctcactaagcgacgagccaaacctgctgttcctattggaggtgcatacaggctcattgatgtaccaatgagtaactgcatcaacagtggtatcaacaaggtgtacatcctcactcagtttaactcagcctctctcaacaggcacattgctcgcgcttacaactctggtaatggagtcacctttggagatggctacgtagaggttcttgcagcaacccaaactccaggggaggcaggtaaaaagtggtttcaaggtactgctgatgcagtgaggcagtttcactggctctttgaggatccaagaagtaaggatattgaggatgtcttgattctttctggagatcacctctaccgaatggactatatggactttgttcaaaatcatcgggagagtggtgcagatatcactctttcttgtctgccaatggatgacagccgtgcctcagattttggtctgatgaggatagacaacaagggaaggatcctttcatttagtgaaaagcccaaaggagaagagttgaaagcaatgcaagtagatacaaccgtgttgggcctttcaaaggatgaggctcagaagaaaccatacattgcttccatgggagtgtacgtcttcaagaaggagatacttcttaatctattaagatggcgatttccaacggcaaatgattttggatcagaggttattcctgcgtcggctagagaattttacatgaaggcttatctcttcaatgattactgggaagacatagggactatcagatccttcttcgaggcaaatcttgccctcactgagcatccaccaaggtttagcttttacgatgcagcaaaaccaatgtatacatcaaggagaaacttaccaccatcaaagattgacaatagcaagattgttgattcaatcatatctcatggaagcttcttgaataattccttcatagagcatagcgttgttggaatcagatccagaataaactcaaatgttcatttaaaggatacagtgatgcttggtgctgattactatgaaaccgatgcagaagtggtagcactcttagctgaaggaagagttccaataggaataggagaaaatacaaaaatcaaggactgtattattgacaaaaatgctagaattggaaagaatgttgtcatagcaaattcagagggcatacaagaggctgacagatcttcagaagggttttacatccgttctggggttaccattgtattgaaaaactcagtaattgaagatggattcatcatataa

SEQ ID NO: 76487 - DNA, 402 bp, Glycine max
  Peptide Sequence Number=SeqID_193265
atggctaaatgcagtgaaggggattcagaaaaggagccctttatagcagctcataacgttatcttgtcacatgcagctgcagttgatatccatagaaccaaatgccagactgagcaaaaaggaagtatcgctgacaaattggctaccgaaagagcaagagcattcagcttcaattggttcttggacccaatcatatttggaaagtaccctacagagatggagaacgttcttggaagccttttgcccaaattttccagccacgaaaaagagaaactcaagaaaggattggatttcattggcctcaattactacacggcttttatgtccaagattgcatgtactccgcgtgtaagctacgacccgggatctccagaacagagggttcatacaagaaaaatgtag

SEQ ID NO: 76488 - DNA, 279 bp, Glycine max
  Peptide Sequence Number=SeqID_193266
atggaagaagctcttattcgaattttaactcctagacgctctattgatatactgagagatgtgcatgctgccaaggagcaaaggaaaccatatgttgttgtatttgttggtgttaatggtgttggaaaatctactaatctagctaaggttgcttactggcttttgcagcacaaggtcagtgttatgatggctgcttgtgacacatttcgatcaggggctgttgagcagctgcggacccatgctcgaagacttcaggtttatattgattttactgcttaa

SEQ ID NO: 76489 - DNA, 312 bp, Glycine max
  Peptide Sequence Number=SeqID_193267
atggggaaaaaaaatcgagcaaacgttcctacattgaagctgtactggaaggtcatgcttgcactggaaatgaggcattttggggttgttggaattgatctctctgggaatccagctgttggtgaatggattacatatttgctagcattgaaatttgctcgagaacaaggtctttatgtgactcttcactgtggagaggtatcaaattcaaaggagattcacgatatgctcgactttcttctgcagaggattggacatgcttgtttcttcaaggaggaacactggagaaggctgaagtcctctaacattccg

SEQ ID NO: 76490 - DNA, 147 bp, Glycine max
  Peptide Sequence Number=SeqID_193268
atgccctgtctcaaagaagtcaaaaagggacaaggaagggctagcaagacagatggaatatatggtgttgtgaacagaagcatggagggtggcatggaccctacacgttgtgccatgtttaaaaccaatggacatgtattcatttga

SEQ ID NO: 76491 - DNA, 429 bp, Glycine max
  Peptide Sequence Number=SeqID_193269
atgcgtagtgattgcttagtgcaattctccattctcaatcttttccggagccccatgaattgcattttcgttcatgtgtcctccaccttcgagtttggagctatgcgtagtgattgcttagtgcaattctccattctcaacctttttcagagccccatgaattgcgttttcattcatgtgtcctccacattcaggtttggagccatgcgtagtgattgcttagtgcaattctccattctcaacccttttcggagccccatgtattacgttttcgttcatgtgtcctccacatttgagtttggagctatgcatagtgatttcttagagcaattctccattctcaacccctttttcggagccccatcaattgcgttttcgttcatatgtcctccaccttcgagtttggagctatgcgtagtgattgcttag

SEQ ID NO: 76492 - DNA, 376 bp, Glycine max
  Peptide Sequence Number=SeqID_193270
agggtacatctacttgggtttgactgagaacaagagagggtacatctcttgtggatcagttctagtggagggtacatccattaggttcaaagagaacaagggagggtacatcccttgtggatctttgcttctaacgctcacgcaactcaaggtcgagagacaaacaataacagagaagagagggattggggaagaaatcagcgtcggcgacggcggaaatgccggagaggacaacaaagaggttttcaaaccaaaggtttggggaagatactggtggcattggcaacaacaccatcgacactcaaatgtcaagataccgccaacggagacagcagcgacgacactcaaatgtcaagataccgccaacggagactga

SEQ ID NO: 76493 - DNA, 879 bp, Glycine max
  Peptide Sequence Number=SeqID_193271
atggacgctatttctacattgccaagaactactactcatcaaccagtaaggtccattagtttgccaacaagagtgcagccttcttctcaaagagttgaagcacttttgaaccataagcctcacacatgtttggaagcagagacgattcaaagcgatttggctgcgcttgctgagttgtacaactgcatggaggaactcttccattctccacagacccaacaagcacttttgcactaccaaaatgggaaactagtggaagaggcattgtgtggctcggtgacactcctagatgcatgtggcacagcgagggatttattgttgtctctaaaagaacatgtgcaaactcttcaatccgccatgcgcagaagaagaggagattcaagcatcgaaaacagcatttgtgagtataatggcttcaggaagaaggccaagaaggaaattgcgacgcaactaggggcaatgaagagaatggagaacaaagttaatacttgttctctaatgggtcagtctcaagatcagcatttgatattcctagcaagagttctaagagaagcaagcaccatcactatctctatatttcgttctcttttgttgtttctatcaatgccaggactcagaacaaaagggacctccttgatctcaaagctaaagccaatgcgattgttttcttcagagaaagagcagaagaacactaatgttgtggaccttagtgctatgtgctccctccttggaagagatgccaaggttgaagttcaaagtgctctaaaagtgttagagacattgaatgttagcattgatggtcttgactgtggattagattgcattttcagacgtatagttcaaaatagagtgtcatttcttaatatgcttgctcattag

SEQ ID NO: 76494 - DNA, 489 bp, Glycine max
  Peptide Sequence Number=SeqID_193272
atgtctcacgatgacagacctatcttacctatccatctcccaaatgtctttgtaaagcatttgatctgggaggatattcaggaaaagtacgacataagcaaaaagaagtggaaccaattttgtcagagccgtagagacccttcatgcgaggatgtactgattgctgtcatcgggcaactagagcacctatgtcgtgttcgtgttgctggagtcggttcccaaatgcaatcacagatgcaatcagaaggacttgcactgcctcttgaacttaaggttggtccttctgctactcgtgccagcacaaagaaaaattgtgtcgatccctcgggacaggacccaggcgcgagtgactcagagaaatatagggtatatgtcgatgagaatcttccccgcctggttgcccttagaagagtttatgaggggtcgactattatccataacgttcctttgggaaatgatcaagtcaaggtcggtgttaaggaagcttga

SEQ ID NO: 76495 - DNA, 1377 bp, Glycine max
  Peptide Sequence Number=SeqID_193273
atgacccttatgaaaaccctatggaaatcaatcttccccggttgttacaagggtgaatatccctctccaaagccaaagaaagtggtggctacaaagccaaattcttcacacagaatttctgtgacggatttgagttatccaagcacgactctttcggaggatctgtcaatttctctagcgggaaccaacctccatgttttctcactcgctgagctcaagattattactcaacaattctcttctagcaattttcttggagaaggtgggttcggacccgtgcataaggggttcattgatgacaagcttaggcatggcctcaaggctcaaccggtggctgttaagctcttggacttggatggctcgcagggccacaaagagtggttgactgaagttgtttttctggggcaactaaggcatccacatctcgtgaagctgataggatactgctgtgaagaagaacacagggttttagtatatgaatatttaccaagaggaagcttggagaatcaattatttagaagattctcggcatcactttcatggtcaacgagaatgaaaattgctgttggagctgcgaagggtttagcatttcttcatgaagctgagaagccagtcatctatagagatttcaaagcttccaacatcttgttaggctctgattacaatgcaaagctatctgattttgggttggcaaaagacggtcccgaaggagatgatactcacgtttcaacccgagttatgggtacacacggctacgcagctccagaatatatcatgacaggtcacttgacagcaatgagtgacgtgtatagttttggagtagtgctgttggagctgctaacagggagaaggtcagtggacaaaaatcgccctccaagggagcaaaacctagtggagtgggcaaggccaatgctaaatgactctaggaaactcagcagaataatggatcctagacttgaaggccaatattctgaaatggggacaaaaaaagcagcagcattggcttaccaatgcctcagccacagaccaaggagcagaccctcaatgagcacagtggtcaagacccttgagccactccaagattttgatgacattccaattggaacatttgtttacacagctccaccggataataatgaaatgcatagtgcaaaggatcaatgtgagacacctaagaggagggaaaataataataacaatggtcaccttcataggaatggccacaggcatcatccacttaaatcccccaagacccctaggccacaatcacaatcacaatcacgttcaaatgatcacaaacaccgaaatggaagaggaagtggatcaaattctcctccatcacatgggaaaattaggcaaggagttcttgcctattag

SEQ ID NO: 76496 - DNA, 246 bp, Glycine max
  Peptide Sequence Number=SeqID_193274
atggtctataatgaacatgctgatatgaccggcagattgcttgctggatcattcacctttgaacgtcatatcatgcattatattctgtgtcgtgttttgcttccacgttccacaaatcttgctcaggcctctgaggaagatttaattatgctatgggttcttcaaaccggtcgccaaattgattgggcccatcttgtcagtgttgttgcctcctttggataccgaaaggatttggaaggccaatga

SEQ ID NO: 76497 - DNA, 600 bp, Glycine max
  Peptide Sequence Number=SeqID_193275
atgatattttctctctgtgagaattcttcttcttcttgtggaagcaatgacttccaagattattttgatgatgccaaagaatcaagagttaagaaagttccaaagaatcaagagttaagcaagttccaaagaatcagacttcaagaatcaagtctcaaagaatcaagattcaagaacaatcaagatcaagattcaagagaagttgatttcaagattcaagagaagaaatcgagaagcaacagtcaagacttcacaagggaagtatttttcaaaaatccaaacataacacaattttgttttacaaaagagttttctaaaaatttttctaagttaccagagtatttactctctggtaatcgattaccagtttcagggtacatcctttgtggtacaagtagagggtacatctacttgggttgttgtactgagaacaagaaaggttacatctcttgtggatcagttcaagtggaggatacatccacttggttgttcaaagagaacaagggagggtacatcccttgtggatctttggcttgtaaaggattttacaaggttgaaagaaatatcaagaaccgttggtttcttggggactggatgtag

SEQ ID NO: 76498 - DNA, 147 bp, Glycine max
  Peptide Sequence Number=SeqID_193276
atgtgtgacaataatgacgatcatgatgacaaaagtgatagtagtcatggtgataacaacaacaacaacaatgataatcatgataatccttgtaatggtggtagtgatggtcatagtggtcatgatggattaattgagatattttaa

SEQ ID NO: 76499 - DNA, 390 bp, Glycine max
  Peptide Sequence Number=SeqID_193277
atgagggtgtctttctctattaatgttagttggccaattcgtgatcaattaagcattgctcttggtttcaaatgcactgatgatctagggaagtatctcagagtcaagcttaatcatgatagggtgttcaggggattgatgggaaaagttgtggaaaatatgaaacatagactcaacttgtggaaagctaaaattatatcctttgcagaattgtgtactgagccatctaagctatgggtgaaggtggtaaggcaaaaacacaattgtaagatgcttcatgatggtggtaatttgatagagaagtctctagttactctcagtcaccaggatttagatctaagagtgtgtgatattgttagggtgataggacctagggatatgcctatctag

SEQ ID NO: 76500 - DNA, 3402 bp, Glycine max
  Peptide Sequence Number=SeqID_193278
atggagaacaaccatgttcagtttttgcctcttctcaccgtgacacttcttcttgtgatcactgttttgtttcctgtgactgagggtgcagcagtttcctccatcaagactgatgcacaggctcttctcatgttcaaaaggatgattcagaaggatccaagtggagttttgtcagggtggaagctgaataggaatccatgcagctggtatggagtctcttgcacccttggaagagttactcagcttgatattagtgggagtaatgaccttgctgggactatatctcttgaccctttgtcttctttagatatgttatctgttctgaaaatgtcattgaattcattttctgtaaattctacctctttgcttaatctcccatatagtttgacacagcttgatctatccttcggtggagtcacaggtcctgtccctgagaacctgttctccaagtgtccaaatcttgttgttgtgaatctttcttacaacaacttgacaggccctattcctgaaaatttctttcaaaattctgataaactgcaggtccttgacctctcttacaacaacctgtcagggccaatttttggcctgaaaatggagtgcatttccttgttgcaacttgatctatctggaaaccgtttatcagactcaattccactctctttgtcaaactgcaccagccttaaaattttgaatttagccaacaatatggtttctggggatatccccaaagcttttggtcagctaaacaaactacagactttggatctttcacacaaccaactcaatggctggatcccttctgaatttggaaatgcatgtgcttcccttttggagctcaaactttctttcaacaacatctcaggctcaatcccacctagtttctcttcttgcagttggctgcaacttcttgacatatctaacaacaatatgtcagggcagttaccagatgcaatctttcagaaccttggatcattacaggaactgaggctgggaaataatgctatcacaggtcaatttccatcttcactatcttcctgcaaaaagttgaagattgtggatttcagctcaaataaaatttatggatctatccccagagatttatgtccaggagcagtctcacttgaggagctgagaatgccagacaatctcattacaggagaaatcccagctgaactgtcaaagtgctcaaagctgaagacacttgattttagtctgaactatctcaatggtacaattcctgatgagcttggagaactcgaaaatcttgagcagctaatagcatggttcaatagcttggaaggaagcattccaccaaagttgggccagtgcaagaatctcaaggatctcatactgaataataatcacctcacaggtggaattccaattgagttgttcaattgcagcaatcttgaatggatatcactgacaagcaatgaactcagttgggaaataccgcgcaagtttggcctcttgacaaggttagcagtcctgcagcttggaaacaacagcttgactggggagataccatcagagctagcaaattgcagaagtttggtgtggttggacttgaacagcaacaagctcactggagagatccctccaagacttggcaggcagctaggagcaaaatccttgtttgggatcctttcaggaaacactttggtgtttgtaagaaatgttggaaactcatgtaaaggagttggaggtttgctagaattctctggtatccgacctgaaagactcttgcaggtcccaacattgaggacttgtgacttcgcaagactctattctggtcctgtcctcagccagttcaccaagtaccagactctggagtatcttgatctttcctataacgagcttcgcggaaaaatcccagatgaatttggagatatggtggctttacaggttcttgaattatctcacaatcagctatctggagaaatcccttcatcacttggccagctcaaaaatttgggtgtgtttgatgcatcacacaatagactgcagggtcatatcccagactcattctcaaacctctcattcttagtgcaaattgatctatctaacaatgagttaacagggcagattccatctaggggacaactgagtacacttccagcttcccagtatgcgaacaatccaggactttgtggtgtaccattgcctgattgcaagaatgacaacagccaaaccacaacaaatccaagtgatgatgttagcaaaggagaccgtaaatcagcaactgcaacatgggcaaacagcattgtcatgggaattctcatctctgttgcttcagtgtgtatcttaattgtgtgggcaattgcaatgcgcgcaaggaggaaggaagccgaggaagtcaagatgctcaatagcttacaagcatgccatgctgctacaacatggaaaattgacaaagagaaagagccccttagcattaatgtggcaacatttcagaggcagctgaggaagctcaagttctcacagttgattgaagcaactaatggattctcagcagcgagcctcattgggtgtggtggttttggtgaagtgttcaaggccacactcaaagacggttcaagtgtcgccataaagaagctcattcgactgagctgccagggcgatcgagaattcatggcagagatggaaaccttagggaagatcaagcacagaaatcttgtccctttgttggggtactgcaaagtaggggaagagaggctccttgtgtatgagtacatggagtatggaagcctagaagagatgcttcatgggagaatcaagacgcgtgatcgacgaattttgacatgggaagaaaggaagaagattgcaagaggtgctgctaaaggactttgtttcctgcaccacaattgcatccctcacatcatacacagagacatgaaatcaagcaacgtgctacttgacaatgaaatggagtccagggtctcagattttggcatggcaagattaataagtgcccttgacacacatcttagtgtgagcacgctagcaggaacacctggatatgttcctccagagtactaccaaagtttcaggtgcactgtcaagggagatgtctattcatttggagttgtgatgttggaactgctgagcgggaaacgcccgactgataaggaggactttggtgacaccaacttggtggggtgggcgaagataaaggtccgcgaagggaagcaaatggaagtaattgacaatgacttgcttttggccactcaaggaactgatgaagcagaagccaaagaagtgaaggagatgataagatatttagagattactttgcagtgtgttgatgacttgccttcaagaaggccaaacatgttgcaggtagtggctatgctgagagagcttatgcctggatcaactgatggaagcagcaacagtgcttga

SEQ ID NO: 76501 - DNA, 1323 bp, Glycine max
  Peptide Sequence Number=SeqID_193279
atgttagacaacaacaacagtgcttctaattctggtgcaccatcttcttctgatgccgcctttgcattatctgaaaatggggtggctaacaacaaaaggaaaagaagaccagcaggcacacccgatccagatgccgaggttgtgtctctctcaccaaccaccttgctggaatctgacagatatgtttgtgagatctgcaaccaagggttccagagggaccagaatcttcaaatgcacaggaggaggcacaaggtgccatggaagctgctaaagagggaaacagcacaagggcagaataagaagagggtgtttgtgtgccctgagccaagctgcttgcaccatgacccttgccatgcccttggggaccttgtgggaatcaagaagcacttcagaaggaagcacagcaatcacaagcagtgggtgtgtgacaagtgctccaaagggtatgctgttcaatctgattacaaggctcacatcaaaacctgtggcaccaggggccattcctgtgactgtggccgtgtcttttccagggtggagagtttcatagaacaccaagatgcatgcactgtccggcagcatcgcccagagttgcaagcacttcaagcagcatgctcttctagaacagcttcaagcgcaagtccctctagtgaggcaaattttagcatagccccaccattgcaaggacttccagtactgccaaaaccagctgaacaaccagcaacagcagtcttattaatgtcagagatacacaataacaagtccaccacctcgcataacttagaacttcagctcttgccctcctcaataaattctcaagaaaaacataatccaaaggaaaactatggcttgaaactttcaataggctcatgtagaaacgacacagggaataatgaaccagcagagagagcatgttcagaagcacataggagcccaccagaaaggaataataataatgtgagtgactattccacattggaagtggcaaggttgaaggagtttgcaggagaggagcttaagttggccatggcagaaaaggcttatgcagaagaggctagaagagaggccaaacgccaaattgagatagctgaacatgagtttgagaatgccaaaaggataaggaaacaagcacaagctgaacttgcaaaggctgaagagctgagaaagcaggccatcaagaagataagttccactgttaaggaaataacatgccacacttgcaagcaacagtttcagtcttcaattgttggggttccatcatcagaagaaacctccattgtgatgagttacatgtcctcagccaccacagaaggagaagcagaatga

SEQ ID NO: 76502 - DNA, 258 bp, Glycine max
  Peptide Sequence Number=SeqID_193280
atgaagaagatccaaggcctagaagctccacatggagctacatcagaaggggtggctccaccaatagtggttcggagtgtcgtggtcaagatgtttcagaggtgctcaatccgatgttcaatggctacacacaaagggggtgaaggacctcgtcagggaagaggtggtgttgtcaacgatggtgcaaatctttatagttcttccacaagaactcgtcctccacgctcaagaccagatcttgccaagaccagatcttga

SEQ ID NO: 76503 - DNA, 114 bp, Glycine max
  Peptide Sequence Number=SeqID_193281
atggagctaccagccagcagcaaagggtatcgtcgaatcttaaccaaagcctggaaagaaaaagactggggtgtggattatgccaatgtcgatcaacactatattgctcgttga

SEQ ID NO: 76504 - DNA, 306 bp, Glycine max
  Peptide Sequence Number=SeqID_193282
atgatcatagctgtgtatgtgaattggggctttgcaaggattgaatggagtcaggcaggttgctttcacctcaaagaaggattatggaaaaggagggagagagagagagaagcacaagctgaagctcaacacagtttacatggtctgaatcctcttgaaatagtcaaaatcttgaatgaagaaaacaactatagagaactgtttgaacaggctaggaaatgtgctgaagttgcaaggttaagggagcttcacagtttacacactaaagggccatatcaagtctgttgtgaaactccagggacttga

SEQ ID NO: 76505 - DNA, 297 bp, Glycine max
  Peptide Sequence Number=SeqID_193283
atggagggtactcatcatcttcgtcatctgcatcaacaacaacaacaaaaacaaagggttcttcctcagagtatgagtagtgtcaacgtggatgtgactgataggtttccccaatggagcatccaagaaacaaaagagtttcttgtgatccgtgcagagctggatcagactttcatggagactaagaggaacaaacagttgtgggaagtgatatccaaccgaatgaaggaaaagggttaccatagaagtgcagagcagtgcaagtgcaagtggaaaaaccttgttactcgctataag

SEQ ID NO: 76506 - DNA, 372 bp, Glycine max
  Peptide Sequence Number=SeqID_193284
atgaactttaccaacacgttcaactcccatctactcgcacttgatggacctgtatatgtgacgaacaaagagcagagaggcacggaaacctacactaccaagcatgaggaagaagccatagcagatgcaggccatatgaacaagccagttgatccaccacaaaggaaagacctacggaaaacacaagccaacatcaatgtcatcaagttgaaagctaagtgctcagagtatattaagggcttaagttgcctctaccttcaaaagattcatgacatcattgttaagaaaataataatagtattggctaaaaaaacgcatcccagcagaaaaaggaaaaatgttatcgcaataaatggcatgatattgcactaa

SEQ ID NO: 76507 - DNA, 417 bp, Glycine max
  Peptide Sequence Number=SeqID_193285
atggtggctcactcaagcttgaggatagagacttcccaagctatttatcttctctctcagagaggcttactcaagcttgaggatagagacttcccaagctatttatcttctctctcagagagactctctacttggattgactcattctactacggtggctcactcaagcttgaggatagagacttcctaagcaagttatcttctctctcagagaggctctctacttggattgagtcatcctatggtggctcactcaagcttgaggatagagacttgtcaagctatttatcttctctctcagagaggctctctacttggattgcctcattctacggtggctcactcaagcttgaagataaagacttcccaagctatttatcttctctctcagagagactctctacttggatttattag

SEQ ID NO: 76508 - DNA, 444 bp, Glycine max
  Peptide Sequence Number=SeqID_193286
atgttcacgtgtaagggtctcgttagttcctttttgccacacatgctcttgtgcagatttagtcatgtccccctcgtatatgagggtttatcggtgataatcaagaccgaatggtattcgttgctcgcacatgttgaaggccaagacatactgtttgacatatgcggatacatggcagaagagtgtgttcggtttggatgggctaggtgtctcctcggcctgactggatactttatccagtatactagcccccaaaccccttttcgtccttggccaaaaaaaggggctttatgttgtgttagaacgattatgaattactcccctgatggttatgtgcctttattgccacaaagtaatcgttacatcgtggaggtaacggttactccccacgtttcttcatcttcctacgttgggtaccgtaacatcacttgtcctccattgtag

SEQ ID NO: 76509 - DNA, 747 bp, Glycine max
  Peptide Sequence Number=SeqID_193287
atgggtgttctcctcatatttaacgttgctccaatgcaacttcacccaaatgggtgggtagccatgcaagcattccacgtactttgcttatatagctttgtgtcggcgatgcccagacttttcttgcactatttctacaaccatcctcaagataaggctcggtggatatcactaatttggctgccgaagcatcctctctttcacctattcacttcttcttataaaatttttaagattggttacttcaaagcaaccacaaggccaatcgctgggaaggattacttctatgacttggaaggaatcctttgttttccttctattgacaataatgcccgacagaatcgaatcgttgctgctagtggtccttcgtcaaatcctactgccaaacgtacctcggggcctcatgagggtctagctgatgtggttccctccgtcgacaaacatcctaagggaaagcaaaaacatacgaagcagagccaccgggagcaccggagtggcttgagggaacaatctaggcaccgagaaggcacctctcgagagaaaaggcttaagcaaccaatgcttaagtattcgaccaattcttccatctacatgtacttggctgctctcattcgctgttcatcgagatcagatgctgacttcttatgtaggctattgacaaaaggtctcggttgtaacatcgttatcaagtggtgcatagccaccgttgggtccaagtttcggatattccatgaaggttctcaatga

SEQ ID NO: 76510 - DNA, 258 bp, Glycine max
  Peptide Sequence Number=SeqID_193288
atgggagataaatgcaatgcatacttcattcaagccgttatgattacacttgcccatgtgggtgaaaatataaacctctatgttgatcaggattcttacatattgtgtgagagtgagactaaagcatgcttgcagttgactagcaatattatagcctctacaggaatcaggctttctgttaaggaactgaaaagaatggtgaaatttaggatctgggttcttatcgttagatctttggacattaaagagtccatttga

SEQ ID NO: 76511 - DNA, 1485 bp, Glycine max
  Peptide Sequence Number=SeqID_193289
atgggtagaagcactttggctttggttctcgcgattctgatctcttttcagggaacccacgttagatccgatgcctccgatcaccgttacaaggatggagactccgtccctctttacgccaacaaagttggtccctttcacaaccccagtgaaacgtatcggtactttgacctgccattctgtgtaacaggtcatgagaaagaaaagactgaagccctcggtgaggtgttgaatggcgatcgccttgttagtgctccttacgaacttagtttcaagaaggagaaagactctaaggttgtatgcaagagaaagctcacaaaggagcaagttgctcagttccgagaagcagttaagaaggactattatttccagatgtattatgatgatttgccgatctggggatttattgggacgattgacaaggaagggaaaactgaccctagtgagtacaagtattttctttacaagcacattcagtttgatattctgtacaacaaagatcgtgtgattgaaatcagtgcccgaatggatcctcattctgtggtggacctgactgaggataaagatgttgatgttgagttcatgtacactgcaaaatggaaggaaacagatacatcttttgagaagagaatggataaatactctcagtcttcttctttgccacatcacttggagattcactggttctcaatcataaactcctgtgtaacagttcttcttttgactggttttctggcaaccattctcatgcgtgtattgaagaatgactttatgaagtatgctcaagatgaggaagctgctgatgatcaagaggagacaggatggaaatacattcatggtgatgttttccggtttccaaagcacaagtctttcttttcagcagcccttggttctggtactcagttattcacacttacaatcttcatttttatgcttgcactggttggtgtgttttatccatataaccgaggtgctttatttactgcactggtggtcatatatgctctcacatctggcattgctggctacactgctacttccttctatattcaacttgaagggactaattgggttaggaacttattgctgacaggatgcctcttttgtggccccctattccttatgttctgtttccttaacaccgttgccattgcttatagtgcaactgctgccctgccatttggcacaattgtggtgatagtcctaatatggacattggtaacttcaccattgcttgtgttgggtggatttcttccttttagtgccatctacatagagctgtactacatttttgctagtgtatggggccaccgaatttataccatctacagcatactcttcattgtcttcattattctgttgattgtcactgctttcatcactgtggctttgacgtacttccaacttgctgctgaggatcatgaatggtggtggaggtatgtaacttatgttattgctaccttctatagtttgtttgagaattga

SEQ ID NO: 76512 - DNA, 201 bp, Glycine max
  Peptide Sequence Number=SeqID_193290
atgttgcttttcgacacccatatttatctcggaggtgaagaacaatgttgtggtgtggccaaacccagtgtccaatctgacgagttgtcaaaggtcaatataattaagaacagattcagatacgcgaaggtgctggaaacacagaagaagaagtggttttgggatgatgtgaattgtaagaagaagaaccagcacacatga

SEQ ID NO: 76513 - DNA, 219 bp, Glycine max
  Peptide Sequence Number=SeqID_193291
atggggaaaccagtcagggtcacgttgttttgcaagaatgctccaaccatgtgggatcgacacaagcttaaaggagcactcaaactgggtgtatttacccccaaggcctacactcctaagagtccatcagggcctctccctcctaattcaggtccaacccctaaaacaattttttacatgcaaacactacttatgaattatacaataccgatgacctaa

SEQ ID NO: 76514 - DNA, 1185 bp, Glycine max
  Peptide Sequence Number=SeqID_193292
atggccaagccacagaaaccacaaccaaaaccggggtgtttctctttctccagcttcctacgtgtgcttctatgtgctggaaatggaactagtccaccagtgcacccttatcacatcacagaatcagatgaatcaaaaaatgcacatttcaccaaagaaaaaatggtggtgaatgataatggtaatgatgatatttctgcccctggagttgtggcaaggctaatgggtttggattcacttccgaaccccaaatgggtggtgaaatgtggtagtggcagcatcccagattctgttcctagaagcaggtcagtgaacttcgttgactacttgcttgagtttgatgctagccatgttagtagccataggagggtgaagacttcaacatcgttcagagaggttcctagtttggttcagaaccaaaagggtaacaatggtaataatctctttgtgttttgcatggatggtgatggtaacatgagggaagagaaagagggtagaaatgagatgagggaagtggaagagttgaggcagaggaagaggcaggggagtaataagaacaaagagagtgtgagtgtgaagaaagagaaaaatcaagggaagaagaacaagaagatttccaagctgaagaatgaaccaaggagggtaccttcttctaagaatggttcaaagggtcgaactcgaaaccatcatggtgaggttaaagatttgtcatctgtgtcctcaaactcctctaagtgtagtagttcttgtagtagtagtagaaaaaatggtgttagttcaagatcaaggttcaacacttctttgtcaaatgcacacaagaagggggttgtggaaccaaaattcaggaagaacatgagaaatcagaatccagtgttgaaggaagaaagtgaatgcaggttggaaaatcacagtccagtttcagttgtagagagcaatgactactatcctttcctttatggaactgattttctagatggtccaagctccgttgcttcaaagtcaaaaaagtggggatctccatcacttttgtcattgggtgaagaagttgaagacagtgcaagtactaatgaaggttataccttcattgatgtcaacaaggaagcagagtattactcagaattgatgttgaagcttcgtactttgactgaacaggatataagagaatcagattgtacctcaaaacgt

SEQ ID NO: 76515 - DNA, 1293 bp, Glycine max
  Peptide Sequence Number=SeqID_193293
atgccggggttaacgtgcaacgcttgcaacaccaaattcaaagatgacacagagcaaaagctccattacaaatccgagtggcatcgatacaatctcaagcgcaagtttatccaaatagcgtcttataatattaggacatgggaggaagatgttgttaccatagaggcatatcaagtggctggggttcctggggtgaccgaggcgctatttctggctagacaatctgtgcttgctcaagagaaaaataaactgggtgaaacccccatgctctacacctgtggtctttgtggaaaggattataaaagttctaaggctcatgctgagcaccttaaatcacgtggtcatatgatgcgggcctctgaaggaactagtcacgcagatgagaaggcaatagttaagcctcttccacaacgtgttgtgaataggcctcctcctaagagagaggtagataactctgaaaatgaggaaagtgaagatgaatgggaggaggttgatcctgaagaggatttggttgacggtgctgcaaagtccttgactgatttgaatgtgaatgagcatggcgaaaatgttgatatggaggtagatgatgattttgaggagttagacccctcttgttgctttatgtgtgatcaagagcacaaaacaatagaagactgcatggttcacatgcacaagcatcatggattcttcattccagatgttgagtatttgaaggatccaaaaggcctcctcacctatcttggccttaaggtcaaaaaggactacatgtgtctgtactgcaatgatcgatgttatccattcagcagcttggaagcagtcaggaaacatatggaggcaaaaagtcactgtaaagtgcattatggtgatggtgatgatgacgaggaggtagaattagatgaattctatgattatagcagcagttatgtggatgatcaaggcaagcagcttgttgcatcttgtgatgcatctaacaatgtagaacttgttggtgggtctgagctcataatcaccacgaaatctggtgaaagagcatcaaccaaaacactaggttcccgtgaatttttgcgttattatcgtcaaaaacctcggccatcactagcaaatatggctatcactgctgcgttggcttcaaggtacaggagcatgggcttgaccactatccaatcaagggagaagattgtgaggatgaaagtgctgaaggaaatgaataggtcaggtgtggacaatatgcgtaccaagatggcgatgaagagtaatgtcatcaggaacctgccaaagaatgtaccatattag

SEQ ID NO: 76516 - DNA, 105 bp, Glycine max
  Peptide Sequence Number=SeqID_193294
atggagtatgcagattataggatagaagagatcgatgatgagattgttagtactagtggctcttcaaggggtagcagtggttatcgcaggcagcatgtgaattga

SEQ ID NO: 76517 - DNA, 327 bp, Glycine max
  Peptide Sequence Number=SeqID_193295
atggccaacacgagaagaaaaattgtgatcaccatctctgcagtcgatgaacggaataaaatcaactatggtgatggccttactttgtacaagacaccacttgcctttgactaccagactccacccaatttttctggttttagtctcggcctatacggtggcaccctagataacatcgttgctgtcgaatttgacacttatataaacgagtatgaccaaccgatgcaccgcgtagggatcaataataactcggttgcatccctcgaatataagaagtttcgtattgagagcaacatagggaagatggggcatgcgttgataacttag

SEQ ID NO: 76518 - DNA, 519 bp, Glycine max
  Peptide Sequence Number=SeqID_193296
atgaggaactaccataattctccatggatgaataggaacatgtcaaaaatccagtggaggagacatcgaagaatgaagagggatgcaatattggcgatgcaacaaaagagtggtgttagacctttagtttttgacagaataaccgaagccatttcacttgacaactatggtggaagggctgctttcaacatcttaccaagatctatgttacagaggtttggtagaagtatagaagatttgatacctcataatatagtggtgtcagatttctgtgggaagccctcagattctgaaagggaatgtgtcctccagaacaacaagagagagttgtggtacatggaaaacagatgcttcaggaacatgtctagaggaaaaagcaaattcctcaaccttgagaaaaaggaggttgaagggtttatcgcttttagagaaaataaaaaggccctcattaagagaattagtaaaattggtaaacctaactctgctcagattgataatgtttactatgtgcaaggttaa

SEQ ID NO: 76519 - DNA, 1227 bp, Glycine max
  Peptide Sequence Number=SeqID_193297
atgggggcggtgttatctcaaggtggtcaccccatagctttttttagcaagcagttttgtcctaaattaatgtgttctttcacctatgtccgtgaactcgccgccatcacagcaactgtcaaaaaaccaccgcagtctcaaggaacttatggcactggtgattcaaaccctgaacaacatctgtatttggtgtgcttgttaggctatgattactcgattcagtacagaacatgcaaatctaatatggtagccgatgctctatcccgatcgtctgacaccctgcctggttctctatttttgctatctatgacgaacttcttatttctaacagaactcaagcaaaagttgtcttccaatggtgacttcgtcaaacttcgttatacaattcaagctagcccagtagcttatcctgattatttcttgactcaagatttcatcatcaccattcgcgaggatactcgcaagtttattgatagttgtctagattgtcaacataccaagtatgaaactcaaaaactttcggggttgctttgtcctctgcccatacctgctcaaccatgggaggatttatctatggatatcatagtgggtcttcctacttatcgaggtcacacaaacatcctcgttgtggtggacaagttctcgaagggacttcattttgagtggtcctacaacacgtcctctcattcagctactggaatgtctccattcgaaattaccttcggcaggaagccacctaattttcctcaatatatagtaggtacctcaaagattgaggttgtcaatgaaatgttgggtcaaagggaagttgtgtttgccttgttgcgaagtaagttgttgaaatcccaggctcatatgaagcacattgcagacactcatcgaagagaacatcaatttaacattggtgattgggtgatggtgaaacttcgacctcatcgtcaggtatcggccactggatcatcatattcaaaattagctaaacgttattataggccattccaagttaaagatcgaatgggaaatgttgcttacaaattgaaactgccagaacaatctcgcatacatcctatgttccattgttcaattcttaaaccatattttcaaccaactccaacttcttcagaacttgtggaattgcctcctttggcaatagacaatcaacctatagtcacacctttaacattcctcgcaacaaaatggattccttcaccttttggcccaaagtag

SEQ ID NO: 76520 - DNA, 495 bp, Glycine max
  Peptide Sequence Number=SeqID_193298
atgaagaagaatgccattaagttgatcacatctttgaagcaaatggatgctaaatttggggtgtccacacttttggatcttgatcaccactttgctgttgtgattagagtacttagggaagtcattctaatcaatttgtcagtcttccaatttattttgtcattcttgaccatggcttcatcaaattcaaagtcaaccaaatggttgctggtggcaaaattgacgcagaaggggggactattgttcgtgttccacaaacccttttcacctgagtgctcgtggccagtctcgctcccactcacggctagccttgctctaggtggccactctcgaaaggtcgccgtgacatacgagacctggaaggaagtccctgttgctcagaaggatttgatatgggaggatattcaagcgaaatttgaaatccctgaagcttctggcagtaggacaaagaagaaagttcttctgacggtgggcgagcattcgaggcagttttaa

SEQ ID NO: 76521 - DNA, 228 bp, Glycine max
  Peptide Sequence Number=SeqID_193299
caatctctgtctattacagctgatcatgatcggtcaatgcttgcctcaagtgagcctacagagtttgaatctcaatctgtgtctgttaccggggatcatgaccctcttctcgggattccattgacaccaactaagcgcgtatcttcttatgagttggataatgagcgaaaaaactttgagatctcacctgctgaagtttcctcgaacaaattagccaagcattcttag

SEQ ID NO: 76522 - DNA, 1062 bp, Glycine max
  Peptide Sequence Number=SeqID_193300
atggcgcggttgatcacagtggtgtggtgcgcggtggcggtgctactgtgcgccgcggcgggcgcgtcgtgggtggaggaggcggcgaacccgatacgaatggtggcgggggtggaggcggaggtggttcgggtgatagggcagtgccggcgcgcgctgaagtttgctaggttcatgagcaggttcgggaagagttaccgaagcgaggaagagatgagggagaggtacgagatattctcgcaaaacctcaggttcatccgctcccacaacaagaaccgcttgccctacactctctctgttaatcgaaaaacagagagagggagagaggaggggaaagggttttggattgaaacagattttgctgattggacttgggaggagttcaaaagacacagactaggcgctgcccaaaattgctctgccactcttaacggcaaccacaagctcactgatgctgttcttcctcccacgaaagactggaggaaagaaggaatagtgagtgatgttaaagatcaaggcagctgcggatcatgctggacattcagcacaactggggctttagaagcagcctatgcacaagcatttgggaagagtatctctctttctgagcagcagctagtggattgtgctggccgtttcaacaactttggctgtaatggtgggttgccatcacaagcctttgagtacatcaaatacaatggaggacttgagacagaggaagcatacccctacactggaaaagatggtgtatgcaaattctcagctgaaaatgttgccgttcaagtcattgactcggtcaatatcaccttggtggtgaatgggttccatttctacgagaatggagtttacactagtgacatttgcggtagcacttcccaggatgtgaaccatgccgtccttgctgtggggtatggagttgaaaatggcgtcccatattggctcataaaaaattcatggggagaaagttggggtgagaatggctacttcaaaatggaattggggaagaacatgtgtggtaagtatccattaacaaccccacctatcccagaaattattaagtag

SEQ ID NO: 76523 - DNA, 459 bp, Glycine max
  Peptide Sequence Number=SeqID_193301
atgagatcgtttgcaaagattttccgctatgggtctcttttatacattaattgcatgcatgcaccaagcaaaccgccagtggaactggcgagtttgctgtttgcgaaggagtcgccagtggtaatggcgatatcgccatgcagggggaatcgccagtcaaactggcgagttccaacaggtacgtgcagcaggctcagcagggctaggtgcaggttcagcaggaggccatgcaggagggtgcaggttcagcgtcaggccatgcaggagggaatcgctatccctattggaggttcagcgtcaggccatgcaggagggaatcgccatccctattggcagtttgctttgggtgagggaatcgctagcctggctggcggtttgtgggcagagtggactcgccaattgcactggcgagttgctttaattcaaaattctggcgttataaaagaagaagctccatga

SEQ ID NO: 76524 - DNA, 279 bp, Glycine max
  Peptide Sequence Number=SeqID_193302
atgctaactagatatcaaaaggctgaaattcccaagcataatcctgagatcaaaagagcttgccgcatgaacaatgcgaacacaaggagaaaaaggatggttgaagcaaatggtggtaatggcggcaatgtgattggcccactggagtgcatcttgcaggactatctcaccctcgtggtgggaatcactaccagtattgtgctcctttacttggagaaccaaaactatgagctaaggcatggactgatcaatataacaatgacaaagagcacgatatga

SEQ ID NO: 76525 - DNA, 693 bp, Glycine max
  Peptide Sequence Number=SeqID_193303
atggcacgtgttgctgataaaataaaattgatagatggatcaagggaagctcttaagctttctgtaaggatcactgatctttggttcattgggattcctggaaagactgaacaagccgaaatggtggttgttgattctgataaattatgttttactggagttattgttgttaggcaatgtgatatggaacagttaccttttagaaaattcatatttgtttctttttccagtgtcattgctggtgattttaaaattggactcttggttgatgttattggcgtggttgatgaagtattattccgatatgtgtcatccaaaaatacgagggttgttttgaatttaaaggatttgagtggacaggtgctatcctgtacactatgggaaaattactgcttacagtttttgtcttatttgaatgatattgaagatgaaaggccgatcgttattctcttgactcatgctaggattaaggaagcacagggatcatatccggcatcggtcagtaattctttcaaggcatctaaactcatgatcaatgacctcgtgcttgaaattcaagaatttagagagagtcttttagatttagggatcgaggttagatcaattttggcgcctattggacaagggagttcacagtttcagggtcatctcaattatcatcaaaagatgtgtttctgtcaaagactgaagtaa

SEQ ID NO: 76526 - DNA, 2088 bp, Glycine max
  Peptide Sequence Number=SeqID_193304
atgagtttatctgagttagtggcacttagccttcttggaaacaagctcaatagtgctgaagtggtttttcaagaacttatcaaacttaagcatcttaaaggaatctggctcaacaataaccctgttcttaaaaattgtgatggtgagcttgaacaggtgattcttaaggagttgccagaactggaaatttataattcaagtttaacgggcaattttggggagtgggccttgggcttttgtgcagggttatatggaaaggataatcctggaaatgctgatcagactgatactctgctgcacactgtgtctactctggacctttcaaatagaaacattcacaatttaatcaagaaggcattttcacccatttgtttgccatctctttcttacttgaatattcgaggaaatccattggagcaaaactcagttggtgacttgttagatctgctgaggagattcccttgcttgcgttcattggaggtggatattcctggtccgcttggaggaagtgccattgaaattctggaatctcttccaaacatttctgagctaaatggtatcagtgcatccaaaatattggaaactggaaagcatattattgattcaatgcttcttcctcgtcttcctgaatggactcctgatgagcctcttgctgatcgtattataaatgcgatgtggcaatatctaatgacatatagacttgcagatgaagaaaagttagatgaaacatctgtatggtatgtgatggatgagctaggttcagctttgcggcatagtgatgagccaaatttcagagtggcaccatttctgttcatgccagagggcaatctagcatcagctgtgagcttttctattctatggccaacacagaatgtttgtaaaggtgatgagtgcacacgtgattttcttcttggtattggggaggataaacaacgttctgccaggcttacagcctggttccacactccagagaactattttatccatgcatatgaaaagcaccatcagaaattgttgtccacaagtttaatgctgcccacctttcagtcttctgaaactagaagcattcatcaacctggtgggcgtccattacgtgtttacacagatatacctcatgtagaggaatacttgactcatccgaagtttgcaatcacaaaggaaccaaaagatgcagatataatatggacaagtgtgcaggtagatgaggatatgaagaaggccacaggaattacagatcaacaatacatcaatcaatttccttttgaggcatgtcttgttatgaagcatcatttagcagagacaattcagaaggcacatggatctcctcaatggttgcagcctacttataatcttgaaacacacctatctcagcttattggtgactattgtgtacgcaaaaaggaaggactagacaatctctggatcttaaaaccctggaacatggcccgaactattgatactactgtaaccgataatttgcctgcaataatccggctcatggaaactggtcccaagatttgccagaagtatattgaacaacctgctttgttccaggggagaaagtttgatctccgttacatattactggttcggagcatgcaccctctggagatattcctgtcagattgtttctgggttaggattgccaacaaccaatattctttggacagaagtagtttgtttgaatacgaaactcacttcactgttatgaactatcgtggagcaataaatcataagaatgctagcgattttgtgagggaatttgaggaagaacatcaagttaaatggttggatatacacacaagagtaaggaaaataattcgatcagtgtttgaggcagctgctgttactcatcctgagatgcatagtccaacatcacgggcaatgtacggtgtagatgtcatgttggacagctcttttcaacccaagttactagaggtgacttactgcccggattgtacaagagcttgcaaatatgacatggatattgtggttggcgagggaggcgttgccaaagctagtgatttcttcaacaatgtgtttaggtgtctctttttgaacgaaatttcacaggttagcccattgtaa

SEQ ID NO: 76527 - DNA, 885 bp, Glycine max
  Peptide Sequence Number=SeqID_193305
atggccaccgacagatacgcttctccgccagccacatcgcctgaggagaacgctctctttctcgatatactgcacgaggctcctctcttcgctcaccgccaggctgcaagggcaggttatgctactttggccattggagctcactggatatttcgtcccgttcgaggactcatctctcccgtgctttgtagttgtgatgttcttcttttgctgttaacaggaatctttcaacaatacctggtttatcaagtgcagaagatacgcttgcagggctattatagtttcagccagaagttgaaatttattgtccgcataccctttgctattacagcttatggaactgctgcaatgctacttgttatagtctggaaaccttacactggttttctgtcaatctctgcaatattgaggtaccatgatggtaggctctctgatcagcaaatggctttgctgcaatatcagcgtgaaaatcttcattttttgagtgaggagattctccgattgcaagagtgtctaagcaaatatgaacgaactgatgatcggagcacaccacaggttgaccttgcccatctactagcagctcgtgatcaagagttacggacactgtctgcagagatgaaccaagtgcaatctgagttgaggcttgcccggtctttgattgctgaaagggactcagagatccaacatgttcgcatgaccaacaatcagtatgtagaagagaatgaaagactaagagctatcttaggggaatggagtacccgggctgccaagcttgagcgagcactggaggctgagcggatgtcaactcttgaattacaaaggaaactttcaacgccaagaagtcaaccatatacatcaacagaagcaaaccaacatggagcttaa

SEQ ID NO: 76528 - DNA, 135 bp, Glycine max
  Peptide Sequence Number=SeqID_193306
atggaagagaagaaagaattccctaagggagagttctcaggctttagttgttggagtggacttgagcctgcgtactcgcgcttagcgtgggtgcttgtattcgtgcttagcacaggtgcctgtatttgcgcttag

SEQ ID NO: 76529 - DNA, 201 bp, Glycine max
  Peptide Sequence Number=SeqID_193307
atgatgaaggtggagaagaaattgatacatagaacaggacaacaacaatctccaaggagtaaaaagaaagagtggggacaacaacaatctccaaggagtaaaaagagtggggtttatataaacattagcatggatggatttttgtcaatagtgggagtgaaattgagcatgaaacatcccttgcaacttgcttggcaatga

SEQ ID NO: 76530 - DNA, 387 bp, Glycine max
  Peptide Sequence Number=SeqID_193308
atgagtaatcgaaggggaaagggatttgaaacggagggaattgaattgaaaagagtagtagtacctggagtcttggagtttggcggtggatttcttcttgacgtcgaggacgacgttgtcggtgccgcggacgccgatggcggcgttgcccttgcagacgactttgagggcgtactcgacctggaagagatggccatcaggggagaacacagtgattgctcagtcgtacctagccacagcgattgtgatgcttctgtgacgaaaatagtaaagacaaagaaaacaagcctagtgttggtgttggtgtgttctttacttgcagttactcagggaacaagtagaatagcgtcttggactggccttttggagagctgctattctccttga

SEQ ID NO: 76531 - DNA, 384 bp, Glycine max
  Peptide Sequence Number=SeqID_193309
atgttgtcaccttcgttgtcacataacacctccaatcatagtgcaaccttattatggtcaaagaaagagcatgatgaagagcaacttgccatccatgttcagaatggcagaatcaaagagtatcttgttctggcacttcctgggcaaatcgtgaagggcaaggaagggacggtgaggctttatggtgggtggcctatgacgatgatagtgaggctttgggtttggcaacaagggtatcagagggagcttgatcatgaaatgtggagagattcaaaccaaattagggttcacaacattaagagaaaaatgaggcagcaagtgggcaaaagatcatgtgttttagaaaaattgactatcgattttttaataaccggtgtcgaatag

SEQ ID NO: 76532 - DNA, 918 bp, Glycine max
  Peptide Sequence Number=SeqID_193310
atgggaacattttcccaaaagcattctagcaaatatggtgttagatccattagtttgccaacaagatcacatccaagcacagttagagttgaagaggagctgagcaagcttaaatcattggaggcatcatcatctacaccaaaggtggaaacaatttgctgtggtctatctggccttgcagaattgtacaaatgcattgaagatcttttgaagttgccattgacccaacaagcactaggccagcaccaaaatgagaaatgggtcaatgagttgttggattgcccagtaggattcttggacctgttgggaaaaacaagggattccattctgttgatgaaagaaagtgttggagagcttcagagtgcacttagaaggaaaagggttggagattcggacagggagagttatctctctacatattggaggctcagaagaaacatgaggaaggagtccacaaaatctatgcttttgttgaagcagatggaaaatgagtcatttgtggcatctccaaatttggatcttagtgagcacctctctgcagtggtaagagtgctcagagaagctagtttaatcaccagctccatctttgagtcacttgttgtgttcctttcttcaccaatcttgaaactaaagcctaataagtgggcatttgttgtgtcaagattgatgcagaaggggctgttcgcttacaacaatcatcaggaaaatataaatgagttggaaaaggtggattttgcacttaacagtttgattgtggacaatctgagcaaagatgctgaggctgagaagattcaatctgcacatggaaggttagaagctttggtggtggccattgatgagattgaaaatggattggaatgcttatttaagcgcctgattaatactagagtgtcttttctgaatatattttctccttaa

SEQ ID NO: 76533 - DNA, 744 bp, Glycine max
  Peptide Sequence Number=SeqID_193311
atgattggtggtgatattcaatatgcagtgccagctatggagggaagtactacaccatcactctcatcacctcaacactctgatttctcaactgggtatctcgaagatgctttgattgaatcatgtgagcgttcaaaacgtagacgtgtgttgccatgtgctactgatgaacatagcaagagtttcattgatgaccttgagcagagtttctggaatttcaaccccttatggaaccaaccagtagagaacttcaacttctactgcatgaaccagatagaaaggttttgtggaatttcagatgagcatataagcacatcaaggagcgaggaagcaaacattcttctagcagacactaaaacaccggaagagacaatatcagcctctgaatctttaaattcatcctcatcttcatacaaacaaccggcgacatgcaaaaccacagaccccacagttgccccaacagaaaatgatgatatgaggaacaagaaggtggtaacaagagtggtgtatccatttgcaatggtgaagccaggaggaagagaaggtgatgtgacattgaatgacataaatgagaggatcctaatgcctcccacaagaccagtgaggcatccagttggagactttgcatgtcggccatgcgtgtccgcagagggtccagggctttcagggaaagcagtggtggcccttactagaattcacacacagggaagaggcacaatcactattatcagaaccaaaggctaa

SEQ ID NO: 76534 - DNA, 213 bp, Glycine max
  Peptide Sequence Number=SeqID_193312
atggggaaaggagtgattacggtggcgtcttcaggaagacctgcaaaggcttcttccggaaacttcccggaagaagtagttctttcggaaagtttccggaagaagggttcttccagatgccctttgaatattccggaagaacttttcggaagagcaacttttttcggaaagtttccggaagaactacttcttccggaagttttattttcttaa

SEQ ID NO: 76535 - DNA, 1177 bp, Glycine max
  misc_feature (1163)..(1163): n is a, c, g, or t
  Peptide Sequence Number=SeqID_193313
atgaactctgttttacaaccattcttgcgtaaattcacggcggtcttcttcgacgatatactcgtctacagtgattccctgcaatcccatcttcaccatttggaacaggttctggataccctcctccatcaccaattcttcctcaagcgctccaaatgtttcttcggcgaacgttgcttggagtatctgggccacattatctctggtgccggtatcgaaccggagccttcgaaatttgccacaatgacacaatggccgcctcccttttcatcgaaggaccttcgtgccttcctggggctcaccggcttctatcgtcgtttcatccgcaactatgcctctattgcttcacctctaacaactctcctctgccgtgataattttgcatggtccccaccagctcaatctgcttttgatcaccttaagaaggccatgacctctgccctcgtgctaacccctcctgattttagcatcccttttgtgctcaaaacagacgcttctggtatcgccatgggtgctgtgttgatgcagaacaataaacccattgcttatttcagcaagcaattcactccaaagctccaacgcgcctcgacatacactcgcgaattacacgcgattatggcggccgtcgacaagtggcgccaatatctcctcggacacaaatttgtcatcctcaccgatcatcggagtttgcaggatttaatgactcaggtcattcagacccctgagcagcactattatttggcaaaattattaggctacgactaccaaatcaagttcaaacgcggacattcaaatgttgtcgctgatgccctttcccgcgttccccaggcatctgagggcctatgtttgatcctccatattcctcagttcgacttcatgcagcaactactccaatcattgcagactaacacagaatttcaggagaagcttcgctccatccaagttgcgcctactgctttccctacctttcttgttcataatgatctcatctactacaaagggagtatctggattcctgatgacaatccctttattcctgctctgctccatgagttccattcaacaccattgggtggtcattttggtgttttgaagaccattcaccgcttacaggctaatttcacttggcccaacattcaccgcgatgttcgcaattacatcanaaactgccaaacct

SEQ ID NO: 76536 - DNA, 1698 bp, Glycine max
  Peptide Sequence Number=SeqID_193314
atgatgaagagagtgaacggagatggctcagttgactacagaggcgggcccgctcttaagaaggatactggcaattggagggcttgtccttttattctaggcaatgagtcttgtgaacatctggccttctatggaattgcgacaaatctagttaatcatcttaccaccaagctgcatgaaggaaacgtttctgctgcaagaaacgtcagcatctggcttggcacttcttatctcactcctatcattggagctgttctagcagatggttactggggtcgatactggacgattgctgttttctctgtgatttatttcattgggatgtgtaccttgacactttctgcatctttacctgcattgaagcctgctgaatgtttgggttctgtatgccctccagctacccctgcacaatatgctgtgttctactttggtctgtacgtgattgcgcttgggattggtggtataaagtcatgtgtgccatcttttggggcagatcaatttgatgatactgatccagtggaaaggattaggaagtggtcgtttttcaattggtattatttttctatctatctaggtgccattgtatcaagcagcatagttgtttggattcaagacaatgcaggatggggtcttggatttggcattcctactttgttgattgtattgtctatggcaagcttctttataggcacacctctctacaggtttcaaaaaccagggggaagtcctgttacaagaatgtgccaggttttgtgtgcgtctgtccggaagtggaatctggttgttcctgaggatagtagtctcctgtatgagacgccagacaagaggcctgcaattaaagggaatcataaactggtgcatagtgatgatctaaggtgtcttgatagagcagctatagtgtccgattcagagagtaaaagtggtgattattctaatccatggaaactttgcaccgtgacacaggtggaagaattgaaaatcttgatctgcatgtttccaatgtgggctactggggccgttttttctgctgtttatacccagatgtcaacattgtttgtggagcaaggaacagtgatgaacacacacattggctcctttgaaatacccccagcttccctggcaactgttgatgccataagtgtggttttgtgggctccagcctacgacagggtaattgttccctttacaaggaaattcacaggcaatgagaggggcatttcagtgctgcatagagtaagcattggctatttcatttcagtcctgtccatgttagcagctgctatcgtggagattatgcgtctgcggctcgcaagagagcttgatcttgttgatgaacctgttgctgtaccactcagtatactttggcaaatccctcagtacttcttattgggggcagcagaagtattcgcatatgtggggctgcttgagttcttctatgaccaatctccggatactatgaagacgttaggtattgcactgtcacctttgtattttgcattgggaaattacttgagctctttcattcttactatggtaacttacttcaccacacaaggtggaaagcttggttggattcctgataacttgaacaaaggtcatctcgattattttttcttgcttctagctggacttagcttcttaaatatgttggtgtactttgttgctgccaaaaggtacaagaagaggaagacgacttaa

SEQ ID NO: 76537 - DNA, 1092 bp, Glycine max
  Peptide Sequence Number=SeqID_193315
atggctgctccaagttccctattgaaggtggaggaaatacaaggaagagggaggggaatggttgcatctcagcctcttaaagctggtcaaagtgtcctcagagactctcccattctgcagtattcggctttgcccttgatcaggcagtccttgtcatcctcctcatctgcctcagcttcctgcttctgtgatcactgcttcaaaaccttgcctcctttacagggagattcttcatcatgcacagttttgtgccccaattgttgccaccattatttctgcagctcaaagtgtctttcaaaggcactgaacaactcccattcttcttgggtatgtcaagcattatctcatcttagagccaattctctactgcttgaacagccccttgagcgccaagtccaagctaattttctcattgctgcctacaatcttgccaatttctccccttcagactttcaaattatgctttctcttcagggttctcctgaggagtccaccattgctgcagctcagttcctacacccccttattagcccccggaatgaattttctttagaactcacttctgcacttcttgccaacgacaagctcaatgcctttggcataatgcagtccttctctgaacatgatgaccagagatttgattacattgacgctaatccacctgatgacggccataatactgactttattatttggatgattaatggtgttcctcaaggcagggagatttgtttgagttatttccctgtgaatgaaaactattctagtaggcagaagagattgattgaagactatggcttcacctgtaattgtgatcgatgtaatgtggagtcaaattggtcagataatggtagtgttgaagataatgctgaggatgaagaagaggaggttatggatgaggaccaatgtgaacctatggcagcatcagacactgacgatcatccccatgaagataataacgattttccacatgcttatttctttttaaaatacatgtgtgatagaacaaattgctggggaactttagctcctttatctccacagggtgtactccatctaatgtcatggaatgcaatgtctgtggcaaattga

SEQ ID NO: 76538 - DNA, 1746 bp, Glycine max
  Peptide Sequence Number=SeqID_193316
atgggttccattgatgatgatacaccgcttctggaagagggtctccttcaggatgatgaagggagtgagcaattcacaggagatggctcagttaactttagaagagagcctgctcttaagaagggtaccggcaattggagggcttgtccttttatcctaggcaatgagtgttgtgaacgtttggccttcttcggaattacaacaaatcttgttacctatcttaccaccaaattccatgaaggaaacgtttctgctgcaagaaacatcagcatctggcaaggcacttgttatctcactcctatcattggagctgttctagcagatggttactggggtcgatactggacaattgctgttttctctgcggggatgtgtactttgacactttctgcatctttaccagcattgaagcctgctgaatgtttgggttctgtatgtccttcagctactccagcacaatatgctgtgttatactttggtctgtacctgattgcgcttgggactggtggtgtgaaagcatgtgtgccatcttttggggcagatcaatttgatgacactgatcccaacgaaagggttaagaaagcgtcatttttcaattggtattacttttctatctacctaggtgccattgtgtcatgcagcttaattgtgtggattcaagacaatgctggatggggtcttggatttggcattcctgctttgtttatgggattatctactataagcttctttataggcacacatctatacaggtttcagaaacctgggggaagttcttatacaagaatggcccaggttttgtttgcatctgtccggaagtggaatctggttgtccctgaggatagtagtctcctgtatgagatgccagacaagaaatcaacaattaaagggagttgcaaactggtgcatagtgataatctaaggtgtcttgatagagcagctatagtgtccgattatgagagcaaaagtggtgactattctaatccatggagactttgcaccgtgacacaggtggaagaattgaaaagtttgattcacatgtttccaatttgggctactgggatcatttttgctgcggtttatgcccagatgtcaacgttgtttgtggagcaaggaacaatgatgaacacatgtattggttccttcaaactacccccagcttccctctcaatttttgatgtcataagtgtggttttgtgggtccctctctatgacaggataattgttccaatcttaaggaagttcacaggcaaagaaaggggcctctcaatgctgcaaagaatgggaattggccttttcatttcagtcctgtgcatgttagcagctgctgttgttgagattatgcgtctgcagcttgcaagagagcttgaccttgttgataaacctgttgatgtgccccttagtgtactttggcaaatccctcagtatttctttttaggggcagcagaagtattcacatttgtggggcagcttgagttcttatatgaccaatctccatatggtatgaagactttaggtactgcactgacacttctgaatttttcattgggaaattacttgagctctttcattcttactatggtaacttacttcaccacactagatggaaagcctggttggattccagataacttgaacaaaggtcatctcgattactttttcttgcttttagctggacttagcttcttaaatatgtctttgtacatagttgctgccaaaaggtacaagcagaagaaggcttgttaa

SEQ ID NO: 76539 - DNA, 1806 bp, Glycine max
  Peptide Sequence Number=SeqID_193317
atgggttccccagaaaatcaattgtcgctcgcagaagaggctcttcttcaggatgatgagagcaaacaatacacaggagatggatcggttgactttaaagggaggcctgttcttaagcggaatactggcaactggaaagcttgcccatttatcttaggcaacgagtgctgcgaacgtttggcgtactatggcattgcgacaaatcttgttacctatcttacccagaagctgcacgaaggaaatgtctctgctgctagaaatgtcaccacctggcaaggcacttgctatcttgcacctctcattggagctgttttggcagatgcttattggggacgatactggacaattgccattttctccaccatttatttcattggaatgggtacattgactctttctgcatcagttcctgccttgaagcctgcagagtgtttgggtcctgcatgtcctccagctactcctgcacaatatgctgtgttcttctttggtctctacctgattgctcttgggactggtggtataaaaccatgtgtgtcatcttttggggcagatcagtttgatgatactgatcccggggaaaggattaagaagggatcctttttcaactggttttacttttctatcaacataggagcccttgtttccagcacttttattgtttggattcaagaaaatgctggctggggtcttggatttggcattcctgctttatttatggcattagctatcggaagcttctttttaggcacacccctttacaggtttcaaaaaccagggggaagccctattacaagaatgtgccaggttgtggtagcatctgtccggaagcgaaatctggttgtccctgaggatagtagtctcctatatgagacgccagataagagctctgcaattgaaggaagtcggaaactagagcatagtgatgaactaaactttttcattcatggctcaactttgcacataattgtcccctattctgaattgtgtcttgatagagcagctgtagcatccgctgctgagagcaaaagtggtgattattctaacaagtggagactttgcacggtgacacaagtagaggagttgaaaatcttgattcgcatgtttccagtttgggctactgtgatcgtttttgctgctgtttatgcacagatgtcaacactgtttgtggaacaaggaacgatgatgaacacaaatgttggttccttcaagattcctcctgcttccctctcaagttttgatgtgataagtgttattgtctgggtccctgtctatgacaggattattgttcccattgcaaggaaatttacaggcaatgaaaggggcttttcagagttgcaaagaatgggaattggcctttttatttcagtcctgtgcatgtcagcagctgctatagtggagattgtgcgtctgcagcttgcgaaagagcatggccttgttgatgaacctgttcctgtaccacttaatatattttggcaaattcctcagtatttcttattgggggcagcagaagtattcacattcatcgggcagctggagttcttctatgaccaatctccagatgccatgcggagtttatgtagtgctttggcacttttgactacttcacttgggaattacttgagctctttcattctcactgtaatgacttacttcactacacaaggtggaaatcctggatggattccagataacttgaacaagggtcatcttgattacttcttctggcttttagctggacttagcttcttaaatatgtttgtgtacatagttgctgccaaaagatacaaggaaaagaagtctgcttaa

SEQ ID NO: 76540 - DNA, 249 bp, Glycine max
  Peptide Sequence Number=SeqID_193318
atgtattttgagtttattggcagtagtatacacatccattcctatgaggagatctctatgaggaagtttgcttccaatcaccttgatgcagatgatacaatacaatcagggaagaacttgatgccactaggagcatgtgtcactaggcttatagattgttcttcttgtatggagaagatgggaattggagctgaaggagagcctcttccagaagctgtgtatgaccttcaatctcatgtctctggttag

SEQ ID NO: 76541 - DNA, 260 bp, Glycine max
  Peptide Sequence Number=SeqID_193319
gtatctccgcgtatcatgggtgcagaatgaccaaacttggtctctgcgtgccaacggacacgactgtgtctgaatggcaaaaaggtgtggataaccgtaagaatgaccaaacttggtctctgcttgtcatcgggccggccgcgtctgaatggcaaaagggtgcggataaccgtaaggggtgcagaatgaccaaacttggtctctgcgtgccatcggacacgactatgtctgaatggcaaaggggtgcggataaccgtaag

SEQ ID NO: 76542 - DNA, 177 bp, Glycine max
  Peptide Sequence Number=SeqID_193320
atggcagccaaattgttagtaaaccatgctgttcgggcttggaaatataagtatggtttcaagatatggcaagagtatggtagaatcaaaaggaagaatgggatgctcttggagggttctccagagcgaactttgaatcatagattgcaatcacctcagtacctcaaggagggttga

SEQ ID NO: 76543 - DNA, 99 bp, Glycine max
  Peptide Sequence Number=SeqID_193321
atgggatttcagactcccatgggtgaagagcataaatgttctagtcagatcattgctcaatcagctaattcgacttggccaagagaagtgagcttctag

SEQ ID NO: 76544 - DNA, 555 bp, Glycine max
  Peptide Sequence Number=SeqID_193322
atggcgcagtcagctgatggcaaagtgtttaagattgttccatggcaccatctggagcatagcaccagcaactccctgagcatacgggccttaagccatgacttgactggttcagataggggtggctttgatcaaattgacaaggatgattccaacctacctctggatacagctcctattaagcatgtcacgcaggataaccaaaacatgtcctttccgtcgtgggagggaacctttatgaggtgcttcactgcaatagatgaaaagcttgctaagaacattgacactgatggatttcatggcggtagcacttctgtatctgtactcaaacagggtgagcaagtaataattggcaatgtgggggattctcgtgcagttctttgcagaagagcacctgacaatcaccttattcctgttcaacttactgttgacttgactccagatattccaagtattgttgacttgactccagatattccaaggagaagggcgtacatgaggaagaagcaagaaggatgtacacgaggaagaagcaggggtgtccagctggcatga

SEQ ID NO: 76545 - DNA, 318 bp, Glycine max
  Peptide Sequence Number=SeqID_193323
atgttatttgtggttctgcccggtggtgtggatagtgttgttagccttcactttgtggcgccgagccctgactcgagggggcgtgttgtcatggctgccattgatgattctaaccccttcattcttcattcttctgacaatcttggcattgccttagtttctcatcctttcatcgtgttctctgttgatgtggtgttgtggatgaattggcgtggagcggttgtgctcgtttatgccaccgcattgtggtacctcttcgagcgtgtcgattacaatttcttgtccttcgtcaccaaagtttttgccaaaaagctttga

SEQ ID NO: 76546 - DNA, 912 bp, Glycine max
  Peptide Sequence Number=SeqID_193324
atggaggggtcaggcgaagatgttgtgttgctggaccgcgcgtctcgagcgacgaggggaaagagattgacgaagctcctcgacgacgaaatccaagaagacgaattgttctggaaccaggacgctctcaaagaggacgaagaggacgataactaccaagaggagcccgaaatcgccgacgaattcgactccgacttcgaccaagacgagcccgtgcccgaggaagaagaagaccctaacaaaaatgacgatgatgaaaggatgcataaaaagaagcgacttatatttcctgggaagactctggcgaaaaagaagaaaaagaagaaaaccatatccaaattggagagttctccaaaggagaatgaggacgaggagcattccgggaaagttgtggaggacgagggtggggagagaatgatcaggaagtccactaggacttctgtcattgttcgccaagctgagagagatgccattcgtgcagccctccaagccaccatcaagccggtcaaaaggaagaaggaaggtgaggagaagaggatgacacaggaagagatgcttttagaagctgctcaaacagaaattatgaacttgcgaaatttagagcgtgttttggctagagaggaagaggttaagagaagagcaattgtgcataaaactgtttttaatggaccgcagatacggtatatttcaaaaaatggtacttcctatttagagtttattaaagggtcgtcatttcactcggacattcccacagcacctgtacaatatccagagcaacctgtttgcccgattactggtttgcctgccaatttggatgacacacaatgtgtgtgcaaattggaaatgcttgatagttttttcccctactatatcggagggtttttggttttggtctcctctaaaaatgcatag

SEQ ID NO: 76547 - DNA, 237 bp, Glycine max
  Peptide Sequence Number=SeqID_193325
atgagcccttacacgattgcagagccatgctgtgacatggtattctttctgaatgaaagtactaacagtagaaaggacatgagcatgggaggcttatatgattcagtttctggatgtggtttttcaattaagcgaaagagatcgataatgccagataaaaatgtcaacccagatggtcggtccttagctcgttttcgtagaattccggattttgaggatgaagattattctgactag

SEQ ID NO: 76548 - DNA, 210 bp, Glycine max
  Peptide Sequence Number=SeqID_193326
atggatttagtgaccaaggatgagcaccggaaagctcatatttatgcgtgtaaagctgatcttccagggcaaaaggaggaggaagcgagggcgcagtcagctgatggcaaagtgtttaagattgttccatggcaccatctggagcatagcaccagcaactccctgagcatacaggccttaagccatgacttgactggtttagataggtaa

SEQ ID NO: 76549 - DNA, 201 bp, Glycine max
  Peptide Sequence Number=SeqID_193327
atgaccgccagcaaagggaaaacccattttgaagtggttcttcctttggaattgccattcaaggtcgctcccgactggcgatgtcccaccccacataaacaaagaggaaaagaccgaaacacccagcttcctctccaaaaacactaccctcgagaaaatcctattgatcctgatcgcgcatgtaatcttttggttcgataa

SEQ ID NO: 76550 - DNA, 675 bp, Glycine max
  Peptide Sequence Number=SeqID_193328
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggaagagccgacatcgaaggatcaaaaagcaacgtcgctatgaacgcttggctgtcacaagccagttatccctgtggtaacttttctgacacctctcgcttcgaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataa

SEQ ID NO: 76551 - DNA, 354 bp, Glycine max
  Peptide Sequence Number=SeqID_193329
atggcctttgatagtagcaatccaagttgttcccagggctcactcccaatatacggcagtaccttaggtagaactcgatccgacttttcaacccgagtatccggcttgtatcggcattcaattctgccgttgattatgttggtgatcacaccgtatccggggaccagccccgctgacttgtcaatatcagatggcgtccattttccagtaataacgtcatggcatgatggcttgtttccctgcggagtcatccaaaaccacaacgctgtcttgaatgacacttctacatttgtggctactaggtctggattgtttagcaaatctacaccaagtgctgtaccagcttgcccgtaa

SEQ ID NO: 76552 - DNA, 1005 bp, Glycine max
  Peptide Sequence Number=SeqID_193330
atggaactggaggccaggcctctagctccgacaagtgaggaagatcctgctagttggtgcactaagaaagtgaagacacgagatagtgaggctgtagtgatagaaaccttgaaggtggaggaggagatgtatgtctcaccaaaagcttcgtataaagaaaagcttctgagtatgtcaggagtcaaaggaacaactccaggtttggagacaacagtgccagggaagattgatttccagagtgtgaaaacgaatagctcaaataaacagggcttgcagggccctgaagtgagcttccgattcttggaagcaaaactccaacgtagttggacaaagaacaacactatcaagattcttgatatgcttgatgactactacgtgattcacttctccaaccaagatgattataatcatgcctttttcgaaggtccatgcattagaacaatgcttaaagtcgacctgatgacatctattcattcaagagagacatttgcgagattgtgtgtggagcttgatctgagcaaaccttttactacacatattatgataaggggttatcccctttatttggaatatgaagagaagactaagggaagccccgataatgagagtgcagacagtgatgatgttcccaagggcaaccgagtggtgaacgaagagaagagtaaggaaacgaaggtggagccttcggtagggtacgagccatggatgatcatcaaaaggaaacctaggaagaaggtagataggcatgagacacaaaaggggattactgccaacaacaaaaaagagtcagacaaaaggaaggatagtcctctcattcagaaaggaaatcctcggatggatcgagtcaaaaatgcattgggagggaaaaatcctcagcttaatggagggaaaagttctcaggaggaggaaaaatctcctagtagtgggaggaaagtcaactccaaggtgttgcctaataataaaggtgtagcaccatcgggtgctgggtcaccattgaaagctaag

SEQ ID NO: 76553 - DNA, 444 bp, Glycine max
  Peptide Sequence Number=SeqID_193331
atggggaaaaataagggtcgtcaatcgcactcagctgcaaagaaaattatggtgaagggtactacctcaggttcaggcaaggtgctcgtaaaaaaggcagggacaagttatgcaaaaactgatgatgtcacacaccaagtgtttgataatttttcagaatgcagtgctgattttgaatctttcccaaaggtttcttgcactttaggggacaatgattcaactactgatgatgattcatctcactcctatggctctaagtcatcaccgcagctagacgataataaggctcccactccttgggtcaatctgttcaaagataacagaaacccttccaaaggttttggaatgaagttctcctctccaccctctgatgatgaagtgttgttggaagaaactgatttgcaacccctgggagaggcttggggacatagccttattggctat

SEQ ID NO: 76554 - DNA, 294 bp, Glycine max
  Peptide Sequence Number=SeqID_193332
atggttccttgctggtctgctattagctaccacctttgtagtgttgttattgctatcaatacccccttatggaagatcaaccttgtccgcaaggttgtaagtgaggcggaggtgatcccaaagctcctaagaagtgtcttctggggtgagggtgtatcttggagccaggacgcagatgtagttgatacgcgactgggacgacacacgcttctacaaggtaaggcccgtagtacctctttgagagtttggagtaagaaggctgcagagaggtctggcgataaggccggagtttaa

SEQ ID NO: 76555 - DNA, 1137 bp, Glycine max
  Peptide Sequence Number=SeqID_193333
atggtgtcgtctcaaggagtggccccagaccccaacaaaatccaggccatgctggattggcctactccatcctccccctcagatttgtgtggttttctaggcttaaccagtttttaccggaaattcatttgccactatgcagccattacaacaccattaactgtgctcctgtggaaagaacaattctcctggtcaccatccgctcagactgcgtttgaccaattgaagctgataatgacgcaagccttggtgttggcgacgtcggacttcaccattcccttcaccattgaatcctatgcttccagcaccgcgatgggcacagtgttgttacaaaactctcgcccaatcgctttcttcagcaagccattatgtccatggcttcaatgggcctccatatacgtccgagagcttcatgctattacgtcctccattcgtaaatggcatcactaccttctggggcattcattcatcattttgactgatcaccggagcttaaaggagctcatgtggcaaactctgtttcaacagattctttcggattcagcttcccacccaggtttcactattaacaatggtctcctactcttcgaagggaaaatatggttacctttgggccacacctttattaatctagtcatggaggaattccacaaaacccctttgggaggacatatgggtgtcacgaaaacacttcgtcgtctgcggtacaatttcttttggccccatatgtgccaagatattacacgttatgtggcccaatgctccacctgtcaacagatgaaatacgaggctaagaaaccggtgggtctgctacacccacttccaattccatccgctatttgggaagatttatccctagatttcaccactgggttgcccatatctaatggttacactatgatcatggtggttgtcgacagatattccaaaggcacccatcttggccatcttccatcgcacttcacggcacacaagaatggtcctatgacacatctgtgcattctggcacaagattttctcccttcgaagtcatttatgcattcgactctccagcacaggctacttaaatctcagaatgcgatgaagactcaagctgatgctcaccattgggatgtccaatttgacgtcggtgactag

SEQ ID NO: 76556 - DNA, 351 bp, Glycine max
  Peptide Sequence Number=SeqID_193334
atggccgagaacccatttctcatcacaatgatagcacaggcccttgtctcatcgagtggccaactcttccgtcgaaaggtgtttaatcgagggtttcgggtttggagggaaggtagtggtagggacaggagaagaagggttgggccgataatggcgacgacgctacgacctgcagaagggataggggttgaaacgcctgcacttcgcggtggagttcggggtagatcggagatgaaacaactcagcaaggagggtggagctaggctaactatgcggtttgcgaggcatttgaactcggtgagatactcattcacggagctgtgctgttggagcttgaataaagtgcactaa

SEQ ID NO: 76557 - DNA, 348 bp, Glycine max
  Peptide Sequence Number=SeqID_193335
atggccttggcatccaagggagatcatgccttaaatggtctatatacaagaatcaatacaagacacatattagagacaagcaagatggtcgaagaatactctggtatgcatttacaacctcacaagcctcttgttggagctaatgcatttgtccatgcaagtggcattcatcaggatggaatgcttaaacataaaggtacatatgaaacaatatctcctgaggaaattggacataaaagaaccaccagaattggtattgtgctagggaagcttaggtatgcaaattacttttttctcaaatatgcttatgttagaaaaagcatgactatcaatataagaggaaggtga

SEQ ID NO: 76558 - DNA, 171 bp, Glycine max
  Peptide Sequence Number=SeqID_193336
atgtatttcaagacttttagtgaatgcgaggtttatatggtgggatgcgtgaaaattcggtcaatgagagtgaatgatgtggagccaaaccaaaacataaaggaagggaaagggcattgcagttttctaagagggttttcgcacaattatcttagaatgacaaccttctaa

SEQ ID NO: 76559 - DNA, 225 bp, Glycine max
  Peptide Sequence Number=SeqID_193337
atggctggttgtggcaaaaccctagggtccaacactgccaaaaaggccacctcaaggagtagcaaagccggcctccaattccccgtcgacctatcgcctgtttcctcgaggccggaaaatatatcgagcgtgttggcgtcggtgctcccgcttacctcgccactatcctcgaatatctcacagccgagttttggagttggttggaaacgctgcaagagacaataa

SEQ ID NO: 76560 - DNA, 216 bp, Glycine max
  Peptide Sequence Number=SeqID_193338
atggatacacgatgtgatcagaggcgtagatcacttccttgggtatactgttttgagtattgcaaaagacaaagtcccatgttgcttgggatagctttggctcaagtgtttatataccattttgtgatatggactttcaaagtggctaccaggagatggaagtctcatgcacatgagcatgagttgtgtgggtttgtcatagtgcaaatccactaa

SEQ ID NO: 76561 - DNA, 321 bp, Glycine max
  Peptide Sequence Number=SeqID_193339
atgggccactccaaaatattaccaccattgataatgaaagaaatagcaccaagaagtgaaattgaattgaagaataacctaaagccttttcactatgtttaccaatcaacaacctcttacgtagagggaactaaagccataggttcatatctacatatccttactgaagatgatcttcctcatgcccacaagattcacaatgttgttttagatgtgaatgatggcggtgtcaaagatagagtgccagaggtggaggagcttcgacatcatgccaatgatcttcaatgtcaaatcactgacattttatttggacttgaatga

SEQ ID NO: 76562 - DNA, 531 bp, Glycine max
  Peptide Sequence Number=SeqID_193340
atggaggaatccactcgctctaaatccaacctcgattgtttggaggatgcgatagccaagctcgctgtgactcaagcatcaatgtcaaccaagctcaatgaccttcatcagaaactagtggttatggagtccactcaccattcttcggtctcgtcttccacacactcccccggttcttccgtctctctgtccatgcaaccatattgcatgaaactcgaagttccatgttttgatgggtctgacccaatgggttggttattcaaaatcaatcagttctttaaatatcatgcaacgccggaccataagcgcttaacaattgccttgttctacatggacgaacctgcgctcgtgtggtatcaatggatgtcatgcaatggccagattacatcatggcctggattcctgcaagctctggagtctctctttgcgccctctcactttgatgatcccaccggttccctgttcaaactcatccagcaagattccgtgagtgactactcttttacttcgaggctttggctaacaaaataa

SEQ ID NO: 76563 - DNA, 102 bp, Glycine max
  Peptide Sequence Number=SeqID_193341
atgaagcaaaatcttgaaaatgaagtgaagcgccaaattgtacgcatattggaagaactgtcaacctctgaatcacctacaaactcaagtgctcaggattga

SEQ ID NO: 76564 - DNA, 459 bp, Glycine max
  Peptide Sequence Number=SeqID_193342
atgaagcttggagagacttgtaaaagaataattgagttgagtggatctagagagaggcgagaagacttacatgaagaggcgatcatatatactttcataaagagatcagatagagaatttctctatgaaattcttggagtagttattgaagccggggcaacaacagtgaacatagccgacactgtaggtatagtaatgccattggagttaggaaaattaattgttgatataaaagacaataccccaggaattgcgaatgttattatttcgactcattgccataatgatcttgggcttgctacggctaacaccatcgagggtgctcgtacaggtgcacggcaattagaagtaaccattaatgggattggggaaagggctggaaatgcgtcgttagaagagttttatatttcttttccaatatcacttcacaataagcctatacctattcaaactttctga

SEQ ID NO: 76565 - DNA, 570 bp, Glycine max
  Peptide Sequence Number=SeqID_193343
atgccaccaactaaagcttttccggttgcacaggaacctgatgatccacttccaactcaaattagcttccatgccatctcagggcacatggcaccagaaacgttacgcgtgatggggtctatctctgaccagaaagtcctcattttggtggacagaggtagtactcataacttcatccaagaacgcttggtcaccatgctagggccatatgcacagtctactccaccattacacattatgattggtaatgacttgactatgaaattcaagcaccacaacaagatcatcgaacttcacagtgaacgtgattacaccatttgcgggatcaatcactatcaactcaaagggatggttcaaatagatggcgtcaatgcttttttccatatcgaccgcatgaaccctaagctcccttctaaccaacaaacacaacccctgacccaagacccaaccatcatttccctacttcaccgataccatatccttttccaaccaccaaccactttacccctaccccgcaatattacccacaccattaaccttctcccaaactcccttcccattaacgtctga

SEQ ID NO: 76566 - DNA, 219 bp, Glycine max
  Peptide Sequence Number=SeqID_193344
atggttcaactggcaaccatcctagttagaggagctggcattaaccttactaggagtggaagtataagggaagttagagttgaatcatgggctatactagggaagtcaaagatagttgaatcaactacaaggaaaaaatgtttcatggttataaggatcaatacatcttttggtagtaggaagcgcaaagattttgtttgtgcaacttggatgccataa

SEQ ID NO: 76567 - DNA, 518 bp, Glycine max
  Peptide Sequence Number=SeqID_193345
gagggtgggcaagtgcaccagatggtccatacgcgtggggatattgttttatcaacgaacgcaaccaggcagattattgtactagcggcacccgatggccttgtgctcctggtaaaaagtattatggccgaggaccaatccaactcacacacaactacaattacgggctagcaggagaacaacttaatctaaatttgctaaacgacccggatctagtatccagagacccaattgtggcattcagaacagccatatggttttggatgaccgcacagggaaacaagccatcaagccatagtgtgattattggaacatggaacccatctagtgctgactggcaagcgggtcgggtccccggatacggtgtgatcaccaacataatcaatggcgggctcgaatgcggacggggcccggattctcgggtccaaagtcggatcgggttctacgaaaggtactgccaaatctttggagtgagccccgggaacaacttggattgcaacaatcaaaggccattttaa

SEQ ID NO: 76568 - DNA, 204 bp, Glycine max
  Peptide Sequence Number=SeqID_193346
atgggaggagggcttcctgctatggtggaaagggagaaatttgatcatatagaggaaaggttgagggtcattgaaggaggcgaaaattatgcttttgttgacatggcagagttgtgccaagtgcccgacgtggtcattcctctgaagttcaaggtgacggattttgataagtacaaggggactacttgccccaagatcacttga

SEQ ID NO: 76569 - DNA, 727 bp, Glycine max
  Peptide Sequence Number=SeqID_193347
atggctgaggcagttggtggtgcattcctctctgctttccttgatgttgtgttcgacaagctgtctacagatgaggttgttgacttcatccgtggaaagaagcttgacctcaatttgcttgagaacttgaagaccactctgagagtggttggagctgtgcttgatgatgctgagaagaaacaaatcaaactctccagtgtcaaccagtggctcattgaggtcaaagatgctctctatgaggccgatgacttgctggatgaaatttctaccaaatctgcaactcaaaagaaggtaagtaaagtgctttctcgctttactgataggaaaatggccagtaagttggaaaaaatagttgacaaattagataaagttttaggaggcatgaagggtcttcctttgcaagtgatggcaggggagatgaacgagtcatggaatactcagccaacgacatcactggaagatggatatggcatgtatggtagggatacagacaaggagggcataatgaagttgttgttgtcagatgatagcagtgatggtgtactagtgtctgtgatcgctattgtaggcatgggtggggttggaaaaaccactttagcccgatctgtgttcaacaatgacaatttgaagcagatgtttgatttaaatgcatgggtttgtgtttctgatcaatttgatattgttaaggtcacaaaaactatgatagagcaaatcacgcaagagtcat

SEQ ID NO: 76570 - DNA, 159 bp, Glycine max
  Peptide Sequence Number=SeqID_193348
atgggcacagctagaatttctgcacaagccaagaaatgcaaaatgaaaatggaaacagacagcttgcaacatccatggcctcaaaaagaagttcaaccaactgtgctgagtggtaacagtaacaagtgcaatcacaggcaagatttttcacctgaataa

SEQ ID NO: 76571 - DNA, 381 bp, Glycine max
  Peptide Sequence Number=SeqID_193349
atgcctttgttggaactaagtcaccagccaccacatttccagaagcatgtgcctgcaatccctacccccccatactttcaccatccctccactaggtgcctgttgacaactccccgttctccacctaaacttcaaatggaggggtggggttcaaagtacaaagaaactagtgctctgatatcaagttatatagtcatagttccagggttagagaagaagggaaatgagaaaggcagattaaaacccttggctttcttctctacggtggaaggtgattgtctatttcaattttcaactgcatcttttgtaattggattgtggaatggaattaatgcatctgggttaagaatagcactaagtttggaattttgccttgtctga

SEQ ID NO: 76572 - DNA, 688 bp, Glycine max
  Peptide Sequence Number=SeqID_193350
atggaaattgaccaaaaaaacgtggccctagatatgcaccggaatgtccttgtagacctagtgacattggagttcattgccattgccaacaatgatgctaggtatccgggtccgctagtggatcaggcactaaagagggaaatgagcctttgggaagtgcttgatggggatgaggggtggtttgctaggaaaaataaagggagagttccaaagggacaaggaataagttgtgtttacgcgaggcaacaggggtcccgtggagacgagccagggaagcctcctgagttagcattagaggttgcaaggcttgtacctcgtggcgaatctcaacgaaagttgggtgttatgagacatccattgaaaccaagccaatgtcgggccatccatgtagaaggaggtgatggtcaatcgttcatggtccgaagtagagtgatagtaaaaaaactgggtgatcttaaagatccaacccatggggtcagtgtcgtcgaagcgaggggaaggttgattcgtctccaattgtgccatgcagtggagaaggtcgttgatctttgtagacatgttgatctgggaggaggtgagtctagcaatgttgtcttcgatttggtccatgttggacttcgagcaagttctgaaccagaacctttccttagaactcgaggactaaggtcacctccagaaatgggagaag

SEQ ID NO: 76573 - DNA, 765 bp, Glycine max
  Peptide Sequence Number=SeqID_193351
atgggtgaaatggtattagaattgaacagtggaacattgggtgaatacgagagtgttctagcaattgaagtttataggctacccttccaattcgatcttccacctgaaatggtctataaaagcgtttggacagttttgagtgagattggcttggaagcaaatacagattcacgatgtatgagtagatcatctactgcctcaaagttggaggtgcttgtaatgtattgtgggatattaggaggtttcttgccaaaggttacctcgaatgatgaaagattggtcccagaatggcatgaggcggaatctgctaatgaagagtgggtcacgatcagagatgatgctacgaggcatgccatggtgcttgggccagaaatgaaatccatgaacaaatattcccaaggtgtcgatggtactggatatgatgttggtttagacttgacggttttctggagaacgagaaattcagagtttgcggctaactccttcttcaattcatcaagaaaggcttcgatgattgatgaggacgatgaagcggtggcccaacagatattgatgccacttcttaacccccatggtgatggtggtgagttcctaaacatagcatctgtttcgaccacgaatggaatggtgaagttgggtagagttaggactagtgccttgctgatggcatccttgagagtttggaaagcaaggtccgcctctagtggccatctgaacttctcctgtgtgaagaggttcatcaatggcactgctatggctgcatag

SEQ ID NO: 76574 - DNA, 807 bp, Glycine max
  Peptide Sequence Number=SeqID_193352
atgtgggccgaatggtcctacaatacctcatgccattctgggaccaatctttcatcattcgaggtaacctttggcaagaaacctcctaatatcccacaatacattacaagcacctccaactttgaggcagtagatgatctactcatacatcgtgaatctgtatttgcttccctatgcaagaaactattgaaagcacagattcacatgaagaaagtggcagatggccataagaaggataaggaatttcaaattggtgactgggtgatggtgaagttgaggccacaccgacaagcctcagctacaagccaatctcactcaaaactgtccaaacgcttttatagaccatttcaggtggaagatcgaattggaagggtagcctataaacttcaattgctagaacactctcgtattcacccaatgttccactgttcaattctaataccatttcacccatcttcttcgatgatcccgaaaccagtagcattaccaacttcagcaatggataaccaacttgagatttgccccttagctttcctggagacacggtgggactctacaccctctgggccgaaacaacaggtcctagttcaatgggttgggttagctctagaggacacctcatgggaggattggtctgacttaagggccacttaccaccttgagaacaaggtgttgccagatgcgcacgggaatgttatggcaaaagccaaggagatgcaagtagaagagaatgggccagaagaaattacaaatgacaagcccaagaggaagcattgtcccccttcgtacctgaaggattatgagtag

SEQ ID NO: 76575 - DNA, 2130 bp, Glycine max
  Peptide Sequence Number=SeqID_193353
atggcggtgcaaatccagtattttactgtcatgctgtgtttttttggtgccgtacaaatcaagtattttactgtcgtgccgtgtttttttgttgctgtacaaatcaagtattttactggaaatgaatgcgagtaccgccacagcgagtatgcacgtgttaatcctagggactgtcggtattggttgagtggcaattgcttgaatcccaaatgtccatttcgtcatccgcctcttgatggcttgttaggaacacaggcagcagtgactggtggaccatctgtatccccatcacagattccaacagcatctgcaacacatgcaccgtataattccagtaaacaagctgtaccttgctttttcttccaaaaaggactttgcttaaaaggtgacagatgtgccttcttgcatggaccacccactcctacttctagcacgggtaataaagtagctgctcaggttccagtgactagccaaggagttgagaatccatgttttaagaagccttttgtcagcaatgaaaagtatactcaggaaaggaaaacttcccaaggaaatgttgcaaagtcaagtggaatttctgaagccaaacctgcctcaaaaattgaaactgctcctcaaagaaatatgtttgaatgggagaagaaagtgccaccaccagctgtgggatttgataatgaggtttctagatttaagacaacctctccaccagtgaccaatggccctactgtagcccggccaaaccgtctgcatcaagctcgtgtgccagatgatcacaatttccagagtggcaaggacagtgatgagtttctcagagaatcatctcctgggtttgatgttcttgtagctgatgaacttaggaattctgattactaccacggagaagatgaattcagtaaagcaagaggtcaagatgaaaggaacttagactctttgaatgaatatgatttaggacattctggtgattatagtttagcagctgatatcgatcgtgaaagattccgtgtgcctcaaggttatgagtcatatgatcacttgcaggagccgtatgcttgggagcagcatagaaagccctcagcccatgtagacagaaggactcgccgcagatccaacagtcctgaaaatgctgaggtctcagatctacgacatcatttatccaagcgcaggaagggcaatggtttgaagtctgttgtcggtcatgattatgcccatgagggccatggtgaggaacaaagtcgtcggcccttctctcggaaggattcacttgagttacctctgaatgagagcttcctcggtaaccgcttccgaggtagaataaaacttccagcaaatggtggtgctgatcacctagagagggaagacaggggaagatttaggaacagattgtcatctggaaggttgccggccactcaccatttgtcacctggagagggaagggtccatgacagaataagaggaagattgcaagatgatgagaggagaaactccaaggatcgattgatggggagagaactaccgggtgataggagtgattttgctgggccaaaaagtctttctgaacttaaaaatgggaggaacactgagaatagggagcaacaatcactgggaaggagaagaagtttaagggatgatcgcccacaatctgaagatgattttctgtttgaaggtccaaaacctcttagtgaaattctgaaggagaagagaggtgctggagctgatgcagactctgggaatggcaaatcatctgacaataagaatcaagaagttaccaatggccagaatcctacacctgctgcaaacacacaaaatggagtgctgtctgagaccaaagaagatgtcaagaatcttccaccaaataatgaagaatcatccaagcttgaggtcactgatgcagctggaggagacaatgatggtgaatatgaggagggaatggtgtacgatgaagcaggtgaggatcagtattatgaaggtgatgatcagagagatgcggactatgagtatgaacaaggtgaaggtgatgagggatactatgagtacgagcaaggtgaagagggtgaaaatcaagaggaagattacatggaagaagaagatggggatgattttgctaagaagattggtgtcgttcattcgtaa

SEQ ID NO: 76576 - DNA, 204 bp, Glycine max
  Peptide Sequence Number=SeqID_193354
atgaagcttgctggacctgaaagggagaggcaactatcagatacagatgtccaatcagctgtgtgggaggtctgtggtgattctggagctttacaattgcttgttgatcttcttcatgtgaattatgaaaccaaatcaagtttagaatctttagatgcagaccttagttgcctcaacaagctcgactggttgtggcaggaataa

SEQ ID NO: 76577 - DNA, 309 bp, Glycine max
  Peptide Sequence Number=SeqID_193355
atgctgcaacgctttcctgtggaatccaaaggtcgacgcaagaagctacaagaggttggctatgtgactaccatatgcttttcatgcttccttatcagatgtgttatgatgtgctttaatgcatttgataaagccgccgaccttgatgtcttggaccatcccattctgaattttatatattacctggtctattgggtttatatggttaatcttgcttttgtggaaatattgccttctactttggtccttttcattttgaggaagcttcctcccaagcgtggtatcacacaatatcacccgatacgctga

SEQ ID NO: 76578 - DNA, 273 bp, Glycine max
  Peptide Sequence Number=SeqID_193356
atgatctctatcatgattactgtcgttgtcattaacatgagcgtcgatgtcaccgtcaacagtaatgacagtgacaatcatgttgatggcgatgacagtggtcatggtagctattaccatggtggtggtgacgacggtgacaatcatgatgatagttgcaacagaaaagaaggtcatgatagtggaggtggtgacaacgacaacgacaatcatggtggtggctataatggtggtcatggtggtgataatgacagttatggtgatgataaatga

SEQ ID NO: 76579 - DNA, 120 bp, Glycine max
  Peptide Sequence Number=SeqID_193357
atggataccgtggagatccacgcagacctcatttttcagggtggtcctggtggagggcctgattttggtcgtggttccgatggttatggtacaccaattagtccaaacattccttcttaa

SEQ ID NO: 76580 - DNA, 783 bp, Glycine max
  Peptide Sequence Number=SeqID_193358
atgaagttgagcacaaatggaggaaatgtccctgcgcaattgctggttcttgatggaaaaaattgggaacggtggcatattcaaatgaaggcattgtttgaatttcaagacgtgatggaggtagtgaagaatggcgtagcggcggaaccaacagaacccgctactgaggcggtgaggaatgcatacaaggatagcaagaagaaggatgcgaaggaaatattctttctgcatcagagtgtagatgatgcgaatttcaatctgatctcgaaggcgaccttagcgaagcaggcctgggataaacttgagaaatgttatgctggtggagatcgaatcaagaaggtgaaacttcaagtgttgcagcgacagtttgactcaatgacgatggaagagaatgagaagattgctgacttctttgcacgagtaaaggtagtcaccaatcagatggctacacaaggtgagactctaactgatggaaaaatttgtgagaaaattactcgatctctactggaaaaatatgattatatagtatgtgcaattgaggaatccaaggaagtaagtgaaatgagtttagaagaattgcaaagttcactagaagctagagaacttagattgctagagagaaataagaagaaaattgctgagcaagccttattggctcaatctagtaacaagaattctggcgacagtaacagaggaagaagtggttttagaggaagaggtcgtggtaggaacaatagaggaagaagtggctatgtttctagtagtggaagaggccagaataat

SEQ ID NO: 76581 - DNA, 468 bp, Glycine max
  Peptide Sequence Number=SeqID_193359
atcatggttaggactagaggattaggtcatgccttaggtcacgttactagcagagtgcacgatgagtcagtacttcctgcaccagatgtagaggctgacgtattttcggatgacccgatggcaccagctgatgtaaaggacactggggaagacattcctacagacacgggcgctcaggctactaacgatgagcatgagggattttcgggtggtccgggcgacccatccgtgctgacccagtatgcggatcacattgcttgcagcgagcgtcctgagttgaagttatcctctcacgggaggaaggtccatagtttaggcaggcctgtccttgccattgagggagtagttgctgggataggactaagtcctctgatcgcatgtgacgatcacgctagacaacgtctcatcacttctgcatttgcccgtggttggcaacttgcacgcctttcaacccttgcacgtggatga

SEQ ID NO: 76582 - DNA, 1206 bp, Glycine max
  Peptide Sequence Number=SeqID_193360
atggattacgagaggatccaaaagcctcagggtgttgggggattttcgcctggaaaattgaggagcatgctactgggtgtggagaagaagagaaaagaagaggaagagcttgattctactttgaccacgagatctcagaattcagacatggatgaatctgctagtagcatagaggcagttggtggtgatcgttttgtgaaggccaatgcagcagtgaattcaaggaatagagtcttagaagacccttcttcagattatgatagtgggcacgataatatgagcatgtcctcatcaatgttcgaatttcaaaaggcggagcgtgccccacagagggtgcccgtggggccattctcaaaaccagcaccatctaaatgggatgatgcacagaagtggatagcaagtccaacttcaaacaggccaaagacagcgcagacccaggggcaaggtgggcatgcaggaccgcgtaaggctggtagtcttggttatggaagccggcaatcttcgatgaaggttgttgttgaagttccagatcaaaaagaaattgctttagatgaaccagataccaagaaaattgatacaaatcaaactaagatggatagtggaggacagaaatttgtgagttgggaggctgatccctatgcaattgcaagtttttgtgctcggtctgtgtcaatgagagatatgggtaccgaaatgacccctattgctagccaggagccatcaagaacaggtaccccagtgagggcaacaacaccaatgcgcagccctaattcttcccggccttctactccccccagagcctcccctgcatctactttaactgatctacatagtgacaatctgaatctcaacatgaatgagttgtccgaaaaggagctacaaatgaaaacaaggcgagaaataatggttctcgggacacaactaggtaaaatgaacattgctgcctgggctagcaaagaagaggaggataaggatgcatccacttccctgaaaacaaaagcagaattacctaagagtgtcgttgaagcacgtgcagcagcatgggaggaggctgagaaggccaagtacatggccaggtttaggcgtgaggagatgaaaattcaagcatgggaaaatcaccagaaagcaaaaacagaagccaagatgagaaaaattgagaatctgagtcagcctaacaatggcaacacaatgtctgcttggagatga

SEQ ID NO: 76583 - DNA, 284 bp, Glycine max
  Peptide Sequence Number=SeqID_193361
atggacccagagaagtccaatagggtcttggggtttccagctttgattacgggcctttgtcaattctacggagtgcccgtcgcccccatcaaggtcatcaagccccctattaactgggctttcatcaagaagtactacgccccctgggcaggcgcagggcgagacaccatagcagcctggggatggccggcagcgggcaatagatgcatcgccgcaacctccagagcccctcagttcatctacaaaggttggagagttgcctacaacccgtggccgactagcag

SEQ ID NO: 76584 - DNA, 546 bp, Glycine max
  Peptide Sequence Number=SeqID_193362
atgcatatccaaggtatttttgcttacctttggctttggacttggtcacctgctagtcggccacgggttgtaggcaactctccaacctttgtagatgaactgaggggctctggaggttgcggcgatgcatctattgcccgctgccggccatccccaggctgctatggtgtctcgccctgcgcctgcccagggggcgtagtacttcttgatgaaagcccagttaatagggggcttgatgaccttgatgggggcgacgggcactccgtagaattgacaaaggcccgtaatcaaagctggaaaccccaagaccctattggacttctctgggtccattggatgtcttgtaggcgcgatcccgggggagatcaacattatggtcacttggtgaaatcttgccccgatatgcatagtagctgcacgatagcctccctctctggttgtgctcgcacagttggccgccctccaatatcagggggtggcccaggaactggtaaaataaaactactagccgctaacccaggagcgctggcctcgattaagcattaa

SEQ ID NO: 76585 - DNA, 242 bp, Glycine max
  misc_feature (37)..(37): n is a, c, g, or t
  misc_feature (148)..(148): n is a, c, g, or t
  Peptide Sequence Number=SeqID_193363
ataatagaacaaaaaaagaattgactgctggagccgntatgagtcaggaattctcaagtacggttctaaggaaaggaattgactcacctattccgaccgaggagaacaggccattcgacagggagactcggaagttgcggagtcttgngtttaatcaagccgctgatattgggacaagctatagccctacccctggtaattatattgagcccagaattgttgaagatcacaggacgttttga

SEQ ID NO: 76586 - DNA, 723 bp, Glycine max
  Peptide Sequence Number=SeqID_193364
atgttgctttttgcgcgcaacatcggtagcagggcctcactccgagtaagctccttccattcctcaccccttcaaaatccttttccccttttcttcactccttcatccctctcctctcaaaattcaatttttgctcgccccatgatttggttcgccagttttctgtgtgttatgagatacccctttgtctcaaaaccttcttttgatgacattgcttccgaatcaatgcgtagtttcttgcagcaggaccgtccccacttgtttgattcagcattggtacccatttgggtgtctaaggatttgcttaatctgaaaggggaccctaaatcagccctgaagttcttcaaggaggcaggggctcgagccgggctttcaaaatcaagcaaaggggaattggcattaagccttttcaaggacatggttgtggctggcctttcgccctcagtttttacgtataatatagtgataggctgtctggccagagaagggggcatagaaactgccaggagtttatttgaagaaatgaaagctctgggtcttaggccagacattgtcacctataatcctctcatttatgggtatggaaaggtagggatgttaactggagcagtcactgtgtttgaggaaatgaaagatgcaggatgtgaaccagatgtgataacatacaattctcttattaatttgaaagaattcctcaagcttttgagtatctgcatgagatga

SEQ ID NO: 76587 - DNA, 1020 bp, Glycine max
  Peptide Sequence Number=SeqID_193365
atgggtgctagggttcccgtgcagcactacaatctcaactccccctcttccttcatcgagagccctctccacgtcctcaacgccgtcgacgcccgaaccgccgcctccgccatcgacaaccccaacgacgattccgcctccgccgtcgattgcatgaatgaatcgcataggagctgtttgccgcttcacagtgtggaggtagacgaggatcgcgctagtctagacactaacgagtcttctagaactacctcttatgatatcttgaccgctgaggatatttcgccaattgaatcagcaagggcaaggtttttgcaaattatcgtggatcattttattgatgaccgtgtgattgaggtgcctgattctgaggctgattacactggccaagacaaaatgagtaagaggaggacaagagagatccagtatgaaggagacccaaatttcactctgcctttgatgtatgtggcaaatatgtatgaaagtttagttagtgatgtgaataataggcttgcttccttgaatggtattcgggagaagacaataggggtagcccttgaagctgctggtggtttgtatagaagactggctaagaaatttcctaaaaaaggaccatgtacatttaagagaagagaattggcgacttctatggaaacgaggacaaggttcccagaactagttatacaagaagagaaacgtgttcgctttgtggtagttaatggattaagaattgttgaaaaaccaaataacatgccaattgatgacgctgagtggtttaagagattaacaggtcgcagtgaagttgctatctcagccagtgattacaaattttactctccaagacacaagtataggcgtggtgcatcgatttcactttcaaatatccaagatatccctagttatcctggagcagaaaattcaactgcattggctactcctcaaggatttcactcaaaatctagtatccaatcacaaagaatagggaaaaattccctgaatacagctaaaattttgcataactga

SEQ ID NO: 76588 - DNA, 897 bp, Glycine max
  Peptide Sequence Number=SeqID_193366
atgtcagcaattgctgccagcacaaatgtacctgtcagtgtcaaatgtcgaattggcgtggatgatcatgattcttacaatgagttgtgtaaggtttcttctttgtcacccactaagcacttcataattcactcacggaaggcacttctcaatggcattagccctgctgaaaataggagtattcctccactaaaatatgaatacttctatggtctcttacgtgactttcctgacctaagatttacaatcaatggtggcattactagtgttgatgaggttagtgcagctcgagaagctggagctcatggtgtcatggttggacgtgcagcatacaacaacccttggcagattttgggacatgttgacgctgcaatttatggtacaccaagctgtgatcttacacgacgtcaggtccttgaaagatatctagtctatggggactcagtattgggaaaatacggacatcggccaactttgcgagatattgtgaagcctctactccatcttttccattcggaacctgggaatggactttggaagcgcaaagctgatgctgctttcaaaaattgcacgaagagtatgtcgtttatattgtataacgttctagatgaagctatcaacagactacaggatataaaaactttttgttcatcaagcaaagcttatatatgtattctttttatatttactgttcttttccatgatttctatctcatcaatggcattggtaagacaatggaatcattttttgaagaaacccttgtagcaattcccgactcagtattggattcgcctgttgcggagccacctcctggccgtgatctttttgctaacatgcacaatttattgcctgcaccatacagaacaagagaagcaacagtaattatttgcgcttaa

SEQ ID NO: 76589 - DNA, 144 bp, Glycine max
  Peptide Sequence Number=SeqID_193367
atgtcatctagaagcagcctgcatgaagcgaagtacatgagaccatatcaggagcataaagcgcctcagcttccaagcaattggtttacaattggcagaaatatggggggaaattatcttagactgacatacctattgagttag

SEQ ID NO: 76590 - DNA, 242 bp, Glycine max
  Peptide Sequence Number=SeqID_193368
gtgatctcaatgaagcatttaaactggaaagtgagatgcagcaggctggagttaacttaaatatcgtcacctacactgcattactggatggtctttgtgaagatggaagaatgagagaggcagaagaattatttggggcattgttaaaagctgaatggactcttaatcagcagatttatacttccctttttcatggatatatcaaggctaagatgatggagaaggcaatggatattttatag

SEQ ID NO: 76591 - DNA, 1644 bp, Glycine max
  Peptide Sequence Number=SeqID_193369
ggctgcacgccctcaccttcagaggactacatgtcctcgccatcagagggttgcacgccctcaccttcagaggactacacgtcctcaccttcagataactgcacgtcttcaccttcagaggactgaacgtcctcgccatcagaggaatacacgtcctcaccttcagagggctgcacgccctcaccttcagaggactacacgtcctctgccagctgagggctgcacgctctcaccttcagaggactacacaggactacacgtcctcaccatcagagggttgcacgccctcacctttagaggactacacgtcctcgccatcagagggctgcatgccctcatcttcagaggactacacgtcctcaccatcagagggtcgcacgccctcatcttcagaggactacacgtcctcacctttagagagctgcagttcttcaccatcagagggttgcacgtcctcgccatcagagggctgcacgtcctcaccatcagaaggctacacgccctcaccttcagagggctgcacgccctcaccttcagaggactacacgtccttaccatcagagggctgcacgccctcaccttcagaggactacacgtcctcgacatcagagggctgcacgccctcacctttagaggactacacgtcctcgccatcagagggctgcacgccctcaccttcagaggactacatgtccttgccatcagagggctgcacgccctcaccttcagaggactacacgacctgacctttagaggactgcacgtcctcgcaatcagagggctgcacaccctcacctttagaggactacataggactacatgtcctcgcctcagagggctacacgccatcatctttagaggattacacgttctcaccatcaaagggatgcaggccctcacctccagaggactagacattcacgtcttaagagcactacacgtcttcgccatcggagggctgcacgcctccacctttagaggacaacacgtccttgccatcaaagggttgcatgccctcactttcagaggactacacgtccttgccatcagagggctgcacatcctcaccatcagagggctgtactccctcaccttcagaggactacacgtccttgccatcagagggctccacgccctcatctttagaggactacacgtccttgctatcagagggctgcacgccctcactttcagaggactagacatcctcgcctttagaggactacacgtcctagccatcagagggttgcacgccctcacctttagaggactacacgtccttgccagcagaggactgcacgccctcaccttcagaggactacacgtcttcaccatcaaagggatgcacgccctcaccttaagaggatgcacgtccttgctatcagagggctgcacgctctcaccttcagaggactacacatcctcgcctttagaggactacacgtcttcgccatcagagggttgcacgccctcaccttcagaggactacacgtcgtctccatcagaggggctgcacgtcttcaccatcagaggactacacgtcctccccttcagagggctacacgtcctcaccatcagagggcaatactccctcacctgcagaggactacacgcccttcccatcagagggctacacgccctcac

SEQ ID NO: 76592 - DNA, 207 bp, Glycine max
  Peptide Sequence Number=SeqID_193370
atggtggcgtctctgatgctctttagagctcctcctctggttgctctgttagggttcttgtgcgtcagaaaagaagaaaggaatagaatgtgttttccaaaaagctgctctagttacggcggttacaaaaggaaccattacccttttatttattggttgtgctcctcacaagcctcaaatagggctttcgttgctactaacaactaa

SEQ ID NO: 76593 - DNA, 1725 bp, Glycine max
  Peptide Sequence Number=SeqID_193371
atggttcagtgtgatgaaaacgatgacgaagcaacaatgtcaatgtccatggaccctcgcgtgaggcacgcacgagccataacatcacacgccaaagaccgcgcagtgtggaacaacctcataacccactactccaaatccaacctctcatcctacgctgtctccctgtttcacagactcccttttcctcccaacgttgtctcatggaccgcattaatctccgcgcactccaacaccctcctctccctccgccacttcctcgccatgctccgccacaacactctccccaaccaccgcacccttgcctccctcttcgccacctgcgccgccctcactgccgtctcttttgccctctctctccactccctcgccctcaaactcgccctcgcccaccaccccttccccgcctcctccctcctctccgtctacgccaagctccgcatgccccacaatgcacgcaaggtgttcgacgaaattccccaaccagacaacgtttgtttctccgccttggtagttgcactcgcccagaattcccgctccgtcgacgctttatcggtcttttctgacatgaggtgtcgcggttttgcgtcaactgttcacggtgtttctggtggtttgcgtgctgcggctcagctcgctgcgttggagcaatgtagaatgatgcatgcacatgcaattattgctgggttggattcgaatgtggtggtgggtagtgctgtcgttgatggatatggtaaagcgggtgttgttgacgatgcaaggagggtttttgaggatagtttggatgatatgaatattgcggggtggaatgcaatgatggctggttatgcacagcatggggattatcaatctgcttttgaactgtttgagtctttggaaggttttggacttgtgcctgatgagtatacttttttggcgatattgactgctttgtgtaatgctgggatgtttctggagatttatcggtggtttacgaggatgagagtggattatggtttggaaccgagtttggagcattatacgtgtttggtgggtgcaatggcacgtgctggagaattggagcgtgcggagagggttgtgttgacaatgccgtttgaaccggatgctgcagtttggcgagctttgctatcagtttgtgcgtatcgtggtgaggctgacaaggcttggtgtatggcgaagagggtgttggagctggagccacatgatgattatgcttatgttagtgttgctaatgtgttatcaagtgcagggaggtgggatgatgttgcggaattgaggaagatgatgaaggataggagggtgaagaaaaaaggtgggaggagttggattgaagtgcagggagaagttcatgtttttgtggcgggggattggaagcatgagaggtccaaggaaatttatcagaagttggcagagcttatgggggatattgaaaaattagggtacgttcctgtttgggatgaggtgttgcataatgttggggaggaaaagagaaaggagtctctttggtatcacagtgagaagttagctgttgcgtttggagtgttgtgtggatctgcaccaccagggaagccgttaaggattgtgaagaatttgaggatttgtaaggattgccacgaggcttttaagtatatgacaagagttttagaaagggaaataattgtgagggatgtcaacagatatcacagatttgtgaatggtaactgtacttgtagagacatatggtag

SEQ ID NO: 76594 - DNA, 712 bp, Glycine max
  Peptide Sequence Number=SeqID_193372
gaaataccaatctcgcattacacctcaggtagaggaaaagacgaaggaaaggccccacctgatgcaacaaccctcgttgaagtcaacaaagagaaggaatatgggtcaaactggaatcccttcacttgggccagtgatgaagataccttcatgcaacaacccagagctactggggggccagtaattaaggggggtctcaattctggaagaagaaagtttgtgaagggaagaaagcaagatggtggcttacaatgggtagcttctccggcggaaggggtgtggagaaacaatggcaaggaaataattatagtcaactcctatgcaccttgcgataggatggctaggaggagggtgtgggaggaattaaaggcaagaaaggacgaaaatgtgggagaaagggaggaattaaacaatttcttggcggacatgcggttggaagatatgtctttggtgggaagaaagttcacttggtataggtcaaatggtggagctaaaagacgaaaacctttcaaagtctttgattgtgggttctcggatacaaggtttagcaagttcgtggaggacacatggagagatctcaagtttgaagtggtagagaggttccaagaggagcttaatcgggtgagggtggtttttgaggaagaggacacatggagatggagggtgaaatcaacatacttagctcttcatggtcgggactttgccaatgagg

SEQ ID NO: 76595 - DNA, 246 bp, Glycine max
  Peptide Sequence Number=SeqID_193373
atgggtagtgaaagggaagagtgtgaacgcgttttcaagcgctttgatgtgaatggcgatggcaatatctccttgtctgagtttgcagatgctctcaaagtgctaggcttaacttcacaggaggaagttgagcgtcgaatggcagagattgataaagacggtgatggacacattacacttaatgagttgattgaatttcatactgccaaccctagcttgatgaaggatgtcttgaagaaactctaa

SEQ ID NO: 76596 - DNA, 1041 bp, Glycine max
  Peptide Sequence Number=SeqID_193374
atggcttcatcacagcaggttagtgtctttgggagctctcgttctgttcttggcgtgatggacatgcccaagaaaccagaaatgggaataccagaaatgtatattcgcccacaagaacctacaattcgatcaaatgaaaccactttgccaaccattcccgtttttgacttcaaagcctcgctacatgaaaatgctatagatgatgctgaacttgacaagttgtttacagcatgcaaagattggggtttctttcaggtggtgaaccatggtgttagctctcagctgctggagaagctgaaacttgagattgagaagttcttcaagcttcccattgaagagaaaaagaagtaccaaataagaccaggagatgttcaaggctatggaactgtgataagatgtaaagatcaaaagcttgactggggggacagattctacatggtgatcaaccctcttgaaagaagaaagccacatcttctccctgagctccctgcatcattgagggataccttggagtcatacttcagagaattgaggaaactaggtatggaacttctggggttattgggaagagccataagcatggagattaaggaagtgatggagatttctgatgatggcatgcagtcagtgagactgacatactatccgccatgtccaaagccagagcttgtcgtcaatggtgtggagggtctggagataaagaaagggggggtttggattcctgtgacctttcttcctgatgcttttgtagttaacgttggggacatcatggagattcttagtaatggggcctataccagcatagagcatagggctgcagtgaacaaagagaaggagagaatttctattgctatgttcttcaaccccaaatttgaggcagagattgggccagtgaagagttttataaattctgagaacccacccttgttcaaaagcatgttgatggaagattacttcaaagactttttctcacgcaatcttaatgggaagtcacacttggagaaaatgagggttacaagttttgacttgataaaagattaa

SEQ ID NO: 76597 - DNA, 378 bp, Glycine max
  Peptide Sequence Number=SeqID_193375
atgtgtcatgtctggtctacgattgacacatgtaaatccaaatgcactagagctgccctcaaaaaactcaatttggtagaagatagatctattccaagggacaagctcatttctttcctaagaatatctgtagatcttcagtacaaggatttaaggcaatttcagtggcattgggaaaagggggagcctgtcattgtcagcaatgtgcttgaatgtacatctggtttaagctgggaatcgcttgtcatgtggcgtgcattacgtcatgtaactaataccaagcatggccaacatttggcggagaaaacaattgattgcttagattggactgagagtcatcagaacagaatgtccttgaaatattttgtgaagtactga

SEQ ID NO: 76598 - DNA, 7941 bp, Glycine max
  Peptide Sequence Number=SeqID_193376
atgtctacttttaaagttgctgcatctaaaaacattgatgtcaatgaagaagggcaaaagtctttgtttatagtatttttgactaatataatccctgatagaagaatatggagtgcactgcacatgccaggaaattcaatgctaatcaagaaaattttatgtgctggtggtgtggttgaggaaagttgtgagtacttctctctacagccagattatgtaaaagatgacagaacgtatcaaaggttatcatcagagttgaatgggtctcagtatgaggcaatttgggcatgcctttcttccattcagtgttgtcataagtctactgtggatctcatttggggtccaccaggaacaggaaaaaccaaaactctgggcacactgctttatgctcttctgaagatgaaccataggactcttgtttgtgccccaacaaatgttgccgttaaagaagtggcctcacgtgtcttgagcatggtgagagaatcatttgatagaaattccgaggctttgttctgtgcattaggagacatggtattatttgggaatcatgagcggctcaaagttggtgcagatattgaagacatatatttggactatcgtgtcaagcatctcatgatgtgcttcgcaccacttactggctggagatgttgtttttcttcgatgattgatcttcttgaaaattgtgtttcccattatcatatattcattgaaaatgagttgagaaaggatcaagaacaggttagcgataataattttaacaagacaaaagacaatagcacttcacattgtagtgagacagagaaggtgcacaaaacttttcttgagtttgtgagagaaagatttctttctgtagcagtgcaactcagagactgtatttctgtcttgtgtactcatgttgctagaagttacattttggaccataactttgaagatttggtttgccttattcacaaagttagttcctttgaagctttgctgtttcaaagtaatattgtttctgaagtactggaaaagcttttttctcctccagaacatctacataattcttgtgagtcatctgtgggtgttgaatacttattgtacaagagcagaactgattgcttgtcttctttaagaacccttaaaggttcacttgatgaactcagcctgccaaattctatgaacaaagaatcaattagagagttctgtttacaaacatcctcattaatattttccactgcttctagttcttttaagctgcattctgttgtcatggagccattaaaagtattggtgattgatgaagctgcacagttgaaggaatgtgaatcaatcatacctctactacttccaaacgtagagcatgctgttcttgtgggagatgaatgccagctaccagcaatggttgcaagtaatgtttctcataaagttggttttggaagaagcttatttgcaaggctaagctcgttgggtcatccaaatcattttctcaacatacagtacaggatgcatccagcaataagttcatttccaaattcacacttctattttaaccaaattcttgatgctccaaatgttgtgagaaagaactacagaaaacaatatcttccagggccaatgtttgggccctattcctttataaatgtagttggtggcattgaagagtttgatgatgctggacgaagccggaaaaatatggttgaagtagcaattgtgatgaaaataattaaaaattgttttaaagcatggtgtgactccaaggagaacctcagtataggtgtagtgtctccatatgctgcccaagttgttgcaattcaggatttacttggacagcggtatgatacacacgatggatttgatgtgaaggtgaaaacaattgatggtttccagggtggagagcgggacattattatattatcaactgtacgaaccaatcacagtacttcacttcaattcatctccaatcaccagaggactaatgttgctcttacaagagctaggtactgtttgtgggttttgggaaatgaaaggaccctaacaaatgaggaaaatgtttggaaatctttggtgcttgatgctaaaaagcgtcgatgtttctttaatgctgatgaagacaaggaattggcaaaaagcatctgggataccaagaaagagttggatcagttagatgatttgcttaatccagatagcttccttttcaaaaaatccaggtggaaggttcttttcagtgataatttccttaaatcatttaagaaactgcgatcaaagcagactaaaaagttagttcttgacctcttgctcaaactctccactggttggagacctaaaaggatgaaagtggacttactttgtggaaattcatcacagatattaaagcagttcaaagttgaaagtctctttgttgtctgttcaacagatatagtaaaagaatcaatgtatactcaagttttaaagatatgggatataatgcctctggaggatgtcccaaaattagtgaagcgtcttgataatatatttgggagctacaccgacgaatttataagttgctgcagtgagaaatgcttagaggggaatatggtggtcccaataagttgggaaagatcaacagagatcactaaatttaagactcttgataataatggaaatgaagctgaattaagtggttgtgatcaaagaatttatgtggagaactcaaaggttgaggagagtttgttattgatgaaattctactccttatcatcagttgtaattagtcacttgctttctgatcgtatcagtgatgaatttgatcttccctttgaagtatcagatgaagaatatgacataatcctctttcctaaaagtacatttgtattgggtcgctctggtactggaaaaaccactgttttgactgtgaagttatttcaaaaggagtacaagcatcacatggctgttgaagaaacgtatggaattaacagtgctgcagttccttgtttgaatcatgataaagagtataaaaagagttctactacgaatgataggcctgtcttgcaccagctatttgttacagtcagtcctaaactatgtcaggcagtaaaacatcatgttgtgcgattgaaaagattcgtatgtggtggcaatattgctgctgaaagcaattctattgaggaagatattgttgatgttgatacatcaatacagtttaagaatacaccagactcttttatgaatcttcctatcgactcatatccccttgtgataacatttcagaagtttctaatgatgcttgatgggactgtggggatttcctattttgagagattcagtgacttatcttctgatggtaagaacctcagtgcaaggtctgttgctttggaaacattcatcagaaagaaagaggtgacttatggcaggtttgattcattgtattggccccattttaattatcagtacactaagaagcttgattcctctagagtgttcactgaaatcatatcccatataaaagggggtatgcaagcggtggaatctagtgatggtaagctaagccgtgaggaatatctttcattatctgaaaatcgagcatcaagtcttatcaggcagaaaagagagatcatatatgatatttatcaaagttatgagaaaatgaagaatgataaaggggattttgatttggcggacattgtgattgatcttcaccgtcgtctcagaataaacaaatatgagggtgatgagatgcactttgtgtacattgatgaggtgcaagatttaaccatgaatcaaattgctttgttcaaatatgtgtgccaaaatgtagaagaaggttttgtgttttgtggggacactgctcaaacaatagcaaggggaattgattttaggttccaagatataaaatctctcttttacaagagatttgtgctagaatcaaagggcaacacacacaatcaaggaaaagtgaaagggaaaatttcagaaacttttttattgagtcagaactttcgcactcatgctggagtgctgaaactatcccagagcaccattgaacttctttttcgttttttccctcattctattgatgttttgaagcctgagaccagtttgatatatggggaaggtccagtggttcttgaatgtggaagtaggaaaaatgcaattgtaactatttttggcaacagtggacatgtggctggaaaaattgttggctttggtgctgagcaagtaattttggtacgagatgattctgctcgtaaggaagttttagactatgtggagaagcaggctcttgttttaaccattttagagtgcaaaggccttgagtttcaggatgtattgctgtacaacttttttggctcttcacctttgaaaaatcgatggagagtgatatatgagtatatgaaggaacaagaaatgttggaacctacagaacttaagtcgtatccaaatttcagtgattccaaacacaatctcttgtgctctgaacttaagcagttatatgtggctataactcgtacaagacaaagattgtggatatgtgagaatacagaagtgtactctagacctatgtttgattattggagaaagaaaggtcttgtgcaatttaaagaactggatgattcacttgctcaagcaatgaaagttgcaagtagtcctgaagaatggaggtctcgtggcaaaaagctatactatcaaaataactatgagatggcaacgatgtgttttgaaagagcaggagactcttactgggagagaaagtctaaggcttctggtcttagggcaaatgcaaaccgtttgcgtgatttgaatcctgaggattcaaatgcaatgcttagggaagctgctgaaatttttgaaggcataggaatggctgaatctgctgcccagtgtttttctgatttaggggattatgaaagagctgggaagctctatttggagaaatgtgaagagcctgatttgaaaagagcaggggattgcttttatttagctggatgttatgaaactgcagctcgagtgtatgctggaggcagtttcttctcagattgtttgaatgtttgtgcaaaaggagggttgtttgatattggcttatattacattcaacactgggaaaaaaatgaaaatgctgatcattgtatggtagacagtcatgaactattcacaatagaacaaaaatttctggaaaattgtgctcgtaattatttggatcgtaaagataccagatccatgatgaaatttgttaaagcttttcactcaatggatttgaagcgtgagttcttaagatcattaagtttacttgatgagcttcttgtgttagaagaggagtcagggaactttatggaagctgcaaacattgctaagatgatgggtgatgttctacatgaggttgatctactgggaaaagctagtaaattcatggaagcttgtgaacttatgcttttgtatgtacttgggaattctctttggtctgcaggaagcaaagggtggcccataaagccatttgcacaaaaagttgagctcttgaatagagcattatcttttgcaaaggaagagttgagcagcttttatgtgattgcatctaccgaagctgaaatattatcaaatgagcatagtaacacttttgagatactgaatcatttgaaatcatctcgcacatatgggagtattagaggtgaaataatatgtttgtggaagcttttggatgctcattttcagctgaactcctccaagtttgtctggctagacaatttgttagatgattctgtggaaggaatgttattggagaatcaattttctgtggagtcattgtttcattgttggacgtgttggaaagataacattgtctgtgtagtggaatctcttccaagtctcaaatcacaagatattcatcatcacagcagttatggaaagtttgcattgaattatttgggtgttcggaagcaaacgtctaatctaaatgacatttacattttgctcatccctgaagctaactgggtgatgaaactgggtgataggtttctaaagaagaatggaaggctagtttctgttgatgttcaagatttagtttctgctgctgagagctattggtcttcacaattggtttcagttggcatgaaagtcctgcacatccttgatgcactctacaaattttctgctagtaaagctctttctgaattttgtcaattcaggtccttatttctgatctatgatgttttcaaatttctcctcaaatctaaatgttttaacctcaaccatggtaacttaaaaacattggagaaatttagcagaactccaattgaccgttcattgtgctatttagttcctcttgactggagtaaatcactgataaaagatatggtttatcttagaacaacagaaacttgtcaggatttggttaaagatgtgatctatgaaaacattaatcggaaagatatgctgacttatggtcaaattggaaatgtggtagtcatgattcttggtacagctaatctaaaaagtgaactgtttgtgaaaattttggcaagatttaaagagaatccactctggcaagagttcattcagagcttgcatttaaattcagctcagaaaaattcacatgttgatgaagcagtagagaatttttataaagctttgcagtacacttacagtgtgaattggacaagggaaattgactatatatctcccagttgttttatgtacctccttgaccgccttctgctcttaacatcacacgggaagtggaaggggttcatttttgctacaaaatcatcgtttgttgaatggcttattcaccaggatgaaaattcctttccaaatttgagtgtaatggctgatgtacaatcaggtggagagcatatccataggttcattttttctgtcctccgtgagcttcttaatgatcaaaatggtaccataagttggattagaaaatcaaatctcaatgtgaaaaattattttccgttgtttcttctgagattgattgtttcgttatgtttgcttcatttgagctctggaaagtatttagagttacttcacaatttgttgaagaagaaccatgtgttgtctcaactgccactggaatttcgtaatgttcttcagaaaggaaggaatcatctggttttgaaagtctttgctgaggcatttaaactgattggcaatcccttggtagttgccaggtttcataacacatcttcagaaattttgtgtccagatgctgtgtttgtggatttaacaatatgccaaagaaagttcatattagaagtattgtttccaaatagagttgacagtgtggatgaggaaactgcagcagtattagaagcttctgactcaacgtctaaggagttttcttcaacaaactgttccagttttccaaataaaagctctcctattgttactgctcagacatcagatagggagattattggcatgtctaccaatgctgactctttctgggctacgatgaataatttatggtttgcaattgatcataaggtgctacacaattccacaatcacaaaggaacttttgaatatttggattgatggtttgagtcatggaatgcatggaagcttgtcagaaaaccctgttaaccttgatgacaaaaatgaagtggaggaggtggtgaacttgcttgatgaaatgaagcaacttttttctgcattggctacgagtggtgatggagcgattgagaatcacgctcaaattggggaactatgtaagagaattctttcaagacgaccaaaagtagggcacgtcatgaataagctgtatttgctgtccatggagaatagcaatgttgggaatgagtcatcacaagccaaaactgcagtagccaatgatgagcatgggcaaaatgctttagaggaatcaaaagataacttgtccaagaattccgaaggtgccaccaactcaggacatggaaacatcaaggaaaataccaaggggaagaaaaacaaaaaaaagaaaggcaagggtgggagaagggatatatag

SEQ ID NO: 76599 - DNA, 789 bp, Glycine max
  Peptide Sequence Number=SeqID_193377
atggacagaatcaaaggtggatggggttggaggctatctctgggtttgggcggtttaccggcactgcttctcacgttgggggctttcttggtggtggacaccccaaacagtctcatcgagcgtggtcacttggaagaaggaaaatctgtgctgagaaagattcgtggcattgacaacattgaacctgagttcttggagcttcttgacgcaagtcgtgtggctaaagaagtcaagcaccctttcaggaatatcctcaagcgcaggaacagatctcaactcgtcatttccattgctctgcaggtttttcagcagttcactggcatcaatgtcataagtctcataatgttttatgccccaattctattcaacacactaggattcaagaacgatgcttctctctactctgctgtgattactggcgccattaatgtgctctccactgttgtctcaatctattcagtagacagagtcgagcattgtaatgggaatgaagatgaaggaccatccagaggagctctcaaagggttatgcagtgctggtggttgtgatggtttgcatttgcatggtcatggggcctcttggttggttcatcccaagtttggcatcttctttttcttctatggatggatcttgatcatgtccacctttgtgcttttccttttcccagagacaaagaatgtccccattgaagagatggcggagagagtgtggaagcagcattggctatggaagagatttattgatgaagatgattgtgttaaagaagagaaagtagtcactggcaattga

SEQ ID NO: 76600 - DNA, 309 bp, Glycine max
  Peptide Sequence Number=SeqID_193378
atgcaagcttggtcaacgacggttgtggtgattggatgcgctactatgtcgtggttatttgagaaaaggggatggtttgcggtttccaaatctgagaaagggagggtggttatggcggtgtcgccaccgttggcttggaagggagtcgttgtggtggcgatttcgtcgttgtcattgtcgtcgccgttggtttccgttgatgttgtcgctgtgatgattgcggtggtgtcatcggcgttggctctttttgctggtgcaggggaagatgggaatagaggacaaagttggaaaagaaggaaagggagataa

SEQ ID NO: 76601 - DNA, 252 bp, Glycine max
  Peptide Sequence Number=SeqID_193379
atgaaagaagccagaagctatgcaaaagaaggacgtgaaggacgtgaacgtgaagaacgtgaggtgcctgggtctcactggtgctactggcggaatgcccagtcccagtcagcacctatatcgctggtgctactggcgataccaacccagtcagctttggtttcgcttttggcaatggcggtacacatgtatatcgctgatggcagtggcgatacatgcttgccgccagtaggaatggcggaatcaacgtaa

SEQ ID NO: 76602 - DNA, 165 bp, Glycine max
  Peptide Sequence Number=SeqID_193380
atgccacaagagagctcccaaaactcatttttcacatctccttcaaagagaggattgaagggtttggtctccatcaacaaggagccttcatgcactgctgccacagatgagagtttcaatgataatgaattggctcagaggaaggcagaggaagcaggtgtataa

SEQ ID NO: 76603 - DNA, 270 bp, Glycine max
  Peptide Sequence Number=SeqID_193381
atgagggagaccaaagccaatcccaagattggtgacaaggagtgggcagtttccttcactgggaaaaaggatgatcaagcttcgtcatcattagaggatgagaaaaaaggcgagaagaggcatcatccactagagaataagccatggaaggagaagcttcaccaccaagagagtgccttggataagaagcttagagaagaagcttcaatggaggaagagaatgagagagagagagaggaggggggaggcatgggaattgaaggagattaa

SEQ ID NO: 76604 - DNA, 246 bp, Glycine max
  Peptide Sequence Number=SeqID_193382
atggagcagcaaaagctcaaatttttgcaaaactccaaggaggagtacacaaaggtacacatctttaggtgtgccaaacaaatgtttgacaccttagctatgacatacaagggcacctcacaggaacttattggtaccctcaagggtcctaaacaagagctccagcaagatgaagatcttagaagagaaaaatctttgtctcttagtagtcagaagaacaagaaagaaccattgtccagagaataa

SEQ ID NO: 76605 - DNA, 370 bp, Glycine max
  Peptide Sequence Number=SeqID_193383
atgggtaacatgaaattgtgtcctttgatgctatgcttgttattagcattcttgcttggggccgcagcacaaaattgtggtacccaagttggtggcgtgatatgcccaaatggtttatgttgcagtcaatatgggtggtgtggtaacacagaagcccattgtggaagaggttgccagagccaatgtacacctggctccacaccaacaccaacaacacctagtggaggagatataagcaacaccattagccgttctcaatttgaagaaatgcttaaacaccgaaacgatgcagcgtgtcccgggcgtaatttctacacctatgatgctttcattgctgctgctcgctctttcaatggctttggcacacccg

SEQ ID NO: 76606 - DNA, 759 bp, Glycine max
  Peptide Sequence Number=SeqID_193384
atggaagatggattctccaccaacaaaccacctttgttcagaggcataaagtatgattactggaaggagcatatgatagcccacttagaatcaattcatacagatctatgggacatggtggaaaatggagattatattcaatatgaagaagaatacaccaaggtacacaacttcaaaagtgcgaagaaaatgtgggacactctggctgtaacatacaaaggaacatcatgggtaaagaggaacaaactcagtctcctcactcgacccaaaagagaaaagtctttggctcttagtagtcagaagaacaagaaggcatcatcatccagagaacaagtcttgagaagttcatccaaagctcttaaagtcgatgattcatctgaggaagactcaaatgaagatgagcttgcctttatttctcgaaagatctgcaagatgtggagaaacaaaggtggctccaagtggaaaaactcctcaagaagaatgcctaaagaaaagaaaagaaaaagacaaaagctccataatttgctacgagtgcaaaaggcctggacatttcaagacctgaacaacacctcgtctaatgaacttgatgaagaagccaacatatgcctgatggaaaatgtagcttcccaagagtctgaatcaaatcaagaagcttacaaaagcctacaaaaagatttcaagaatctatcaaaagatcatttaaaacttgagaaaacccttcaagatcaagtagatgtttcattggacgagtccatgtag

SEQ ID NO: 76607 - DNA, 948 bp, Glycine max
  Peptide Sequence Number=SeqID_193385
atgtacggtctaatgaggctactacgaaatatttactcatgggttggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgagtcaggaacaacgaatccctttatgataaacagattcattttgcaagttcgttattacgggtagttcctacaaaggatcggactaatgacaaagaagtgaggaatcctcttttcgactctgactctcccactccagtcgttgcttttctttctgttacttcgaaagtagctgcttcagcttcagccactcgaattttcgatatccctttttatttctcatcaaacgaatggcatcttcttctggaaatcctagctattcttagcatgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggttttttcggaaaacttcatttattctggtgtggatggcaggcaggaatatatttcttagtttcaataggactccttacgagtgttgtttctatctag

SEQ ID NO: 76608 - DNA, 249 bp, Glycine max
  Peptide Sequence Number=SeqID_193386
atgaagaagggaggaacgcgaaccacattatatgaagtatatctctatttgaatcctgtgaggggctgcaagggacaaaactgctttgtgtcgaaaactaccttgtgcatacccaattatggtaatatagaaagcaaaggagaagctagaagtgataagaagacctcctttgactctgctgcagttcaaatgcttcttgaggtgcaaagactgggaaaagttggaattgatcctctcccttctagttag

SEQ ID NO: 76609 - DNA, 279 bp, Glycine max
  Peptide Sequence Number=SeqID_193387
atggcgtcgaggttccctccaggcgtgagcacgattgggttgagaatcttgcaagcacgaaggggaagaaagaaagaaaaaaagaaggagaggttgacagaggagaggagaagaactgaagaaagaaagggtaaatctggaaaagcttttaaaaaggctatcaggccagggcaggcttttaaaaaggctaagctcagacctttcaaagtctggtctggcctagcctattcccacccctacctaggcataaccgacgccaagttattttggggtcggtag

SEQ ID NO: 76610 - DNA, 4629 bp, Glycine max
  Peptide Sequence Number=SeqID_193388
atggttgagttgatacattcacggttttctacaaatactttccctagctgggatcgtgctcaacctatgcgtgtattgggccacaatggagaaatcaacacactcagaggcaatgttaactggatgaaggcacgtgagggtctactgaaatgcaaggagcttggtttatcagagaatgaattaaagaagcttttgccgattgtggatgcaaattcatcagattcaggagcttttgatggtgtgcttgagtttttgcttcattcgggaaaaagtcttcctgaagctgttatgatgatgattcctgaagcgtggcaaaatgacaagaacatggattctcagcgtaaagcattttatgaatacttctcagctctcatggagccatgggatgggccagctcttatatcatttactgatggtcactatcttggagctacattggataggaatggactgcgaccggggcgtttctatgtcacccatagtggacgggttattatggcaagtgaagttggggttgtagacattccaccagaagatgtgtgtaggaaaggaagacttaaccctggcatgatgctgttggttgattttgtgaagcatacagttgtaaatgatgatgccttgaaagagcaatactctttggcaagaccctacgaggattggctcaaaaggcagaaaattgaactcaaagacatcgttaactctgttcatgaatctgaaagagtgccgccacccatagcaggagtggctccactatccaatgatgatgcagatatggaaaatatgggaattcatggtttattagttccactgaaagcttttggatatacagttgaatcattggaaatgctattacttcctatggccaaggatggtgtagaagcccttgggtcaatgggaaatgatactccattggctgtcatgtctaaaagagaaaaactcacttttgagtatttcaagcaaatgtttgctcaagtgacaaaccctcctattgatcctattagagagaaaatagtcacttctatgcaatgtatggttggtccagaaggtgatcttacagaaatcactgaggagcaatgtcaccgcctttcactaaaaggtccccttttatccactgaagaaatggaagccattaaaaaaatgaattataggggatggcgcagcaaagttatagacataacttattcaaaggaatgtggtaagagagggttggacgaagccttggacaggatgtgtgcagaggcacatgatgcaattaatgaaggctacaccactcttgtgctgtctgatagagccttctcaaagaaacgcatctctgtgagctccctcctggctgttggtgctgttcatcagcatctagttaaaactcttgagcgcactagggttgccttgatagttgaatctgctgagccacgcaaagtgcatcatttctgcacccttgttggttttggtgctgatgctatatgcccatatttggcaatagatgcaatttggcgcctgcaggttgatggaaagataccaccaaaagcaagtggtgaattccactcaaaagatgagttggtcaagaagtatttcaaagcaagcaactatggaatgatgaaggttcttgccaagatgggaatatcaactttggcatcatacaaaggtgctcagatttttgaagctttgggtctttcatcagaagtgattgaaaagtgctttgctgggactccaagtcgagttgagggtgcaacgttcgagatgcttgcttgtgatgcttttcaactgcatgagttggcttttccttcttgggttttctctcctggaagtgcagaagctttagctttgccaaatcctggggattatcactggagaaaaggtggtgaagttcacctgaatgatccccttgctatggcaaagcttcaagaggctgccagaactaacagtgtagatgcatataaacagtattccaagctcattcatgaattgaacaaggcttgcaatttgcgcgggcttctgaaatttaaagagacagcagttaagattcctattgatgaagtggagcctgctagtgaaatagtaaaacggttttgcactggggccatgagttatgggtcaatatcattggaggcacacacagcattagcaatggctatgaataaaataggagggaaatccaacacaggtgagggaggggagcaaccatctcgtatggagcctcttcctgatggctcaatgaatcccaaaaggagtgccattaagcaagtggctagtgggagatttggagtttcaagttactaccttacaaatgctgatgaactgcagataaaaatggcccagggagcaaaaccaggtgagggaggtgaacttcctggtcacaaagttataggagacattgctgtcactaggaattcaacttccggtgtaggacttatcagtccacctccccatcatgatatttattcaattgaagatcttgcccaactaattcatgatctgaagaatgccaacccggctgctcggattagtgtgaagttggtatcggaagctggagtggggataattgctagtggagttgttaaaggccatgctgaccatgtattgatttcaggtcatgatggaggtactggggcttccagatggactggcataaagaatgccgggctgccttgggaacttggcctggctgagacccaccaaactttggttgctaatgatctacgtggtcgcacagtcctccaaactgatgggcaactgaaaaccgggagagatgtggccatagccactcttcttggtgcagaagagtttggtttcagtactgctccactcatcactcttggctgcatcatgatgcggaagtgccacaagaacacttgtccggttggcattgctacacaagatccagtacttagagagaagtttgctggagaacctgagcatgttatcaacttcttttttatggtggcagaggaaatgagagaaattatgtcccagcttgggtttagaagagttaatgagatggttggccgttccgatatgcttgaagttgataaggaagttgtcaagagcaacgagaaactagagaacattgacctctctctattgcttagacctgcagctgaactgcggccagaagcttctcaatactgtgtgcaaaaacaggatcatggtttggatatggccttggataataagctcataagtctgtctagtgctgctttggaaaaaggtcttccagtatacattgaaactccaatatataatgtaaaccgtgctgtgggaactatgcttagccatgaggtgactaaactgtaccacctagctggtcttccaaatgacaccatccatattagatttactggcagtgcaggccagagctttggtgcattcctctgtcctggtatcactttggaacttgaaggtgatagcaatgactatgttggtaaaggattatctggtggcaagattgtagtgtatcctccaaaagaaagtaactttgaccctaaggagaacattgtcattggtaatgttgcactgtatggggcaacacgtggggaagcttatttcaatgggatggcagcagaaagattttgtgtgcgtaattctggagctaaggctgtagtagaaggtgttggtgatcatgggtgtgagtacatgactggtgggactgttgttgtgcttggtaaaactggtagaaattttgctgcaggtatgagtggtgggattgcttatgttcttgatgtggatggaaaattccaatctcgatgcaacttggaacttgtagatctagataaggttgaagaggaagaggacattcttacacttagaatgttgattcagcagcatcaacgtcacacaaatagtcggctcgccaaagaagtgcttgatgattttgagaatcttcttcctaaatttatcaaggtgttccctagggagtataaacgtgttcttgcaagtatgaagtctgaggaaacctccaaagatgcagtggtgcatgctgctaaacatgagcaagatgatgaagcacaagcagtggagaaggatgcttttgaagagcttaagaaactggcaactgcatcattgaatgagaaaccgagtcaggctgaatcaccgaagaggccaagtcaagtcactggtgccattaaacatagaggttttgtttcttatgagcgagagggtgttcagtatagggatcctaatgttcgcatgactgattggaaggaagtgatggaggagacaaagcctggtccccttttgaaaacacagtcagcgcgttgtatggactgtggtactcctttctgtcatcaggaaaactctggatgtcctcttggaaataaaataccagaatttaatgagttagtataccaaaataggtggcatgaagcattagagaggcttcttgaaacaaataactttccagagtttactggtcgggtgtgcccagcaccttgtgaaggttcttgtgtccttggtattattgagaatcccgtatccattaaaagcattgaatgtgccatcatagacaaggcttttgaggagggttggatggtgccacgacctcctgtccagagaactgggaaaagagtagccatcgttggcagtggaccatctggcttggcagctgctgatcagctaaataaaatgggtcataca

SEQ ID NO: 76611 - DNA, 570 bp, Glycine max
  Peptide Sequence Number=SeqID_193389
atgcaacaagggttcaaccttgataagtacagaattggttcgacaaggaatccagagagaagctctcacgaatacacaaggtcacggaatcggatgacgtcacttccagagatggaagataagtcaggagtagacgctacaaggcaatcaagattcttggcagtgcctctgggtcttcatccttttccacttgcactaggccgtggattactatatgaaggcaaaggcaatgccaagatcatttgttttactctgatgctgattaggcagactcaccatcagccacgaagaaatttgatcccatggggaagcaagaaacaaaatatagtcactagatccagtgctgaagctgaataccgtgccatgcctgcaactacaagtgaaattacatggctaaggaaacttctccagcagttccaatttggagacactcaagccaccaatcttatttgcgataatcaagccgttctccacattgtatctaatccggtcttccatgaatggactaaacacagtagaagactgtcattttgtgagagagaaagtgctctcaggaaaaatcaccattga

SEQ ID NO: 76612 - DNA, 180 bp, Glycine max
  Peptide Sequence Number=SeqID_193390
atgtctatggattcctcgagccacaattcatacagagatctgggcaatagcaatttgaatcagaaagttatattaagaaccgatatgtacctaagaacctacttgagtggtgcttcagaaggatttaacgatagtctacaaactaaatccaaggttgttgctaggtggattgttgttaaa

SEQ ID NO: 76613 - DNA, 654 bp, Glycine max
  Peptide Sequence Number=SeqID_193391
ccgggtcgttgcgtcgtgcatagagaggaagaggtttctgggaacccggttccgaccgatcgggtcggaccgaatccggttacttcaatcgtgtcggttgccgaagccgagggtggcggtgcggtcggcattctcggccgtgccggagaagccactggggctgcgagagcagccgcaaaacggtgcgtagcgggttgggttgggtttggtttggtttttggtggatgtggtgacggacgcgctggaaatgttggtgcggatgacgcacagaggtgcatgcggatgcgaagccaacactggagatggtgccggtattcttgtggccctgcctcatgccttttaccaggaggcacgaagactattgttggttgttgttgggtttatacggtgaaggttggaccggatgggaatattgatcgattcaaagcttgtcgggtggctaaaggctatactcaaatctttggcctagattgtagggatactttttcccttgtggccaagatcacctctgttagtctgtttcttgctatggttgtcattggtcatatggttgccattggccattggccgcttcaccggtcacagaatcggatgtcgccacttccagagatggaagataagtcaggggtagacgccacaaaggttcaaccttga

SEQ ID NO: 76614 - DNA, 153 bp, Glycine max
  Peptide Sequence Number=SeqID_193392
atggcgatgtcggactcattcaccgttggattgacgatttatttctgcatattttcaccattgggatttccaaaaacttgtttgtggagggagaactactcattgcacatagacagtgaaatagaggcttcaatctcttctccttctctctaa

SEQ ID NO: 76615 - DNA, 570 bp, Glycine max
  Peptide Sequence Number=SeqID_193393
atggatcaaagctatgaagtctatataaagcttgaggatggagagattaagagcagtgccaagagtggcctagagagtactcattgtagccaaaagtggcataaagaatacttggtcataatcaaagacttgattaatggaacccttcaagttttgaaggagaactggacaagtggtaaactacccaaggaattggagttccttattcagttgaaagaggactccattcaagtgctacatcctgtgaagacgtatcattttggtgatgcctacatgtgttttactaaggatgatgaagatgatgacttcattggtagattaacaaaccttcccatcatcttcaatgttgtggacgatgccattattaatgaggttcccactaaaaatgtggcagatgaacctatattagagaaaactaatgagaaacctcatgaagttatgtccaaggaacacgtgctactagatgaggtagtcatcttcttgactaattttggtccaacgcctattaactatgcaccttcagtttccttgactgaagatcatgttcaagagatgatcggtaatggataa

SEQ ID NO: 76616 - DNA, 507 bp, Glycine max
  Peptide Sequence Number=SeqID_193394
atgtctgtcgaccgagactgttgcagtctccctttgccaactagagacaagcaagtccattggcacgtagagacaaattatggtcatccagagaccatcaagtccgatggtgcgcagagacaaatatggtcatttgccccctgtggtcgaagactcaatgtctttcgaccgagactattacagtcccccctttaccatccagagacaagcaagttcgatgactcaatgtcttttaggccgaaactgttaaagtcaccccttcgtcatccagagacaatcgagtctgatgacatgcggagaccaacatggtcacccgctttcgttattttgacactattttttgactcctttatcatccagagacgagcaagtccgatggtatgcggagacgatgatggtcatctgtttttaattgtttccgagaccattgaagtctcccttgccatccaaagacaagcgagtccactggcacgcgaaaaccctcatggtcatatgtttttcatttga

SEQ ID NO: 76617 - DNA, 171 bp, Glycine max
  Peptide Sequence Number=SeqID_193395
atggaaatccaaagaaccaaggaatggggtacttacttgtatggagtgagcaagagtgcaaaaatggaaacaaaagtgcaaaaatggtggcttagggatgcaaaactcgtgaatcccatgtgttcgcccaggcgagctaactctgcatttgttttttttgcaaaaatttaa

SEQ ID NO: 76618 - DNA, 207 bp, Glycine max
  Peptide Sequence Number=SeqID_193396
atgaacacagcaagggaaaggtttagcagtggggttgaacttagaactgcagtccaggcagaagtagctaatccaaaaagtcctcaaagggggacagcaaacaaaagcacacaattggataactctgccaccactgatcatctgagcaaagacacaagcaacaataaaggtcatggcaatgccaatcatgccacaaaatccacataa

SEQ ID NO: 76619 - DNA, 252 bp, Glycine max
  Peptide Sequence Number=SeqID_193397
atggtcggggtagagggtgtcacagttgccaatgctaatgagtttcaaagaggccatgctacaaatgaatgtgctaaaactcacgaggaagtgcagtacatgaataaacaaggcaagggaactaccagaactacaacaatcaaggctacatacctcatccaagtatgtcaagagcaagggagtaattccattgccatgcctaggaagaaactctatgaaaagacaagcaagctggagaagacccttacataa

SEQ ID NO: 76620 - DNA, 1323 bp, Glycine max
  Peptide Sequence Number=SeqID_193398
atgaaggccaacatggaggccatgaaagagcaaatgaccacaatgatggaagccatgatgagtatgagaaaaatgatggaggtcaacacagctatagttgttgccgcaagtaccgccattgaggtttacccgactcacccatctatcctcaatcaagtaaaccatctagtctcggatatggtaggcaagggaggcgaagcattgggaagtatgggtgacccctattttgtgcaggtccagagcaagcatcccttcccaccatttggcttgcctcccaactatacaccacccaatgttgtacatgctcccgatgagaatgtcgacaactccgcacccatacccattgagaaccaacaagccgaatctggttatgcacaggtccctcaacctatgggggagacacatgaagtaccccaagaccatattctagccgactttgagccttgcctcggatatgccactgaggggcaggcgtttggtggcatacccttgccaaacactttggggggctctcagtatcgcccacaatcctttcattttgcggtggaaagactacctcctgccatggtggaaagggaaaaatttgatcatatagaagaaaggttgagggtcattgaaggaggcagaaattatgcctttgctgacatggaaaagttgtgcctagtacccgacatggttattcctctaatgttcaaggtgtcggattttgataagtacaagggcacaaatcacctgaagatgtactgtaggaaaatggaagcatacgcgaaagatgagaaattattgatgtatttcttccatgaaagtctgactggggcagccgttgcctggtatactaatctagaacattcccgagtccgttcttggaaggacctaatggttgccttcattagacaatatttactacagaacatgtgtaaggaacatgaatctttcaaaggatacgcccaaaggtggagggatttggcagctcaggtagtgcccccaatgatggagagggagatgataacaatgatagtagacacgttactggtgttctactatgagaagatggtgggttacacactttcaagcttttctgatttagtttttgtcgacgaaaggatcaaagtaggtctgagaagaggaaaatttgattatcttgctttgataaataggaagcctggggcaaatggagagaataaggagggagaaacccatggtttgactattgttcctacatggtcaaatttcccactagctcaacaatatcaatactcagccaatatcagtccttctcattacccaccaccttaccagccaagaacacccaatcatccataa

SEQ ID NO: 76621 - DNA, 177 bp, Glycine max
  Peptide Sequence Number=SeqID_193399
atgaaaggcctttttgttacaaaacttgaaagcaatgaagtgcttcttagtccaatagctcttaaggtggttggcccctttattcttgactcaaattcttcaagggatggcaccaatcctccttccaattccctatatggcaacccacaaccaaggaaacaaagagacaagcaataa

SEQ ID NO: 76622 - DNA, 3807 bp, Glycine max
  Peptide Sequence Number=SeqID_193400
atgatgaagttttcaacttttgcaattgtgttccttttgtgtttttcttctatgctactagtccttggtcaggtcaactcagacagtgagagtactttgagagtgttgttggaagtgaagaagtcttttgtggaagacccacaaaatgttctgggtgattggtcagaggataacacagactattgcagttggagaggggtatcatgtgaattgaactcaaactcaaacactttagatagtgactcggtgcaagtagtggtggctctcaacctttctgactcgtcgctcaccgggtcaatatcaccttcactcggtcgtttgcaaaacctgctccaccttgatctctcctccaacagcctcatgggtccaattccacctaatctctccaacctcacttcattggaatctttgcttctcttctccaaccaactcacgggtcacattccaactgagttcggctcgcttacgagtctccgagtcatgcgactcggtgacaatgcactaacaggaactatccctgcgtctctcgggaacctagtcaacctagtcaaccttggcttggcttcatgtggaatcaccgggtcgatcccgagtcaactcggtcaactcagtctcttggagaatctgattctgcaatacaacgagttgatgggtccgattccgaccgagttggggaactgctcaagcctcaccgtcttcactgcagccagcaacaaactcaacggctcaatcccgagtgaactgggtcgactcgggaatctgcagattcttaacttagccaacaacagcttatcatggaagattccgagtcaactcagtaaaatgagtcaactcgtttacatgaacttcatggggaaccagctcgagggtgctattccaccgtctctggctcaactgggtaatcttcaaaatctggacttgtcaatgaacaagctcagtggaggaatcccagaggagttaggcaacatgggcgacttagcttacttggttctgtctggtaacaaccttaattgtgtcataccaaggaccatatgttccaatgcaacaagtttggagcacttgatgttgtcagaaagtggacttcatggtgaaattccagctgagttgagtcagtgccagcaattgaagcaacttgatttgtcaaacaatgcactcaatgggtccatacctcttgagctttatgggctgctcgggttaactgaccttttgctgaacaataacactttggttggttccatctctcccttcataggtaacctcagtggcttgcagacacttgctttgtttcacaacaatttggagggttctctgccaagagagattggaatgcttggtaagttggaaattttgtatctttatgataatcaattgtcaggggctattcctatggagattggtaactgttctagcttgcaaatggttgatttctttgggaaccatttcagtggggaaattcccatcactattggaaggctgaaagagttgaacttccttcacctcagacagaatgagcttgtgggtgagattccatccaccttgggtcattgtcataagctgaacattctggatttggctgacaatcagctctcaggtgcaattcctgaaacgtttgaattcctcgaggcgttgcaacagctcatgctctacaacaattctcttgaaggtaacctccctcaccaactgataaatgtagcaaacttgaccagagtgaatctctcaaagaacagattgaatggtagtattgctgcattgtgtagctctcaatcatttctttctttcgatgttaccgacaatgagtttgacggtgaaattccttcccaaatggggaactcaccctcccttcagaggctgagattgggcaacaataaattctctggtaaaattccaaggacattgggaaaaatccttgagctgtcgttgttagacctctctggaaattcactcactggaccaataccagctgagctttctttgtgcaacaaactggcttatattgatttaaacagtaatcttctttttggacaaataccatcatggcttgaaaatttgcctcagttgggagagctgaagctttcctccaataatttttctgggcctcttccattaggcctattcaaatgttccaaattgctagttctctctctaaatgacaactctctgaatggaagtctcccatctaatattggtgatcttgcataccttaatgtcctcagacttgaccacaacaagttttctggaccaatccctccggagataggtaagttgagcaagctttatgagctccggctctctagaaatagcttccatggtgagatgccggctgagattggaaaacttcaaaatctccaaatcattttagacctcagttacaataatctctcaggtcaaatcccaccttctgttgggacactgtcaaagttagaagcacttgatctttcccacaatcaactcactggagaagtccctccacatgttggggaaatgagcagcttgggaaagcttgatctctcttacaacaaccttcaaggaaaattagataagcagttctcgcgctggtcagacgaggcatttgaaggaaacctacatctttgcggaagccctcttgagcgctgccgccgtgatgatgcttctgggagtgcaggcctaaatgagtcatcagtagcgataatatcttccctttcaactttagctgtaattgctcttttgatagttgcagtgagaatcttctccaaaaacaagcaagaattttgcaggaaaggcagtgaggtgaattatgtttactcttcctcttcatcacaagcacagagaagaccattgttccaactaaatgctgctggaaagagggatttcagatgggaacacatcatggatgccacgaacaatcttagtgatgacttcatgattggttcaggaggttcaggcaaaatctacaaagctgaattggccactggagagacggtggctgtcaagaagatttcatcgaaagatgaatttctgttgaacaaaagcttcttaagagaagtcaagaccctagggaggattaggcatagacatctggtgaagctaataggatattgtaccaatagaaacaaagaagcaggttggaatctgctgatatatgagtacatggagaatgggagtgtatgggattggcttcatgggaaaccagccaaggcaagcaaagtaaagaggagaattgattgggagacaaggttcaaaattgctgtgggattagctcaaggagtggaatacctccatcacgattgtgtcccgaggatcattcatagggacatcaaatccagcaatgtattgctagattccaaaatggaagcacacttgggagattttggactggcaaaagcactaactgagaattatgactccaatactgagtccaattcttggtttgctggctcttatggctacatagcaccagagtatgcatactccctacaggcaacagaaaaaagtgatgtttacagcatgggaatattgcttatggaacttgttagtggtaaaatgccaacaagtgaattttttggagctgagatggacatggtgagatgggtagagatgcacatggatatgcatggctctggacgtgaggagttgatagattctgagctgaaacctcttttacctggcgaagagtttgctgcattccaagtgcttgagatagccttacagtgcacgaaaactacaccactagagaggccatcttcaaggaaagcatgtgatcttctcctccatgtattcaacaacaggatggtgaagtttgagaagatgaatttgaatcattacaaatga

SEQ ID NO: 76623 - DNA, 591 bp, Glycine max
  Peptide Sequence Number=SeqID_193401
atggctggtgatacagcatcttccttctccacttgcatggccctcttcttctctttgctcctactttctcacttcactatggccatactagaacacaatatcttttctccttcaacatctaacaaagagggtgtcaagaagaggaacaccaaagtagttgcttcagtaagagaagaaagtgaacaaaattccaagaaggatatggcactaggagaaactagcaaaggcagcattcatgttccaaagagagagcactctcaacactctcaatctccaaataggatcttcaatgcaagtgcacatgaagtccccagtggtccaaaccccatttcaaacaggaggttgctcattgcacgctatagtgaaaggagaaatgaaggaaaagagcagaaacctccctcaaccaccattgttttgcgtgaaaaagtttacatggatttggcatccaaagtagcgtataaagggtcaatatctttcttcctcaatatcccgaaatatcctcaccactttctctggaactgccttgctatatcggtacacttgaatcatgatttcaaaagttgggataaagctaccaagattccaaagtga

SEQ ID NO: 76624 - DNA, 417 bp, Glycine max
  Peptide Sequence Number=SeqID_193402
atggaggtgtctattacatatgaaattgcagacactgtggagctcaaccctgataggctacgtgagcttaaagcatttgatgactcaaaagctggtgttaaaggccttgttgatgaaggggtcacaaagatcccaacattgtttcatcatccccgtgatgagtttgtgaaagcctcaactttaggctacacaaaacatattagtcctgtcatagacctttcagaagttggcaaagaactgagttacgggaatcatctgagaaatggggtttctgttagcgtaggtcttaaatcatcaccgaaactctatggacctataaaagatttattatcagaagacaatcatcccaaatacagagaaaccaccgttgcggaatatgcacgctactgtcaaaagaacaaaggagaaaacacctag

SEQ ID NO: 76625 - DNA, 489 bp, Glycine max
  Peptide Sequence Number=SeqID_193403
atggcggatcctttggaggccacgacagtcacgaacacagaggacatgatggtcacggtggtggcggaagagtttgtggaatctagtgagagagagcagaggaaaaggggaagaaaaatgttgagtgcgacggcgatcggcgcgttattgggtttgggaacccagatgtactccaatgctctccgcaaactcccctacatgcgccatccgtgggagcacgtggtcggaatggggttgggcgcggtgtttgtgaaccagcttctgaaatgggaggcccaagtggagcaagacctcgacaagatgctcgaaaaggccaaggccgccaacgaaagacgttatatagagaaagcacagagggtgcctctgcaggaatggttgatgtggattgtcagatatgcgggtgagaaaaagagagaggttttgcatatgatcacatctttggatttgaataaggtttctcttttgacaatgttggaattcgataagtag

SEQ ID NO: 76626 - DNA, 1803 bp, Glycine max
  Peptide Sequence Number=SeqID_193404
atggtcattggggccattcagcaaaggaggtgtaattggaaccaggtgctgatgatgcagcaatacttttctgtggctgatgtggcgcatgcgctgcagcaagtggcgtggaggaggcagcagaggcctctggatccagtgaaagtgggtgcaaaggaatttaggaaatccggttcgggataccggcatgggcagaggtttgagcctgtaaaggaaggttataattctagtgtagagtcttataatcaatatgatgcaaatgtcacggttactggaggcacggagaaagggactccagttgttgagaagagtgaagaacataaatctggtggaaaggttgagaaagtgggggataagggtttagcatctgctgaagacaagaaagatgctataacaaagcatcaaactgatggcagcttgaagagcacaaggagtactgaaggatctttgtccaacttagaatctgaagctgttgtaaatgatgaatgggacgattcacattctgtgcaaaatcaacatcagagccaaagtctttctaccaaagcaaaaacttttattggcaatgaaatgtttgatgggaagatggtgaatgtggttgatggactgaagttgtatgaagatttatttgatagcactgaaattgcaaatcttgtttcattggtcaatgatctaagggtttctggaaaaaaaggacagttacaaggaagtcaggcatatatagtttcaagaaggcccatgaaagggcatggaagggagatgattcagttgggtgttccaattgctgatgccccagcagaaggggaaaatatgacaggagcctccaaaggcaagttgtattatatgaatgtagaacctattccttccttgtttcaagatattattgagcgtatggtttcctcgcaagtaatgactgtgaagcctgattgttgcattgtggatttctataatgagggtgatcactcacaaccccacagttggccatcatggtatggaaggcctgtttatatcctttttctgactgaatgtgaaatgacttttggaagagtaattgcctcagagcatcctggggattataggggtggtatcaagctttctctagttcctgggtcccttctggttatggaaggtaaatccagtgattttgctaagcatgctcttccttccgtacgcaaacaacgcatacttgttaccttcacaaagtcccaaccaagaaagtcactatcaagtgatgctcaacggcttgcctcgacagcaacatcttctcattggggtccattgccaagccgatcccccaatcatgtccgtcatcacgtaggctccaagcattatgctacacttccaacaactggagtactgccatctccacccattcgaccacaaatggcagctccagttggcatgcaaccattgtttgttactgcgccagttgtacctcccatgccatttcctgcacctgtggcattcccacccggttctactggatggacaggagcacctcctccaaggcatccccctcctcgagtccctgctcctgggacaggagtcttcctacctccgccgggctcaggtaattcatctcaacagttaccagcgggtactttggctgaagtgaacccaagcacggaaactccaaccatgctggagaaggaaaatgggaaaactaatcataatagtacaagtgcttcaccaaaaggaaaagtgcaaaagcaagaatgcaatgggcatgcggctgatggaactcaagttgaaccagctctagagacacggcaagatagcaatgacaaagctgcaccatgtcattga

SEQ ID NO: 76627 - DNA, 393 bp, Glycine max
  Peptide Sequence Number=SeqID_193405
atgaagcataatataaagagcaagaacgtaagaataagtgggttcgaatacctggtttggtttgtggaggcaacagaacagagttcaaacgaatgcaaactgcgtatgcggactctgctttacgaaagaggcggtgttttgctgtgcagctttggtaggagttcacactcaacttatgttgagcttgggcatttttgtcatttactcacacaatatccactttgggcgcattatgtggggagattggagaatgggaaagttttcgatagcagctacaatcgtggcaagccactatgctttcgcgtcggtgttggagagcaatatacaacattggcaacaaatcttattgagtttaatggtgtcaatgtaaaagttttaacactgaaccaataa

SEQ ID NO: 76628 - DNA, 912 bp, Glycine max
  Peptide Sequence Number=SeqID_193406
atgtccgaggttgagtttgaacctcaatcaccacgcctcttcatccccaacttcctctccctcaacgaatgcagagaattggaattcatccacaagagtagcagcacggtgggttacagacccattgtcttctccaccactctctcccatctcattgctaccaattcttcccacttcatcattccttttatacccatcagagaacggttgaaagacaagctagaggagtttttcaagtgtgagtatgagctcttcattgaattcactggtttaataagttggagcagaggagcaagcattggatggcatagtgatgataacaggccctacctcaaacaacgtcacttctcagatgttctgatgtacacagctgatgaccataacattcattctgttgatgagataactgaaggagaaaggctcacacttgctttatggttcagtcgtgatggctcccatgatgaggatatgaagctcatttctcttctttcacgacacctgttgcatgacaacatggctgattcatacttacctttgccagcatccagtaatatgtactggttttctaaggaccaagcttccaataatcagttcggttttaatatatgctgggctagactgcatgttcttggatacgacatatatatttctcaagacagtagctgtgagtccgatgtctctgaatcactgttaaagccagtgcgcttagtgagggagaatgagttgctagaccaggaatttgtcaatattatgcatgcacttcagggtcagggcaagcctcaaggctcaatgatcacttacagaagtacttacaaatactacaaagtagtgtatgcctttgtttctgaaacttctatagcacgagttagggtgcatactacagctactgcaaggacattagaatttctctaa

SEQ ID NO: 76629 - DNA, 706 bp, Glycine max
  Peptide Sequence Number=SeqID_193407
atgtggcgtaccgtcggccaccggcaccttcagttccggcgtggccaccatctccggcagctctgccagtacctcatccggggtctcctcgcgctgggccaggatctccagcaggcgcgccgccgcatacaggccatcgtcgaaaccgaaccagcgctccttgaagaagaagtggccgctcatctcgccggccagctcggcgtcggtctcgcgcatcttcgccttcatcagcgaatgcccggtcttccacatcagcgggctgccaccattgcgcagcacgtggtcggacagcttgccggtgcacttcacgtcgtagatcaccatcgcgccggggttgcgcatcagcacatcggcggcaaacagcatcagcaggcggtcggcatagatgatcctgccttcgccggtgaccacgcccagccggtcgccatcgccatcgaaggcgacgccgaggtcggcgccgaagcgcttgaccgtctgcaccaggtcttccaggttggccggttcgctcgggtcgggatgatggttggggaaggtaccgtagacatcgcagtacagcggaatgacttcagcaccgatcgcttccagcagttgcggtgcgagcgcaccggcgatgccgtcgccggcatcggccacgcccttcaacgggcggtccagctgcacgttgtcggcgatgcgctcaatgtagtcggcactgacaagcgctcag

SEQ ID NO: 76630 - DNA, 189 bp, Glycine max
  Peptide Sequence Number=SeqID_193408
atgacgcaaagggaggggcttgaagaggaagatctagggttgggattaatgaagaatgtggaacaaagggtatggcttactgatcacgcatgtgttgtagtcttaaatggtggctcatattcacaagtcaccacacaacacactctttctctatatatatttgttgctgtgcatctgaggactgaatag

SEQ ID NO: 76631 - DNA, 156 bp, Glycine max
  Peptide Sequence Number=SeqID_193409
atgacgtatagaatggagaagttagggtatggcattatcaaggtgcggttcttctggttttggattccgcaaattcgttatgcgccacaaatcaaggagaaaaatgaaagacagaaacgtatggttgaagaagggaacgcattgtgtttaaaataa

SEQ ID NO: 76632 - DNA, 189 bp, Glycine max
  Peptide Sequence Number=SeqID_193410
gtagattcatacatgatactaaagtcagtgcaagagaagtggctgcaattgcttgcagagaattctgaggcaaagagtaatggtttcaagtgcaaggcaggccatatctggccttctggctgttggtggggtaaatgctaccagctgtgctttgttgggcaaagggaatttttggaaaaccaagtttga

SEQ ID NO: 76633 - DNA, 711 bp, Glycine max
  Peptide Sequence Number=SeqID_193411
atggctaagtatgatctagaaatagtcatggagttctatgctaatgcatggcccatagaggaaggagtgagggataagcgctcctgggtccggggccaatgggtcccctttgatgaagatgccattaatcaatttttggggcatctgttggtcatggaagaggggcaacattgcgagttcagtcagaggaggagccaggcctcgggatttgatgaaaagtccataggccaactgttgtgcattccaggacaggacttcgcacgaagtgtgacggggagatgggatctcaccgcccagacacccagtggacccagaaaagtccaacggagcactggggttttcgaccttgatcacaggcctctaccagcaagcacaatagcaaggggaggaccagtagatgcaccaccgccacctctacagcagccaccatctctagagtccatctctgctcacatgcggaggatggagctccagatgcatgcatatatacagcatctgaatgagagcttttaccagtacaccctgcatcagcaaagccaagatcccagccctttcccatggcctacccccgagcaattcagggccacagtttcatggcctggagataggcccaattttcaggtaggggtaggacccgcagggaccctcgaagatgaagatggagctcaggaagatgatgacatggccaatgtgatggacttcttcctttga

SEQ ID NO: 76634 - DNA, 1271 bp, Glycine max
  Peptide Sequence Number=SeqID_193412
gtcaagaagcactgctacaatattcccgtgtaccgcggcgcaaagtacctcgttcggaccacctacttttacgccggagtcaacggcgctgaccacccctcgccgccggtcttcgaccagatcctcgacgggaccctctggagcgtcgtcaacaccacccgggattactccgatggaaactcttctttctacgaagggcttttcttggctcagggcaagatcatgagcttgtgcatcggttccaatacttacaccgattctgatccctttatttctgctctggagttcttgattctcgagggttctctttacaacacctcggatttcactaaatatggacttgccttggttgcacgacacagttttggatactccggaccacccattcggtatcctgatgatctgtttgaccgtgtctgggagccttttgggcagagtaattctacccaagcaagcactgataatgtttctgtttctggtttttggaatcttccacctgcaaaaatatttgagacacgtataggatctgatcaattggaaaccttgcaactgagatggcccacagcatcacttcctagttcaaattccaaatactactacatcgctctatacttcgctgatgacactgctggatcaagaatttttaacataagtgtgaatggtataacttattaccataatttgaatgtgatcccatcaggtgttgttgtatttgccagccagtggcctctttctggtcctacaacaataactttgacccctgctgctagttcttccttgggccccttaatcaatgctggtgaagtttttgatgtgctgccacttggaggaagaactttaacccgagatgttattgctttggaaaaggtaaaacagagcctccgaaatcctccacttgattggaatggtgatccttgtatgcctcggcagtactcatggactggcatctcatgttctgaaggaccacgtatccgtgtagtgactttaaacttgacaagtatggatctttctggatctttatcaccttttgttgccaatatgacagctctgactaacatctggcttgggaataacagtttatcagggcagattcctgacctcagttcactaaagattttagagacattgcacttggaagacaatcaattcagtggagagattccctcatccttaggggacatcagcagcttgcaagaagtgtttttacaaaataacaatttgactggtcaaattccagcaaatctcattggaaaaccaggactagatatcag

SEQ ID NO: 76635 - DNA, 177 bp, Glycine max
  Peptide Sequence Number=SeqID_193413
atgatgtttggtgtgggcattgcccgttctcgaggcagagccttcaacgacgtgatgaggagggcgttacttgcatgggtttccgatgacgtgagaaatgagcctccggcgattgttgttgttgttgagaatatagagagaaataaggagaaacggttgccaattaaaggattttaa

SEQ ID NO: 76636 - DNA, 453 bp, Glycine max
  Peptide Sequence Number=SeqID_193414
atggataatgcaacatttcgaagttttcttcaggttcttccccctgttgaatttgcatgcgtctatggatcatctcttcatccatccaaccacgacaagacaaccatgacagattatattcttggcgtgtctgatccaaagcagtggcattctgagaatctgaaattgaacaagcatcactatgcgtcatggatggtgcaccttggtggcgagagcctgattactggagttgctgatagaattggtgtgggagtgcatttcaacccttttgttacttggaatggaaagctgttcaagtatggggttatacaaatgcatgacttacttcaagatgttcagtattgggagaaattctacttgtgtggccggttacagaaaccagaccgtttatttaactgccgtcatgaactagcagtgaaggtagatatgcagaggaacactagtaacatatag

SEQ ID NO: 76637 - DNA, 528 bp, Glycine max
  Peptide Sequence Number=SeqID_193415
atggtagaaataagtcaagatgagagggaacaaataagggaagaagaaagaagaagaatactaaaagagttaagaaaagaaaaacatgactcctatagtagtcataactcctgcaagagcttaagtgaagaatttagtgactattatagaggaaagcataggtcacttttgcaacctaccattcggaaggggcacgaaaaggccgacacaatgggccaaaactgtttgtctccgaggcaaaaaatgagtggagtcgccaccaatgtttatttgagaaaaacgacctctggaccttgggacctcattcttagcctcccttcacgcctatttatagcaaaacaaggcatttgggatgaaggtagctcgcccaggcgagcaaataacttcatcctgaagcaaccctacttgcccaggcgagctgagctcgcccagggaagtaaaaataaagacactaattccgttctagggatctcaccatctaactggccactagcggaagtccaagcagtaaaacctgtgaaaacatga

SEQ ID NO: 76638 - DNA, 312 bp, Glycine max
  Peptide Sequence Number=SeqID_193416
atgggtcggaaagctggtacgcttttcatcaaccccaagagatttggtaatcttcaaaaaccttgcatgaaggaaatggcattgtttctcagttgtatggctgcaaaccatagcgataccgacgcttgtgctcgccagaaggagctattaaatgtctgtattgatgctcagcctctttgcatatgcaagagtaaggctgcgtacaatatcccttccccataccttcacatagtgaagagcctctgggcaatggggtacgaagtggaagtggaagtggagtggtggtgtgttggtattagttttagaggatga

SEQ ID NO: 76639 - DNA, 1413 bp, Glycine max
  Peptide Sequence Number=SeqID_193417
atggggaatcccaacatgtgcaatgtttgtctagagtttcctgaacatcagcagctgattgttgacagtagtgctttaactcatcttgttgatcttttgaagaggcacaggaatggcttaacttctcgtgctattaatagtctcattcgtagggcagcagatgctattactaatcttgctcatgagaacagcaacattaaaacccgtgtcaggatggaaggtggaattccaccacttgctcatttgcttgattttgctgatgcaaaggtgcaaagagcagctgctggtgctctgcgaaccctggcttttaaaaatgatgaaaataaaaatcagatagtcgaatgcaatgctcttccaactttgattctaatgctacgttctgaagatgctgctgttcattatgaagcggttggtgtgattggaaatttagtccactcttcacctaatataaagaaagaagttcttctcgctggagctttacaaccagttattggattacttagcaataatattcaatcagatatattccgtggaagttcctgctgctctgaaagccagagagaagcagccttgttacttggacaatttgcagcaactgattcagactgcaaggttcacattgtacagagaggtgctgtccgacctttgatagagatgcttcagtctcctgatgtacaactcagggaaatgtctgcttttgcattgggaagattggcccaggacccacataaccaggctggtattgcacacaatggtggcttagtgccgttgctcaagcttcttgactcaaaaaatgggtctttgcaacataatgctgcttttgctctttatggccttgcagataatgaggataatgtgtccgatttcattagggtaggtggagttcaaagactgcaggatggagaatttattgttcaagcaactaaagattgtgtagccaaaacgttgaaaagattagaggagaagattcatggtcgtgtgctgaaccatttgttatatctcatgcgagcttcagaaaagggctgtcaaagacaagttgctttggctcttgcacatctttgctcttcagatgatcagagaataatttttatcgatcactatggtcttgagttgcttattgggcttcttggctcatctagctctaagcagcaacttgatggtgctgtagctttaagcaagttagccaataaagccttgaccttgtctcctgtggatgctgctcctccttctccaacaccacagactattcttcttgcaggcaaacgattttatgctcatcgaatttgtcttcttgcatcatcagatgcatttcgtgcaatgtttgatggtggttacacgccaacgaaggcctctagtggcaatgggtattgttcacccgtgaataaagcacgctctgaggtggttccagtgtga

SEQ ID NO: 76640 - DNA, 222 bp, Glycine max
  Peptide Sequence Number=SeqID_193418
atgtgggtgcaagccattggtttgtttgctcgagcgacgtgcgctcctgaaatgctgaaatccaagaccgttcaatcagaaattactcgtcttgcacgttggtgggggtgccgtaaaacaacgaagagaagtgagttatcaagaataggatgtgggacaaatggcctcagttatcttaagaaggggggtcgaattaagatacaaagactattccccaattaa

SEQ ID NO: 76641 - DNA, 420 bp, Glycine max
  Peptide Sequence Number=SeqID_193419
atggctaaaattgatcttattggaccagctttttacaagaattggagttgcgcttcgcatcatcctactgtaaaacttgagttccttatgatgggaaccgcatgtttcccaactactaatgttgttctcaaacctcaaaacttatctgggaatttctctaccctctgtgataactttcggtgtctgaggttcctcactccgaaaccgccccacctgcgatcctctcactctaagttgggaaatagagtaaagctgacatctttttcgatgtccaaggcaacccatttgaaggtttcacaagctgcactctcatccacggaagaatcactgtcttcatctcctcgggtaataggagaacatgacttgctcattgtgggtcccggggttcttggtcgtttggttgctcagaagtggagtcag

SEQ ID NO: 76642 - DNA, 693 bp, Glycine max
  Peptide Sequence Number=SeqID_193420
atgaagcaaatggttgacaaatcgacaattgacttcatagagggctttagaaaggccggaagtcattgttcagtgcaatttcttgaagtagaatgcacgactatggagaaagaacaaaggagggtcaataaagggcgaggatcccacttgatctcattggtcaatattgatgaggacaatggggaaatttgggaagaggaagctaagattatggttgctgaaatgttaaggggaaagccttgttcatgtccagctttgaagccagggaaagaacaagggtgttgctggagatggaaagatagccataagatttcgtctcctgaagaattaaaggggaagaactactgcaagtggcataattcatacatccattttacagctaattgcatcgtgtttcagcaagttgtgcaaagggcttttaaagaaggccactttaagctagccgataggggtatagccgaaatggtagtagacacggatcctttcccaaaattggatatccatatcgtgtcctatgagcatccaacagccaaaagaaagatgaaacaagtagagggtatttccaatgggcctatctatcctattactggtcctaagctagtcgatatgcggcaagctaagagaagaaatgaggaagccttgaagtttgagaaactaaggcaacaaatccatagggaagcagaagtgggttaa

SEQ ID NO: 76643 - DNA, 1293 bp, Glycine max
  Peptide Sequence Number=SeqID_193421
atggaaggttttcacccttctatgtcctctcctttttcgtacacattccctatcagtggtgctggtactagcaattacagcacttccactccatggatgaacagcagaatatggagcaagctccctcagaggcttcttgaccgtgtcatagcctttcttcctccaccagcattctttcgtgcacgttgtgtttgcaagagatggtatgcacttctcttctccaacaccttcctcgaattgtaccttcaagtctcaccacaccagcactggttcttgttcttcaagcaccacaagacccgcaagagctacatctacaagaacaacaacaatggaacaagtggtggttgtggacatcacggtggtgcgtttgaagggtacctctttgacccctatgagatggcatggtaccgcatttcctttgctttggtcccttctggcttctctccagcttcatcttctgccggtttactttgctgggtttctgatgaggctggtccaaagaccatgcttctgagcaaccctttgatcggttctctcactcagctacctccaacattaagacctagactcttcccttccattggcttaaccattagccccacctgcatagatgtcactgttgctggtgatgacatgatatccccttatgcagtgaagaacttgacatctgaaagctttcacatcgatggaggaggttttttctccttgtggggcaccacctcttctcttccaaggctctgcagcctcgaatctggaagaatggtttatgctgaaggaaaattctactgcatgaattgtagccctttcagtgttttggcttatgacatcacctcaaacacttggttcaaaatacaagccccaatgaggaggtttctaaggtctccaaacctagttgagtgcaaggggaagcttcttcttgttgctgctgtggagaagagcaagctcaacgtgccaaagagtttgagggtgtggagtttgcaggcgtgtgggacaatgtgggtggagtcagagagaatgccgcagcagctttatgttcagtttgctgaattggaagatgggaacgggtttgaatgtgtagggcatggtgagtttattgtcatcatgatccgtggaacggacaaggccttgctgtttgatatatgcaggaagaggtggcagtggattccaccttgtccttacattgcacatgatggatttgagttgcatggttttgcatatgagcctaggcttgccacccctgtcactggcctccttgatcaattggcactgcccttccagagtttcaatgcttag

SEQ ID NO: 76644 - DNA, 692 bp, Glycine max
  Peptide Sequence Number=SeqID_193422
atgtttgatgtccaagaggaagtggatcacggaaaagaagtatttcctattaaaaggaagtcacccagttttgaagcacaagatcccttagaagagaatgttggttaccaatcaaagaaggggctaaaccacatcgacaacctccaagaagatgtaacccacaacttttgccacaaatcaagggaaaaattgaaaggatgttgggagctggatctcaatttggcaaccccaaaagatgaatatgtgatacctatagctgacatgctagtggacgctacaactaaacatggtgtgcttaatttcatggatggtcattctgattataatccgatttttatggttgttgaagatgtgcataaaacaacattcaagtgtcttagaactcttgggatggcattggataaaagactccaagaagattacaccaaagatgaaggagaagttcctaaggttgagcttagctattggagggcttcttatcccaaacactctcttggtggtgaagcttcttcttccatggcttattccctagtggatgacgcctcctctcacctcttctcctttatctttcactgcaaatccatagctgaaaatcaccattggaggacctcattgaagctcaaagatccagtcttcatagaagcttctcaagcaagcttccttcaagtggtatcagagcacatgagcttcaa

SEQ ID NO: 76645 - DNA, 261 bp, Glycine max
  Peptide Sequence Number=SeqID_193423
atggatgaagccaaaccaatgactatccctatgcatccatctattgtcattgaccaagataagaaagattccaatcttgtccaaagaaagcaaaacttctcactcacccctcctaaaaacgaagataagagaaaaggcaaggcgatagaggcgtcttctgggtctgattcagaagctaccataaccatcacacgccctcgtgccaagggcattgtgattgggtcaccaacaaagagaagctttgtgaaggaagaaaattag

SEQ ID NO: 76646 - DNA, 2046 bp, Glycine max
  Peptide Sequence Number=SeqID_193424
atggatcctagacgctgtaatagtttatcctattcttttgtttttgctccactgcaaagagtatatgaagaatttaaagtgaaaattaatgccttagtggaaaaagcacagaagaaaccagacgagggttgggtaatgcaggatggcaccccttggtctgggaacaacactcgtgatcatccaggaatgattcaggtatatttaggaagtggtggtgcattggacgtagaaggcaaggaactgccacgacttgtgtatatttcacgtgaaaagcgtcctggctataaccaccacaagaaagctggtgctatgaatgctttggttcgagtttctgctgtgctttcaaatgcacatttcatgttaaatctggacagtggccattacatcaacaacagcaaggctatccgagaggccatgtgctttctgatggacccccaactagggaataagctctgttatgtccaatttccgcaaagattcgatggtattgatcggcatgatagatatgctaatcggaactttgtgttctttgatatcaatctgaaagcccttgatgggattcaaggtccggtttatgtcggtactggatgtgtgtttaataggcaggcattatatggatatgatccaccagtatctgagaaaaggccaaagatgacttgtgactgctgcccttcatggagttgctgttgttgtggtggatcaaggaaatccaagtcaaagaagaaatcaggaggaggaggagggggtctatttagtagattatacagcaagaagaagaaaatgatggggaagaattatgttaggagagggtctgagtccatgtttgattttgaagagattgaagaagggcttgaaggctatgatgggatagagaaatcatccctcatgtcccagaaacaatttgagaaacgattcggacagtcaccagttttcattgcttccactctgatggaaaatggtggacttcctgaaggcaccaatagccaatcacttatcaaggaagctattcatgttataagctgtggctatgaagaaaagactgaatggggcaaagagattggatggatttatggctcagtcacagaagatattttaacagggttcaaaatgcattgtagaggatggaaatcagcatactacatgccaaagagaccagctttcaagggatttgccccaataaatctatcagataggttacaccaagttctgagatgggctcttggttctgttgaaatttgccttagtcaccattgtccattgtggtatggctatggaggaaagctgaaatggctagagaggttggcttatactaataccattgtttatccactcacttccatcactctacttgtatactgcacaatttcggcagtgtgccttcttactggaaagttcatcatccctactataattttatcccttgctgacaagttttactcgatgcagttgaccaaccttgctagtgtatggttcatggctctattcatctccatcattgtaactagtgtcctagagcttaggtggagtggggttagcattgaagacttgtggcgcaatgaacaattttgggtcattggaggtgtttctgcacaccttttcgtcgtattccaaggtctccttaaggttcttggaggagtggacgccaatttcactgtcacagccagagcaacatatgatactgaatttgaagagttgtatctgttcaagtggacaacacttctcatcccaccaaccactcttataatcttgaatatggtgggagttgtggctggagtctctgatgccattaacaatggctatggttcgtggggtcctttgtttgggaagctattctttgccttttgggtcattgtccacctatatcctttcctcaaaggtctcatgggaaggcaaaacaggactcctactattgttgttctttggtcaattcttctagcatcaattttctctttgatttgggtcagaattgatcctttcttgcccaagcaaactggtccagtactcaaacattgtgaagtagaatgccaaggcattggagttgcactt

SEQ ID NO: 76647 - DNA, 639 bp, Glycine max
  Peptide Sequence Number=SeqID_193425
gaacttccgggtagtcaagtttatggtcagacagtgaccactgatcatcacaacgagttgattcaaatgggtattaacccatctttgaaatggacagaagctactcacaaatttcccaatgtcatttattgtgctccaccctctcgtaccccagactatgctggtaatattaggctagctgcattaagctggaacggtgaaggttctttcttatttacatcaagcagtgctccatatgattgtaatgataatggaccatgtgatgaggattctccggttgtgcctattgggaggagccccagagttgatgtccttctaaaagctgaaaatgtggtactggatggtgcttatgatggggataaaattggtgctcattttgacatgcttccacaccaggatgcagcttccctctcagttgcaatcttgaagaaaaacttccgtggacagattttcttgggttgtgataatcatcctttgtctaggcaagaaatgatggatctggttaataaaagtgggaaattcagtaaaaaatttgacaagtttactggaactgatggccctcttggaaagagattaaataacacaagaaccagccagggaattcttgctgtagatggagagttcatcagacatgcctga

SEQ ID NO: 76648 - DNA, 408 bp, Glycine max
  Peptide Sequence Number=SeqID_193426
atgtgttttattgcatggcaggagaaggaggcaagggacatagagattccaaatattagatgggaggtttttgagttgatgatgaggtctattgatgtcactctggatattgctctagatcttctccgagcagccaatcaatatcttttggaaggacttaagagactctgtgagtacacaattgcacaggatatatcgccagagaatgtgtcaagtatgtatgaactttcagaagccttcaatgcaatatcattgaggcatgcatgcatcctttttatcttggagcaatttgataaattgagttcaaggccagggcactctcttctgattcagcgcataataccagagatccgcaattactttgttaaagctcttacaaaggccaactctcatgacaaccaactgtag

SEQ ID NO: 76649 - DNA, 438 bp, Glycine max
  Peptide Sequence Number=SeqID_193427
atgagattctcagcggtgtattttgtcttattattatttgtggtggcagaactagaagcaaccacatgtttcactttcaacaaagagaaaaagctgtcagaattcaagaccaaagttcatgaaaagattcaaaagttatcagcacctgcttcttcatcagaaacaaagaagagtgggagggtgctgtacgtgagtgaatatggtgcagacccaacagggaatgaagagagcagtgatggcattttgaaagctgttgaagatgcttttgcgttacagaaaggtgttgagtttgttggaggagtgaatgaccttggaggagttgtgattgatttggaaggtggaaactacaaaatcagcaaacccatttcattcccttcatctggtggtgccaatcttgtggttagtattccttttcctctcttttgttacattccatag

SEQ ID NO: 76650 - DNA, 249 bp, Glycine max
  Peptide Sequence Number=SeqID_193428
atgagacctactggtggcgtactgaacactgaatcgttcgatgagggtgtcgaagctatctatggatcttggaaggcgtccaaatgcttgtctggatctgttgtctcatcataccgctcgaggttaagtgatttccaccccaagggtatgtctacctccataatgcggtcgataaaaggatgccaatggacagtctgtgttgttggacgatgcatgagagagactcagatcgtctgcaatgttgcttga

SEQ ID NO: 76651 - DNA, 727 bp, Glycine max
  Peptide Sequence Number=SeqID_193429
atgtcagaaatcagccgtgccgtactcttcggcaaactggatacgctgttatttacctcgctggaaagcgccaccgccttttgtaaactgcgcggtaatccttatgttgagctggtgcactggctgcaccagctgatgcagcagcaggatggcgacttacagcgggtgatcagccatttttcactggatgaaaacgcgctgacgcgggatatcgtcgcggcgctcgaccgcctgccgcgcggtgcgagcgcggtttccgatctcgccgaacacatcgacagcgccgtcgagcgcgcctgggtctacgcctcgctgaagtacggtgcgacgcgcattcgcggcggccatctgctgattggcatgctcaaaaccttcaacctcgccagcgtgctgaaaggcatttccggccagtttggccgtatcaatgctgatgcgctgctggagcagttcgacacgctgctcgccagcagcaaagaggcacagcaggcgctggtggcacagccgggcgtggagagtgccgcaccggcagccagcaccagcacgctggcgcagtacgcgcaggatctcaccgcgcgcgcacgcgaaggacgcatcgatccggtcaccggccgtgatgaagagatccgccagatggtggatattctgatgcgtcgccggcagaacaacccgctgctgaccggcgaggcgggcgttggcaaaaccgcggtggtcgaaggcctggcgctgc

SEQ ID NO: 76652 - DNA, 222 bp, Glycine max
  Peptide Sequence Number=SeqID_193430
atgttcagcataaattccgccttgaaatcggcccgcttagcgccgccgaatacgcccgttttctgccgggcgaaaacgcgggtacttatccgcggcgatgaaatacccggtacggtcctcagcggcgacggcaaactgggttacagcacctggcttggccaccagccagcccccgcgccgcgtggcgatttagtgtttagcgtggagcagagcgacgcttga

SEQ ID NO: 76653 - DNA, 384 bp, Glycine max
  Peptide Sequence Number=SeqID_193431
atgaaaaagactgtatgtcgtaccctaatttcgtccagggacaattgtttgtcaacatacgggtttttgctggtcacgttgagttgcttagagccaattgtcacgcgatccgtaagatttcacgatgtttcagatggaaataagccaaaaactcaaaacgggggtgaactgatcaatttagggggtgttcttcagccctgggcccatctaggcccatcaggaagcttctacatgaagcaaccagctcacctgggcgagcatgttacttcaggcttaagccaccagctcgcctgggcgagctgggtggcaagctcctcccctattttggctataaatgggcgtgggaggctgaggggaaggggtcagcaccctgcgaaagaataa

SEQ ID NO: 76654 - DNA, 219 bp, Glycine max
  Peptide Sequence Number=SeqID_193432
atgacaaggggtaaaaggtatgtggaggttaaggatgaggatagtgttgtgcataagaagaaaactgctgtcaagaaaagtattgatggcaagaaaaatgaggaaagcatcataatggaaggaaattgcagtgctgtgatccagaagatccttccatccaagcttaaagatcctggaaactctagcttatatagcaagtttaatccatggaaactctag

SEQ ID NO: 76655 - DNA, 1179 bp, Glycine max
  Peptide Sequence Number=SeqID_193433
atggcgaatttgccctggcgtgtcagcgtgcgtgttatcgcgcttgcaaagaaaatggcgatggttgcagggatcgtcgtggtcgtcctgctggcggtgcgggtgtatctttcgcagcagggaccggaactgcacctttggcacacctggcgggcagatgaaatgtccgtgcgcgagctggataacgccgattttgccgggtatctcacccgggaaaaggcgattttcgccgacctggataacgcggtaacggtgaaaacagggcacgaggagcaaacgccgctaaaccgttattatcgccagagcctggtgtggtcaggtcagttttcacccgatgccaaccgctcatttgtgctgatgccacccggaaagccccgcggcgcggtagtgctgctgcacgggttgacggactcgccttacagcgtcaggcatctggccctgaactatcagcagcacggctttgtggctgtggttccgcgcctgcccgggcacggcaccgcgcctggcgcgcttactgacgtggactgggagatgtggctggcggcgacgcgccttgccgtgcgggaagccacgcgtctggcgggagagcatgtgccgctgcatctggtgggctactccaacggcggagcgctggcgatgaaatatgccctcgacgcgctggacgcgcctgcgctgcgaaagccgcagcaggtgatactgctttcgccgatgatcggcgtgacggcctttgcgcggttcgccggtttcgccgggctaccggcgctgctgccggcatttgccaaagcggcgtggctgaatatcgccccggaatataacccgtataaatacaattctttcccggttaacgccgcccgccagtcgtggctgctgacgaaagccctgcaggagcagattggccgcgcggcgcgggaaaacaggctggagaatttgccgccggtgctggcgttccagtcggtgatggattccacggtcagcacccgcgcggtggtcaccggtctgtttgaccagcttccggcaaacggcagcgagctggtggtgtttgacatcaatcaggcggccagcttccgcccgctgttcaaaccgtcgtcgtggacggcaacctcggcgctgctgccggttgcacagaggcgttacagtgtcacggttatcaccaatgcggacgagcacagtttcccggcg

SEQ ID NO: 76656 - DNA, 564 bp, Glycine max
  Peptide Sequence Number=SeqID_193434
ctgcagattgagatggcgcaatcatctcgaccctcgagtgaacagaaaccctttcactggagaggaagaggagaggctgcttgcagcgcacgaagtgtatggagcgagatgggcgctcatatccaagctcttcaacggcaggacggataatgctgtgaagaatcactggcatgttatgagggcgagaaagagaagggaatctaagcagaaaaactggccaggggtatttcaggattcatacgcttcatcctccagcaacactgttctccatccaaatggaccaaaccctcatgacatggtgtgccccagtaatggttcttcgagctctgccaagtttggaacgataccatccttcgcagactctactcctgtgaatgggagtgatcattttggactattcaatggtgctgatgatgcaatgcttcaaaggagtttgttcgataactcgttcgcggagttcgggtcttcttcttcgtcagtgcaagtgcaagcagatgaggagtcaaatggtagtggacaaaaagaagttcctttctttgattttcttggtgttggtgatgacca

SEQ ID NO: 76657 - DNA, 154 bp, Glycine max
  Peptide Sequence Number=SeqID_193435
atggccaattcttcggcagctgctgaggacataaccaatcgtcttcgtgttaattactggaagaaagatgaggatgtaaagctcttgcaacaggttcgagaacatggtccacaaaactggagatcaattgcttctcatctagaaggaagaactg

SEQ ID NO: 76658 - DNA, 243 bp, Glycine max
  Peptide Sequence Number=SeqID_193436
atggatcttaggttgggctatggagattatgttgtgtcaatccagaagaggagcattatttcaagttcaacttatgagaatagaaaggaagacgcaaatcaattgcctcaaaaccctggcatgcagtttcttccatctgagatgctttctaacatgatagagaaggccggagagcaaatgttcgctaggaggtctgatcagctaagaattcttcagctcgtgaacaagaatgagagaaattaa

SEQ ID NO: 76659 - DNA, 714 bp, Glycine max
  Peptide Sequence Number=SeqID_193437
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgaggtcataatccaacgcacggtagcttcgcgccactggcttttcaaccaagcgcgaagaccaaatgtgcgaatcaacggttcctctcgtactaggttgccttactattgcgacactgtcatcagtagg

SEQ ID NO: 76660 - DNA, 204 bp, Glycine max
  Peptide Sequence Number=SeqID_193438
atgtgcagcaaacatcagcaccgactcaccgagaagttggtggaagccttcgtgaatgccattgttgatgagaatcaccctgttgtatatgctggatcgataaacgcgccaaaggtcctcgcaaacatccttcaatccattgtcgcgttctctatgtcgaccaaaacttcaaccttcaaacactatggccactgtgtacgttga

SEQ ID NO: 76661 - DNA, 447 bp, Glycine max
  Peptide Sequence Number=SeqID_193439
atgtctcttgctactttatttggaaagttacaagaacatgaaatggaattgatgagattgaatcaacatgaggagaatgataagaaaaagaaagcaattgctcttaaagcttcatcatctactcaagaaggaagtgataaggaggactcaattgaaatagacaaagatgatgatcttagtctatttgtaaaaggattcaacaaattcttgagagtaagaggaaatcaaagaagatcaaattttaaatcaaagaaaagggcagaagattcatcctctactccaagatgttatgaatgcaatcaacctggacatttgagggttgattgcccaattctcaagaaaagaatagagaaatctgaaaagaagtttttaatgaaaagaaggcctgcattacatgggatgacattgatatggactcacataaagattcagaaaacgaagttgtaa

SEQ ID NO: 76662 - DNA, 396 bp, Glycine max
  Peptide Sequence Number=SeqID_193440
atgaaactggccaaatacaggctaaaggcccaagtggagaagaacgaaggcccaagtggagaaggacaaagcccccgagtggagaaggatgaaggcccaagtaatccttgtggcgtctacccagacttatcttccttcactggaagtggcgtctacccagacttatcttccttcaccggaagtggcgtctaccctgacttatcttccttcaccggaagtggcgtcatccaaaagctctacagcctgtatcaagcgttccgccccgtaagattcacatcatctggtatcagagctttggctcttgatacagcctattcgaattctgtttggggtaaaaattgcctaattgctgaattgctaaattgtcaaatttgcctaatgatgattgcctattga

SEQ ID NO: 76663 - DNA, 1220 bp, Glycine max
  Peptide Sequence Number=SeqID_193441
gttcgggccgcgccgcgcggtggaagatatctcgctgcgcatcgacgcaggcgaaacgctggtctggtgggcgaatcgtgatcgggcaagagcgtgacggcgctgtcgattatgcgtctgctgccgcagccgccggtgagttatccgcaggggcgagatcctgttttgacgggcgcgatgtgttacaggccagcgaacgtgagatgcgcgggctgcgcggcaaccagatggcgatgatttttcaggagccgatggtatcactcaatccgctgcacagcgtggaaaagcagctgtatgaagtgctgtcgctgcaccgtggcatgcggcgtgaagcggcgcgcgctgaaattctcagctgcctcgatcgcgtaggcattcgccaggccgcgacgcgcctgcaggattttccgcaccagctgtccggtggcgagcgccagcgcgtgatgatcgccatggccttgctgacgcagcccaaactgctgattgccgatgagcccaccacggcgctggatgtcacggtacaggcacagattttacagctgctgcgcgaactgcagcgcgaactgaacatgggcatgctgttcattacccataacctgaacattgtgcgtcagctggcccacagcgtgacggtgatgcgcaacgggcgcgaggtggaacacaaccgctccttatacccgcgagctgctggccgccgagccggacggcgcaccggtaccgctgatcgacgcgccgccgctgttgcagcgcaccgtggcggaaaaaaccgcgctacacaatctcagttttaccctgcggcgcggcgaaagcctcgggttagtcggcgaatccgggtcaggcaaaagcaccaccggcctggcgctgctgcgcctgattgctgcgcgcggcgagatctggttcgacggccagccgctgcatcagctgagcgcgaagcagctactgccgctgcgccagcgcattcaggtggtgtttcaggatcccaactcttcactcaatccgcgcatgacggtacagcaggtgattgccgaagggctggcggtgcaccagccgcagctcagcgctgccgaacaggaagccagagtcattgcggtgatggaagaggttggcctggaggcagcgagccgcagccgctacccggcggaattctctggcggtcagcgccagcgtatcgccattgcccgcgcgctgatcctgcagccgcagctgatcgtgctggatga

SEQ ID NO: 76664 - DNA, 1089 bp, Glycine max
  Peptide Sequence Number=SeqID_193442
atggagtctctctttgatgcacttttgaattcatctagtgttaaagggtttgggatgtacctaacgcacgagtctgtgacaattcttcatgtaaaaggaggaacgttaagagcatctgatacatttcctggtgatcggcatctaattgagttatggtcatcaaattccgggaaacttgagacaaaagaatctctgaacgctgatgtcttcaaaagcatcaaagctcaaaacaatgcaatttactatgaagacataacgtttcgggacatccttttcgattcatcctacagaggaggagggatattcatcgttgattcggctagaacccggatcaacaattgtttcttccttcatttcaccacagaaggaattctggtccagcaaggacatgagaccttcatatcaagttgttttcttgggcaacactccaccgttggcggagataaaggcgaaaaggacttctctggggttgccattgatcttgctagtaatgacaatgcagtcacagatgttgcaattttctcagcagcaattggtgttgtgctaaggggtcaagccaacattctaactggggtgcattgttataacaaggcaacatattttggtggcataggcatattagtgaaattggcagtcatggaagatcctgtgcaagttcatgtcactaatgggttgtttctaggggatgctaatattgtattgaagtctattaaaggtcaaatttttggcctaaatatagttgataatatgtttaatggtgaccccaataagaaggttcctattgtaaaactagatggagaatttagtagcattgaacaagtggtgattgatcgcaacaatgtgaatggcatgagcttgagatcaacagttgggaagttaactgcgagcggaaatggcacgaagtgggtggctgatttttcatcagttttggtgtttcctaataggattagtcattttcaatattcattttatgctcaagatgaggctaaatttgtagcactttctatgaccaatgtgtcagataatgttgttgttgtggagagtgagaaagaagctaaagggttcgtctccttcaaagttgaacaataa

SEQ ID NO: 76665 - DNA, 315 bp, Glycine max
  Peptide Sequence Number=SeqID_193443
atgtgggaagacgtggttgaaaatggtaactgcatacctttggacgagaacttaaaagaaatacctcacagtaggtggagtgatgaggacaagaaaacatatctcttaaactctaaagctggaaatgccattatatgtgctttacttgaagaaaaatatacaaaaatgcatagcactaagagtgttaaacaaataagttttcctagacagtggagaccacatgtaacaacgttgaaagtgtccaaggatcttgcaagattatctctagaaaggcttattggcatcttgaaggcctatgagatagagcttcaataa

SEQ ID NO: 76666 - DNA, 387 bp, Glycine max
  Peptide Sequence Number=SeqID_193444
atgactgaagcacgtcaaaaggggctttggatattttgggatgctttcatccacatcgaggcggtggtgaccgcatgggcgtctccttcctttttcttcgcgcccactactggggctcttctgttgttgttgggggcacattggaagcatattcgaacttgcctttttgtagtccggatcaatcctttctccggcgaagacgagatccgcaaagttagctggcatgtagccaatcagcttttcatagtagaacgtgggtgtagacaaaggattaagctgaatgttttgatgatgccaaaggattacatgaatcatatgcttctcaaagatttactcaagacaaagaaattaaagatattcaagatggatgatcaagacagtctatag

SEQ ID NO: 76667 - DNA, 136 bp, Glycine max
  Peptide Sequence Number=SeqID_193445
atggagatgaatatgctggcttcttcgttcactggttatgcaaaaccctttgcaagtgtaaacccttctcttcttcccttcagggcttcttctctgcgccatgactaccctcttgcaagcaaaattgttgttaaaa

SEQ ID NO: 76668 - DNA, 411 bp, Glycine max
  Peptide Sequence Number=SeqID_193446
atgtatattcttggccttcaacgccaacatggtgccattaatttgttggaagctgtcaattcttacttctcttcacatggcctattctgtacattgaatacttcctctttcacagtggatgttgcagcatcaaaagatgattgtgattcaatcttgaggaatgaattacacatcatcaacaaatccatcaattgccaacctacacaaaagacatctaatgggtcgagtttgaatctctcttctgagagattatgctttcgtatatcggtttttcagcaaattcctgggacactgttggtgaaaggttcattacaagacaggaattgtgcagtatcagtagcactttgtctagaaatagctttggaggaatgcgttctttgtctgtgcttcagagatatccttattggctaa

SEQ ID NO: 76669 - DNA, 3847 bp, Glycine max
  Peptide Sequence Number=SeqID_193447
aactgcaagctaatgagcctatgtcagttcaaccagtttcactgaatatcatgccaaatggttttgattgcacagtgattgaaggaaatgtcactcatgatgagaatgtagctcaggcatttgtcaattcatctattaattctgatgctgctatacaatgtgaaagcggtgctgatgtacctactagcatccacaatgtgccaattgagtccatggaattcaatggatcatcaaatgctgatgggcagcctcctaatattgagttagggggctctggttttgaaactcccaatccaggtgattcccatgcatcgtcaatttatgctagtgctgatgttgatatgggtggtactgatgccgaaggaaatcaatcagagcaaccaactgtttttgaagacgggaggggtgagatgttatcaactcagaacactgaggttgctccagatgctactcaggctgaccaagttagtgcaaataatgaagcttctggtgctaataccattgaccctacctttttggaggctctgcctgaagatctacgggcagaagttctggcatcccaacaagctcagtctgttcaacctccagcttatgcaccaccttctgcagaagatattgatcccgagtttttagctgctcttcctccagatattcaagcagaagttttggcccaacaaagagctcaaatggttgcccagcaggctgaaggacagccagttgacatggataatgcctctataattgctacttttcctgctgaattgcgtgaagaggttcttttgacttcttctgaagctgttctgtcagcactaccatccccattgcttgcagaagctcaaatattgagggatcgagcaatgagtcattatcaagctcggagccttttcgggagcagccacaggcttaacaatcgaagaaatggtcttggatttgaccggcgacctgtgatggatcggggtgttggagttacaattgggaggagatctgctcttacagatagcttgaaggtgaaggagattgaaggtgagccactacttgatggaaatgcattaaaagctttgatccggcttctacgactgtcacagccccttggaaaaggccttctgcagaggctcttgttaaacttatgtgcacatagtgttacaagggccactcttatttatcttttgcttgacatgattaaacctgaagctgaaggctctgtaagcagaccagcgacattaaattcccagaggctttttggttgtcactcaaacacagtttatggtcgatctcaattgttggatggtcttcctcctcttgtgttccgccgaattctggagattctaacttatttggccacaaatcattctgctgttgcaaaattgttgtttcactttgatcaatcaattattccagattcttcatgtccagttaaggtgcatatgaatgagaaagggaaagagaaggttattgaagggagaccatcaccaaattcctctggagctcagacaggggatgttcccctagtgctctttttgaagctcttgaaccgacccctgtttctacgcagcaatgctcatcttgagcaggtcatgggtctgattcaagttgtagttgatactgcagcttcaaaattagaaagtcaatcacagtctgaaaaaggaatggcagatacccaaaatttgtcagccagtgaagccccaagtaatactgagaaggatgctccttcggtggagtcggactctaatcaacaagataagcatgcagatacaaatccatgccattctgaagggaagaagaatgtagatatgtacaatatcttcttgcagttgccacaatctgatttgcgaaatttgtgcagtcttcttggtcgtgaagggctttcggataaaatgtatatgcttgctggtgaggtgctgaagaagttggctttcattgtttcctcccataggaagttctttactttagagctttcagaatcagctcatgcgttgacaggttcagccatcagtgagcttgtcacactccagaaaacaaatatgcttggtttgagtgctggttctatggctggtgcagccattctacgtgtgctgcaagctcttagttcactcacttcacttaatactttgggtgatttggatatggaaaatgatgcggatcagcatgatgatcaagcaactatttggaatttgaatactgcactcgagccattgtggcaagaactgagtaattgtataagtgcagctgagatgcagcttggacagagctctttctctcctaacatgtcaaacataaatgttgccgagaatctgcaaggttcctctacttcaccacctcttcctcctgggacacaaagactcttgcctttcattgaggctttctttgttttgtgtgaaaagctacaagcaaatgaatccttcatgcagcaagaccattgcaatgcaactgccagagaagttaaggagtctgctggttgttcagcttcaacaagtgttaaaattggtggagattcactgcggaaattcgatggtgctatcactttcacaaggtttgctgagaagcatcgccgactgtcaaatgctttcattaggcagaatccaggtttgttggagaaatcactttccatgatgctcaaggcaccaaggctgatagacttcgataacaagagagcctatttccgctcaagaataaggcaacaacatgaccaacacttgtctgggccattgcgtataagtgtaaggcgggcttacattttggaggactcttataatcagctaaggatgcgtcctactcaggatctgaaggggcgattaaatgtgcaatttcaaggtgaagagggtattgatgctggtggtctcaccagagaatggtatcagctgttgtcgagggtcatatttgataaaggtgctttacttttcacaacagtgggcaacaatgcaactttccaaccaaaccctaattcagtataccagactgaacatctctcatacttcaagtttgttggccgagtggtggggaaggctttgtttgatgggcaactgctggatgtttactttactcgatctttctataagcatatacttggtgttaaggttacataccatgatattgaagcggttgatcctgattactataagaatttgaaatggatgcttgaggaaaagactgattgcgggtgtagagagcgagaactatggagcttggtgtacagccttgtcagtgagaatgatgtgagtgatattcctgacctgacatttagcatggatgctgatgaggaaaagcacatactttacgagaagaatgaggtcactgattatgagcttaaacctggaggaaggaacataagggtcacagaagaaacaaagcatgagtatgttgatcttgttgctgaacatcttttgacaaacgccatccgtcctcaaattaattcctttctagaaggttttaatgaattggtaccacgagaacttatatccatatttaatgacaaagagcttgagcttctcataagtggtcttccagaaattgatttggatgacttgaaggccaacaccgagtataccggctatacagtggcatcaaatgttgttcaatggttctgggaggtggtcaaaactttcaacaaagaagacatggcaagattactgcaatttgtgactggaacgtcaaaggttcctttggagggttttaaggccttgcaaggcatctctggtccacaaaggtttcagattcacaaggcatatggagctcctgatcgacttccatcagctcatacttgcttcaatcaacttgaccttcctgagtatacctctaaggaacagcttcaagaacgtttgttacttgccatccatgaggctagtgaagg

SEQ ID NO: 76670 - DNA, 3374 bp, Glycine max
  Peptide Sequence Number=SeqID_193448
atgccccctccacctgatgaggcaaccattgccactattgttgagatgggcttctcaagggcaagggctgaggaagcattgagaagagttgaaacaaatagtgttgaaatggccatggagtggctgtttagtcatgctgatgatcctgtccaggaggatgatgaacttgcacgggcacttgctctgtccctaggaagtagttctgaatctactaaagctgagagtgctgagaagactatagatgttctaactgaagagggacatgtgaagaaacctccagttgatgatatacttgctgcatctgtaaagttgtttcagagtagtgattcagtgccatttcagttgacagatttgcttgtaacactttgcagtcagagcaagggtgatgatcgtccaaaggataactgtgcattgagtgtgttagcacatatcttggcactgcttctttttgaggatggaagtacacgggaaattgctgctcagaatggcattatatctaccattatagatatcttgacaaacttcaaaggtaggcaggagttggggaaagaactaccagtccctaaatgcattagtgctttactacttatattggatcaaatggtgcagtcaagacccaaagttgaaaatatggaaggaacccagactggttccctgcctgattcttctggggagcaattttctgatacagttttaccaaaggaaaaaaattcaaacgggattgagaaagaacctgcaatggcttttgagaatatactgggaaaatctactggttttgcaactattgatgagagtcataaattgctggatattgcatgtgatttgataaaacagcatgttcctgctgttgtcatgcaggctgttctgcaattatgtgctcggttaacaaaaacacatgctttagctttgcagttccttgaaaatggaggtctggctgctctttttaatcttccaaggacttgccttttccctggctatgactcagttgtgtcagctatagtccggcatctccttgaagatcctcaaacactacaaacagccatggagttggagatacgacaaactttaagtggaaatcgccattcagggcgtgtctctcctcgatcatttttgacatcattggcacctgttatctctagggatcctatggttttcatgaaagctgcagcagcagtttgtcagatagaaacatcagggggaaggactgttgttgtgttgtcaaaggagaaagaaaaagaaaaatcaaaatcatcaagtgttgaggttgggttatcttcaaatgaatgtgtccggatacctgaaatcaagtcacatgatggactggggaaatttttgaaaagccacaaaaaggttcccgttaatctcactcaagtaattgatcagcttcttgagattgtgcttaagtatccacttgtgaaaggtcaggaagattctgagtgtgactcaactttcatggacatagatgaacctaccatgaaggtgaagggtaaatctaaggttgaagaggctgggatattagagcctgaatctgaaaggtctactggactggtgaaggtgacttttgtcctcaagttattgagtgacattcttctaatgtatgggcatgcagtaggtgtcatactcagacgtgactctgaaatgtgtcaattccgtggatctaatcagccatctggacatagtggtattattcatcatgtattacatcggttgttacctctctccgttgataaatctgcaggacctgatgattggagaggtaagttgtctgaaaaggcttcatggtttttggtagttttgtgtggtcgatctggtgaagggcgcaaacgagtgacaaatgaacttgttaaagaattgatgtctttttcacatctggagagcaattcaatgaaaagcagcttactgccagataaaaggctattcacttttgttgatctagtgtattctattttgtcaaaaaattcgtcatctggtagcctacctggttctggatattcacctgatattgcaaaaagcatgatagatggtggaatcattctgtctctaactagtattctgcaagtggttgatttggatcatcctgatgcacccaaaattgtgaatcttatactcaaagggttagaaggtcttacaagagctgctaatgcaagtgagcaaatctttaaatctgatggaactgaaaagaaaagatccgctgttttaaatgatagatctgatgatcaaataacagcaccatctgcagctgaagcagtggcacatgatcagaatgcgggcagtcaagaagcaagcagagatgcaatggataatgcacacaatcaaggaacttctcaaggtgatgatcgtgcggataatccagatcaatcaatggaacatgatattagagtagaagaaggggggacaatggctcaaaaccaaacaatggaacttggaatggacttcatgcgagaagagatgggagagggtggtgtcttgcacaacccagatcaaattgagatgacttttcatgttgagaatagggctgatgatgacatgggtgatgaagatgatgatatgggtggcgatgaggatgaggatgaggatgatgatgagggagaggatgaggatgaggatatagcagaagatggtgggggcatgatgtccttggcagatactgatgtggaggatcatgatgatgttggctttggagatgaatacaatgatgagatgattgacgaagacgatgatgattttcatgagaatcgggtcatagaggtgaggtggagggaagctcttgatggcttggatcacttgcagatacttggccaacctggatttatagatgtggctgctgagccttttgaaggtgttaatgtggatgacctttttcgtcttcagagttttgaacgccgccgtcagactggtaggtcttcctttgagagatctgccacagaagtaaatggttttcaacatcctctccttgttagaccaccaccatctggtgattttgtctcaatgtggtcatcgagtggtaattctgcatcccgagattcagaaaccctgtcatctgggaatcttgatgtggcccatttctacatgtttgatgcacctattcttccatatgatcatgtgccaagtagtctgtttggagaccgtttgggtggtgctgcacctccacctctgacagattattctgtgggtatgggctcattgcatctacctggaagaagagtgttaggtaatggtaggtggactgatgatggtcagccacaaggaagtgctcaagcagctgccattgcacaagcagtagaggaacaattcctagctcaattgtgcagtgtagctcctgctagcagtcctgttgaacgacagttacagaattctggagaacaagagaacaa

SEQ ID NO: 76671 - DNA, 267 bp, Glycine max
  Peptide Sequence Number=SeqID_193449
atggcctgcttggatcagcaatattctggaaaggagggacagattgttgttgttgtggaggacttgcccatctcagagttggatgattcttccaactgggattatatctgttgcttgaaatatcataattattctgctgttattggttttgttgccgagggggtctattataaatgtttgcagtataagcttcagaagaacatagaccacagagtcttgcaacaggtgcagatttctgattcatggcaagctgagttactaggttga

SEQ ID NO: 76672 - DNA, 183 bp, Glycine max
  Peptide Sequence Number=SeqID_193450
atgaagtgggctaagcgcgcatccaccgctaagtgcagcttcagcgcgacagaagaatctggcagggcatcaatatcaaggccgtgcgctaagcgtgagatcagtgtgctaagcacaacagttgtcttcagccaggctcaacgcacgtctggcgctaagctcaaatccccttacttgcactaa

SEQ ID NO: 76673 - DNA, 297 bp, Glycine max
  Peptide Sequence Number=SeqID_193451
atgacgaggcccaaaatagaaggcgaagacccaaacaaaggagtggtacagtccagcagtacaatccactcaacagaacagatagtcagatgcagaaaccaaacaaaacctagtttgcccgtaacatatccttcaaatcagtgtgtttatgaggaaggtatattgatgagatttgcaagattattcatgataatggaggccaagtaccaacaagttgttggtcagagtgatactggactcaatccccttaagaaaggtcttaagttcgagtattgtggattgagaaaacgtggttga

SEQ ID NO: 76674 - DNA, 546 bp, Glycine max
  Peptide Sequence Number=SeqID_193452
atgggtggaagtgatttggggggttccatccaacaacccttggtggaatgggaggtcattccaatcggtgactcctcgtcaaaggagacatgccacaaagcttttgatagtgagtcttcctcttttgagaggttgctggacctgcgtcatgtcgacgagggaaagggtgacaatgttgttgttagggtttcacctcataataagcgtagccgtagtgccaggatgtcctcacctcctcctttcattgatcatttcttcaaggtcaaggcgaccaatgtcatttctaacgagttgtcggtgaagcaagttggacctacagaagatgatgtgcctcctactccccttgtcatttgtgagccttctgttggggagggaagtcatcctaaggccagagtcgaccctcctcgactttgtgaagttgacaaggatgaagttgtcgaggttacgcccaacgtgccgccacctgtttcggccaagagaaagtgcaatgaaggggctgaaaggtccagtcaacgtaagaagtcgagggccctcttcaatctctga

SEQ ID NO: 76675 - DNA, 378 bp, Glycine max
  Peptide Sequence Number=SeqID_193453
aatggccctgatgaatgcgagctaaattcgttggaagcatgtgctctcaacgttttggatgatgtgaacaaacattatgctttgatttactgctttgagtttctggcaattgagggaaggcacaagaattggcaggactgtttcagccaattggacttgcctttggaacctattctgagctgctataacagaggaaatggaacagagcttggacaaaaatatatcaacgaaacaactctcttttacacaccccacgaatttctgccttgggtggtagttaacaatcaatctattggaaaggaatatgaaaattttacacgctatgtttgtgaggcttataaaggcattccggctccagcagcatgcaaccgtcgctag

SEQ ID NO: 76676 - DNA, 677 bp, Glycine max
  Peptide Sequence Number=SeqID_193454
gacgtgtgaggagatacatggagaaaaatgaagaaacaacaatggaggagaaggtaaagctgaaaattaatgaagcttcaatggtgattttcaatcatggaggcatagcggaagataatagagaagaggaggagcttcaccaccaagatagtgtcttggataagaagcttagagaggaagcttcaatggaggaaaagaatcaaagagagaaggggggagacgaaattgaaggagaaaaagagggagagaagttgaactttgaggtgtatttcacaagtttcacattcatcaaaggtgtgacagagaaatattccaaaaatatgccaaatgcatcttatcatattccaagaatgtgtcaaaagcttagcatattccctttagatgtcacaggaatgaaagaaatctaccttgaggttcatgagaatcctaaggccttattcaaaaactctagcacaatcctcttggagccttgtgctcatggctcttgtgactggtcccttcctagggaggattgcatcaggcacattggacgcaaggacaagggcaaccttatcttcctaagtttcactgaggtctctaagtattgtgctacgatttacctccacaacttacttctaggaacttctcttagtttgagtagcctttggacgcttgctcgaaggactagatgttggtga

SEQ ID NO: 76677 - DNA, 1032 bp, Glycine max
  Peptide Sequence Number=SeqID_193455
atggctcatctgagccacaagaccttggtttatcttccagaaatgaggcctgaacatgaagctgaggaaggccaacccagaaaaagtcttggttctttttcttcttggcctcatcgtttggagaatgttttccccgtttatgccatgggaacttccaaccctgcagtcttggattcttcacttcacacttctgattgtcttgatcctatttgggatgctgtcagagaagaagccaagttagaggcagaaaaggagccaattttgagtagcttcttctatgccactattctgtctcatgattgcttggagcaagcattggcttttgctcttgccaaccgactccaaaaccctactcttttggcaactcagctgatggatatattttctaatgtgatgaagcatgataaaggtatccagcaatccattcgcttggatattcaggcatttaaagatcgggatcctgcttgtttgtcatattgctcagcacttttatatatgaagggctaccagtctttgcaagtatatcgagtagctcatgctttgtggggccagggacgcaaagttttggcctcagctttgcaaagtcgagttagtgaggtttttggagttgatatacatccagctgcaaaaattggggatggaattttagtagatcatgggacaggtgttgttattggtgaaacagttgttgttggaaacagagtttcattgatgcaaggtgtaacttttggcggcacgggtaaggaaacaggtgatcggcatcccaaaatttctgaaggtgttctaattggagcacatgcaactatacttgggaatataacaattggtgaatgtgtgatgatagctgctggctcccttgtgttacaagaggttcctcctcacagcattgtggctggtgtaccagcaaaggttattggaagagtacatgagcattatccatccttaaccatgcagcaagatgaaaataagcatctatcggaggagtttttctatagcaaagatgaaaccacagaaaattactacataaattga

SEQ ID NO: 76678 - DNA, 1263 bp, Glycine max
  Peptide Sequence Number=SeqID_193456
gccaaagaagagaagattcaagtagctgatgacttgctcaatgaggcagatccacttagcaagtgtcatccgcttagcgaggcatccaactcgcttagtggatgggaaacccaagaagagaaagagtcagagatgtgcttgtccagcgggcagccaacccacccaccgaggatattgtctcttctcgcacttagcacacccagtctcgttaagccaaaattcacttactctcgcttagcgagcctttggaagctgaaaggtccaagaacctttaaaacactgaatggatcttcttctttagccttgccaatttcaagtctgtctgtcttgccgttagcggcgcctgcctcatcttctcacccaagtgtctcactagaccatgtttatacttcttgtgacatgaattcaatgtggagcatgggctatagaccggagcaaaagactcctattgactttgtgtccccttttgaccaaaaccttaatcgacagttggggagtttggcgattttggaggagaatagacaaaggcaccaagaagctctaaacaaagttgggtctttagagactgaggtcgccaaatggagagtctcgaggctggataatgacaaggtgtttggacgatgtaaaaactttttgaaagagatgaatggtttggcaagtagtgtggagtgcattgctgaagagaaaaaaaagcttattgcgatagtggccgagtctgctaaagtgattattgacctattagcccaactaaaagagtcagagtccaagatgaaggagtttgagcttgaggcggcgaaggaaaaggaagtgaacaaagagcttgagaagaagttgttggcgtttaagaaggaggccatggaacaacatgagaatggattctacaaggccatcaaggagcaagatgctgatgaagaagaagatgatggggccaatgtgttaggcgcgactttagctttcttgacgggtttgtatgaaatagagaatgagataacgtctgataatctcgtgtttgatttcaacctagttgaaggagccttggagattcatcgagactcaccaagagtaaaccttgggtttgacgagcctttgagattcgtcgaggctcaccaagggagcaccttggagaattgtcaaagctcaccaagggcagaccttgggtttgaggagccttggagattcattgaggctcatcaagggcggaccttgggtttgacgagccttagagagtcatcgaggctcaccaagggcggaccttgggtttga

SEQ ID NO: 76679 - DNA, 327 bp, Glycine max
  Peptide Sequence Number=SeqID_193457
atggcagaaccttggagaaacatcgacgtggaaaagctgatctcgtacagtgacgacctcgtcaaggtattgtcgcagggtccgcgcgacttcaacaacctctcccactctctccaacaaaagctcgccctttcttcctcctgcgactccgacctcgacgatgttcgctcttctctccaagactatcagaaaaaggtagatacatgcaagcagaaaatagaggaagctagatccgagactgctgctgatgcagacctggatctgctacagagagaactggaggaagaacttgagaaagaacacttgttgaaagaggagtttagataa

SEQ ID NO: 76680 - DNA, 279 bp, Glycine max
  Peptide Sequence Number=SeqID_193458
atgaaaggtgtgactctagcaccagggaaaggaatatgccacaagaatatgccaaaggaatattccaagaatatgctaaaggaatattccaaggatatgccaaagggtggaaaactacacacacccctttggataccctacaaacctaaaatggccaaaatacaagacccaaaagaagaagaaccaattctaatatttatagagaaaagtggaaccaaccttggcccatgggctcttaaatctaccctgaggttcatgagaaacctaaggccttcttaa

SEQ ID NO: 76681 - DNA, 2229 bp, Glycine max
  Peptide Sequence Number=SeqID_193459
atgacatcctcatctactagtataaaaaaagatgtcttcatcagctttagaggcccagatgttaggaaaggtctacttagccatttgaaaaaagaattgtgtcgcaggcagattgaagcctgtgtggatgagatacttgacagaggagatgaaatatcatcctcacttctcagggcaattgaagaatcacaaattttattggtcatattctcaaaagactatgcttcatcgcagtggtgcttggaggagcttgccaaaatgattgaatgcttggaaagaaacaaacagattcttgtacctgttttttttaacgtagatccatcagatgtgcggcagcaacacggagaatatggtgatgctttagctaaacatgaagaaaaactcaaggaaaacatgttcaaggtacaaagttggagatctgctttgaaaaaggctgctaatttatcagggtttcattatccaggaaattttgatgatgaatctgatcttgtcgataaaatcgtagaagatatttcggaaaagttgagcaagtctagcccaagtgagtcgaatggtctggttggaaatgatcaaaacattgtgcagattcaatccttattgctaaaggaatcaaatgaagtaatttttgttggaatttggggcatgggtggcataggtaagacaaccattgcccatgctatgtatgataaatattctcctcaatatgagggttgctgcttcttgaatgtaagagaagaagtggaacagcgtggactgagtcatttgcaagagaaacttatatctgaactattggagggagaaggtctccatacaagtggcacaagcaaagcaagattcttcgattctgctgggagaaagatgggtcggaaaaaagttctcgttgtgcttgatgatgtgaatacttcggaacaattgaaatatctggttggcaaaccaatttgctttggtccagggagtagagtgctgataacaagtagagataagcgtgtgcttactagcggaggagtttatcaaattcacaaggtcaaggaaatggaccctagagattccctcaaacttttctgcttaaatgccttcaatgaaagccatcccaaaatgggttatgaaaagctatctgaagaggtagttaaaattgcccagggcaatccattagctttaaaagttttgggtgcagatttccattccagaagtatggacacatgggagtgtgccttaagcaaaatcaagaagtatccaaatgaggaaattcaaagtgttttaagatttagttatgatggactgcatgaagtggagaagaaggcatttctagatattgcattctttttcgaagaagatgacaaagactatgttacaaggaaactggatgcttggggttttcatggagctagtggggtggaggttctccagcaaaaggctctgatcacaatatcagataatagaatacagatgcatgacttgatacgagaaatgggttgtgaaatagttcgtcaagaatctattatatgtccaagaagacgcagccgattgagggataatgaggaagtatccaatgtattgagacaaaacctgggaaccgatgaggtggaggccatgcaaatagatgtgtctggaattaaaaatttacctctgaaattgggcacttttaaaaagatgcctcgtctgagatttctcaaattttatctcccattgcatgccgagctttccctactgcaaagccatgatggacctatttggtctccggagaaacaagatgagctacttttatctgcagggtgcaaacaactcatgagggttgcaagtgagattcacataaaatgtcttcactaccttcttattgatgactgctcagatccttcactactcgatgaactaacatcaactgagatgagcatgctgcaaaacatagcacaagatgctggagtggaaataatattgaactcatccattgggcaactcagcagtcttgaatgctcagatgtggttgatcaacaatttaagaatcttcccaatgagctactttgcttaagatgtacatattaccttaagctttctaagagcaggcaacaagacatcgggaaacccaagctacatattctctttgatagtttaaggtattatcaacgaatatctgtcagtcagttgtataaaccagttgtcgtatttcctccgaaaagtcgtgcagagatgtggctgaaaggggctaaaaaggagaggtatttcacaagataa

SEQ ID NO: 76682 - DNA, 762 bp, Glycine max
  Peptide Sequence Number=SeqID_193460
atgtgggaatctgttgtgttgacggtagctgccaccgccggcaacaacatcggaaagatccttcagaagaagggcactatcattcttccacctctctctttcaaactcaaggcatgggcattattgatgttaagggcattgtctctggctccagtgtctgtcatccaaccagtttctggctgtggactagcaattctttcaatcttttctcatttttatctcaaggaagtcatgaatgctgttgattgggttggcattacattagcaggttttggcacaataggagttggtgctggaggtgaggagcaagaggtggttgctctatctatttttcacattccagggctggcatttgttgttttcatcttgtttatacttcttagtggatggcttcgaatatgcaagtgccaacgaagagaacaagagatggtggaatatgatgttgttgaggaagtcatttatggcttggaatctggaattttgtttggtatgtcatctgtaatatcgaagatgggatttctattcctagagcaaggttttcccaagctgttggttcctatgtgcatcatgattagtgtgtgttgtagtggcactggcttttactaccagacacgcggtctaaagcatggaagggctattgtagtttccacatgtgccgctgtggcatcaattttgactggtgttcttgctgggatgcttgctttgggtgaacgacttccttcggaaccaaaagctcgcttggcacttcttcttggatggtaa

SEQ ID NO: 76683 - DNA, 615 bp, Glycine max
  Peptide Sequence Number=SeqID_193461
atgtctgaatcagaagctcagcttcctactgcctttgttgctgatgttctattgtggaagaggtggcatgtttccttgggtatcattgttgttgcaacagttgcctgggtcctatttgagtggaccagtttaccatttttaacaatttgttcagatgttttgctgattttgatcgtactgttgtttctgcatgctaactatgctgcccttagaaataagtatgactcatatcccttacaaccaccaacattacctgaactagttgtgtcagaggagatggttaataatgtagcagcttcatttcgggtcaaaatcaacaatatgcttcttatagctcatgacatcactattggcaaggattttagaatttttttcaaggtggtgatttgtctatggctcttgtctgtcattggcagcgccttctccttcttcacactcgcatatattggaacccttcttatgattactatccctgcattgtacagcaaatatgggggttatgtagataaatgttgtggagttatacatcgccaattttcaagacattataggatagttgatgagagtgttttcaacagactgccacgtaatatatcaaaggacaaagagtcttga

SEQ ID NO: 76684 - DNA, 522 bp, Glycine max
  Peptide Sequence Number=SeqID_193462
atgagactccaaattggcagttcagattttgatgttagtgaaagaaaacaatttttagactggattttgggcattggtaatggaactattggacatagcaatgatgttgatataaatgtttcgattccagatgatttgcttcttcaaagcaaagataatatgaatgatgttgcattctttcaagatagggtcattttaacacctagaaatgacattgttgacttgatcaatcaatacatgttgtcattactgccaggggatgaaaaatcttatttaagtttggatactccatactttgtgaatgaaaataatgacactccaaacattgtgcacactgctgaattttttaacacaatcactacttcgagactttcaaatcacgttttgaaactaaaagttggagttcccattatgcttttgagaaacctagaccaatctgtcggattgtgcaatggaactagaatgattgttacaaaattgggcaaatatgttattgaagcaaaagttatatcaggtacttaa

SEQ ID NO: 76685 - DNA, 255 bp, Glycine max
  Peptide Sequence Number=SeqID_193463
atgattgagaatcaggagtgggcttgggtggatatggcagctcattcagcctgtgattttggtgggggtaaagctgagaaacttgctctagcgaagtaccgacaggtttatggtggagaagctaggttagcaactttaagcaagttatgtcctcttatggaagataagaagagcctagtctccatagaggaacttgccaaggttaaaggaaaggcatcactgttagctactgttgattattatgtgagcatgtag

SEQ ID NO: 76686 - DNA, 312 bp, Glycine max
  Peptide Sequence Number=SeqID_193464
atggagaaggaaccatgcaaacgaaaaaggaaaacacaaaaggatagtcttgaaaggaacccagaaaccattttccagccaaccgaagcaaagaactgccaaaccaagcaaaaaagcttcagcctttggaaggatagtcttgaaaagaacccaaaaatcattttccgaccaacccaagcaaagaactgtcaaaccaagccaaaaaagcttcggcctttgggttttcctctcggaagagaaaacaaccaagcaagagcctttgagtttttcgtcaaaaccaagcaaacagaaaacgaaaacgcagaagaatag

SEQ ID NO: 76687 - DNA, 375 bp, Glycine max
  Peptide Sequence Number=SeqID_193465
atggggtttaccattggaagacttcattttgttcctcctgcgaatgatttggtattgactccagaagagttgaaaagctttgcattgatagattcagagaagttactacaaagtaataacaagagtttgatggacttcccctcaatgcctcaacctgatattgatttgattggtgaaaaaggaataggaaaaacttatatttggaaagctttgtttgctgcattccgatctaaaacagaaattgttttaactgtagccttttgcggaattgctacttttcttattcctagaggaagaattgtgtattcaaggtttgctatacctataaatgtagatgaaaattcaatttgcaatatcaagcaaggaagtccatga

SEQ ID NO: 76688 - DNA, 1002 bp, Glycine max
  Peptide Sequence Number=SeqID_193466
atgtccaaatgccctaggtgtggggtatcacggcataaaatcaaggatgatgaggagtgtagtagtgatgaaaactcaaaaaaggacccctcagtgaagcgaaaatacatgacgttgtccatgatgatatcgggcccaagacagctaggaaatgacattgatgtttatctaagtccattgattgaagacctcaaaacgttttgggacgagggggttttagtgtttgatgggtttcagaatgagacttttcaaatgcgtgcaatgcttttttgtaccattaatgattttccagtatatgggaatttgagcggttacaatgttaagggtcatcatgcatgccccatcagtaaagaagacacaagctacatacaactgaaacatgctgactcaacaaatagggaccatgtggaggagtcgatcacagaaaaagtgacttggaagctaatattatccttcagccagatgcagtcccagttgcaagcacagatccatgcactgcctctggagcctgaggttggtccctcagctgctcgtgccagcacaaaggggagttgtgttgatcccttagtcaccgatccagacacggggatccacagtggctcacaacatcctttattgcatggccaagtgaaggttagtgttgaggaagttaaagatgcagatgctctcattcttgtacccactgacgaggcagctgtgtctccagcaaaacctatagatagggtgtttaatcaagaattcccattgtacataaagcatgaagatctgtctgaaattgcacacaatgatcaatgtctcagcatatctgttatacagttgtggattcttgcgcactggcaaatggtcttcattttgcctaaggaaaatcttgttgtctggttatgttccttgcataacaggccagacaactatcttaaaggaataattaacagtgctttgaaagaacttgatgatactccacaacctaaatccaaggctggtgctaggtggattattgttaaa

SEQ ID NO: 76689 - DNA, 426 bp, Glycine max
  Peptide Sequence Number=SeqID_193467
atgccgatggaactggagttggagctaggttcaacaacaattcaacgttccttcgacgcgcgctacacgcgccacacacgtgacttgcttgacgaattgcctgacagcttcaccgtcaccgacccctccatcctgggacaccccatcgtgtttgccagcccaggcttcctcaagctcacgggctattcccttcgcgaagtcctgggtcggcccacagccatcttccagggcccactaacattcccaaaatccgtaattgaaattcgcaaggttgttagagaggagcgaaacgcgcaggtaccacttcagaaaaaggaagggtccggggtgagggatttcgggtttgagtgttgtcgaaggaagtctttgtgggatgcagaagtggagagagaagagttgtgtgaggcgagtgatgatgagaagtga

SEQ ID NO: 76690 - DNA, 567 bp, Glycine max
  Peptide Sequence Number=SeqID_193468
atgacttcactcttttacttcttttcgagcctggcgttgatctctggcgttatggtaatacaagcacggaatcccgtccattctgttctgttccttatcttggtgttctttaacagtgctggattgcttgtcctattgggtctggagttctttgcaatgatcttcctagtggtctatgtgggggccattgcagtgctgttcctgtttgtagtaatgatgctcaacatcaagttggcagagattagcgagaaaaggttgcgctatctacctattggaggccttttgggcatgcttttccttggcgagatcttcctaatagttgacaacgacttgatcccttggctggggtctgcccacctctcggaatgggctgagctttcggctatggagtggactccgtggtcacacttggcagaaggcgttaccccgttggaggggcctgatcctgttggtggcaatgataggggccatagttctgacgctccacaagggggtagctgtaaagcatcaagaggttttccatcaaaacagcagagagtttgcgaaacagtagggaagctgtcctga

SEQ ID NO: 76691 - DNA, 4881 bp, Glycine max
  Peptide Sequence Number=SeqID_193469
atgtcgagagggcgagggaggccgaaaaagacagcgccatcgtcaccggcgagccaaacaaacattgctgaacaagcgatcgggaacaaccaagatgaagattcaacaaagcaccaagttgtggaggaaatcgaagttgtcgatgacgattcatctgtttcaatgccagaaacccttattcccaaattaacatgtgatgcacaggatgatccgaaagaagagaggaaattatggatagatgttctcaatgataatagaaaccctgcaaaaggaatggcgattgagtatgttcaaccaaccttggtggatggggagattgaaatcgctatagatgaggaggatatcgtgtctgagaaaaaattctgggaaaatgccttggtcatgtatgtccttggtggagaattgagcatgaatggggtaaagcaattcatcactaaagcatggaactttgtccaactgcctgctatctattaccacgatgatggctattttttgttaaagttcaaaacgcacaaagacatggatgacgttatgttaagaggcccttatacactgccactccatctttggggagcaaggagccttggtaagataggaagtgcccttgggaaaccgataacaacggatgagtgcaccgctaaaaaatatcgagtatcgtacgctaggatattggtggaggtggatgttactcaaaaattgccaaatgatataaccatcagagatagcgagggaaagaaactaaagcagcctgtgcattatgaatggaagccgatgttttgtgataaatgtcaaaagtttggacatcactgtgaagaagtgaaagcaaagaaggtctggcagatgaaatccaagcaaggtagcacttctcacgctcaaccaaaggaaaataacactggtttgtataatatagaaactgttgacaatggcttggagagtaaaaaaagtgttgaaaatgggctgaaaagtacacaggctgctgggaaaaatgcaagctcatctggtgtgaaaggtacaaacagtgcagattttcaagcgaatacatctacaactgtccttaatttggtagcatctgatgatattgggaatgtggctgaatatacccatgagtggtctagcaggagaaaaaacggtaaagataacgggaaaaaaattgtagttgattgcacgcctaacttgatccgatgcacgaatggctttgaggcactagaggatttgaatgaccctctagtgtatcaagatggtaagctaaaggagataggctcccgtcttctagagcttcggcctacgatcacgatcttaattgagacaagggtaaaacaagttaaggctcgcaatattcgaaataaactcaggttgcaaggtgagtttttggacaattattctagccattccaacggcagaatctggttaaattgggatactaacaagcgatctatgcccttaataagctggatcagcgtagaactttgtggactgatatcgaatgtattcatggcaatcaacatggtccttgggtcttgcttggtgactaataacgttttgaaagctaaagatagagttggtggtaatttggtaaccgagtcagaatatgaagacttggcaaaaatgatgcgaaataccggaacttttgaaaaggatagcacgggtgactactatacttggtcgaataagcaaactgatggtatgatctattctagaatcgatagggtgttggggaatgtggaatggttccaagacaacatggacacaatgctccaaatcctgcctccgagcgtatcagaccacgctttactttgtttggctgatccagggaatactgcaggtcggcaatttcattttaaattctcatactgtttgacagatttggaggaatatcatagcactgttagtaatagttggaacgaaccattgaatggtagaccgatgtatgtgctttgggagaagctcaaacggctcaaacctgctttgaataaaatcaacaggcctctgcatcatatccagtctagaataatggaggctagacaaaatctgcaacatgcccaacaaagccttgtagaagatagatggaatagcagtaaaattgatactgttaagcggtatacagaggaggttatcaattggaattccctggaagagaaaacattacaacaaaaatccaaaattgattggcttcgattgggtgatggaaataactcatatttccatgctaccataaaagctaaaaagagttccaaaaggctgaatttgctgcataaggatgacggtacggttattacatctcgtgacgaaattcaggacgaagtcttaaatttctatgagggtttaatggggacaaaagatggtaatgtgcgtcatattaatattatggccatgagaggggggcctcaacttagtatggaacagagggaacagcttgtagcccccattgccgaccaagaaatccgtaaagcgttgaatggcattggtgacacaaaaagcccgggaatagacggttttggagcaaaatttttcaaaaccagctggaatattatagggaaagatgtggtggccgctgttagagatttctttgagaatgatcggatctacaaggctttcaattgtactttggtaactctcattccaaaaaatgaggaagccaaagctatcaaggaatatcgacctattgcggggtgcactacagtatataaaataatttctaaaattattaccgctagaatgggtagggtgatggatagtatcgttggtaagaaccaagctgcttttgtccccggccaaaaaattcataatcacattctacttgcttacgagctgattaagggttactctcggaaaggtgggactccccgctgtatgatgcaaatagacctccagaaagcttatgatatggttaactgggatgcactggaatgtattcttaaagagattggtgtgcctcaacaatttatcagatggatcatgatagctgtgaccactgtttcttaccgtttcaatgtcaatggttgtcactctaaccttttgcaggctaagcgtggactccgtcagggagaccccatgtcccccctcctctttgttattgttatggaatatccgaatagaattctgtatgacatgcagaagaatcctaattttaaccatcatgctaaatgtgaaaagcttagtattactaatttggcttttgcagatgatttacttcttttttcgagaggtgatccaatatctgtggatcttatggtgaaggctttcaagaatttctctgagtccactggtcttattgctaatcctagtaaatgtaagatttactttggtggtgtgggggatgatagcaagaggaatattctcaatcttactggttttactgaaggccttcttcctttccgttacttgggggtcccgctcactagtaaaaaactttctattcaccactatatgcctttagtggataagatagtggggagaatcaatcactggagcactaatcttttgacttatgcaggccgtgttaagcttataaggagtgtgacgtttgctattgcaaattactggatgcaatgctttcctatcccgaagtatgttgttcacaaaattgaagctatttgcagatctttcctctggacaggagggcaagagataaagagaaaaagtccagttgcttgggactctgtgtgcaaaccgaaggattatggagggttaaacatcattgacctttcggtttggaataaggtaactatgctgaaactcctttggaatcttagtggcaaatctgatagtctttgggtgaagtgggtaaatgcctactacttgaataaggacacactgatgaatgtgagtgtaaagattcacaactcttggattatgaaaagtatcttgaagcatcgtagtagcattttggatatccaatctatatgggacagcatgctagagaaaaatcgatttggtatgaaggaggtttataaaagtctttgcaccaacacttcaaaagtgcgctggcgtaatctgtttcgggggaatacagcgaggcctagagctctgatgactctatggcttgcttgtcatgggcggttagccactaaaaaccgtctgaaaaaatttggtatgattgaagatagtaagtgttgcttttgtcctgctgaagaatctattaatcacttgttttatggctgcccgaagcttaaaattatttggactaaagttcttgattgggttcaaattaagagagtaccgcgtgagtggaatgatgagttagagtggttaatttcatccacaaaagggaagggaaagagacatgcaattttgaaactagccgctgctgaaactttatatggaatctggagataccgtaacgataagagtttcggtaatactgttgataatacaaaaatagcgaataatattatagatatgatagtttacagaggttggtatagtggcaactccggcaaccgccaattcttcagtgacgccaccattgaattggccaatgaactggttaagaggaacattgacttggtgtatggtgggggaagtgttgggctgatgggcctaatatcccagagaatgtatgatggaggctgccatgcttgttgttattggtttaataattttgtctacaagggtattccaaaagctctcatgcctcttgagatatctggtgaaccagttggtgaagtaagaattgtttcagatatgcatgagcctaaagctgcaatggctcaaggagctgatgcatttattgctctcccaggaggatatggaactatggaagagctgttggagatgataacttgggctcaacttggaattcataaaaaacagcgtggtgctcggaatattcttgtcacggcttcaccagccaaagaacttatgatgaagatggaggtctga

SEQ ID NO: 76692 - DNA, 444 bp, Glycine max
  Peptide Sequence Number=SeqID_193470
atggcttttacgttcctctctaacatagtggctgggagaactaagtggaagttgaaggtccgtgttattagattatggtctttaccagtgtttgaaaatccaaaagtcattaggagtcttgagatgatattgctagatgaaaagcttcaatcttgcctctcagcctgtgtctcgcgtctcgttgtccgtcgtgtgtgtctattgcgcgtgctactagcagtcatcccttgcctgagttcgcgcgcttccaacagtcatccctgtctagttcgacgtagtgtggctgggttttttggtgggctgagttcgcgcggtagcaggagtcatcccttgcctcctacagtcccttgttcgcccacaagtaacgaaatgtgtttacaatcccttgttcgcccaaaccctgttcgcacacaaacaatttttagtgtttgggttgaatgttaa

SEQ ID NO: 76693 - DNA, 801 bp, Glycine max
  Peptide Sequence Number=SeqID_193471
atgaggtcaaccgcatggccgaggcaaacaaggcatttgcaacgagcagattctaaggatttctcccgatcactccgcccagttggctcagtggtggggccccgtcgggatctaagctttatggcacgtggaaaatttgaacgcaagaagccgcatgtaaacattggcaccatcggtcatgtagaccatggaaagacaaccttgaccgctgccattacaatggcattagcctcgcaaggtggtgggaagggtcggaagtacgatgacattgactcagctccggaagagaaggcaagaggcatcactatcaacacggctcatgtagagtacgaaactgagaaccgccactatgcacacgttgactgtcctgggcacgccgactatgtaaagaacatgatcactggtgcggcccaaatggatggcgccattctcgtggtttcgggcgctgatgggccaatgcctcaaactaaggagcacatcttgttggcgaaacaagttggtgtgcctaacgttgtagtcttcctaaacaaagaagatcaagtcgatgacgaagagttgcttgagctggtggagctagaagttcgagaaaccttggacaattacgaattccctggcgatgaaataccaatcgtagctggatctgctctcttggcactagaggccctaacggaaaacccgcaactcaaggcaggtgagaacaaatgggtagacaagatatatgagctaatgcgccaagtggacagctacatccctacgccagaacgggagacagacaagccattccttatggctgtcgaagat

SEQ ID NO: 76694 - DNA, 487 bp, Glycine max
  Peptide Sequence Number=SeqID_193472
gtcgactctagaggatcccacagccccagaggcagaagctgcaggaccttcgcaagcgccacagccagggatcagccgcaggcagctcagcgctcagggagccgagcaggacatcgtccaacggtggcttgcgttcagcctcaaggcctcatccaccgttgcagagctgaagcggttcctgcttgacagaggccagcggccagtgatcttcaccagaagcgcgctgctcgccagggtggaagggctgcttagatttgagcatccagaaggtggactggagccgagtgcggcggcggttgaagagatcacagccgctgttgaggccgcagcccaaccggcacggcaaagaccagcaaggcagaaggcgccgaagaagtcacagcttcagatggaagcggccaagtccattgttaacaagggtgagtgggcgctctcagctggaagctctgatcacctggtgactgttgcacacccgagaaggctttaa

SEQ ID NO: 76695 - DNA, 561 bp, Glycine max
  Peptide Sequence Number=SeqID_193473
atggggattcgagtctcctgctccgggacatattgcaaacacgacgctgattggtttagggagcaagtccaagggttctgcgatgaggtgttaattacggatgatcacacccatgttggagacatgatagctcgcattgagccagcagcaattttcggcacgcagatggagcgacacataggcaagcgattggacatcccgtgcggggttatctcagctccggtacacatccagaacttcccgttggggtatcgtcctttcctgggatatgaaggaacaaatcaggttgcggacttggtgtacaattcctttacgttggggatggaagaccacttgctagaaatctttggtgggcatgacactaaagaagttattacaaaatcgctatcaacggaggggggccttgtttgggcacctgacgggctagctgaattgacgaagataccaggttttgtacggggcaaaataaagcggaacaccgaaaagtttgcgagtgacaacaacatttctaagatcacgttggaagttatgtatgcagcgaaggaggccgctggtgcatag

SEQ ID NO: 76696 - DNA, 246 bp, Glycine max
  Peptide Sequence Number=SeqID_193474
atggcgtgtttcttccttagggcaaggagagaattgaaccctcgaccccgcgcttcggagacgcgtgctctaccatcgggctgtttgccgctcagttgggtgggcttaaataagggcccgcttagcgaaacgggcttgcctcacaggcctcacagcccttgcaaagcttgccccttccttgggccaattgcgtggctttgcgaggcaagcacttcgactcccgctgagcacacatctaatttttag

SEQ ID NO: 76697 - DNA, 814 bp, Glycine max
  Peptide Sequence Number=SeqID_193475
atgaacctgttcgaggtagctcacttcgtcccagagaaacctatgtatgagcaaggtctaatcctgttgccgcaccttgcgactctaggctatggcgtaggcccaggtggggaggtaattgacacattcccgtactttgtttcaggagtgctccacctcatctcgtctgccgtgctaggctttgggggagtttaccactcattggtaggccctgaaaccttggaagaatccttccccttctttggctacgtttggaaagacaagaacaagatgactaccatcttggggattcacctcattgtgcttggcattggcgcatggctgcttgtttggaaggccctctactttggtggggtttatgacacatgggcacccggcggtggtgacgtccgcattatcagcaatccaacaataagccctgcggtaatctttggctacctgctcaaatctccgtttggtggtgacggttggattgttagtgtagacaacctagaggacatcattgggggacacatatggattggaacactgctcatactgggcggggtttggcacatcttgaccaagccatgggcttgggcacgtcgtgcatttgtatggtctggggaagcttacctgtcatacagcatcgcggctgtgtctataatggcatttgtctcatgctgcatgtcttggttcaacaacactgcatacccaagtgaattctatggaccaactggtccagaagcgtctcaatcgcaggcctttaccttcttggttagagaccaacgacttggggctaacgttgcgtcagctcaaggcccaacaggccttg

SEQ ID NO: 76698 - DNA, 2020 bp, Glycine max
  Peptide Sequence Number=SeqID_193476
atgcgggaagcaggatttattcctactctgctacctctccttaaagatacaaatccacagcacttgcatttggttgaaaaggctgtgcgcattttagaagcttttatggattacagtaatccggctgctgctctgttcagagatttgggaggcttggatgataccatctctcgcctaaagattgaagtctccaatgtagaaaatagtggaaagcagccagatgataattctgagtctagtgcaaatgcagctggtcttccgtctgccttcttggatgctataatggttgatgttctcaactctgcagaagccattacctgcatcccccagtgtttggatgccttatgcttaaatagtaatggcctgcaagctgtgaaagataggaactctctgaggtgttttgtgaaagtgtttacttctagaacatatttgcgtgctcttgcaggagacacacctgcatctttgtctagtggactggatgaattaatgcgccatgcttcctcattgcgtgggcctggagtggaaatgttagttgaaattctggaagctatttcaaaaattggttctgcagtggattcctcatccttgagtcctgatccatgctcttcaacctctgttcctatggaaatggatggtgaagacaagaatttgatcttgcctaataacaaggagtcatccaatgctaatgacacagagcagattactgagccatctcatgatgtgccaatagtaaatgtagagtcatttcttccagattgtgtaaacaatattgctcgtctacttgagacaattcttcagaatgccgatacatgtcgaatatttgtcgagaaaaaaggaattgaagctattctccagttagttaccttacctttaatgccgccttctgtttctgttgggcagagtatatctgttgccttcaagaatttctccccacagcattatgtttctcttgcccgggctgtatgctccttcttgagggaacatctgaaatctatcaatgagcttttagatttggtgggaggaactcaacttgctctagtggaatctgcaaagcaaacaaaggtgttgaaatatcttgccagccttgaagctgtcttaactctttctgtgtttttgttgaagggttcaactactgttgtctctgaactaagtactttagatgctgatgtgttgaaagatcttggaaaaacatacaaggaagtaatttggcaaatatcattgtgtaatgattctaaggccgagggaaaaaagaatgctgatcaagaacctgaggttgcacaggtacccccatctactgctgttgaaagagagagtgatgatgattcaaatattcagacagtaagatacacaaacccagtttttgctaggaatggttcacattccctgtggagtggggaacgagaattcctttctgttgttcgtgctggagaaagtatgcaccgtcgaagtcggcatgggttatcccgcatacgaggtggaaggactggtcgtcacttggaagctttaaacattgattcagaggcatcttctagtgcactcgaagcacctttatcccaagatctgaaaaagaaaagccctgatgttcttgttctagagattcttaacaaactggcatcaactttgcgctctttcttcactgcccttgtgaagggattcacttcaccaaatcgtcgcagagctgactcggggtcacttagttcagcttcaaagactcttggagctgttttagctacaaatttttttgaggctcttagtttttctgggcattctacttatgctggacttgaaatgtcactttctgttaaatgtagatatcttgggaaggttgtggatgatatggctgctctcacatttgacagcaggcgccggagttgttatactgccatggttaataatttttatgtccatggaacatttaaagagctactcacaacatttgaagctactagtcagttgctatggacacttccgtgctctcttccatcatcagatattgatgttggaaaaaaaggggaaggag

SEQ ID NO: 76699 - DNA, 1044 bp, Glycine max
  Peptide Sequence Number=SeqID_193477
atggttagccagtgggactttattccaaagagtgttagaaaggcggaaggtggcaatagccaccatataggccagcaccccaacggggaaccggcaacaacccggggaaagggaaatgtgctcttcacccaagctgaccatacgagcctatcgaataaagggcacgacctgaagagatgcgtaggcgaattcgtaagcattggggacgagatcatttccgggtatgcaacacctacatctggccaaattgtagccattgagaaggataagattacacttcgtcgaactcaagctcttttgttctatgcacagggtgttatgcatgtcaaccatggtgaatgggttgagaagaatgctccaattctgactttaacctaccaaaagttgataacgggagatatcgttcagggcatccctaagatcgagcaattctttgaagcgccagctacgaaagagggggaaccacttcctaatagcttgcaagcaagattgcggcgaagcttccagcgattgaaacagctttatccagttccacaagcggtgaagagaagcctcgaagaaatccagcagatcttggtggaagggattctcaaggtttacctttcacagggtgttcgcatcgcggacaagcaccttgaaattgttattcgccaaatgatctcaaagggacaggttcttgatgtggggaacacgggcttgtttcaaggtgaacacgtgagattagaccgaattgagcggataaatttggcgacctatggtcaaaaggctgattatgaaccagccgtgttaggaattacgcaagcttctttggactcggagagcttcatctctgccgctagtttccaagaaacgacacgagttttaagtcgcgacaccataatagggaagaccgatttcttgcgtggattgaaggaacgtgttgtgctaggggaccttatccaagctggaacaggcgtggatgacaacatcaactatggtctcctttttggcattgctccggcttgtgatccagcgggagatgccccctccttggcttggctctga

SEQ ID NO: 76700 - DNA, 234 bp, Glycine max
  Peptide Sequence Number=SeqID_193478
atgtcggtagtggtgacagcttcagactggtttggccatgacggtggcggtgaaaatgaagatgttgggttctttttcaaacacatcaataagcacgagaggaaaaatgtgatcagcaaaaggaaacgtttgatacttaggtatttttacatgtttatacccgttcatctcacaatggaggacgacgaagaagaacgaccgaaaatacataataatatcacgaagaatcactag

SEQ ID NO: 76701 - DNA, 738 bp, Glycine max
  Peptide Sequence Number=SeqID_193479
atgtgttttagaatgaaagttatcctgttatgctggagtcaacctccaaaaattagatgtttcatcgatcgtgttacttcagttccacttgagaagatagaagaacctttaaaggcttttgtttgggagtttgataagggagattttcatcactgggttgatctttttaaccattttgattcattctttgagaagtatgtaaaaccaaggaaggatctgcagattgatgatgattttctggacttggatcctttattccctagagaatctgttcttcaaattcttcgtgttatcagaataattttggataattgcacaaataagcatttctatagttcatatgagcagcatctttcagcattgcttgcttctactgatcctgatgtggttgaggctagcctggacactttggctacctttttgaagaaaacagttggaaagtactccataagagatgcttctttgaattcaaaattgtatgctcttgcccaaggatggggtggaaaggaagagggtcttggactgattgcttcagctgtgcctaatggttgtgaccctattgcttgtgaattgggccgtacccttcattttgaattttatgcagtaaatgagtcagaaagtgacatcaaagttactgaacccttggtccaaggcttgcaaattattcacttatctgatgtcaacaaatgtgtggaaactgatcttgagcttttgcataagttagttacagaatataag

SEQ ID NO: 76702 - DNA, 664 bp, Glycine max
  Peptide Sequence Number=SeqID_193480
tgtggttattaggttcatcaagaaagagataatttccggtatggttttgcctaggaagattatcaaggacaatgccaccaatctgaaaaataaaatgatgaaggaaatgtgtgaggatttcaaaatccaataccataattctacgccttacaggccaaagatgagtggggcaattgaggctgctaataagaacatcaagaaaatagttcagaagatgaccgtttcatacaaggattggcacaagatgctcccttttgcgctgcatagttatcaaacctcggtacgcacatcaactggggcaacctcattctctttggtgtacgggatggaggttatgcttccagttgaagtagaggttccatcattgaggattctagccgagtcaggattggctgccatgagccatggacaattgtatcaaagccgagtaaagaacgcttttgacaagaaggtgcgcttgtgcaagttctgcgagggggatctcgtcttgaagaaagtatcccaagctcaaaaggaccacagggggaagtgggctccaaattatgaaggaccttttgttgtgaaaaaggcgttttcaggaggggcattgttgcttgccaccatggacgatgaagaattgccttctcctgtgatatccaatatcatcaaacgatattatgcataa

SEQ ID NO: 76703 - DNA, 246 bp, Glycine max
  Peptide Sequence Number=SeqID_193481
atgcaccctctagctaagttgtatgtatgccccttgaggggatgtgaggtggtggcaacaagggcttggttcccaatggctcatatccccatgtttcactttcccatgttggcaattttgttggccacttggcaacacttggcaactcttggcaacactcagcctaggcatgctgcagcaagtcgctctcatgacaaaggctcaagggacccacaggagggcattctggagcttccagggccttga

SEQ ID NO: 76704 - DNA, 783 bp, Glycine max
  Peptide Sequence Number=SeqID_193482
atggcttcatttgtttctactcaccgtatccttccaagccatcatcaatctgggcttggatttgtgcatgaccaagctcgttcttgtgatagaactaacacttttcatcttcaaaatgctcctaaaatcccaaggtctctctcctttttgctctctgtgccagcttcagaaagtagaccagatgctgttgttgttcagagcaacggtcgatcgtctttttcacagacagctgctgtgaggcatctgacaggttctgttactagaccccatggacttcgttttgctgtggttgttgctagattcaatgaaattgttaccaaaccactcttggaaggtgctttgggtacttacaagaattattcagttcaagttgaggatattgatgttgtgtgggtacctggtagttttgaaattggtgttgttgccgaaagactaggaaaatcaggcaaatatcatgcaatcatatgcataggagctgtggtacgaggagacacaacccactatgatgcagttgctaattcagcaggagtgctttcagctggtctaaactcaggtgctattccgaaaagggacaccttctttgttgggtacaaagagagatgcttcctttctctatgtcgaatgggctttgggctggttttggtggttgtgatggtggttgcgatggaggtggggtgtggtggttgggtggttgccagagagccgccacactcatctagatttggtgaagaggaagaccaagcctttcttcttcttgttttgggaccccatagttgtggttga

SEQ ID NO: 76705 - DNA, 559 bp, Glycine max
  Peptide Sequence Number=SeqID_193483
atggatgcaaccatgtcatcatcatcagagggcatgatgatgttgagaccaaccaattcacacaactacacaacaagtggccacaatttaactccaaagggttgtgcattcaaaccaatccgaaggagatctagaacttctaagagcactccaattacccttctcaaagccaacacctccaatttcagggcattggtacaacaattcactgggtgtcctaccacaaccaccatgtcacttgcaatccataagggtcccattaccttaaatttccaacaagatggtaccaaacaacatattcatcacgatcagcatcacacaaaaataacaactagaggagcaatgccaccatttgccaccataagttctaaccaaaaccatgcttctgtgccatttcctaagcaacaattgatgcaagagcagcaaagtggatactttcttccaacttattcgggtaactcatataggccaattagctgcatggatgatggattgatctttgataatgattttagtttgcatgaactaactgtgaatgccatctccaatgatagcgatg

SEQ ID NO: 76706 - DNA, 510 bp, Glycine max
  Peptide Sequence Number=SeqID_193484
atggagtcaggtgacatgcggaggtaccgtatggtgacccgcacctttcgtcaaccaggggcaaaagagcctgttgacgcggaaagactaacatcgtcttctgcactttttggccatccagggacagcgagtcgggtggcaggtttttactctcatcgtctggagacattcaagcccgacgacacacgagattcttctctgctgggcggggacgataaagttcaatggcgtagggaagtgtcgtggttgtcccgctttatcgctttcgaagacactgaaataagtaaagaggggcaactatcatactctaatttcaaccggggaccattgtctggtggcatgcaaccttcgcttgaccacctcgagttccgcaacattctggaagtcgaaaggaagcattgttgcgtaatccgtaaagttcagcaacattccggaagtcaaaaagggcattgttgcgtaatctgtaaagtttcgcaacattctggaaagaaaatgggtgtctttacgtaa

SEQ ID NO: 76707 - DNA, 498 bp, Glycine max
  Peptide Sequence Number=SeqID_193485
atgaacaatgggcacccaattatccacatgaagttcgatggactctcagaggtcagggcagatttaaaaatctacgagtctattatcatcaacttctttgcctgcgatgataataccatctttgatctacattttacacctccccttaatcaacagacatgcggtagaccaatacttcattcccgtgtacatgcctggagaactgaaattacccaatgtatactaggtgctccccaaccactggaaatccaatcacatgcaaggaaatatctgaaacaatgtgagaatcacttgacaattttaaggaagaatgcacctcctctgcaatgggacgtcgttacacttgaccgcgacattaaagataaaagtatcgtccggccatggtacaagtttctcagggaaaacgatttccatcacggagacgaggtatcattctattaccggccacatgaaagaatttgggaaatagtcatcagaagagaaaggaagtggctataa

SEQ ID NO: 76708 - DNA, 723 bp, Glycine max
  Peptide Sequence Number=SeqID_193486
atggacctcatcaaggctgctggactactgaagacagtcaccaagttgggagactgttatgaaggcctagtcagggaattcattgtcaacattccctctgacataacaaacagaaaaagtgatgattatcagaaagtatttgtcagaggaaagtgtgttagattctcccctgctgtgatcaacaaatacctggacagaccaacagatggagtgatggatattgctgtctctgagcatcaaattgccaaggaaatcactgccaaacgagtccagcattggccaaagaaagggaagctttctgcagggaagctgagtgtgaagtatgcaattctgcataggattggcgctgcaaactggagagaatctcctctatccctgcactacaaactgttcgaggggacacatgtcccagacattgtctcgacatcagggaaagctgctgcttcaggtgctgtgtccaaggatgccttgattgctgaactcaaggacacatgcaaggtactggaagcaaccatcaaagccaccatagagaagaagatggagctagaacggcttatcaaaaggctctcagaaagtggcgttgatgatggtgaagcagccgaggaagaagaagcagctgagcaagaagaagaagaagctgaggaagaagaagaagaagtcgatgaggaagatgcagcagaggatacagaatccaatgacgatgattctgaagccaccccatga

SEQ ID NO: 76709 - DNA, 270 bp, Glycine max
  Peptide Sequence Number=SeqID_193487
atgaagaagatcctaggcctacaagctccaatggagcttgcatcaaaaagggtactcaaccaaatgatgatgaaggacaattaccggttgaaggatactcttctctccttcaaagtattttggacaggtttgatggactccaaacctatgttgtggacatgcgattcgatgcaatggactcaaggatcacaaaggttgaagaagatgccaccatcattcgcgattgccttgatttacctccaccaccatcagtttaaactttattattag

SEQ ID NO: 76710 - DNA, 755 bp, Glycine max
  Peptide Sequence Number=SeqID_193488
atggaaacagggaagcatgatgagactgaagatgagaacaaactggatggggaaaagctgattgaggagagatccaaagaggtggaaacccctaaagatgatccgaaaggaaatcaagaggcgagaagattatgggttgacgtgataagtgagaatcgaaatccaacaaaaggaaggatgatgtcttatgtggcaccgaaaatggtagagggacaaattgaaatcgagattgaggatgaggacatcgaatctgaaattagatattgggaaaatgccctaatcctatatgtgctggggggtgacctcaatatgaatacgattaagaatttcatggagagaaactggaattttgtgcagctgccaaacttgtattatcacgatgatgggtacttcctgctaagattcaaatcacatgacgatatggaagtggtggtgatgaagggtccctatacaataagaagcatgccggtggtactcaaagagtggagaactgattttagtctgaagcaggacatgctacgaaccataccgatatggataaaacttcccaagctcccgttgtatctttggggcgaacgaagccttaacaaaattggcagtgccattggtacacccatggttactgatgaatgcactacccacaaactcagagtttcctatgccaggatgttagtggaggtcgacattactagaaaattggtggaagaaattgctatcaaggataaagatggtcggaaaatgatgcaacccattga

SEQ ID NO: 76711 - DNA, 616 bp, Glycine max
  Peptide Sequence Number=SeqID_193489
atgtttgcattcacatctccaggtgtcaaagtagacacatcctataatactggaagaggtcctcctacattgcgcatacatggtcaatcgcatcacctcattggaagcctcctacctatgcctgataactcgccaaagtttgcacaactatatatttatgacattgaaaacgaagtcaacaataggctttcacaataccctataaaaaataatgttgatgaagacattataattggcatcaagaatatgctagatacccacaatcgatatgcacaaaaattcagaatgtcaagggacaaactacactcttctgcagtgtgcgacctgaaactaaagctcattagtggcagacaatcagatggcagattatataatttgccaaatgctactgaagtggctactttgattattggtgacgagcatatagtaaataacagagatatcatcatcgagaagcaaacaagcatgctccaaagaataaatgaacttcatcctgcatatttacctttgcaatatcctcttttgtacccacacggtgaagatggctacagaccaaacattcttcataaggataatccgcatagccaagttgcaaagaggaacaaagttaccatgt

SEQ ID NO: 76712 - DNA, 501 bp, Glycine max
  Peptide Sequence Number=SeqID_193490
atggagatgattttcatgtacaacagcaatatgatcggaccttggagaaggtggcaccccactgccatccttgacgaaaatgacagtgtcgccggcgacgagcttcttatgattgacaaacttgctccagccgatggtgaagaagtggtggcgtggcgtgccatggtagatgtggcggaagcgccactcgacgccgtggatgtcagcgacagagaggagctagacaggcagatcggtgcgaaagtcgagtggagggaagcacgagtcggcgcagaagcgtggcacagagaagtcgtcgccattgttggcgtcggagggagttgttgttgtgattgtgagaggagagtgaggaggaacatggcaggggacgaaggggagagagcggatgagagggctgagtacaaagcatctcccgttctccgtgaagatgacacgtggcaggacttgggacgcgtcgggttgtgttggggatccaggcacgaccggtctgctgggacctag

SEQ ID NO: 76713 - DNA, 282 bp, Glycine max
  Peptide Sequence Number=SeqID_193491
atggaatggtctcgcccaacgcagctaggagaaataccatcaccacgtgctggacatgctggtgtgacagtaggggaaaactggttcattgttagtggtggtgacaataagagtggggtctctgaaacgattgtactgaatatgtctacactgacttggtcagtggtaacttctgttcaaggacgagttcctgttgccagtgaggtctatgttcttaaaccaagccacaaatcaaccttgcaatccaaaataattgaaaattccataccagacagtgtttag

SEQ ID NO: 76714 - DNA, 1677 bp, Glycine max
  Peptide Sequence Number=SeqID_193492
atggagacggcactggatgccgcggctgatggtttgcgcaggattatcgatgcgcatggcccggaggcggtggctttctacggttccggccagttgctcacggaagattactatgtggcgaacaagctgatgaaaggctttctcggcgtcgccaacatcgataccaattcacgcctgtgtatggcctccgcggtgacaggctataaacgggcatttggggcggatgccgtaccgtgctgttacgaggatctggatgaggccgaggtagtcattcttgtcggctcgaacgccgcctgggcccatccggtgctgtttcagcgcctgaaacaggcaaaagtgcagcgccctgagatgcaggttgtggttatcgatccgcgccgcacggccagttgtgaattcgccgatctgcatttaccgctccggccgggcagcgatccggccctgttctcgggcctgctgcactggctggaacagcatgacggcattgacgtcacgatgctgccgcatctggacggtgtagacacaaccttacgggccgcgcggcagtgggatggtgcggcggtggcagcccattgtgatatcagccatgaagtgatcgccgcgttctacgggttgtttacccggcatgagcgcgtactgaccttatggtgcatgggcattaaccagtcacaaagcggcagtgacaacaacaatgccattctcaatgcgcacctgctgagcggcaagattggccgacccggctgcggcccgttttcgctgaccggacagccgaatgcgatgggcgggcgggaagtaggggggctggccaaccaactggcggcgcatatgagtttcaccgcagaagattgcgaccgtttacagcgtttctggcgcagtccgcgtatggcgcgtgagcccggcctgacggcggttgatctgtttgacgccattgaccgtggggcaatcaaagcggtgtggattatgggcaccaatccggcggtgtcgatgccagaaggcaatcgcattgcccgggcgctggctgcctgtccgctggtaattgtgtcagacgtgctggcgcaaacggataccaccgcctttgcgcatattttgctacccgcgcagggctggggggaaaagaacggcaccgtgaccaattctgaacgccggatttcccgtcagcgcgcgtttatgcctccggccggagaagctaaaccggactggtggttactcgcgcaggtcgcccagcgtctgggctttcatgaaggctttacctggacgcatccggcagccatcttccgcgagcatgcggcgttgtcggggtttgagaacaacggccagcgcgcctttgatatcagcggtctggccggtatgagcgacgcacagtgggatgcgatgaagccggtacagtggccaatcaacgcccgctatcccgagggctgcgcccggctgtttagcgaccggcacttttaccatcctgatggtaaagcccgcctgttgccaccggccacgccgcagccagtggtgtgcgaaacggcttacccgctattgatgaacagcggacggatccgcgatcagtggcacaccatgacgcgtaccggcctggttccccggctcatgcagcattgtgatgagccatttgcagccctgcatccgcacgacgcaaaacgctatggcctgcgcgcgggcgcactggcacgg

SEQ ID NO: 76715 - DNA, 678 bp, Glycine max
  Peptide Sequence Number=SeqID_193493
atggcgctgcgcgcaagttccgcattaaacctgatgagctgcctgaactgctggcccagcaactgcaacgtgtcacagagttggagggttctgccgatgatggtgccttggctaagcaggcaacaagctgcacataagctggctaaaaccatcactgaacaaatgcaggcgctgtctttaaaaggtggccagtttgcggttgctttaacgcctggtgaacccgcggcgcatggtttggagcaagtggagttcctggtggctggtcatgccggcgttgagcctcgtccgctcaataaagtcgcctccggcggtgagttgtctcgcattagcttggcactacaggtgacaacagcctccctgggcacagtgccgtgcatgatttttgatgaagtcgatgtcggtattggtggcggcgtggcagaagtggtgggacgtttgcttagcgaactgggccagcaccgtcaggtgttggtcattacgcacctggcacaagttgcctcgcaggcgcagcagcatttacaggtcagcaagtctgagcagcaaggcgccacattaagccgtattcgtcccttgggcgcggatgagcgtgtagaagaaattgcccgtatgctgggtggcttgcaaatcactgaaaccactcgcaatcatgccagggaaatgttgggactcatcacctag

SEQ ID NO: 76716 - DNA, 135 bp, Glycine max
  Peptide Sequence Number=SeqID_193494
atgtttagcaaaaccaatgcagacaaacactttagcacagacaatgattgggatgagcttgttgatggtgtggacaatgatgatacaggagattggcattaccctgcacccaatcctagtggcaaggatatgtag

SEQ ID NO: 76717 - DNA, 264 bp, Glycine max
  Peptide Sequence Number=SeqID_193495
atggcttttatcagacaaggtgatcaaatcatcatcgtttacttcacaaaattgagagttatttgggatgaattgaaaagttgtaggcctgatccaacatcatataatcaggcaacaattcatcgaattatgaacattcatgtacctattattggaaagataatcacactatatatagatgctataggaagaatggttttcctcagaattatgcttccagaggaggaaaaagaagtcaaagcaatcctagcagaggaaatttag

SEQ ID NO: 76718 - DNA, 238 bp, Glycine max
  Peptide Sequence Number=SeqID_193496
atggctttagaacttaatgatactttggttttgactgatttgcctcacataagaatgttattggctgtaagtaggcaagattaccgagacaccttttctccaatggccaagctaaccacaatcaaacttctattggccttaactactatcaataaatggtatcttaagcaattagatgtgaataatgctttcttacatggtgatttgaatgaagaggtgtacatgatacttcctcaag

SEQ ID NO: 76719 - DNA, 531 bp, Glycine max
  Peptide Sequence Number=SeqID_193497
atgatgggaaaattcagagtttgtgatcatgaatataaattatgttttactggagttactgttgttaggcaatgtgatatggaacagttcccttttaggaaattcagatttgttgctttttccagtgtcattgctggtcattttaaaattggactcttggttgatgttattggcgtggttgatgaagtggtattccgatatgtgtcatccaaaaatacgagggttgttttgaatttaaaggatttaagtggacaggtgctatcctatacactctgggaaaattactgcctacagtttttgtcttatttgaatgatattgaagatgaaagactgatcgttattctcttgactcatgctaggattaaggaagcacagggatcatatccggcatcggtcagtaattctttcaaggcgtctaaactcatgatcaatgacctcatgctggaaatccaagaatttagagagagtcttttagatttagggatcgaggttagatcaattttgacgcctattggacaagggagttcacag

SEQ ID NO: 76720 - DNA, 210 bp, Glycine max
  Peptide Sequence Number=SeqID_193498
atggctgacaagctcttgaagctactgcttcctccactgaaaattgatttccgtgatctttctggcttcatagggctagattccacttctgtatcacttactttgttaatcttagcaaccaacaaaggatctagcagggcagcacatgcattatgcttgtgcttcagggcaacttccttgcgccatgttgttttatttgattccacttga

SEQ ID NO: 76721 - DNA, 396 bp, Glycine max
  Peptide Sequence Number=SeqID_193499
atggaagatgatttctcttttagaaggttaattggtaggctgatctacttgactaatataaggccagatatcacttatgttgtgcaacatctaagccaatttgttgctgctcccacctcagttcatcaacagcctgctgttcgaattctcagatatattaagggatccccaatagtagggattttcctttttgctacaagtaaaattcagttaaagggaattagtgattgtgactgggttggttgcattgacatcagaaggtctatcactagttatgctatgtacattggtgactcattgatttcatggagatccaagaagcaagccactgtatccaaaagctcatcagaagctgaatatagagcactagccagtgccatttgtgagctacaatag

SEQ ID NO: 76722 - DNA, 675 bp, Glycine max
  Peptide Sequence Number=SeqID_193500
atggcatccaggaagagaaagagcactacttctagacctgcagctcagtatgataccaggcgattccaatctttggaagcttggaatagatacacgggcaacattctcagccgaaatatccttccggagagaaatgttaagatttatcatactgagttcgacaagttcaaagtggagttggagaggcataatctacacaaatgtctcaccaacctccaagatggaagcatagacgtggctgtggttaaggaattctatgctaatttatacagcccagaggaccaaccaccaaagcaagccagagtaagaggacacctgatcaaaatacatgcagacaacctaaatgagtttcttcaaactccagtggtattagaggagggggaatctttacccacctactctagattttgcatgtcaaggtctaatcctcaggagattgaagccatgttctgtattccccacaaggggtttgttttgaatgctgagggccaaccatggaaattccttagaaagaatctgactacactgacccaaatgatgcaatcctaccccctaaggctaagctctagtttcttaaggaagcttctcaaagaagcttctcaaggaagtttcacaagaaagcttctcagggaagcttctcaaggaagtttctcaaggaagctacctaggctataa

SEQ ID NO: 76723 - DNA, 216 bp, Glycine max
  Peptide Sequence Number=SeqID_193501
atgaatgaagttgggaacttacttggattgaagatgctcagtgaagattggatgcaaaatgcaagattgaagctcgaagatgtaatgtgtgaatttcagaagggagatgttgcaggaaaatttttgaaatatatgggcgcaaagaagcgcactaagcgagttgtgcagataaggaatcctgcaactcgccctaagccaggctcaaggccggcttag

SEQ ID NO: 76724 - DNA, 198 bp, Glycine max
  Peptide Sequence Number=SeqID_193502
atggataagaagtataagtttgaaagcattgtcatcattaaatatacaagtcaaatcatcatcaaattcaaggttaatcttctctgcaatgtcaaccatactcctttggatgagactgtaaagttgttcaggcttcaattttgcaggagtagggaactttccaatcaaaatcttcccaccacatcaatgtgttcataa

SEQ ID NO: 76725 - DNA, 2046 bp, Glycine max
  Peptide Sequence Number=SeqID_193503
atggcttctccaactcttgtatttgtcttcctcctatttctctctctcttaccccaagttattgcctccaaggctgtgatttttgaaggattcgatgatgaaaacagtgaactcaatcttgaaggatcttccatcatcaaaaccagccgtttacttaaactcaccaacagatcaaccaatattgtaggccatgcattctatgccacacccttccaaatgcttaacaacacaaaccaaccctatgcttattccttcagcaccaattttgttttctcaattgtgtccccaagttctggttctggtggctttggccttgccttcaccatagcaccctcaacacagtttcctggggctgaggctggccattatcttggccttgttaactccaccaatgatgggaatgagtcaaaccacatctttgcagttgagtttgacacaatgaatggttacaaagatgactcagacactgaaggaaaccatgttggggtaaacatcaatggcatggactcaaatattactgaaccagctgcatacattaaagagggcactgataaggtaaaggaagattttagaatggccaaggttgatgctgtccaagcttggatagaatatgatggtgaaaacaaaactctgaatgtaacaatagctcctttgtcaaaaccaaggccaagcaaaccaattataaagaatcatatcattgatctttacaatgttatggaggaaagcatgtatgttggtttctcagcatcaacaggccaggaaacaagctctcactatcttctagggtggagttttgcagtgaatggtgttgcccctcaactgaaaatttccaaccttccaaatccaccaccaaaagagaaagaaccgacatcatttccttgggtcaatattgcaattggcgtcttgtctgcttcgactttttgcctcttgtgtattctgttttgtataacatgttataggagatattatatggactttgaggttcttgaggactgggagatggattgtcctcacaggtttaggtacaaagatcttcacttagccacaaaggggttcatagagagccatctcattggagttggaggctttggtgctgtgtacaaaggtgtgttgccttccacgggagctgaggttgctgtcaagaggattgtgagaagccctttccatggaatgagggaatttgctgctgagattgaaagcttgggaaggttgaggcacaagaatttggtgaaccttcaaggttggtgcaacaaaaagaatgatctactcttggtctatgatttcatcccaaatggtagccttgattatgtcctatataaacccaacaacaacaactttgttttgaattgggggcaaagattcaacattctcaaaggcattagtgctggactattatatttgcatgaagagtgggagcaagtcgtgatccatagagatgtgaaaactagcaacattttgatagatgcacacttgaatgcacgtttaggtgactttggactggcgaggctctataaccatggtcaattgtcacacacaacaagtgtggttggcactattggttacattgcaccagagttaactcgcacaggaaaggcttccacaagcacagatgtgtatgcatttggggttgtgctccttgaagttgccacaggtaagaggcctcttgattcggatcagtttttcttggtggagtgggttattgagaagtaccacttgggtcaaattcttgaggtggttgatcctaagcttgattcactttatgatgaggaagaaattgagttggttctgaaattgggtttactttgcactcagcatagagcagattatagacctaccatgaaacaagttacaaggtacttgaactttgatgaacctcttcctgatattgttgattggggacatggtgtttctgggagcagtagattgagttcaggtttcttagaagttacgtattctatgggaactgttgaaacattagggtatttgtcatccattagcatgagtactaagtccatagatgctggtaggcagcaaataatcatatag

SEQ ID NO: 76726 - DNA, 636 bp, Glycine max
  Peptide Sequence Number=SeqID_193504
atggagaggagtgatagcatctatgatggagacatagacacccctcggctaagaccacctccttgcctctggcatccactaaaagaagcaactaaagctgataatggtgctcttgcgtttgatcaagatgatggttgtgatgctgacgacgatgaggatgatgacaagcagaatgatgtgttctcagatgcagtggatgttctatcactatcagaggcatcagacattatgcaacaatcagaggcagctcatagtgacagcaaagatggtttgagattaaagctttcagagtctaatggtggtccatctccaacttatatgatcaaccgttttctccctgatgccaatgcattggttgcatcatcttctgcacatttttccaatgatgccaaagtttgtgataattgtagtcatgagggttatctcaaaggttccactaggcattcacatgctacttctccaaaaggttgtggcttggaatttctcttctcttggcttatgaagaataagctttgtgctataaagagtcctgtcttaccatcatttacaaatgtgcagaagcatcggtacagttcaaaacatacgaaacatcgtacgtcagtccataagccctgcacaaatgttaaagatgtttga

SEQ ID NO: 76727 - DNA, 450 bp, Glycine max
  Peptide Sequence Number=SeqID_193505
atgggtgtggaggaggtaaagatccagatgctcccgtcctgtaccactgatgaggtttccttagtgggacagtcaattcacaccttccttgcttggccgacacatctggtcaagcctttatcacaacaggcaactgtgtctctggcaaaaccacctcaaaagccgaatccggagatcgatgatctgctttatctaatggcattgactatctcagagcttttcttgaggccttaccagcggacactggcagatggtggtcattgtgcccaaggaacacctagttgtcagtgtaatcgacaaaaaggaagcactgagtgtgactattatgtcatgcactggatgtccaccatcattttaggaagtttcaggaataattgggaaacgaccattggagccagagagattaaaggcgcttcgaatccagtgggcacaatattatctctgagttag

SEQ ID NO: 76728 - DNA, 267 bp, Glycine max
  Peptide Sequence Number=SeqID_193506
atgaatgtgccattgaacactgagctaaatgcagatgctatctttgtacaccttatcttaggctataagagagcattgttatggatcaagacaaatttgttccaaatttgggggagtgtcttggaattacatagcaagaggtttgaaagagggttgaagaactggagcaatgtgctcaatgcgtcaacaaccgctcaacgcgaggagccaacttggaggccaggcttagcgtgtctttggcggcttagcgcgcatctggcaacttag

SEQ ID NO: 76729 - DNA, 285 bp, Glycine max
  Peptide Sequence Number=SeqID_193507
cgtttcgtttctaaacgaccatttagaggaaacactgggtccaacaaaatagaagaaaatcactcgaagtgtatcaatctcacacagtgcgaggcgaaaaagtcgctagcgcacaggcaaggatgggcattttcacccggggtcaaggtttatggtgagttgggattttggctcaaggcttgtagaatggttggacatgatatatgtcagggtaccggtttggctagcggttcagggataaaggagatgtcccacattatttccatgatacacatgcaacaatga

SEQ ID NO: 76730 - DNA, 132 bp, Glycine max
  Peptide Sequence Number=SeqID_193508
atgcggaaattgattaaggaaaggatggaaaataaggtggctaatttcgtgggtcttaataaggttaagtggtggctggacagaaatatagaaatggcaataactgaagttacagggctccaaatgaggtga

SEQ ID NO: 76731 - DNA, 535 bp, Glycine max
  Peptide Sequence Number=SeqID_193509
atggctagaacacgaggtttaggtcgtgtcattggtagacttgtaggcagagatagacaagatgatcatgatgcagctgatgttcccgagaggcgtaggcctactgcctcagcccgtaggcaacgggttcatcagacgactgcggatgcacgtgatatgactgaggacattgctaacatgactaacgatgtccctgatgtggctgcggaggcacttgagatgcgtgcggacatacagggtgctgatggtgctgaggggtctgatgctgatgatgctgctgagggattccttggtgggccatgtgacccgttagtgctggcatcatttgcggaccacgttgcacatgctgtttggagtggacaggaacatccttatttgaagttagtgtcacatgggaggaaggtgacactgattgagaggtcagtgcctgagattgaaggcctggtggctgccacaagattaagtccactgattgattgttcagttattattggcgatcctggactgatatccgcattcgtggagaggtggcacg

SEQ ID NO: 76732 - DNA, 192 bp, Glycine max
  Peptide Sequence Number=SeqID_193510
atggaacgagtggtggctacggtgagcaactaccatggctccgagcgattcaatctcatcaagctgatttcacagactggcggcaattacattggcgctatgtcgaaatctataactcatctggtgagctgtttttcgggtgtatcaaatggatggcactacagaggaactacagatgacatcacaatttaa

SEQ ID NO: 76733 - DNA, 684 bp, Glycine max
  Peptide Sequence Number=SeqID_193511
atgcaaggcaaactgattttgcaactgcaaagccaggggtccctgcaattgctggtcgttgaatgcacgtctgacctgaacattcgtgccacggccaaagtccatggcgaactgctgggtgattcactgactgaatggttgaaacaggggcaactggtcatcaccttgatgccggaagagggcgagccctaccagggcatcgtcccactggaaggtgacaatattgctagcatgcttgagaactatatgctgcgttcccagcagattgatacacgcctgtggctgactgccgaaggtgaccgagctgctggtttgctactccagaaattaccgcaacaacaagagcaggatctcgactgctggaaccgcgtgcaacatttggcggggacagtcactgatccagagttactcgagctggatacgaccactttgttacaacgcttatttgtggaagaggacgttcgtttgttcagtggccgtcagattcaggctttttgtagctgctcacaaaccaatgtgaccaatatgctgcaaatgctaggcctagctgaagtgcgcagcattcttgaagaacaaggcagcattgagattcaatgtgacttctgccacaaacattacgtgatcgatgaggaagaggccttagccttgtttaatgacgatgatgagcatgaggtcacgcactag

SEQ ID NO: 76734 - DNA, 276 bp, Glycine max
  Peptide Sequence Number=SeqID_193512
atgctggctactggtaatcgattactaccttatgtttgtgtggacttggttcgcggtgcaaaggacaaacagctcaggattaagggacctgtcaggatgcccactaaggttcttcacatcactaccaggaagtccctttgtggtgaagttttgaacatgcatgccctttgtataaggagtagttttgcaatatatctcttagtttgcaaggtctggaatgtgctaaatggaaaatttggatggagacttttgaaggaaaaaggaagattaagttag

SEQ ID NO: 76735 - DNA, 303 bp, Glycine max
  Peptide Sequence Number=SeqID_193513
atggcaaccaaaagtaacagcaattgtagaatcaagagatctcacaatatgtctcttgccactctctttggaaaacttcaagaacatgaattggaacttataagactccatcaacatgaagagaatgataaaaagaggaaaggaatagcactcaaagccgcatcatcttctattcaagaagaaagtaacaaagaggacttgaatgaaataaaagaagatgatgatttcagattttttgtgaagagattcaataaatttctgagaaacaagaaatcaaaggagatcaaacatcaatccaaataa

SEQ ID NO: 76736 - DNA, 297 bp, Glycine max
  Peptide Sequence Number=SeqID_193514
atgaaagaagaacaccaaacgaagaacaatgtagaagtcgattacggttgcaattcggtagtgcctcaacctcattttctcttctctcttatttctctccaatttctcttaatactgaaggtccaaccccttcctcagcctctttcacgcctatttataggacatgagggcacttggtggacttggagctcactcaggttaattaggcaagttggtgaagtgctgattttcacacgctcactaagccaatctgctggcttagcgagccatccgctgagcgaaacatttctcggctaa

SEQ ID NO: 76737 - DNA, 240 bp, Glycine max
  Peptide Sequence Number=SeqID_193515
atggcaatagcagaaaatcctcagggaaaactcgttataaagatcttctctccagaaaaagaaggaggatactgtgcgtgtggagtgcaagaacagagagaagaagaagcgaaaggtggagcatgtaatgacgatggaccattgcaaaaagatgcaatgctgggtgatgttgaactttgcccaccaatgtgtgtcctagtagggtctcacatatcattcagggcatcaacatattggtaa

SEQ ID NO: 76738 - DNA, 210 bp, Glycine max
  Peptide Sequence Number=SeqID_193516
atgtggtaccatttttcagtgaaaaacctcgtcgggcgcctaggagtacatgactggacatgcctcacaatggggagaccagtcagggtcacgctgttttgcgagaatgctccaaccatgtgggatcggcacaggcttacaggagcactcaaaccggatgacccccaaggcctgcactccgaaaagtctgtcaaggcctctccctcctga

SEQ ID NO: 76739 - DNA, 361 bp, Glycine max
  Peptide Sequence Number=SeqID_193517
gtacgctttaaatgaaattgctggtgagtttgagtgtgtaccttatgcaagcaagaactcttcacgttgtggatgtgtcatgaggactacctacggtcttccatgttcatatcaagggttatgtgagactgaggtgaccataactgaggagatgaaaaccatatcgaaacgatttgagcaactcgatatttgcggcaaggtacatttgaagacaaagcttcgagaaattgcttatccagatctgaactttatgtgtcctcctccagaaaagaaccctaacagagcaaccggaggaggagctctagagagcaccagagacgccacaattgctaacggagaacgattgagggactacgtcgag

SEQ ID NO: 76740 - DNA, 369 bp, Glycine max
  Peptide Sequence Number=SeqID_193518
atggagcagcatggccatggaatgtattacacgccaccaacattttctcagtatccttcacagatgtatcagtatcctttcgaaggtcatgacactgatatatctgcaagcgaacattcgtttggtggtgttgcaaaaacacatcctcatttttcatggccgactatgaccccttcacagcaacatgatgccccaatggcaacacctaacgccccattggctccacaatggaatgtacccagaactatacctgatatgggtgacttattaggtgttgatttacgtcacgagttttctactgaggctgagcaagtagaagcggggagacatcgcagcagaagaaatcctgatcgtcaagcgcgaagatag

SEQ ID NO: 76741 - DNA, 726 bp, Glycine max
  Peptide Sequence Number=SeqID_193519
atgaaaaattctcacggaaattatagtcattcatgcatgcatatattctatgttgtttctagagggatcatagttgcttccaatgaccagctggacggactttacgaggaaaatccttcccgcttggttgccctaggaagactttacgagggatccacaacaattcacaacatccctttgttgcatgttcaagtcaaggttggtgttgaggaggttaaagatgcagaggctctcgttcctgtacccactaacgaggttaccttagtggggcagacacttaacactttccttgcttggccaacacatcttgtgaagcgtttatcagaacaggcagctgtgtctccagcaaaacctccagaaagcccggatgaagaggtcgatgatcccctgtacctgatgacattgaccatcccacaactgtttttgaagccgctccaggttatgtgggatgctaccatattcggggtgtttaatcaaaacttcccgttgtatataaagcacgaagatctctctgaaattgcacacggtggtcaatgtctcagcatatctgttatacagttgtggattcttcatctgactgagacaagtgtgcgagcgaggaattctatggattccttgagccacagtccattcagagatctggacaatcacaatttgaatatgaaagttacatcaagagttggatacagagttcaaaacgagatgtttaccttggagcctacctga

SEQ ID NO: 76742 - DNA, 183 bp, Glycine max
  Peptide Sequence Number=SeqID_193520
atggataaggatggtaaaaagagttcagaccctaagggtgacaagagatataatgatctgatattagagaagactcgtgccctgaagaaaaccatggaaaaatgggatgcccagctagctacatccagctcttctgaaaataacaaaggagatagtaaaggaaaaaaatgtgaaaaatattag

SEQ ID NO: 76743 - DNA, 159 bp, Glycine max
  Peptide Sequence Number=SeqID_193521
ggattagattgtcagaacttcgctcaggcggattatcgcagcacgagtgcggtgaataagtcagccgataatagtggcggtgtgcggctttttccagcgatttgtatcagcgttggtatagtatggcgtcagagtctgattgatatcacaggagagtga

SEQ ID NO: 76744 - DNA, 390 bp, Glycine max
  Peptide Sequence Number=SeqID_193522
atgttccttggaattcttttatgccttgtgattagttccagagtttgtattattagtgtttacctttcggaaagggcagaatcatggcttctccacctgatttacacacatctacggtcgttgtctactagaccacctggtgctgaggaaccagtggtccatgttgatcctgctaccggcaaggctgacggtccctacaggaagaaattaagaacatatttggggattgtggcgcgtgataaggtggacgtcacctacgagaattggaaggaggtccctactactcagaaagacctgatttgggaggatattcaggcggaatttgaaatccaagaggcttctgataatagcacgaaaaggaagttacttcagaccgtgggcgagagatga

SEQ ID NO: 76745 - DNA, 573 bp, Glycine max
  Peptide Sequence Number=SeqID_193523
atggttgcgactgttttaggtttgggatggtgggaaacaaccatgggaagtggagccggcatgggtgcagctgttggtggtgatttgggagaagatggagtggttctaggtgaggcgatatacaacctcttcaaggcggtccatgatggtcgggtggctgttgtgagcgtgcatggttggagggaggctaagctacactatgctaactacactaacagtgatgcatccttacgtgtagccatggtgttcctttgttgtctgctaggtgttgctggtgtagtattgctatcacaccaactcccaccattttttcttaaattcaccaacgtcaatgtccccaagaatgcaactttggaactgtttggaaaatgcattgttattgttagatgttgcattcctagccaaattccatgcacacagtctgtgatgagcattaggaaacacccttatagaattcctcatggcatgagaagaggtgagaggaggcgtcatccactagagaataagccatggaaggagaagcttcaccaccaagagagtgccttggataagaagcttagaaagaaagcttga

SEQ ID NO: 76746 - DNA, 219 bp, Glycine max
  Peptide Sequence Number=SeqID_193524
atggattatcaatccatatggtttaacaaacaatcatggataggggtactcacggtggggaggcaaggtggaatggaagaatgtagcaagaataatggaggggagggacaaactcgacataataaggaggggaaggaggggcacaaaaggatgaaggaggcgtgcagaaggatgaaggagaaactgatgagtgatgagtgcaggaacaataacccttag

SEQ ID NO: 76747 - DNA, 570 bp, Glycine max
  Peptide Sequence Number=SeqID_193525
gagcgacctgatctcaagttggtctcccatggtaggaaagtagataaatttgggagaccgactgctgagatcaaaggtatgattgcggccaccggattggatccattgatcaggtgttctgtgatcaccactgatcctagactcatatccgcctttgttgagaggtggcatagggagacgagcagcttccacctcccagtaggggaggtgatgatcactctagacgatgtttcgtcactgctgcacattccgattactagcgcgctgcattcatttgagccgctggttacatctgacgcagtcgccctgttgacggagctacttgaggtcaccgcagacgaggctacagctgagacacgtcaggcaggtgggcctcatgttcggttgtcctggcttcgggacatgtaccagagtaggtgccgggccaggcagtgggttgctgcagctcgaacgtacctacttcatttggttggttgcactcttttcgctaacaagagtgcaacccatgtccatgttgtgcacctacaggcattcagagacctgggccaggcaggggcattctctttgtga

SEQ ID NO: 76748 - DNA, 192 bp, Glycine max
  Peptide Sequence Number=SeqID_193526
atggcacgtaagctcaactccattatgagctactcaaaaggagacttggaaaattactgtactatgattaaaatgtgggttattcgaagggttgcaaggattaacattgaaatgatcttgatggatgagaaggctgataggattgttgctcaaattgaaaatgttgatcctgtgctaatcctgactacttaa

SEQ ID NO: 76749 - DNA, 240 bp, Glycine max
  Peptide Sequence Number=SeqID_193527
atggctctaacaaggatctgggaaggggggaaagaggccctgttcgggacagacacagattgtcttcaactatttatgtgggagatgaggcccggcggcatgttcgttcagagacgcgaggcagcggcggataacggcggcggcggcaacggcaacatgacgacgacggtgttgatcactgtcgtccacgcttcctcccactacgacctccacctccctaccaactccactttctgttag

SEQ ID NO: 76750 - DNA, 315 bp, Glycine max
  Peptide Sequence Number=SeqID_193528
atggagtgcatcaataaccctacctcttgtgaagggtcatcatcatcttccaagcaccccaacaagagcaatagggagaaaaaaggtgtgaggaaaagtaacaaaggaggaggaggaggagtgaggctttccactgatccacaaagcgtggcagccagagaaagaaggcacagaatcagtgacaggttcaagatccttcagagcatggtccctggtgggagcaagatggacactgtttccatgttggagtgtgccattcactacgtcaagttcctccagacagagattttgctccaccaagcattgatagacttt

SEQ ID NO: 76751 - DNA, 546 bp, Glycine max
  Peptide Sequence Number=SeqID_193529
atgtatatattaaaaagaatacataacataatctcacctaacattgttcccatcagtctaaaaggtatcaggcttagaaccaagcttcatgaacttcatcttgacaataataagatctgcttcctctcagttgatgctgactcagctgaaaaaactaaaaaaacagattcaccaccactcaatattcgatttctaaatccatccatttccggagacacatcaccacagttctccaccaatgctgagatcggtggctacctcttcaacttcctcttcatggcgcaggacgcatctacttcgtcgcttctgtgggcggtggcattgcttgaatcgcacttggaggtgctcgcgaaggtgagggccaaagtctccggaatctggcggtggcatagaagcgaagctagtcatggaagaattggaagaaatggcgcgaacaaagagagcgatgaggaatttagggttttaatttgcaaaactaaggaagagacgtgggttttaatttccctctcgcattctacattggttctacaagaatcgatgtcataa

SEQ ID NO: 76752 - DNA, 300 bp, Glycine max
  Peptide Sequence Number=SeqID_193530
atgatgtatgtagtttatgtacttatgttcatggttagcatgcttacaagcaacaacatgagaatatggcatgtgcaatttctagaatttggcacattcacactgtctttcattcagcctgatcgtgaaatctccaatggaccgaacctctcttgggtttattgtgatgcaatcctcccaaggaggggacccatcactagagtcatggctaggggactccaagaaaattggatcagagatgtaggagaaggctttaggattcttatgaatcttagggtagattttgggttcatgggctaa

SEQ ID NO: 76753 - DNA, 3013 bp, Glycine max
  Peptide Sequence Number=SeqID_193531
tgtttacttcaccggggtttctgcccatattgttgaggatcaacaacaatcactgctcaaactgaagaacagcctcaaattcaagaatgaaaattctaccaaacttgtgtcctggaattcaagcatagattgcagtgagtggaggggtgtaacctgtgataaggagggacgtgttattggccttgacctgagtggagaatcaatcaatggtggacttgacaattcaagtactcttttcaaactgcaaaatctccagcaattgaatttggctgctaataacttgggttctgagataccatccggattcaacaagttgaagagattaacatatctgaatttgtcgcatgcaggctttgtggggttcctacctgacaagggaaatgaatggtgcaatgctttgttgcagctgcatagcctgcaggagctaggcatgtcaaactgcaatctttctgggccccttgatcctttgctgacaagacttgagaatctatcagtcattcgtcttgatcagaacaatttatcatcctcagtgccagaaacctttgctgattttcaaaatttgacaacccttcaccttagttcttgtgaattgacaggaatatttccagataagatctttaaggtagcaacgttgtctgatatagacttatcattcaattatcatctatatggatctttgcctgaattctcagttaatggtcctcttcggacattgattgtaagggacacagagttctcagggtcaataccagcttctataaataatcttaggcagttattcgtcatagatacttctaattgctatttcaatggaacactgtcgagttcaatgtcaagactcagggaactcacttatctggatttgtcatttaatgacttcattggtccaattccgtccttgaatatgtccaggaatctcgtgtatttagacctctcacacaatgatttcacaggttcaatcacttctgttcacttggaaggcttaccaaaactggtccaatttgatttgcaggacaacttcctcaatggaaaccttccttcgtcaattttctctctctcattgctacaaagtatacaactttccaacaacaactttcagggtcagttgaataaatttttaaatatctcttcctccgtgttagagatccttgatttaagtagtaacgatttagaagggcccattcctacagatatctttagtctcagatcacttaatgtcctcagactatcttcaaacaggttaaatggcacattgaagctagatgtgattcagcaacttgaaaatctaactacattatctctttcacacaacgaattgtcaatagacatgaatgttacagatacacaaataacaactttagacctctcaagcaactatattcaaggatctataccaacatggatttggcaacttgactctcttgttcaactaaatctttctcacaatttgctcataaatttagaaggagctgcgcagaacactagttccaatttgaggctccttgacctcaaatctaaccaactccaagggaagcttcctatatttccaaagaatataatttatttggactattcaagcaataacatttgtttcactattccatcaaatgttggtacttatctgtcttccataattttcctgtctctttccaataacagtttatctgggaatattcctcattccttgtgcaataattcaaatctgctagttctggatgtttcctataatcagttcaatgggaaaattccggagtgcttaacacagagtgacacacttgtggtattaaatctgcaacataaccagttcaatggcagcattccagataaatttccactatcttgtgctttaaagactctggatctcaatagtaatctattgaggggcccaattcccaaatctctagcaaattgcacatcattagaggtgttggatcttggaaacaatcaggtagatgatggatttccatgcttcttaaaaacaatatccacactgtgtgtcatggttttgaggggaaacaaatttcatgggcacattggatgctctcatactaatagtacttggcatatgcttcaaattgttgatgtggctttcaacaatttcagtggtttacttccagcaaaatgcttcaaaacttggaaggcaatgatgcttgacgaatatcatgatggatcaaagctcattcgcattggatctcaagtccttatatatagtggtatatattatcaggattctgtgatacttacaagcaaaggtttacagatggagtttgttaaaatcctaagtatcttcacatctgttgacttctcatccaataattttgaaggaacgataccagaagagcttatgaattttacaagacttatttttctcaacttgtcacataatgctttagcaggccaaatcccttcatctatagggaatttaatacagcttgaatcattggacctgtctagaaaccgttttgatggagaaattccctcgcagcttgcaagtttaaacttcctctcatacctaaacctttcctataatcgtctggttggaaaaatccctgtaggtacacagcttcaatcatttgatgcatcttcctatgctggaaatgcagaattatgtggagttcctttgcctaaaaattgctctgatatgagcaatgcagaagaaaaagtgcctgaagtacatacagattttggagttaagtttgactggacttatgtatcaataggagtgggttttggcgttggagcaggattggttgtagctccatcattgtttttggagattctgaaaaaatggagcaaccataaaattgataaagttctccttgtcgttcttccaatgtttggtttaacttggatacccattgatgatgatgaagcagaggaagatactgaagaaaataactcggacatggaagaggagtgtgactacaatgaggaacaaactattttgtgccatcaaaggtttcaagggcggtattgtgtcttgtgttccaagcttgatatccgtaagaagaag

SEQ ID NO: 76754 - DNA, 1712 bp, Glycine max
  Peptide Sequence Number=SeqID_193532
atgtcaacagttgcaactagatggaggcaatttaagtctttcttgacttctaaatttgtgtatgctgacaatgagggtcaacaaataagtgatcctacaatgaagtatggtcttgatccagctacatgggcagaatttgcaaaaagccgccaaacccctaattggcagggaatacggaagaagggaagctttgttccccatggtcgtcaggatatcgtaaacacaactattggcagacctgagcatctaggacgtgttcgtgtcgcagggacatgtgtcacaatcaaccaatactttggacaagcatcacgtagctcaagcacttcgccgccatcaatcacccaacaacaattggctgacatcatcggtgacctcaaggatcaggtacgaaaagaggttgaggaagaaaacaagcagcagcaggaggcgtggaggagggaagttgaatcggtagaaataaaagttttaggtgcacgtgtgagcacaaagggtagttgcactgaaccagagacaaaaggagtagctaaagagccttctgatgttgttgtggacctaatgggcttgtacgtagtacacgatcaaagtactatgctcgtggcattgggaaaactatacgacacttcatcctccacacacaatgtgccttatgcaaatgacgtggttagggtgagtgttgtcacagtttaccacggtgacgctcagatcccttttttgatgtcagaggttcggtttgtcagccaagctgttggcatattcgtcgcttggccgaaacatctattcaaagtggtatctcatgaggattcgcagaagcctttgcccaactcggttggatcggctgaaaggggcactacaatggctgcagttgattccctgggagaattggtgaagaacttatttcacgtttaccaaaagccagtcgagttatcgtgggacgggaatcttgtagtttggttttgttctttacggaaaaagcctgatgttcacatcaaggctgcaattaacagtgcaatgaagaaaatattcactactctggaaggcaaggcggatggtcctgcacctcgatggattgaaccaaagagtcatcttcaagccggaggctatgagtgtagatactatgtcatgcattggatgtggtgcatatttagtggcggtttgaagaacgaatggaataaggcagcatgcccagtatgttaccttcccgtggatgaagccattgcacttatgcctaagcttccgtcaccttctccagtacttaagaacttagcatttatctatgaggaaactcttagcaggaatggtgaatttggtggaactaaacctgatcacaacacaggatttgacatggatgaagatgacctcattgaaatggagcagtgtcacgacgtagttgatgcattagccatatttggaaattttgatgagataaacgacccaacaaatataagtgattattcaaaggagacaatatgcttccttatgtttgtagatgaagaaatagagtctaatttgaggagttctgccaggctggggaccagaaagaagattggtttgtggagaattattgtttctcataatcttccttatacagatccaagaggcacagggaagattccaaagcttctgttgcatagaatggttccaaatgcccactattctatatggcttgatagaaagcttgagcttcttgttgatccatatcaaatccttgaaag

SEQ ID NO: 76755 - DNA, 360 bp, Glycine max
  Peptide Sequence Number=SeqID_193533
atgggaaagctggatcatctagaggaaaggctcagggccattaaaggaggtgaagattattcctttgctaacctaaaagagttgttcccaatacccaatatcatcacccctctcaagttcaaggtgctggactttgacaagtacaaggggactacttgccccaagaaccatctaaagatgtattgtcggaagatgggggcatacgcaaaagatgaggaattgttgatacattccttccaagaaagtcttactggggtagttgttacctggtacactaacttggaaccttcccgagtccattcctgggaggacctaatggttgccttcgttaggcaatgtcagtataatggcttcggatag

SEQ ID NO: 76756 - DNA, 264 bp, Glycine max
  Peptide Sequence Number=SeqID_193534
atgaaggccgacatggaggccattaaagagaaaatggccacaatgatggaggccatgatgagcgtgaagaagataatggaagccaatacggttgcaattgtcgctaccaacgttgttgctaagcacgccttcccgccatatggcttgcctctcaactatacgccacccaatgttgcatacactcccaataagaatgtcaataactccactcctatacccattgagagccagcaaccccaaactgatcatgcacatgtctattaa

SEQ ID NO: 76757 - DNA, 453 bp, Glycine max
  Peptide Sequence Number=SeqID_193535
atggtgattgatgaagatcatgatggatttccatacttcttaaatacaatatccacactctgggttatggttttgaggggaaacaaacttcatggtaacattgaatgttctcagactaacggtattgagcatatggttcaaattgttgatcgggcttccaacagtttcagtggttcacttctagcaaaatgcttcaaaacttggaaggcaatggtggttgatgaagatcatgatgaatttccatacttcttaaatacaatatccacactccatgtcatggttttgagggaaaacaaacttcatgaaaaagttgaagattggaacagctcacttaatgcacaagacagaccaaaagcgtcaacttgcttagcggccaactcaagcttagcacgaaaaaggcctacgaagaagctcaaaggcgtgcttagcgcgaatcccgcgctaagcgcatga

SEQ ID NO: 76758 - DNA, 450 bp, Glycine max
  Peptide Sequence Number=SeqID_193536
atggacgctggttgccagagcaattgcgttggggcccacagaattgatgtgactagtgcctccattgcaaggctttgtggaagaaaactcagagtgatgatggttggtgtggatctcatcctcatccatgctgtccgaggattacacacactcagtgctctccaaatccatcaactcgccaaaccaaacccccttccttccaccactgaagggtacatcctttgtggtacaagtagagggtgcatctacttgggttgtaatactgagaacaagagagggtacatctcttgtggatcagttcaagtggagggtacatccatttggttgttcaaagagaacaagggagggtacatcctttgtggatctttgcttgtaaaggattttacaaggttattggaaatctcaagaaccagtggttgcttggggactggacgtaggcacgggttgtga

SEQ ID NO: 76759 - DNA, 264 bp, Glycine max
  Peptide Sequence Number=SeqID_193537
atggaggaggaagaactatctaagttgtctcaagatatcggagagatgtggttgagactagtaaagggtctaaggaaggctttactactaagttatgaggaagtaaagaacaaaaacaataacttagacaaaagtaaagcggaaataaaagtacacaatggaaaagtaaagagtgtagggaagaagaagacaaacacaagatttatactggttcggtcacaacccgtgcctacgtccagtccccaagcaaccactggttcttga

SEQ ID NO: 76760 - DNA, 663 bp, Glycine max
  Peptide Sequence Number=SeqID_193538
atggtggttgatgaagatcataatggatcaaatttcaatcacattgcctttgcttttgttgacttctcattcaacaattttgaaggaagcatactagaagagcttatgagtttcacaacacttatttctctcaacttgtcacataatgctttagcaggcaaaatcccttcatctatggggaacttaaaagagcttcagtcattggacctatcaagcaataatcttgatggagaaaattcttcacagcttcaaagtctaactttgctctcatacctcaacctttcctataaccgtcttgtgggaaaaattcctataattgtgttcgtcgccgctaatgacggaggaggttgccaacctttgaccatgcctatccgttgcctccttggcaactatgaggctctcgaaggtgctcgcgctagccttctcatcttcatcgggtttgggttggcgaagctgctaggtagagttgtttgttgtgactatgttttctctggccctgactcagctctcaaaggtgcttgtgctagccttctcatcttcaccgggtttggtttggcgaaggtagggttgtttggtatgactgtgttttcattgtgtatatcatcttgtcatcatcattttgtttttgacgttgtcgaatatgaacacacgaacgatctatag

SEQ ID NO: 76761 - DNA, 219 bp, Glycine max
  Peptide Sequence Number=SeqID_193539
atgcttccagtcatcaaccaaagtgccctcaaaagagttaaggaacatggtgaggaaagggagggattgggtggtgttggtgggtcaccggaagtggcttggcggtgttgtcttgcagcaatggtgataatgaaaaatgatgaagtttgcactttgttagaagtgatttggggagtggtaatcaattaccagaccctaaaatatgagtttcaagtctaa

SEQ ID NO: 76762 - DNA, 489 bp, Glycine max
  Peptide Sequence Number=SeqID_193540
atgtcagccaatgatcacgccattttgcacgacagaacccatcaacccacaaagaaaagcttgttagaactatcatcatatgacgctttattgacacataataagttgctttctaagcaacttgagattttaacagaaatacttggttgtaccatctgtggtgaggctcatgaaacaggccaatgtattcccattaaagaaaacactcaagaaattcattatataggaaatcaacagcgacaagggtatactcaagtaggatttttaggcttccagcagggtctttataatcaacaaggacagtggaagtcgcaccttggtaatcagttcaacaaagaccagggtggaccttctagcaggccaatccagcaagggcctaacatctttcagaggattgctaagctagaggagactttgacccagtttatgcaggtaattgttcggcttccagcaagtgcaccggatcgcacaagtagtataaaacggtaa

SEQ ID NO: 76763 - DNA, 337 bp, Glycine max
  Peptide Sequence Number=SeqID_193541
ggattgtgcccgcaagacacccagtggactcgaagaagtccaacagggtcctggggtttctagctttgattacgggcctctgtaagttctacggagtgcccgtcgcacagagcaaggtcatcaggccccctattaaccagactttcatcgagaagtactgcgcccccaggcaggcgcagggcgagacaccacaacagcctaggaatggtcggcagcaggcaacagacgcaccgccgccacctccaaagcccctcagctcatcttcaaaagctggagcattgcctacgacttgtggtcgacagcaagcgaccaagtccaaagccaaagataaacaaaa

SEQ ID NO: 76764 - DNA, 138 bp, Glycine max
  Peptide Sequence Number=SeqID_193542
atggcccaagcggttagcataggtgtcaagtacagtcgtggtgactctactatggccatgtttgatgtattgagggcactacatgtattaagtgtggcgaggggtatcatggctccaccaactttgagctctctgtga

SEQ ID NO: 76765 - DNA, 267 bp, Glycine max
  Peptide Sequence Number=SeqID_193543
atggccattgtggattttagcactgccacagtgtgcctcagacgagtgttcgcttccggcaagtgcaccggatcgcacaagtattataaaacggacacacttgctcttgtgggagcactatttttaggaatcaatgagcataaattctttactatggaagaaggtgagacatacaaaattaatggaagcggaatggagaaggacgaaaggttattggacacgccacttcaaggagaagatgagtcgagaacaagctcatcaccatag

SEQ ID NO: 76766 - DNA, 828 bp, Glycine max
  Peptide Sequence Number=SeqID_193544
atgtcatcttatgccaagcattggaaagaaattttatcaaacaacgggaaattggaaaattttggcattgtgggtcttaatgaggagtcttttgctatccttaggaaacttctccctaagacgaaagaccccgataaatttactattccttgtttgatagaggggtcttactttgataagtgtctatgtgatttaggggctagtgtaaagttgattccctattttatctttaagaaattgggcataatagacttagagcctactaacatcactcttcaccttgctaatcgttcagttgtttatcctagaggggaaattgaggatgagctgattaagggggtgttcttaagtgtggggatgcctgatcctctagagaaagttctctctaatgaggactttgactgggagttgaacctagacgtggaggaaatactaacgtttctccactctcaacatggtcctaaaccatctagttttgagaggttggaatggggcaatggtccaaagccttatgttgaggaatcttctaatttggcgttgaaggcctttccttctagcatcaagtatgttttccctaaaaccctatcttctcttccaattttgatttttgaagttttacatgaaattgaggttgagaaactattgtgggttcttagggacaacaaggaagcctttggaatcaacactgaagagtgctttccacctaaacagatattccaaaggaagcttaatcctaacatgatggaggttgttgatggagagaatgttaagcccactttcatgatgaatgcacatagagtcaaggcatataataagggattccaatag

SEQ ID NO: 76767 - DNA, 324 bp, Glycine max
  Peptide Sequence Number=SeqID_193545
atggaagaaggatactccaccaacaagccacctatgtttagaggagtaaagtatgattattggaaggagcaaatgatcttgtgcttcaagtccatacacatcgacttgtgggacaatgtagaaaatgaggaatacaccaaagtccataatatcaagagtgccaagcaaatgtgggacactttagccataacatatgaaggtatgccacaggtaaagaggaacaaactaagtccttacactcagttcatcaagccccagagcttcaacgtcatagtttctgactacaatcgtggtggatatcaacacgaccgtagtgcgccttag

SEQ ID NO: 76768 - DNA, 321 bp, Glycine max
  Peptide Sequence Number=SeqID_193546
atggctccaaagaagcttctagctaagagggcaaggaaagatgctgttggagaaggatccagtgtggccccacaagagagacgagtccagttgagggaaggagaatatgctgagttccaggaggcagtggactcaacttgcagcgcccatgggattagagtcttcttagagtcttctatccaatacctttgggggaaaagagtgcagaaaatacccaaaatggagggcaaaagggtcatttggaagacttttctaacccctggctcacctaggctagcctttggctcgcctgggccctcaaataacttaggagtgaagtaa

SEQ ID NO: 76769 - DNA, 978 bp, Glycine max
  Peptide Sequence Number=SeqID_193547
atggcgcgcgaggcggaacagcacggtatcatcgtgatgcagttccagctgttcggcattgatgacgggcatcaggcgtgtcagccactgcgtcagttcctgcgccagataaaactaaaagcgcagcctaccagcatcagtaacatcgccagtaagcttaataagccaacggttcgcgccagccgcgctggtgcaaacctgagcaaattatcacaattaccgatccaaatcagcgcccgcccggcgccgggtttcgccaccctgcggcgcgagtataacgtcaaattaatcgatttgccggagaaagccatgaagcgcacgcacatccttaccgaagccgatgttacgccggaaagcatttttaatctgcgccgccgccaggtgctgaaagcgctggggctaggcgctgccgcggccagtctgcccggcggcgcacatgccgatgtgctgagctggtttaagggcaatgacaggccgccggcgcctgccggacgcgatctgcagttcagtaaacccgcccagtggcaggcggacctgccgctgacaccgtttgataaagtcgctggctataacaacttctacgaatttggtctcgacaaagccgatcctgcagccaatgctggcacgctgaaaactgacccgtggcaattgcgcattgagggcgaagtggcgaagccgatgacgctggatatggacgacatcttcaaacgcttcgccatggagcagcgtatctatcgcatgcgctgcgttgaagcctggtcgatggtgattccctgggtaggctttgaactcaacaagctgctgaagctggctgaacccaccagcaatgcccgctatgtcgccttccagacgctatacgcgcccgatcagatgccgggacaaaaggaccgctttatcggcggcgggctggattatccctatgttgaaggcttgcggctggacgaagcgatgcatccgctgacgctgctcagcaccggc

SEQ ID NO: 76770 - DNA, 2479 bp, Glycine max
  Peptide Sequence Number=SeqID_193548
atggcgctgcgcgtggtggtgctcgatcccgccaaaacctggttccgctcgttcaccggtgcctacacgctgattatcctgctgacggtggtggcgatcatgtcggcgctgctggtgatgacgcaccgctggcttaaccgccgctggcagcatatggagcggctggaggcgcgcgcggagcgcattctggctggcgagcgcgcgccacgcagcgataccatcgccgaatggccgccgaaagccagccgcgctatcgatctgctgctgggggatttacaggaagccggcgagcagcgtctgcgtatcgacaccttaatccgcacctttgccgcgcaggattcgcgtaccggcctgaataatcgcctgtttttcgataaccaactggccacgttgctggaagaccaggaagatgttggcacgcacggtgtggtgatgatggtgcggctgccggacctcgataccctgcatgaaaccctcggaccgacgctggtcgatgaatacctgttcgacctggtgaacatgctctccaccttcgtgctgcgctatccgggtgcgctgctggcgcgctatttccgcagcgactttgccgtactgctgccgcaccgcactttgaaagaggccaacagcattgccgaccagctgatcaacgcggtggattcgctgccgccgatgcgcatggtggaccgcgatgatctgatccacattggcatcagcgcctggcgcagcggcgagtcggtgtcgcaggtgatggagaatgtcgaactggccacgcgccgggcggcgctgcagggcggcaacaactggtcggtgggcgagggcaatacgctggagatggggcgcggcagcgtgcgctggcgcaccctgctggaaaacaccgtgaaccgcggcggcccgcgtctgtaccagaaaccggcggtgctgctggacggcaaagtgcatcaccgtgaaatgctggcgcgcgtgttcgacggcgataaagaggtggtgtcggcagagttcatgccgctggtgctgcagcttggcatggccgacagctgggatcgccagctggtcatgcgtattgcggcgctgtcggaggtctggccggatgaaacgctggcgctgccggcggatgtttgtcaacacatcaatcgtttagtgccggttttccgcatgctgaccgcgtttggctgtcggattgcggtagatcaggccggattaacggtggtgagtagcgcttacatcaagcagttcccgattgagctgatcaagctcgatccgggcctgattcgcaacattgagcgccgtacagaaaatcagctgttcgtgcaaagtttgctggaagtgtgtaaatccacgcccaccaaagtctttgccgccggtgtacgcacgcgcgcggagtggcaaacgctggccgggctgggcgtcgcgggcggccagggcgacttttttgctccttcgctgccggcggattttattttccgcccccagcttgcaggattatcccttagtatgtttaaaaaatttcgtggcatgttttccaatgacttgtccattgacctgggtaccgcgaataccctgatttacgtaaaaggacaaggcatcgtgctgaacgagccttctgtggttgccattcgtcaggatcgcgccggctccccaaagagcgtagcggctgttggtcatgatgcaaagcagatgcttggccgtacgccgggtaacatcgcagctatccgtccgatgaaagatggcgttatcgccgacttcttcgtgactgaaaaaatgctccagcacttcatcaagcaagtgcacagcaacagctttatgcgccccagcccacgcgtgctggtgtgcgtgccggtcggcgcgacccaggttgagcgtcgtgccatccgcgaatcggcgcagggcgccggtgcccgtgaagtgttcctgattgaagaacccatggctgcggcaatcggcgcgggtctgccggtgtcagaagcgaccggctcgatggtggtggatatcggtggcggtacgaccgaagtcgcggttatctccctgaacggcgtggtttactcttcttctgtgcgtattggtggcgatcgcttcgatgaagctatcattaactacgtgcgccgtaattacggctcgctgattggtgaagccaccgctgagcgtatcaagcatgagatcggttcggcttatccgggtgacgaagtgcgcgagatcgaagtgcgcggccgtaacctggctgagggcgtgccgcgtggctttacgctgaactcgaatgaaatcctggaagcgctgcaggagccactgaccggtatcgtcagtgccgtgatggtcgcgctggagcagtgcccgccggagctggcgtctgacatctccgagcgcggtatggtgctgaccggtggcggcgcgctgctgcgtaacctggatcgtctgctgatggaagagaccggtattccggtggtagtcgcagaagatccgctgacctgcgtagcgcgcggcggcg

SEQ ID NO: 76771 - DNA, 2082 bp, Glycine max
  Peptide Sequence Number=SeqID_193549
atgcatcgcggtatcatcctcggcaccatcgtagtggtgatactgatgctcggtatgcatctggccggcgcactcggtcgcgcggtactgccggatctggcgattccggatcgcgtgatcccgacgctgatgatcaccgtgctgccaccgatggcggctggcgtgttcctcgcggcgccaatggcggcgatcatgtcgacgattaacgcgcagctgctgcaatcgtccgctacgctgatcaaagatctttacctgcgtatcgcgccgcagcacagcgagaacgaggcacgtctgcggctgctctccggcaccatcacctttgtgctcggcctgctgctgctgctggcggcctggaatccgccagatatgattatctggctcaacctgctggcgttcggtggccttgaagcgtggcatggtggtgggagccggatgctatacgctgcttgccagcctgaaaatcgaactgtggggctttcaccctatcgtgccatcgttgacattaagcctgctggccttcctggtggcaccggcgagcacgccgaaaccctcagcgacgcgctgatggatgtcggtgcggtgtcggtcacctttcaggacacgcacgacaacccggtttatgagccgctgcccggtgaaacccgcctgtggggcgataccgatgtgattggcctgttcgacgcggaaaccgccatggacgatgtagtggccgaactgagccagcatccgctgctgggatcgggtttccgccataagatcgaacagatcgaggataaagactgggagcgcgaatggatggataacttccatccgatgcgcttcggtgaacgcctgtggatctgcccaagctggcgcgacgtgccggatccggatgcggttaacgtgatgcttgatcccggtctggcctttggtaccggcacccatcccaccacgtcgctgtgcctgagctggctggatggtctcgatctgcagggcaaaacggtgatcgatttcggctgtggctccggcattctggccatcgccgcgctgaaactcggtgcagcccaggcgatcggcattgatatcgatccgcaggcgatccaggccagccgcgataacgcggagcgcaacggcgtggccggccgcctgtcgctgtatctgccgcaccagcagccggaaaacctgcaggcggatgtggtggtcgccaatatcctcgccggtccgctgcgtgaactggcgccgctgattagcgtgctgccgaaagctggcggccatcttggtctgtccggcgtgctggccagccaggcgaaaagcgtgtgtgaagcctatgcggagcgttttgcgctggacgccgtggcggaaaaagaggagtggtgccgcatcactggcactgctgcaccaggcgatagcgctatccctgttaaccgtgccgctgccgcctgggattatgctcagccacagcagtggggcgacctgtcccctgattttcacgtctgcaagcagggcgtgaatcagtcgccgattgatattcgccaggcgctgcatgccagtctgccggcgctgacgctgacgctggaactgcaggcgcgccaggccgccattgttaacaacggccataccgtgcaaatcaacctgcagcagggcgatacgctgacgctggacggcgagaccttcacgctgaagcagttccacttccataccccgagcgaaaacctgatcgacggcaaacgctatccgcttgagggccactttgtattcagtgacgagcagcagcagctggcggtcatcggggtgatgttcgaagccggtgcggcaaatccggtgctgacgacgctgctggatacgctgccggcgcaggtcaatcagccggctacgctgcaacaggatgtcgatattacgccactgctgcccgccgatcgccgttactaccgcttcagcggttcactcaccacgccaccgtgcagtgaaggcgtgcgctggctggtgatgaagcaaccggtaacggcttccgcacagcagctgcaggccttcagcgcggtgctgggtgaacacggtaacagccgcccggtgcagccgctcaatggccggctggtggttgagtaa

SEQ ID NO: 76772 - DNA, 1353 bp, Glycine max
  Peptide Sequence Number=SeqID_193550
gaatacgagaaaaacccttacgacaaggtccataaccccaaagggattatccaaatgggtctcgcagagaatcagctctcattcgacctcctagagtcatggctcgccaagaaccttgacgtggcagggttcaagcgtgacggcaaaaccatattcagagaactcgctctcttccaagactaccacggtctcccttcattcaaaaaggcattggtggatttcatggccgaaatcagaggaaacaaagtcactttcgaccccaaccacatcgttctcactgccggcgccacctccgcaaacgaaaccttaatgttctgtctcgctgaacaaggcgaagcattcctcctccccactccttattacccaggtggagaaccggggttgagattgttccaatacaatgcaacagttccaatagcttccaaatcacggaggcaagcattgcgacaagcgtacgaggatgcgaagaagcgcaacctaagagtgaagggcgttttggtcacgaacccgtcgaacccgttaggcaccacgatgtctcggagtgaactgaaccttctcgtcgacttcatcaaagagaaaaacgacatgcatttgataagcgacgagatttactccggcacagtttttagctccccgggcttcgttagcgtcatggaagttctcaaagaacgaaacgacgtcgtcactgacaacggagtctggaacagagttcacgtcgtctatagtctctcaaaagacttgggtttgccggggttccgcgtcggcgctatttactccgaaaacgacaccgtagttgccgcggcaacgaagatgtcgagctttggtcttgtctcttctcaaacgcagtaccttctctcagccatgctgggggacaagaagttcaccagaaactacatcgctgagaacaaaaagaggcttaaacgacagcagagaatgctcgtatcggggctattgaaaaccggtatttcatgccttgacagcaatgcggggttgttttgttgggtagacatgagacaacttttgcattcgaacacgttcaaggcggagatggagctgtggaagaagatagtgtaccaagttgggcttaacatttcgccaggctcctcgtgccattgcaccgagccggggtggttccgcgtgtgtttcgcgaacatgtccgaggagactctggccttagccatgaagcgcttgaagaacttcgtggcggctgagtctcagaggaatagttctagtggttgtagtgctggtgctctgttgaacaacaacaacggaagcttcaagagaaagtccctcactaagtgggtttttcggttatcgtctcgcgatcatcatcgtgaacaggaagaacggtag

SEQ ID NO: 76773 - DNA, 546 bp, Glycine max
  Peptide Sequence Number=SeqID_193551
atggcctcatggaaacgccgagtagtgcccgcacaaggaggggattcgacttgggattcctctcgctttacttttgaaactgcttggcatcggtaccaagacaatgttcaccttcggaacattataccagagaggaacgtggagctagccctggacctaggcacacctggtagaggttttgttctgaacgctgatggtgccccatggaagctgttgaggaaggatctgactacgcttgcacaaacatggagcgacaagactgatttacggtcttgtaataaagatggacatggacttgggcagtttcatctcagaattgctagaaccccgcagatccatccatcacattcctcgagccccgtcatactcgcactagagctggcacaccagacgcctcgctactcacacaaccaccaccataggccgcatgtcaccaacacccatccacttcagcttagctggatctacatagagagatgctccagtccatctatcagggccaacagatcatcgtccaatatcttcattgactttccattcacatga

SEQ ID NO: 76774 - DNA, 342 bp, Glycine max
  Peptide Sequence Number=SeqID_193552
atggcaaaagcagaacatcctcggagaaaactcgttataaagatcttccctccaggttctaaagtttcttattcttgtggtgccaacactccaaaagattcaatagtgtccaaagtgtgtgagctgaagaataagaagggttattatgcgatgacaatgtgggttaacaccgaaaacccatcagaatcttgtgtcactgattcaagaatttcaagaaccgaaatggcaacacgggttaacactaaaaaccagtccaaagtatgtgagtcgaagaaaaagaaggaggatagtgtgcgtgtggagtgcaagaacagagagaagaagaagcaaaaggtggagcac

SEQ ID NO: 76775 - DNA, 183 bp, Glycine max
  Peptide Sequence Number=SeqID_193553
atggtgatgttgatgcaagcagagaggttgttgttgtgcgcgtggagggagatgatggtattccagacgacgacatttcggggagatgagcttggtgtagtggaggaggaggaggaggtggctgtgggagaccatagttcaaagaggctccgagctgaaaggggagtctatggaagcttctag

SEQ ID NO: 76776 - DNA, 375 bp, Glycine max
  Peptide Sequence Number=SeqID_193554
atgtggagactatggaggaatgttgttccagttaagaagaatctcaaagcaaaaatagaatcttttgacccaacttgccctttttgtggaaaggaagaggagatggtggaacatgagtttcttttccgtaaggagcgtagaaatgaatgggtctttgaaggaaaaagtattcctataaagctcatccttgatagagctttttgggtcacctatcctgacctcgaaattaaaagggaccaagctttgaaccatccgtcccataggagcccaactttgcaggatgaaggggtcaaacaaaattttgatgaagctacaaaggagaactttggtataggaatgggcttaattgtagaaaccatcacggggagatcctag

SEQ ID NO: 76777 - DNA, 321 bp, Glycine max
  Peptide Sequence Number=SeqID_193555
atggcaacaagtcaacaagaagatgctacagtagcaacaacaggggtacaccaaccaaacaaagaggtgcaattagtgagtaaaactaaaaagaggattgcaaagtttgatatcgcagaagctacgaaggtgaagacgaaggttatgtcaacagtagcgacaagatggcggcaatttaagtccacattgactagcaaatttgtgtttgctaagagtgaaggtcaacaaacgcaagatgttgtgacaaaatatggactagatcctgaagcatggaaacaatttgaagaaacccggctcacacctaactgggaggttagttga

SEQ ID NO: 76778 - DNA, 153 bp, Glycine max
  Peptide Sequence Number=SeqID_193556
atgattaaaacaaagagggaaacgagcaacaatttgaaggttgtacattcaggaactaaagaattcaaaatagctagtaataagagggatttgtttttgggattttctgagcaccaagaggggctacgcaagaagcttgcacttgaggagtga

SEQ ID NO: 76779 - DNA, 186 bp, Glycine max
  Peptide Sequence Number=SeqID_193557
atgaagtctttacagggaaccactcaggcgttgacacgtggcagtcaacgtctaagggctagtgataataccccacaaacgttgggaggaattgcggcaaagacttcaagggcagtttcattgtggctgacgaaaagtcgagtggtgagggatttcagaagcaaggattatgggtttggtgattga

SEQ ID NO: 76780 - DNA, 567 bp, Glycine max
  Peptide Sequence Number=SeqID_193558
atggagattgtggataagaggttgggtgaacacttcaacaaaacggaggcaatgatgatgatcaatgtagcccttttatgcaccaaagtctctctagcactcaggcccaccatgtctttagtggtaagcatgcttgaagggagaacacgtattcaagaggtggtgttagacaaaagagaggtattggatgatgacaaatttgagataatgcaacagtattatcaacacagaggagaaaataacataattgagtctcagaacctaagtgaccctacgggggaatcttctaaacttttcgctgatacaagttcttctgaatttaatgagtggaagaatacttcgttttcaacggttgattctctaaccattaagaccatgaatatccctcaccgagtgcaaggtttaatctcatcatggatactgaaggtagaggataagccccttccaactaggtttgctatattagagttgagagatcaatctcctaatctcttgttatttctttgtctggtggtgaggaaggaaagggagggaatgaaagtgaatgagaaaagaatagagaaatag

SEQ ID NO: 76781 - DNA, 150 bp, Glycine max
  Peptide Sequence Number=SeqID_193559
atgaattattcaaatagtaaaattatactgataactttaggtctttacttacattacatctatctcgccagtgaaagacagcgtgcagtgccggtgtcaggtgggtggccccccaacccctcctcctcctacgtgggacttcaagtctga

SEQ ID NO: 76782 - DNA, 969 bp, Glycine max
  Peptide Sequence Number=SeqID_193560
atgcagttcccactcttcaggcgtcctttacaccatcccagaaccagagcattgaatccaactctgcttatgcagcctcactacgatatggccaacaccttttatgaggaactcacacttgacgcttataactcatccactttaagcccaaaccatagtggtcaccaattccatcttcaacacttctatccacaatttcaccacaacccacgacacaaacagcgacatacgcaacaatctcaagagtatcaacattcttatcaattgtgccaacaacacccaaatcaatttcaaccttcacagcaacacgaacaaccccaatatcttggagcatttgattatcaccagccccaagaagaatccacaaccacagtgtcgttttggaaagcattcaacacggtgctctctgatgcaaatggaaacgtccaagaggtaaacgaaaactttggggagctagaagctgtgtacataaatgctcgcaataaacaaaaggctgattcaactattgccgttgaaaacacatgtaatgtggccaatgttggtgttccagtgacaaatgagtgtcaaatgttagcgacggaagcaactggggttgatggagtacgaacgaagaagggtaggaaaaggaggagaaagaagaaagtggaagaagaaatgggtttgatgggttcatttttcaagaggttggtgaagcgtgtgattaagcaccaggaggttcttcagaacaagtttctggatgctatcgaaagaatggagaaagagagagcagaatgggaagaaggttggagggtccgagaaagggaaattcacgacagagaagcgatagtgaaagcacgagagcgagatctggcttctaagagagactcttccattgtttccaacttagaaaagataacgggtcaaagcttcgttcttgtttcttctgggaagagtagtcacgagcaattatctacaataaatgaaaattga

SEQ ID NO: 76783 - DNA, 291 bp, Glycine max
  Peptide Sequence Number=SeqID_193561
atggaagcaaaaagttttgagaaaattttgaaatacagcaaccatttggagcatttggttagagtcaagtgcacgagggaattgacgagggaggacttgccgactttggagcgccgagaacgacgaatttggggtctgacgacgatgttggagccgggaaagatcgtggagtcgtcgacctcgtcgggttcaatgctcggagggatgaatagctgggattcaaaggaagaagaaggaagagggttggtggtgggggttttggaggcgttgcttaaatgggaaagagggtag

SEQ ID NO: 76784 - DNA, 2127 bp, Glycine max
  Peptide Sequence Number=SeqID_193562
ggttatgaatggatggtgctgaaaggcggtgaagtaagcatgtctgagaagaaaagggaagtgatggtggcgattccacatgagggtggtgctgaatctttgatgccaaagcagcagagcagggtgaattcgccacacagagcattaaacgacaacgaggttgctgcaaagtcgccacctttgaactgtgcttcccctgagataaggttcatgccaagcccaaacaagcccccaaaagttcccacttccaatgccatcctcactcggagaaaatcactcacaaggtcagtgtattccaaacccaaatcaaggtttggtgaacaatcttaccccattgatgggacccttttggaagagaatgctacctcaactttgcaagaaaatttgactgttggttcgccatataaagcatcacctaataacaacaacaaacctgggactgttaatagaacattctccatcctgtctgtggtcactcccaagacgccgctgatggcatctcccgggctggccggggaggatttcgatgaaatcatttacaagaaagttgaattgagtaaaaacatgcgtagtaggagactgactgttaaggttttgtttgaatggtttgtgtttgtgtgcattgcaagtagcttggtggctagtttaactgttggaaaacttaaaaggaccgagatttggggcttggggttttggaggtggtgtgtgcttgtgatggtgaccttttgtggcatgttggttaccagatggttcatgctcattgtggttttcttgattgagaccaactttttgttgaggaaaaaggtgctgtattttgtccatggactgaagaagtgtgtccagttcttcatttggctaggtttggttcttctcacatgggtgctgttgattaaccgtggggtccaccgaactgaattggcgtcaaagattttgaatggggtaacatggactcttgtttccctcctcattggagcattcctgtggttcgtgaagacattgttgttaaaaatcttggcatcgaatttccacgttaagtctttttttgatcgaattcaagaatctctcttccatcagtacattctgcagaatctctctggacctccacttgtagaagaggctgagaaggttggggcatcatacagtgttggtcgctttagtttcaggagtacagatggtaaaggcggcacaaagaaagagactattgatatcgcaaagcttcaccggatgaaacaagagaaagtttctgcgtggactatgaaggttttagtagatgcaatgacaacttcagggctgtccacaatctctagtgcactagatgaaagtttcgatgaaggagaaaatgaacaaactgataaagagattactaatgagatggaagcaactgctgctgcctattacattttcaggaatgttgctgcccctggttgcacttctgtcattatgaataggtacattgatgaggatgaacttcggaggttcatgattaaggaagaagtgcgaatggtatatcccctactggctgaagcagaaacggggcaaattactagaaagtccttaacagactggttggtatatcaagaacgcagagcattagcacatgccttgagtgacaccaaaacagctgtaaaacaactaaacaagctcgtgacagtactcctagtagtggtgaccataattgtgtggcttctactaatggagattgcgacaacaaaagtacttgtattcctctcatcgcagctagtacttgcagctttcatgtttggaaacacatgcaagaacatatttgaagctatcatctttgtgtttgtaatgcatccatttgatgttggtgatcgatgtgttattgatggtgttgagctattggttgaagaaatgaatatattgacaacagtcttcttgaagcttaacaatgaaaaggagcttgaagatgtaaacaagattaagatgggtcttaatgttacccacacaatgaactttcaagagtttggggagaaaaccaagcgaagaactgaactggtgatggaattaaagaaaatatttgaagagctcaatatcagatacaaccttcttcctcaaggcattcatcttagacatattgaatcaaactcaagtttgctcaatatatga

SEQ ID NO: 76785 - DNA, 600 bp, Glycine max
  Peptide Sequence Number=SeqID_193563
atggctgtgtcctccaccactgccacagtatgtattcctgctaagaacattccaaccactcaagcaccaaaaattggattctcaagtaccatcgcctttgctgcgaaaccgcgaagaagattattacgcatcagaagctcctcagccgaaacatctggcacagaggtagattcagagacttccattgaagttccagaagaaacatcatcactcatttctgctcttaacgtcgaaaagattctccgtggcttaccaattacagatgcagatcattatggtaggctaggtattccaagaggatgtccctttgacttggtggggggtgcatataatatcaaggttcaagaattgaagagtcagaatttagaggaggatgaacttgagaagaaattggaacttctcaaagaatcatacaccatcctgtcatcggaggaagaaagaagaatatatgactggagcttggccagagcagaaaatacagacaaattcgtttggccgttcgaggttgacataacacagtcaaaaatttcaaaagaagatcctccacaactggtaggtggctcttgttcttctatctatcttctagtagttagaaaataa

SEQ ID NO: 76786 - DNA, 304 bp, Glycine max
  Peptide Sequence Number=SeqID_193564
ttctgcaattaatggacagattgagttgggagaaaagatagggcagggaaccacgggcgagattcatagagggacatggcgtggatttgatgtggcgcctcctcatcatgcatgggtagttaccgaggagtggctacatgggccgggcaagaggcccaaaaacagaaccgtgccacttcctcccttcaaagacagtcacatgggccttggaaatagcccaagccatgctgtatctccacgagcaaaaacccaaagtggttcatcgcaatttcaagcccagcaatatcttcttggaaacaggcaa

SEQ ID NO: 76787 - DNA, 937 bp, Glycine max
  Peptide Sequence Number=SeqID_193565
agaactagacgtcctcacgttcagaggactacatgtcctcgcctttagagggcgacacgcccccaccattagagggccgcacgccctcaccttcagaggactgtacgtcctcacctttagagtactgcacgccctcgccttcagaggactacttgtccttgccttcagaggactacttgtcctcgccatcagaggactacacgtcctcaccttcagaggactgcacgtcctcaccttcagaggactagacgccttcaccttcagaggactagaagtcctcgccttcagagggatgcacgccctcggctttagaggactagacgtcctcgccttcagagggctgcacgcctttgccttcagaggactagatgtccttgtctttagaggactagatgtcctcgccttcaaagggctacacgtcttcaccttcagggtgctatacgttctcaccttcagaggactagacgtcctcgccttcagagggctacacgcccttgcctttaaaggactacgcgcccccacctttagagggcttcgcgccctcacctttagaggacttcatgttctcacctttagaggattgcatgtcctcacctttagagggctacatgccctcgccttcagaggactacacgtcctcgccatcagaggacaacacgtcctcgccttcagaggactgcacatcctcaccttcataggactacacgtcctcacctttagagagttgctcgtcctcaccttcagagggctacgcgccctcacctttaaagggctgcacgtgctcgccttaagagggttgcacgccttcaccttcaaagggcgatacgtcctcgacttcagagggctgcacgccttcgcctttagacggctatgcgtcctcactttcaatgggctccacatccgcactttaagagaatttaaggtcctctgcccttaa

SEQ ID NO: 76788 - DNA, 492 bp, Glycine max
  Peptide Sequence Number=SeqID_193566
atgcatcacaagcatagggcaccaattgcagtagaaaacacagcagcactgcaccttttgtacaaaatgttgcattacaaaacacagcagcaagtggagttagttggaccaacaatgctaacaagtcaaatggtgcatggctatttcaagggatttggcatttttcactttgttggcctctattctacacctaagttgtggaggtcaagaccgggttgtctcatcaacgagaactccattagccatcttccagcggtcaatgacatgctctgcatgcaaggggactggagaaatttgaacaacttgcaatacatgttctggggatggtcggggcagaaacatttatcaggctggaggggtaaacaagtgaatgtgcaacgggatgggttgaggttgagtatattttggattctatatccaaatgatgcaaagccccaagctgttcactcaacagaggcaatggagcctcataggggggcacatcaggtttga

SEQ ID NO: 76789 - DNA, 846 bp, Glycine max
  Peptide Sequence Number=SeqID_193567
atgggcttgaaagtagagtctgtggctataaattcctcagcagatcgcttgaaaaagaagtggttaggagtgattgctgcagcaagttggaggactaaggttatgggccgatctgaatctgtcacaaaggtctatgttagaagaaaagtggtgctgcctagtaggggacaggcccaatatcctaagagtccaactgtgaactcagttacgggcttacaatctgtttgcataccttcagatcaagaagaggaactggaaaggcaatatgccctggtaaaagacctgggattgacccatgggggtgctgcttcgaaggtccagcagttcatgaaggacatggacaccagacataacaaaatggcagttgagattcaagagcaagttgatctcatttcaatgatggggaattttgaccaggacaggtggaggtggaacttcaagtggcgaaggaatttgtttgattatgagagtgatcaagctgtgaattttatggacgagatcaattccatacacattcagagatatgttaaagatgtcatgttatggaaagctgaccctagtggggatattgcttgtcctttatgtggtgatgaacaagaggaggtggggcatctatttttcaattgcaagaagatagtagggctatggtgggagtccatgagctggattcaggttatgggacctctcccagcttctccagtggaccattttcttcagttttgtgatggttttggagcagagaaaaatcatagtacttgctgtggatggtgggttgctttgacaagtactatatggaagcataggaacttcctcattttccaggacaaacctttcgagccgcagaag

SEQ ID NO: 76790 - DNA, 2274 bp, Glycine max
  Peptide Sequence Number=SeqID_193568
attggtacgctgggcgcgctgatcggcaccatcaacgtgctggtgctggataacccgatgaagtttgagttcaacgtgtttctcgacaacgcgctcggccagtggattggcagctttgtagcgatgatggtgattttgctgattcgtgacaaatccaaagcccgcaccggacgcaagctgctgaatcgctttatgtatgctgcggtggccgcgctgaccaccaatcaggcgcgccggcgtgagaaccatttaccggcgctttatcagcagctgttcctgctgcttaatctgttcccaggcgatatcgacaagtaccggatcgcgctcacgctgattattggtcatcagcgcctgcgcaacgcggaggtgccggtcaatgccgacctgtcggcgtatcaccgccagctgcgcgccaccgccgaccgcattattgcggccagcagcgatgataaacggcgctactactttgagcgcctgctgcaggagctggacgtttatcagcagaagctgcagcactatgccgccccggccagcgtgacggaaccggtgaaacggctgtcgatgatgctggataagatgctcactgacaggagaataacgatgtccacttccctgcaacaacacgaactgttcaacactggctacttcgcggacggccagtggcacaccgccagcagcacctttgatgtcaccaatccggccaccggcgaggtactggcgcaggtggcgaaagccggcaaggctgaaaccgaacaggcgattgccgccgcacagcgcgcttttccggcgtggcgcgacaaaaccgccaaacagcgcagcgaaatcctttatcgctggtaccagctgatcattgaacacaaaagctggctgggccagctgatgaccgccgagcagggcaaaccgctgcaggaagccgagggtgaagtagagtacgccgccagctttattcaatggtttgccgagcaggcgaagcgcgccaacggcgaaattatcccgccggccaaagccggttcacgcattctggcgacgcgcgagccgattggcgtggtcgcggccatcacgccgtggaatttcccgatggcgatgctgacgcgcaaactcggcccggcgctggcggccggctgcaccggcatcatcaagccggccaataacaccccgctcagcgcctttgcgctggtggcgctggcacaaaaagcgggcgtgccggacggcgtgctgaacgcggtagccggcgacacgcacgccatcagcgacgccattatggcttcccgcgcggtgcgtaaaatctcctttaccggttccaccgcagtggggaaaacgctgatgcggaacgcggccgaaaccatgaagaaagtctcgatggagctgggcggcaacgcgccctatatcgtctttgacgatgccaatatcgacgcggcggtgcagggggctatcgccaataaattccgcaacgccggccaggtgtgcgtcagcgttaaccgcttctatatccacaacgcaatatacgaccgctttgtgcatcagctggctgaggcggtgggcaaactgaaagtgggcaatggcgtggagccgggcgtggtggtcgggccgctgattgagccgtctgcggtggagaaagtggcggagcatgtcaaagatgcgctgagcaaaggtgggaaactgctggtgggcggcgagcgccatccgctgggcggcaacttctggcagccgacggtgattgccgatgcgcatgaagagatgcaactggcgcaggaagagaccttcggtccggtggccgcctgcttccgctttgacgatgaagctgaggtgatcgcgcgcgccaacaataccgaatacggtctggcggcttacttctatacgcagaatctgcagcgcgtgttccgcgtttcggcggcgctggaagccggcatgattgggatcaacgagtgtgcggtctcaaccgagctggcgccgtttggcggcgtgaaagagtccggactgggacgcgaaggatcggatgtcaccatgagaaccgagcgtttcgacttcaatgaaatcgtcgatcaggctcatttctaccgtcagttttgcgaacgtttcgcgctggcggatcgcaccattcacgatctggacgatctgtgggaaatgatcatcggcgagcagatcccgctgccgctggaaattgcgttcatcaatctggggaaagggcagaaacgccgctatggtgcgctgatattgctattcgatgaggcagaagaggagctggaaggccagctccgctttaatgttcagtag

SEQ ID NO: 76791 - DNA, 552 bp, Glycine max
  Peptide Sequence Number=SeqID_193569
atgaaaaccaagttatctattgctgtactgagtctggcttccgttctgtcttttggagccagtgctgctaccctggtaaccaacacccaggctgaaaatctgcagccgctgaatcagaccattagcgtgagcggcgtcgacggcgaccagaccaatatccgtcaggaactgtcccagaaagccgatgctcagggtgccagccattaccgcatcattgagaacaatcaggacaacaccttccacgtgacggctgaactgttgttgattctaatgaggagacgaattatgaaaatcaaaacaaccatcgcaaccgctacgctgctttctctgttcgcttttggcgcttcggctgctcaactggtaacggatgaatccgcgcagaatctgcaatctaccggccagaccattaccgttagcggaacaggcggctcacctatggattaccgcgctcagctttctcagaaagccgatgagcagggtgccagcgcgtataaagtgattgaagcgcgcaccggtgacagctatcacctgactgcagagctgtacaaataa

SEQ ID NO: 76792 - DNA, 228 bp, Glycine max
  Peptide Sequence Number=SeqID_193570
caaggtggcgacaccactccaaagggcacgagatcggatacgtggtggtggtcagaacaatggctagggtttttcttcttggtggtcggaaacgcaatgtcagggtgggcacgacggagtcgtcgctgggatgacttcaggcaacagagcgcatgcgcattagggttttgctatagctttttcgaggacgcgagagtgttcaatcatcgcgaaacaaggagtatttaa

SEQ ID NO: 76793 - DNA, 1383 bp, Glycine max
  Peptide Sequence Number=SeqID_193571
cgggctgaatcatctctatccgaaaagccatcagccgctggcacaggagatcatcgccagcggtggcgcgctggtttcagaactgccgctgtcgatggcgccccatgcgcgtcactgaagagcggctcgctggtgacggcgcgctatgcgctggaacaaaaccgtaacgtgtatgcgctgcctggcgcactgggtaaccctggctgtgaaggcacgcactggctgattcagcagggtgcgctgctggtggcgcatcccaacaatatccttgaggatttgcattctgccctgcattggttgccggccagcatctcagaaacaatatattcacaactcagtgatgatgtgccattgccatttcccagcgtgttggctaacgtaggtgatgaggttacacctgttgacgtcgtcgctgaacgtgccggccaacctgtgccagttatcgcagcgcaattgctggagctggagttagcaggatggatcgcagctgtacccggcggctatgataaattgaccgatgacttaaccgatgccggttttcatcgcgaagatatctataatgcgttgaattggcttgagcggttagcggattatcaggatggcctggtcgcgccagtgttgctggctaacgatccgctctccatgcgaatctacacggaagaagagagccagcgtttagatgccgagtgtcgtggttttattctgttcctggagcaaatccaggtgctgaatatggaaacgcgcgaaatggtcatcgaacgggttatggcgcttgatacgctggaattcgatctggaagatctcaaatgggtggtgctgatggtgctgtttaacatccccgggtgtgaaaatgcctatcagcagatggaagaactgttattcgacgtcaatgaagaattagtgatacgtgccggcaaacacgggccttttctcggctgtgttaattatccaacctgcgactatattcgcccgctgaaaagtcagggtgatggccatattgtcaaagtgctggaaggtcatgcctgcccgcagtgtggtgcggacaaagtgctgcgccaggggcgattcggcatgtttgtcggctgtagccactatccggagtgtgattacacggaaaccatcgataagccggacgaaaccgcaattgcctgcccgcagtgcgccagcggcaagctggtgcagcgccgttcacgctatggcaaaaccttccacgcctgcgatcgttatcccgactgccagttcgcgatcaacgccacgccgctggaaggtgtctgcccccattgccagttcccgttattaattgaaaagaaaaccgcacagggcatgaagcgcttctgcgccagcaaacgctgcggtaagcccatcgcccaggatgaagagtga

SEQ ID NO: 76794 - DNA, 234 bp, Glycine max
  Peptide Sequence Number=SeqID_193572
atgaagaaatattcgccagagccaccaaacacaagcttctgtccatatttgagaaacatggagggttggaagaatatggtatttaagggtgaggaagcgatagacggaggtgtaaacccacgagctttcaaatcaatcatgacgaaagtttggaacgtgaaagagggggtggacataagagatatagcacataacctcttcaccttttggttcatggagaagaaggatatgtag

SEQ ID NO: 76795 - DNA, 360 bp, Glycine max
  Peptide Sequence Number=SeqID_193573
atgttgtcttgtgggggttatgaatttctagaaaacaagttgttagaggagaagaaaaagaaacaacttgcaaaggctgctaaatctggaagcactcacactgtcattgatcctctatctcccatcagacgacacgtgaagtggaagatgaaccgcaccaagaaagctgggcaaatgacttctgagacaattaaagaaattgctgacaagattgatgtactgattgctgccattgggcgaccagaacaccctggtcgtgtgcgtgctgctagagctggtgtcacgatcaagcaatactttgtatcggctctaaggacctcccgcacatcttcatccatggctcccgaagacctagagtag

SEQ ID NO: 76796 - DNA, 565 bp, Glycine max
  Peptide Sequence Number=SeqID_193574
atggataataataacaacaacaacatcaactcctccgtgtttgtttcatacgcatgtcgagatccatttgtcagtccacttctcgataactttaacgaaccggatcctgcacttgtctatttattacccgaaccgaacctacgaaatgatgaacagcagcccctgcagggtcatgtttcctccacggattcaacgatccatgatcaatcccaccattattgcaatgacaattttaccatcggaggaggagtatttcctaactatgaattcgtagaggggtcttccaagaacaagcgtaaatatcccttcacggatacggatattgaagatcaatccttcatgcatgactttgaagcgggtccatccaatctgaatcagccagcaagtgggaatatgggtcctcgtaattggcctcctatgccaaggccattcttttgcacttgctgccaagttctaagacagacaattcacaccaatggtactgattttgagagaatagaaatacatggaaggatcggattgatcaggcacataataattcagaatcagagtattacaccgggtg

SEQ ID NO: 76797 - DNA, 1656 bp, Glycine max
  Peptide Sequence Number=SeqID_193575
atggccgctcagccattccggaaagccatagcgaaaccactttgttcttcatccacagctccaatcccaaacctctctctcgtaacctgcatcaccacaatccttcaaaacataaatccccaaaacccagattactcaccccttagagagttctcatctcacctcaccccaaacttggttatccacgtgatcaagaaccaaaacaacccccagcacgcccttcacttcttcaactgggcctccaaccccaaccccaaccccaacaactactcccacacccccctctgctacaccgccatcaccgacctccttctctcccactccctcttctccaccgccttctccctcctccgccactccaacagactctccgacaacctcgtctgcagattcatcaacgctctcggccaccgcggcgacatcaggggcgccattcactggttccaccaagctaatacctttactagaggacgctgtgttttctcctgcaacgccatattgggcgtcctcgtgagggccaaccgtgtcaacattgccaaggccatctacgatcaggttctcgctgaagctgttttggaaccggatgtttacacctacaccaccatgattcgggggttctgcaaagtgggcaaggtcgagagtgcgcgcaaggtgttcgatgaaatgcgctgcgaacccaatatagttacttacaacacgttgatccacggcttttgtaagaaaggtgacatggatggtgccaggagggtttttgacagaatggtggagagtcagagttgcaagccggatgtcgtgagttttaccactttgattgatgggtattcgaagaggggtggattccaagaggcgctggagtgcttgaaggagatggtggaacgagggtgttccccgaatgctgtgacctacaatgctttggttgaaggtctttgtttgagcggtgaagtggacgaggcccggaagatgatgagtaggatgcggttgaatggtttgaaagacgatgttgccacaaacactagcttgttgaaggggttttgtattgtgggaaagtctgatgaggctgttaagcatttgagggaaatggttagtcgcgggatgaagccggatgtaaaagcgtatggggttgttgtcaatgagtattgcaagattagaaaaccaagtgaagcagtgttgcttctgagggaaatggtggtgaggggtgttaagccaaatgtgtcaagcttcaatgcagtgtttagagttcttgtggatgaggggaagattgatgaaggacttcatcttttgaagcagatgcctaagatgggatgctcgcccaacttcttgtcttattgcacagtgatatgtggtctttgtgaagtgaagggtaggatgcaacaagttgaagagcttgtttcgaacatgcttcagaatggacataacctggatgccactatgtataattgcttacttctgggatattgtgaagacagggatgaagaaatggcacaaaagacggtttatgacataatggacaagaactttgtaatcaaccaagacattttctgcacttttgtgaagctgttgtgtgcaaagggaaaattgaaagaggcagagacagtatctgaggagatgcggaggagatgccagttgaacgggaaagctgaaacagaggaacattaa

SEQ ID NO: 76798 - DNA, 1146 bp, Glycine max
  Peptide Sequence Number=SeqID_193576
atgtacacaacaaagagagaacaacaaaggctcaggttccaaaaccacgctaaaaaaccctccttctcttccattctactcgatcaaatctaccgttccatcgacgagggcaacgacatgaagctctacaacgaaacaatggcgaagcaacagaacagagtcttcgtcgaagaagaagaagaagaagaagagataacggctgccagcattcgccgcgcttgtttgctcgacaaatggaaagaaagcgaaaaggctggaagtcaatggaaaacacaaacggagggaaaatcgcgttggcatcatcatcataatcacgaacatgaccaggaggttatgttcttcagttcaacttcgagttcctcggattctagttctggtttattgtcctcctctgacacggaatccttgtacggaatgaggtcgaaatcacgagtttcgtgctttgcgccgtcgaggccgaagccagtggtgacgtcagcgagcaacgaagtgggtttaataaagtcagaatcgagggcattgaagatttacaacaacctgaagaaggtgaagcagcccatctcaccgggggggggcagcgttaagaaaaccaaaacctacgacgacgacgccaaagcttccaccaagtcgggacaggactccacgtgttcctccgcttcctcgttctcgcggtcttgtttgagcaaggcttcgacttcctctaaggacaaattgcgtgacggggttaagcgaacggtgcgtttctaccccgtgagtgtgatcgtgggcgaggattctcgagcgtgtgggcataagtgtttgtatgaagaggacactcgcgtaacggaagtgtccgtgccaaccgcgtggaaaattgggcgcaagaagaaccaagaagatgaagaattaagggtcgtggataggagtaggcgcgtggaggaggctgctagagagttcttgaaagagtaccatcgaagccagaagaagagcgattttactaatttggatgtggaagatgatggtgatgcatcgagttgttcaagttcggatctgttcgagcttgatcacctagcggtgatgggaaacgataggtatggtgatgagcttcccgtttacgagacaacttatgtttctactaatcgcgccattgctaatggcctcatataa

SEQ ID NO: 76799 - DNA, 663 bp, Glycine max
  Peptide Sequence Number=SeqID_193577
atggagatggaggcaggaggagctcaatctcaacgctacaactacaactacgactacaatccctgctctgttatcaccagtgtgatccagctttgtgatacaaagatggaaaatcttttcctttatggatttcctagggaactgtgggaagtcaatgtgcctccagaccttctagtgccaacattgggtattaactttgacagagacgggaagcaaaataaggactggctatccttggttgctatgcacagtgatgcatggaagcaactgtttgatgtgataaatgatcttccaacaataaatgaggttgttacagggatgaccaagaagcaaggaaaggaaaagtcatcagttcctaatcatagcaaacctaaatcaaactctaagaggggttctaaacctcaagggaagtattcgaaagcgatgcaatcaaaggatgaagatgaagatgatttagaagtggacgatgaagaggagcatggagaaacactttgtgggacatgtggattgaactatgcaggtgaagcttctgagttctcgatttgctgtgacaattgtgacaagtggtttcatggaaaatgtgtgaagattactcctgctagggttgagggtatcaagcggtacaaatgtccatcttggagcagcaagagagctcgaccttga

SEQ ID NO: 76800 - DNA, 675 bp, Glycine max
  Peptide Sequence Number=SeqID_193578
atgagaaatgcgatgtttacttctcaatcttttactttctgtctgcaattgctaattaccttcatttggttttgcgtgtgggggattattatcagtttcaccaacggaagccctgcagaagttaagggtttccttgaagattacattgcacggaaggataaattagggtacattattgcggaagaatctttttctgagttttatgaagccgtctgcacaaaacttgattgggttggaaaacgcactaataacgaagacgatgatttgactccacaaaatgtggaggaagaacctgagcctgagcctgagccgcctaaggaaagaaggcgtaaacgtagtcgcaaagaccagtcagataggataaatagtatgacattggatgatttgagtggcgtgttccacataactatgaaggctgcaaagaatgtattagacatgtctgttactgcaattaagtcaatttgccgcaagtgtcgtttatataaatggccccacagacagttgcaacccctagcgaggaggttgaaagtgctgaaaagagcattggaatcttcacaagatccagtggtaatacaaacaactagcatggaagttcgaagaattaaacaacacatgactcagttgtgtggtggagttaccccaacgggtatagaaattcctgaagttgaagaatag

SEQ ID NO: 76801 - DNA, 249 bp, Glycine max
  Peptide Sequence Number=SeqID_193579
atggctgacatttattttccttttttgcccccactttcccaaattctccctccacccctcaaagaaccccgtggtcgactgaaagtgaaagttgttggtggcttgtttagggagttcatgatttcaattatttttagacaagggcttcttgggtggggagcggtggctaccatcgcaatgtcttcggtggaggaagaaggagatggaaagacggaggaaaaagaaggatattttgcgaaagtgagttaa

SEQ ID NO: 76802 - DNA, 135 bp, Glycine max
  Peptide Sequence Number=SeqID_193580
atggtgagaagggttggcaaattcatgaggaagttcacgctccgtgataatgctaacatggataagaagatatcggttatttctcaggatgggctaagtgaagatggaccgggtttgcaatttagtcaagtgtga

SEQ ID NO: 76803 - DNA, 768 bp, Glycine max
  Peptide Sequence Number=SeqID_193581
atggctaagcttcccaagttgttactacttgttccaatccttactagttgcactcttcaaatatatttcaaggttcttgatgcatgtgcagcaccaggaaacaaaactgttcaccttgctgcccttatgaagagaaaggacatacaagtcctcaatgatgatttcttgaacctaaatcccaaggatccttcatactccaaggtgaaagctattcttttggatccttcctgctctggttctgggactgctgcttcaagactagatcatctactcccatctaaagcagcaggtcaggatgctgatatggaaagattgaacaagcttgcaactttccagagaaaggctcttcagcatgctttactttttccagctgttgaaagaattgtttatagtacatgttcaatcaaccaaattgagaatgaagatgtcatcaaatctgttctgcccatagccgaatcaaatggatttcagttggcaaagccattccctgggtgggaatgccgtggtcttccagtgtttgaaggctctgaatgcttggttcggacagatcctgctaaacatggcgagggtttcttcattgctttgtttactaggaaagatgctaacttttcagggcgatcaaataaaaatgaaactagaatttccgacagcactgccgaaattaaaaacgcgcgaagaaagaagaaacgtgtaccgtttgttagcacaaacccattcaaaacgtggttatatgatagtaaaattgttaagtcttggcggtcgaattga

SEQ ID NO: 76804 - DNA, 789 bp, Glycine max
  Peptide Sequence Number=SeqID_193582
atgaagaagacgaagaagagtggcgaagaaaatgggggcaagctcaagttcaagggcgcggagaggtcagcttacttcgcacgcagagaggcagcgaaggttttgaaagtgattctcgaaggagacgccaaacgccgcgctctagcctccatcaaatccctcatttatcaaccttccgttagaaacaagaaggccacattcgctctcatttgtcaaaccctaaaacatcttcccattatcaaggatgtcttggaagctgcttctattctcaacaccaagtggaagaggcaacgagaattgatttatatcattgtctatgatatccttttaggccaggcggtttcactagttggtgatgctgagaagtaccttatgcgccaccaagatgccctgcgttcaaccctcaaacagcttttgttacagagaaatgtcaagacagttaaacagttgattgctctgcatcaagttcctgatatttctgtacctcgatatgttcgtgtgaatacacttaaactggatgttgattctgccttgcttgaacttcagaaaaaatactcggttcaaaaggataatttactgcctgatttgctgatactcccaccaggaacagatttacatgatcatcctcttgtcaagaatggcagtatctttctgcaagtaggaattatccctcctttatatatttttttcagagacataaggcttgttcggatacaagccaaaagtgcttttgagagcttctttactagaaatttagagttttttccagtagagaagctcctaaactga

SEQ ID NO: 76805 - DNA, 720 bp, Glycine max
  Peptide Sequence Number=SeqID_193583
atgacagataaaaatccaagaccaccagattcacctgacgatgatttcaccaaccaatggcctttggagctctccgagtacttgaattttgatgatgatcaatggccagacgattacccggaatcatttgtttcggggcatgtcttcagccataacaatcaagccaatgaagttggtaactttggaggaagtagcacccactttgaagagtcttctagcagagacgttggcaatgaacgtgagaagaaggaagtcagagatagagttgcattcaaaacaaagtcagaggtagaaatactggacgacgggttcaagtggaggaagtacggaaagaaaatggtgaaaaacagccccaatccaaggaactactataggtgttcagtggacggatgccaggtcaaaaagagagttgaaagagacaaggatgatccaagggctatgaaaatcaaacagaagaaacttgcttgtttcctctccacgacaatggatttcggaagatttactcataaaaatgtattagggattttaggctacgcatctgtggttaagggagaaacagaccacatgatctccaactccattgaacaaataccagggacaaatataaaacagaacaaatctcttgaaaatgtcactgttatgcttgatgaattaggaaaggattatccagccttaaaaaatggaaaaagagattatcctcgctgccacttaaattcttaa

SEQ ID NO: 76806 - DNA, 981 bp, Glycine max
  Peptide Sequence Number=SeqID_193584
atggaggatctcgaggaggaagagaacggagcggaggaggtgttggggtcaagcttgaccatggagaaagtggcggctgcgaagaagttcattgagaatcattatagggctcagatgaagaacatccaagagaggaaggagagtttaactgaaggcatagagtatttgagacacggtaatcaatccatctacatacccggtgtgagactcgatggaaggatgggttttatttggtcgtcacagcgctgggttttagaaagaaaattggcatcatcagatgtgccaaatgaggagcggatcaacctcatcaaagatttagagaggaaggagactgaatatatgcgattgaaaagacacaagatttgtgttaatgattttgaacttttgaccatcattggaaggggggcttttggggaggttagactgtgccgggagaagaaatctggaaatatttatgctatgaaaaagctgaagaaatctgaaatgcttaggagaggccaggtggaacatgttagagctgagaggaatttgctggccgaagttgccagtcattgcattgtgaaactttactactcatttcaggatgctgagtacttgtatttaattatggagtatctgcctgggggtgacgttatgactctgctgatgagggaagacaccttaagtgaaaatgttgctagattttacattgcacaaagtgttctggccatagaatctattcacaaacacaattacattcacagagatattaaacctgataaccttcttctggataaaaatggtcacatgaagctctctgattttggtctctgtaagcctctggattgtattgccttgtctacactgcatgaaaatcagaccatagatgatgaaactttggcagaaccaatggatgttgatgatgcggacaatcgaagtagctggagaagtccacgtgaacagcttcaacattggcagatgaacaggaggaagttggtatga

SEQ ID NO: 76807 - DNA, 1369 bp, Glycine max
  Peptide Sequence Number=SeqID_193585
gtgtcacaatcagaggacaaggcagtgagaagagaaaagaaggaaagggaagggaaggaaggaaggaaggaagaaacgagactctacatggctgtgatatcagtagggtgtgagggtaactttttgtactacatagacaaggattttgatggaggagatgtcaaccacggttacagtgccatggagaggttgttatccaattctataactaaggtttccgatgaaacttttataggttcagatgagaatcatgacagtggttgtcatgaggatgaaattggtattacagcagtcacagctccagaacagcaaagagaaggggaaattccgatgttggatatgatatcccaaaatataagctctctggttgttggtgatgaagttttaaccccagaaattgaggaggatgatttgatatcactggaaggtgatccaattattgatagctcttcactttcagtagccagtgaacatagtagtatttgtggagatgagttcatcagttctgaggtttcttcagatttagggacaacaagttccaaagacataggaaagagcatctccactgtcaaaattgcagccagggctactgatttgagtatgtcaaatgtagaggcagatgtggcagtgagccttgaagagacaggagttagatctggctcaaagcctactacaggtgtttttcaccaactaactctggaaagatctgtgagtggaacagtaggtagaagtgtttttgaattagattgtaccccactatggggatttacatctgtgtgtggaaaaaggcctgagatggaagatgcagttgcaactgttcctcgatttttgaaaattcctattgaaatgctaactggtgataggttacctgatggaataaacaaatgtttcggtcagcagacaatacatttctttggagtctatgatgggcatggtggctctcaggtggcaaagtattgccgtgagcgcatgcatttggccttggctgaggaaatcgaatctgtcaaggaaggtctattagttgaaaataccaagaatgattgtagagatctgtggaaaaacactttcaccaattgttttttgaaggttgatgctgaagttgggggggaagttaatcgtgagcctgttgccccagaaactgttggatccacttctgttgttgctattatctgttcatctcatatcatagtttcaaactgtggtgattcaagagcggttctgtgtcgtggcaaagaacccatggcgctatctgttgatcataaaccaaatcgagatgatgaatatgcaagaattgaggccgctggaggcaaggtgatacaatggaatggtcaccgagtatttggtgttctagcaatgtcaaggtctattg

SEQ ID NO: 76808 - DNA, 189 bp, Glycine max
  Peptide Sequence Number=SeqID_193586
atgggagagaatatgctaactaccaaagatctaagtttcgttggttatacttacaagaatttcgatgctgtaaaggaagggctccgtcaatcttttggtgattccatgcaagagtatgcttctaaacgggcagctgaagaaacaagtttacaaatgcttgcatcctctggagatccaatggttccataa

SEQ ID NO: 76809 - DNA, 426 bp, Glycine max
  Peptide Sequence Number=SeqID_193587
atgtccaaaccgcaagctcagtatataatttacttagaagttcaggatattgtggagcaacaagcagcaggcttgatgaaagaggcagagcggttcctaatcttaagcaatatcgatcgcctgtggaaagaacatctgcaggcactaaaatttgttcagcaagccgtggggttacggggatatgcgcagcgggatcctcttattgagtataaggttgaaggctataaccttttcttggatatgatggcacaaataagaagaaatgtcatgcattctgtgtatcagtttgaacctgtgctggtagagcaagatcaggacaaaacagagaatcggaaatcaggaaaacgtaatgcacgcactcaggttaatccaaaccctgatccagttggcactgtcgagccttcaacgtcaagtactacttcctaa

SEQ ID NO: 76810 - DNA, 2034 bp, Glycine max
  Peptide Sequence Number=SeqID_193588
atgattgcaatccctgatttcgctgctggagccatggagaactatggtttagttacatatcgggagactgctttgctatatgatgaccagcattctgctgctgcaaataaacagagggttgcaactgtagtagctcatgaactagcacaccagtggtttggcaaccttgttacaatggagtggtggacacatttgtggctgaatgaggggtttgcaacatgggtgagctatttagccactgatagctgttttcctgagtggaaaatatggtctcaatttcttcatgaatctactgagggtcttaagctggatggacttgcggagtcccacccaattgaggtagagatcaatcatgcttgtgagattgatgaaatatttgatgcaataagttatagaaaaggtgcatctgtaattaggatgctgcaaagctatcttggtgccgaatgctttcagactgaggatctatgggctgcacttgaggaaggatctggtgaacctgtgaacaagttaatgacctcatggacaaagcagaagggatatcctgttgtatctgttaaagtcaatgatcagaaattggaatttaatcagtcgcaattcttgtcaagcggtgctcaaggagaaggccattggattgttccaataacattatgctttggctcttatgatgtccacaagagtttcctcttgcaatcaaaatctgaaacacatgatgtcaaagatttccttggttccacacacaaaggtttaaattgttggattaaacttaatgtggatcaggctggtttctacagggtgaagtatgatgagctgcttgctgctagacttagatatgcagtagagaaacaactcttatctgcatcagaccgatttggcattttggatgattcatttgcactttgtatggctcgccaggaatcattgacctccttgattaacttgatgggatcttacagggaggaagttgattataccgtgttgtctaacctgataactataagtcttaaagttcaacgtattgcagctgatgcagtaccagacttactagaatatttcaagcagttctttattaacctttttcagtactctgctgagaggcttggttgggagcctaaaccaggagagagtcatgtagatgcaatgttgagaggagaaattttgactgcccttgctatgtttggtcacgatttaacactggatgaagcaagcaagcgttttcaggcattcttagaaaacagaaatacaccacttcttccacctgatataagaaaggcggcatatgtagctgtaatgcaacgggcaagcaaatctaacagatcgggttatgaatcccttttgaaagtatataaggaagctgacctaagtcaggagaaaacgcgtattctgggctctctggcatcttcacgtgatccagatctaattcttgaagctctaaacttcatgttgtcatctgaggatgctgtttttggacttgctgttacccgggaaggacgagatgtagcttgggcatggcttaaggaaaattgggaacacctcataaaaacatatggttcaggatttttgataactcggtttgtcggtgcagttgtctcaccgtttgcttcctttgagaaggccaaggaggtagaggaattctttgctacccacgctatgccatccattgctagaacgttaaggcagagccttgagcgggtcaatatcaatgcaaattgggttcagagtgttcagaacgaaaataggcttggtgatgctatgaaggaattggcatacagagaaaactgggaacacctcaaaaaaacatatggttcaggacttatgataacttggtttgtcagtgcagttgtctcgccgtttgcttcgtttgagaatgccaaggaggtagaggaattctttgctacccacgctatgccctgcattgctagaacgttaaggcagagccttgagcgggttaatatcaatgcaaactgggttcagagtgttcaaaatgaaaatgagcttggtgatgctgtgaaggaattggcatacagaaaatactag

SEQ ID NO: 76811 - DNA, 1431 bp, Glycine max
  Peptide Sequence Number=SeqID_193589
atggagaagacaacattgtttgtgttgttgttgaatgtgcttcttgtgttcagtgcctctcttgtgtccgcagagcaacaaagtcatgcctcagctgtaggggacccaggaatgcaaagagatggtttaagggtggcctttgaagcttggaacttctgcaatgaagttggtcaagaagctcctcacatgggtagtctaagagctgctgattgttttgatctttcaggttctctgactcacaaggtcacacaagctgataacagacttggggtgggggactcatttcctggtataaatccagaaaatatcaacaacacagacctttatgcaattgaaaaggaattgtatttgggttctctatgtgaagttgcagacaccccaaggccttggctgttttggatggtaatgctgaaaaatggaaactatgacaccaggtctgggttatgtcctcaggacgggaaaaaggtacccccttttagcccgggaaggtttccttgttttggacaagggtgcatgaaccaacccatcgtgtgtcatcaatggacacagctcaaagatggctcaatgcaaggggggttcagtggtacttatgatttggattctggttgtggaggtgaacaggatggtgtgtcttactatgaggtagtttgggagaagaaagttaatgttgggagttggatgttcaaacacaaattaaggacttcaaagaagtacccttggttgatgttgtaccttagagctgatgcaaccaaaggattctctggaggttaccattatgacacaaggggaatgctaaaaactgagtccaagtccaaaacttccatttctcttccagaatcaccaaatttcaaaaagttgagcttggacatcaagaaggggggaggtggcaagagccaattctaccctttagacattggaagctgttggaagaacaatggtactccttgtgatggagatgtactgactgatgtcgctagatatagtgagatgatcataaaccctgaaaacccagcttggtgcagccccaaaggcttggctaactgtccaacatttcatatcactccagacaacaaaaaaatcttcagaaatggcacagccaatttcccctactcagcatatcactattactgtgctcctgggaatgctcaacacttggagcaaccagtgagcacttgtgatccttatagtaatcctcaagcacaagagatagttcagttgcttcctcaccctatttggggtcagtatggctatcccaccaaaaaaggtgatggttgggtgggggatgcaaggacttgggagcttgatgttggaaggctatcaagtagactgatccaaggcacttctcctgccaagagaatatggacatctattgattctggtactaagatatttgttagtgacaaagatgaagggttaaataagtggcattaa

SEQ ID NO: 76812 - DNA, 675 bp, Glycine max
  Peptide Sequence Number=SeqID_193590
atgccgagtaggaatagtgccaaaactccaaagaatgatggaaacaactcaaattccagtcttgcttctctagaaaataattgctatgaaggagaacgtctcaccagtctgctccaatcaatccgtagggggatccaatctgctagacatttggatggaagttccttgccagagaagatatggttaaagcaacaattttctattggggtcaacgatgtaactcgtgtccttgagcgcatgaaaccatgcacggagttagaaagctctactgaactcatctctttgagaagcaaccatacagcatcttcagttaagcttcaggttgatttcctctgtttgtctaatgtagaatatgctgtgcttgtagcttctgactgtaacccacgttggctgacgaaacatctcctaagtttggcttcatcaaggaatgtgcccctggtatttgttagagatactaaacaaggttctttgagactaggtgaacttgtgcaattaaaaacggccattgctatcggaattaaggttaaaggaagcaccataaataaaattattcagcaagttattcaaggcgatagatttgaactttcacctgaagggcaaaattcagcaagaatatttgatgcgcaaagtaactttcaggaccctgacaaaaaaatgctatcaaatgtaatttaa

SEQ ID NO: 76813 - DNA, 480 bp, Glycine max
  Peptide Sequence Number=SeqID_193591
atggttgttgctttgtttatgatatttctcttcgttgcattctttctgcctgtagtttggtcatctgtttcatcctgtaggcgtgtacttgtgcacgatgttaggttgcatgtccttgaaaagttgctcctaagacctgtgctacttgcacggtatttgaagccatggattattccagaccccgaggtgacgtttcttcctcgtgcgaaagatgatgaatgcctcattctggccagtgatggcctgtgggatgtcatgaccaacgaagaggtgtgtgacattgctcggcggcgcatacttctctggcacaagaaaaatggcttggcattgccctcagaaaggggagagggaattgatcctgctgcacaagcagctgcagagtacctatcgaaccgtgctcttcagaaaggaagcaaagacaacatcactgtaattgtggtggatttgaaagctcaaagaaaatttaagagcaagacttga

SEQ ID NO: 76814 - DNA, 411 bp, Glycine max
  Peptide Sequence Number=SeqID_193592
atggataagagcttaaaggtagaagaagaaaagaggagggagagggagagaagaagcacgaaatttagtgcctcaagagagatatggttcaacccactaatccaagatcaagtccaagattctccactaagtgtgcttaggtgtcatgaaccatcccatgggctcaaaatctaccctaaggctcatgagaaccctagggtcttctcttacatctctgacccaatctacttggagtcttctatccaatgcccttgcgggaggaaagttgagcctgagaggggtgaagagttcaagaaattgagagggaatcacgcttggggtggggaagggtttgctatcctaaccatcatggcacatgagtcaatcaaaatgaatggtagggtcatcaacattagtcatgcccctcattga

SEQ ID NO: 76815 - DNA, 531 bp, Glycine max
  Peptide Sequence Number=SeqID_193593
atggaggccgtgaaagagaaaatggccacaatgatggaggccatgatgagcatgaagataacagaagtcaatgcggctgtagttgccgccattgctgaggtggacccgactcccctatctagcctcaaccaaataaatcatccaacctcgaatatggtaggtcggggaggcaaagagttgggaagtacgggcggtccctattttgtacaagttcaaaacgagcaccacttcccggcatatggcttgcctccgaactatatgccacccaatgtggcgcacactcccactgagaatgtcaataactccaatcccatactcgttgagagccaacaacctcaatctaatcatgcacatgtctctcaacccatgggggagacacatgaaataccccaccataatctagtcgacttcgagccgagcctcgaatacgccactaagggacaagcaattggtggtgtacccttgccaaacactttggaggaccctcaatttttcccacaacctcaacccttgcattgtgtggcgggatga

SEQ ID NO: 76816 - DNA, 1008 bp, Glycine max
  Peptide Sequence Number=SeqID_193594
atgggaagagctccttgctgtgacaaagctaatgtcaagagaggtccatggtcacctgaagaagacaccagactcaaatcttatattgaagagcatggcactggtggcaactggatagcgttgcctcaaaaattaggcctcaagaggtgtgggaaaagctgtcgtctcaggtggctgaattatcttcgtccaaacatcaaacacggaaatttctcagaagaagaagacaacataatttgcagcctctatgttaccattggaagcaggtggtctattatagcagcgcaattaccagggcgcacggataatgacataaagaactattggaacactaagctaaagaaaaagctactggggaagcaaagaaagctggagcaacaagctcaagctcgcaaagtttttaaccaaaagcaacagatcaagagagagagtgaagatttgatgttacctgttggagttactacccgaactccttattggcctgaacaacaatattcttggcccattccagtggcaaataatgcttccatccaatactccaatctcaacaacaataatcaaacatcatcattcagcaaacacttccccaacaacatagtcactgccaccaccatgaattcacaacactcatcacgtgacatttccttaacacaaaaccagttacatgatttacacccctccacattaatgaacatgataagcacggacacgtgtcacacatcaaacgtatttcaagggtttgtgaacttttccagtgattttccctgtgtgaaccagcaacaaatagatggaacaatgcgagttttttatggattggaaaccatggacatggcaacaaatggtagcacaaacactacttcgacagaaagcactagttggggagacataaactctttggtttactcgcctttgttggtttctgaccacgaagcttgtcaacaaagaataataatgcctcaagatgtcacttttgaggaatctagttgctttgcaatgcaaaggcaataa

SEQ ID NO: 76817 - DNA, 123 bp, Glycine max
  Peptide Sequence Number=SeqID_193595
atggcaagggtcgagtgtcgacgatctaataacggtgttgaaagggcatactccggcattctcaaatatttctttatagttgtgacttctcctgtattagaagataaaatagtctatatatag

SEQ ID NO: 76818 - DNA, 276 bp, Glycine max
  Peptide Sequence Number=SeqID_193596
atgggtttaggaggattgttgatgcagaatggtcaggtagtggcctatgcttctagacaactcaagactaatgagagaaattatcttacccatgatctggagttaactgctgtagttttttctattatgatatggaagaattacctattcggttctaagtttgaagtgtttagcgatcataaaagccttaagtatctgtttagtcagaaaaagcaaaacatgcgtcagaggactatgattttgagcttagttatcatcccagcaaagccaatgtag

SEQ ID NO: 76819 - DNA, 2472 bp, Glycine max
  Peptide Sequence Number=SeqID_193597
atgattcttgagaggcaatccctttctgaaaggcaaaagggtttgcaacaagagcaggaaagattacttcaatcacaatccttgctgaaccagagagaggaacactttttgagtagatctcaggaactgaatcgtcttcaaagagagttggaggacacaaaagggaaaattgaaaaggaacatgaagccctacatgacgagaaaaccaccctaaaactgaaggaggcaaccttaatacaacgagaagaggaacttactaaatggaaatctgagttgagcaagaaagaacaagagttacttgaatttcaagcaaaactttctaatagagaatctgatgaaactcagaaagttgttgctggtcaggaagccgcattgagaaccaaaaaatataacttggaagttgagctacaaatgctgcgcaaattggttgaaaatgaaattgaggaaaagagacgggcttgggagttgaaggaggttgatcttaaacattgtgaggaccaaatcctgcaaaggcagcatgagttggaagttctgtcaaggtcactgagtgagaaggagaaggatctgaaggacttgtcaagtgctcttgaagaaaaagatcaaatgttgagtgcttctgagaagaagtttgagttaaataaagtgcttttgcagaaggaaaaagatgatgttgaacaagcaaaccaagatctgcagaagtcattggcatcattggaagataaaataagacaagttgatattgacaaggagaaactggaggccatgaaaagtgaaacgggtgacatgtcaattttggaagtgaaactaaaggaagagatcgaccttgtaagatctcagaagttggagcttttggctgaggcagataagctgaaaactgagaaggcaaagtttgaagctgattgggagctgcttgatgaaaaaaaagaagagttgcggaaagaagcagaattcatagcaaaggaaagggaagcggtctccacatttattaagaatgagcgtgaccaactaagagaagagaaagaaaatctgcgcaatcagtacaaccaagatttggggtatcttgccagcgaacgagaaaagttcatgaacaagatggcacatgaacatgctgaatggtttggcaagatgcagcaagagcgagcagatttcttgcgggaaatcgagttgcaaaagcaggagctgaataacctcattgagaagagacgtgaagaggtggaaagttctttgaaggaaagagaaaaggcttttgaggaagaaaagaacactgaacttcagtatattaatgctcttaaagagaaagcaacaaaagagttggaacaggtttccttggagatgaaaaggcttcagactgagcgggctgagataaatttggatcgtgaacggagaaatagggaatgggctgaacttactaaatgtattgaggaacttgaggttcaaagggataagctccgaaaacagagagaattgttgcatgctgatagaattgaaatttatgctcagactgaagaattgaaaaaactagaagatttgaaagctgtctctgatgataatgctatcactgaaatgcttaaatctgatatggagtctaaccaaaagaaaatctctgcaaggaagaacttgaagcatcaatctcttacacaaggtggtgataaaatcaacaatgggtttgatactccacttgtgcagaagtcacctgtttctcctcctagccctgttcgattctcatggataaaacgatgcacagagctaattttcagaaattctcctgagaagccacttgagagaaacgaggattctcttatgggttctgatacaggtaatgtttgtaatggaaaacagtactcggaaaatgacgaatctcttggtaatattggcaagggacagcaaataggatttgcttttgaagaaccaaaagtaatagttgaagtaccttctctagatgatgctagaagaagtgagattgaatctgaggctaaagatgtgaatggaaaaagtgctctcctgcttccagatggacatcatgcaggcagacggaaaagagggagggggaacgtgactgataaagttggcgatccacttgtagatgtggggcaaaataagaaatcaagagcagaacaatccaatgaaaaggtccaatcaggtgtgtctaaggtccagcaggtgttaacgtcatcaaatcaaacacaagggaacacggaagaaactcgtgtagtaatggttgataaggttattcatgtatcagaagtgacttccgagaaacttgatgctctccctatcctcagtcaagaaccaagagataatatgcagagtcctacattcggagcagatcaatgtattcttcatggagaaacaattgatcgatcaaattctaaaaccaggcaggaagatattttaccttgtgcttccagtgtattgggaagcacagaagaaatatcaaaaggaaacaatgatcaagtttctgagcactgttag

SEQ ID NO: 76820 - DNA, 312 bp, Glycine max
  Peptide Sequence Number=SeqID_193598
atggcgaagcctaaagtacaactggtagcatgcatctctctcaactacaacctaggagaagccaaactcgaaccaagagaggcaaaaccaaaagtagatcccgctaaagaagatggggagaaaactatattcatgactaatatgactaacggatgctattcaattatgccattcaatcttaagaatgtcaaagcaacttatcagaggctaataaataagatatttatgaaccatcttgggaagaacttagaagtctatgtagatgacatggtggttaaaagcacaagcaccacttctcacgcagaggaataa

SEQ ID NO: 76821 - DNA, 831 bp, Glycine max
  Peptide Sequence Number=SeqID_193599
atgctgaaggtgtcccgcaggcagtactggcggcaccaaggtgtcccgcaggcagtactggcggcaccaccctctctcacctgtgccgcaaacagcattggcggcacccaccctacccaccctctctcacctgtcccgcagatgccatcagcggcacaccctcacccctctctcctactcagcacatgtcccgcaagtgggactagcggtaccctccttaccgccattggcactggcggttcaagcttcccgccagtgttaatggcggcacccacgtcggaaagagaccctgcattgttggcagcatggatgagactcaagtatcctcatgttgctgttggggcacttgcttcttctgctccgattcttcaatttgaagacattgtgccacctgaaactttctatgaccttgtttccaatgcttttaagtcatggaatgagatggcatctgcaggccaaacaaataatgggcttgagcttctgaccaaaactttcaacttatgtcagaaattgaataggactaaagatctgtatgactgggtggaggctgcttatagttatttggcaatggtgaactacccatatcctgctgaattcatgatgactctgcctgaacatcccatcagggagcgcatatatgaaggagtgaatgtctactacaattatactggagaagctaaatgttttgaactggatgatgatccccatggcatgagtggttgggactggcaggcttgcactgaaatgattatgccaatgtctagcagccaggagtccagcatgtttctgccgtatgagtataatacacttctatccaagaggaatgcttaa

SEQ ID NO: 76822 - DNA, 675 bp, Glycine max
  Peptide Sequence Number=SeqID_193600
atgacgactacaacgttgctagtgatcgtgtttccagcattcctgctagtaacatcgtccttgttggtggtgtggcttctgctaatgtcgatgtcactacccttgttggtggtgtcgttgctattgaagccagaaggggggcttcatcctaactccaacgtgcgagagaatcttagggaggatgaggctgagtctccattttcgaaacctcctcccaatgtaattaatttggacttagaggccactgatgtgcacatcatagcgccttgtccttccatttttccttctcctcttccacctagaaaacctatgattatggctaagtttaactacaaatctgtcaaaaaggctcagggcaacaaggttgaaaaagttaaagttgtcgaggctcaagctggaaggccaagggcaagaagcatgcccaagttgaagacaactggggaaagggtggagctggtgttgattgttactccttccactgttgagcatcaccctgcttttctatccatgaaggaaagagaaactaagttaaagaaagttgagacctgggaggagactttgaaggtcaagctggctattgtggaagattcagccaaagctctccaaaaagagattaagtgcctcaacaaggagtttgttctccttaaggtgaatgttgaaaaggttgatgagtaa

SEQ ID NO: 76823 - DNA, 2028 bp, Glycine max
  Peptide Sequence Number=SeqID_193601
atgtggttctacttcctcgttgatggttttgcaagccatcttcaatggtgccttcttctcgacgacgggttcttcttcaatagctctcttcattggcagttctgcaagcactcttgttgccgtcaattctcgtcatcatcggttcccatcattgttgtttcttgtttgtgggaaaagataggagatgggggtggtaataggctgtggagttgtaatttttgtgaaaaagttgtcaaaagttcatactctagggttaaagcacatttgcttagaatttgtggtagtggaattgctacttgtccaaaagttactgatgcatatttggttgatttgaggagggtttgtgaagaggctgaaaacatattaaagtctaagaatgttcctttacctactgacaaaaggactccaacaccaccaacattaccaccaaaaagaagaaaatcaagcaatatagagaatgcatttaatattgaggataggaatcatcttagagcagagatagcaaggatgttttattctgccggcttgtcattccatcttgctagaaatccacattttgttagttcttattcatttactgctaactgtaatctaagtggatttcttcctcctagttataacacattgagaactagtcttttacagcaagagaggtctcatattgaaaggttgcttcaacctatcaaatctttgtggagtttaaaaggagttacattggttgtagatggttggacagatgctcaaagaagacctttgataaaattcatggctatatctgaagaaggacctatgtttttaaaggccattgatgggtccaaggagtacaaggacaaacattacaagtttgacttattaaaggatgtaatcaaggaggtagggccacaaaatgtagtccaagtcataactgataatgctcttgtttgtaaggcagctgggttattgatagaagctgaatttcctcatattttttggatcccttgtgtggttcatactttgaatcttggagaagatgatgtcagaaaagctgcacatgtaaaagagttgattttgaatgatatatggcgggataaagttgattacatcctttctttcatggatcctatatatagcatgattagaatatgtgacaccgatgcttctaatcttcacttagtgtatgaaatgtgggattctatgatagaaaaggtgaagacaaccatctataggcatgatgaactagaaaatgaagtttctagtttctttgaagttattcatgaaatacttaattctagtgataattggcttaatgaggttccaaatagggttcctcctcatagagatgatgaactttctagccaaaggaataaatgtcttaagagatattttccacatgttaatgttaggacaaaagtttatgaagaattctctaaattctcatcttgtgcgggtgactttggttcatttgattcaattgaggatagatgggcattagatccaaaaacttggtgggtgatgcatggatcctctacacctatacttcaaaagcttgctttaaagcttctagtgcagccatgttcttcctcatgctatgagaggaattggagtacatactcctttattcattctttgaagagaaacaaaatggatccaaagagggttgaagatttggtttttgtgcactctaatcttaggcttttgtctagaaaagaggaagggtataaaaaaggagagacaagattgtgggacattaatggagatgcgcatgatccccttgatgatagtgctggagttcttgaaatgacaaatttatctcttgatgagccagatttagaagctatgcttttcttagatgatggcaatggaggagaagaaaatgaaacaattagagaagacgcccttaatggagcctgtcctacagaagagaagagtgattgcttggaagcaggagatgaaaccaacatagcattggatcctttattcatgtttgttttccatttgggtgttaatggtgcagctattgctcatgttataaatcttaggttttcttga

SEQ ID NO: 76824 - DNA, 454 bp, Glycine max
  Peptide Sequence Number=SeqID_193602
atggctttcgcttcaagctctggtggcattgtttgtgctcgtgcgcttagcgcaattctgaaccgcttagagcacattagtgaatttcggcttaacgcgttcttttctcgctcaacggatggactgaagcgacatgcctttgtaaaatggtggtcacaattcgatacctcaaaggctgctccagaacaagtcaagaactggtttcagagcaaccctgagtttctcaagcctgctgatccagagacatctttgtttctgaatcaaaagtctcaacttgcagcgttcttagcaagctcaaaatctaaagagagtcttgctcagaatcttaaggaagttctccaactacttcaacaggaagaagaagaagaactccccaagaaagaagccgaatcatccgagaataatgatgaccaggaagatgatccattctaccagaatgaagatgactgctttg

SEQ ID NO: 76825 - DNA, 306 bp, Glycine max
  Peptide Sequence Number=SeqID_193603
aataaatgttggtggcgactccgcgcgccttcctcccttggaagacacactcatgagccccgcgtcgccctcccgctgaagggtaggttgcgacaaaagaaaagtgagaaagatggaaaatggtggaatggtatcaagctgtctctagagtatctcccatttgatttaatgataaaatttgcacaatttcaggtcaaaagaggctataatcttgaagtgctaaagggagcagttgcgcttagctcaccatttgggctcaacacgcatccaacgctaagcacagcttcagcgtgcttagcgcgatag

SEQ ID NO: 76826 - DNA, 327 bp, Glycine max
  Peptide Sequence Number=SeqID_193604
ccgaacgaccgagcgcagcgagtcagtgagcgaggaagcggaagagcgcccaatacgcaaaccgcctctccccgcgcgttggccgattcattaatgcagctggcacgacaggctcatgatcatggagaggctacgcatgtgcctaggtcctatgatgttcacactcatcctcgaactgtgctatctcctccactgacaacactacatttgtaccccaagaggatatgtctccttttcatctgcgtaagtgcctcgggtccttcttgccttaactttgtgccaacattatatgcttatttgaattgctcctcatcaccatatatctaa

SEQ ID NO: 76827 - DNA, 288 bp, Glycine max
  Peptide Sequence Number=SeqID_193605
atgaatgacttagtttatgtcatgtacaacttgaagctcaaaaacaatctccaagttgagcaagagcaacctttaggggaaagtggtagcggaagtaatattgatttggttggaggaaatttaaccgatccaactttggatgcatttgatattgacaatttggtattgaatgacaacgtgaaagatcacttctcaattgagaaagagcttgaagatgatggagatgcagatgatggtggtggtggtgatattggagatgattttattagaggattgatgaacatttga

SEQ ID NO: 76828 - DNA, 1406 bp, Glycine max
  Peptide Sequence Number=SeqID_193606
ccaagggcaaacccaatccaataaacaacactgttcagagacccgtgagtcttcgtcagttccaattcgttaccgcgaaaatgaacgaacccacgagaaaataccgcaagaagaacgaagaaggatcaagatcaacccagaagaataacaagaagaaagaactaaagagcatcctcacttcgctcttgttcgtggatgcaggagagaaaaatgaagaacaacacaagaaaaaggaggacttgatggacggttactacagcgaggtggaagaatccaattacccgaaaaagagaaagaaactcgccggcggtgactcggggagtctccggcgagtctgggtgaaggaacgttccggagcgtggtgggaggagtgtaacaaacccgaatttccggaacaagaattcaaaaaagccttcagaatgcgaaggctcacttttgaagcaatttgcgaggagctgaattcggtgattgcgaaggaagacacgactttgagaagcgccattccggtgaagcaaagggtggcggtttgcttgtggcggttggccaccggcgaccctctgagcgtggtttccagaagattcggtttggggatatccacttgccacaaactggttctagaggtctgcactgccataaagacagtgcttatgccaaagtacttgcaatggcctaatgtcgttgccttacgggacatcaagggtgagtttgagaacatttctgggattcccaacgttgtagggtccatgctcacttcgcatgttcccatcatagctcctaagatgaacgtttctgcttacttcaacaagaggcagactgagaggaaccacaagacttcgtattccgttactgttcaaggtgttgttgaccatagaggggttttcactgatgtgtgcattgggtggcctggttcaatgggtgatgatcaggttttggaaaagtcagcgctttttcatagggctaataatgcggggcttaatctaagtggggtttgggttgttgggggttgtgggtatcctttgttggattgggttttggtgccttatactcagcagaacctcacttggacgcagcatgctttcaatgagaagattggagaggttcggagggttgctaagggtgcgtttgggaggttgaaaggaaggtgggggtgcttgcagaagaggactgaggtgaagctccaagatttgccttttgtgcttggggcttgttgtgtgttgcataatatatgtgagttgaagaatgaggaaatggatcctgagttgttggagaatattgatgatgatggtgattatgctgaggtgatggagccagaggttgccttcagatctgttagctccttgaaggctagggatgcaattgcgcataacctcttgcaccatggactagctggcacttcttttgtttga

SEQ ID NO: 76829 - DNA, 1833 bp, Glycine max
  Peptide Sequence Number=SeqID_193607
atggctaaattaaacaaaaacgaacgaacggtggaggaagagagatgggaaaggttagttccggttccatcttcagaggagcgagcgagagcgagagcgagagcgaggcttttgttctccctcctttccttgttcctcttccgtcctccttcgtttctggtggacgtggaccccacaccggcggcggcactcccacatgtcaccaatgtgtttccacccgacgaagaggatgtagccaatattttcaataccttgcgtggaatgtgtacccgcaaagctgtcaagatgaaagaagccgtaatcgatgatagtgatgttgtgagaggacttttagagtatgcaaacaggaatgccatacatagtatcgtggatataccaacagccatgatcaaatcagccccagattactgctctgtgtacataatttccaaattgaagattgtgtcagctcgatcagcggtacggtcaatgtcaaaaggttttatggcaccgaaacaacttcctgtgcaggcatgcccacctagtgaaccagaaggtggatcagtaaggggacaaccaccaagaagtaggagcacttacgaaggaccagtagaaccaatgagaatacaggcacgtgagaggccaaggagtgcgggtagtatgtcaatagacattaacattgatgtacacactcatccacgacattggtcaatggatgaaagagaaattgcagggcttgtgacaatggatgtgactaagcaagattctattcctgatgtatcagattccttcgggacatcaggtcctcagtcctcagtaagtgtaacagaaaagaaagagcttgaagccgagatgaaaagattgaggcttgaactgaagcaaactatggacatgtacagctcagcttgcaagcaagcaatctcagccaaaaatcaggcagaacaaattcgtcaatggaaaatggaagaggaccgtaaggttgaggtagttaggttgtctcaagaggcagctcttgcactggcagaaagggagaagattagagccaaagctgcattggaagcagctgaggaggccaggaggagggcagaacaggatgcacagagaagaaaggatgcagagatgaaagccaggttagaggcagaagagaaggaacgtgcattatctgcgttggctcataacgataaccggtatagaaaatacactatagtggagattgaagcagccacagaaaagttctacccattaaacaaaattggtgaaggtggatatggacctgtgtataaaggccaccttgatcacaccccagttgcaatcaaaattttaaggcctgatgctgttcatggcatgaagcagttccaacaagaggtactaagctgcattagacatccgcatatggtcctcctcctcggtgcatgtcctgagcatgggtgcttggtgtatgaatacatggataatggaagcttagaagatagattataccgaaaaaataacagcaggccaatttcatggaggaaacggttccaaatagctgctgagattgcaactgcactcctcttcttacaccaaaacaagccagagcctattgtgcacagagaccttaaaccatcaaacattctcttggacaggaattacgtgagtaaaatcagtgacgttggtctggcacggttagtccccgcttctgtagctgatactatgacacaatattacatgacttccgctgctggaaccttttgttacattgatcctgagtatcaacaaacgggaatactaacaacaaagtcagatgtatattctctggggataatgctactgcagataatcacagccaagcctcccatgggacttgctcacata

SEQ ID NO: 76830 - DNA, 523 bp, Glycine max
  Peptide Sequence Number=SeqID_193608
atggatccaaccatcgatttagatgaagttttagatcaaatgatagatgaggaattagaagataatagcgatgaagaaatcattaggttgatacttgagagccaacaacaactacatggcaacaccactagccgtagccaaagaagaagagtggtacatcgtaatcgtgaagaaggtcatcatcgattgttcaatgactatttttcagaaaatcctgtgtacacagagattcaatttcggagaagcaaccatgatgaatactttcaaatgagggtcgatgcactacgtcgaaaaggcttatctccattgcagaagtgcacaactactattcatatattggcttatggatcacctgctgacagtgtcgatgaatacgttcgaattggtgaaaccactgcagtggaatgcttggagcgatttgtattaggcatctgcaccatatttgggaatgaatacttgaggagaccaaataatgaagacatcaaacgcctactacaaatgggagcagcacatggatttccag

SEQ ID NO: 76831 - DNA, 231 bp, Glycine max
  Peptide Sequence Number=SeqID_193609
atggagacgagagatgcgaccatggccggagacacaaccatggccggagacgagaccatttttggagacccgaccatgtgcttcattgttgatgccagcaaagtgaaggtgagaccacgggaaggtgttgcggtggtggccggaggtgttgacgaatgtggccatggaggagaggaagaagatagagaggaggagagggggaagcttctggaggtgttgttggagagataa

SEQ ID NO: 76832 - DNA, 672 bp, Glycine max
  Peptide Sequence Number=SeqID_193610
atggttgaatgtatcaaaggattcaattataggagtcgaccaaacatcaaagaatattgggcaaggataaaaaatgcgtacaataatgacgatgtgcatcaaagtggacaattttgtgaaagaagctggactcaattaaaatctcggtggaacaggatccatcctcccgttcaaaagtttaatgggtgctacaaacaagcagataaacataggagaagtgaaagttcagagaaggatattttggctgatgctcatatgatttactcacaagatacagaatttatgtcaaagtgttcaaaaagaacaaaggtttctacttctggaaattacttgttgtcttctaacctagagacacccattgaagtcgaagaatatgatacgccatcaccaatgtctcgcccaattggacaaaaagcaacaaaaaggaaaagcaaagggaaagaatgtcctaacactctcgatttatctggcatagaaagtgtaatgaaggacaaaaatatgaacacatcaaaacttattcaattaaaggaggcacaggaaaagcgtctgcaagaacatgaacgacgtatggagtatgaaatcctcatgaaggatacttccaacatgtctgaacaacaacgcaaagaccacgaaaagtattgtgaccatattaggaaaaaactaggatattaa

SEQ ID NO: 76833 - DNA, 303 bp, Glycine max
  Peptide Sequence Number=SeqID_193611
atggagcccatggacattgttaggaaggccaaggaagacgcttctcttcctaaagttttttctcctactttcgcagcagaagacatgcttcataggttaagcagatgctgcttttgcatcgttactccacgcccttggcttttcatgggcttgggcaaccctagcgacaagtttaaaggaaccaaacacaatgttggctttgagatgattgatgcatttgcgaagtcacaggggattcctatggacactgtccacttcaaagctatttttggaaaaggttttgttggtgaatctcagtggtga

SEQ ID NO: 76834 - DNA, 213 bp, Glycine max
  Peptide Sequence Number=SeqID_193612
atggcaaaagagggacccgctgaggaagaggaacccgccgcagtcatcggtggcgtagcactcgtgcttgttgatgtcgaaggtgcaaccgtggtggccccagaagcacccggattagagggcgaccttgaagcctccgcgggccagaacgggctttcctacactaggctggatcccaggccacactggataggggcacttgttctagaatag

SEQ ID NO: 76835 - DNA, 1053 bp, Glycine max
  Peptide Sequence Number=SeqID_193613
atggctgctgcaggtccagaaaacgtccctcctttcatcgccgctcagcttagccacctcctctcccacttcggtcttacagtcaaggcaataatcaatcaaatcaattctctctctttccatttccacccccattcctattccccaaacactaacactttcttttctttctcaggggatgttatatacgacgcggaatctccgaacaccgcccccgacgttatctttagccccgaagacgacgatttccacccctttcacatgtttccttcctcctcggaacccgctaataactgtttgtctgattggaactacaaagaccccacgcgtctcttaaccctaattcagtacttgagggatcaatatgtgctttatcagaggaagcgcgtcggagaagttgacgacgaccggttgacattcgaaatcagtactatcttgtccagggagggaatagaaatgcatatgagttctggtgctgagaagtcagaggaggttaaatttgctgtgcccctactggacatgaatataaacaagatggtggcttgctgtccctggagatattcccagaggatatacttacaggttgtatatcctgttggaagaaaatatatgtcagtgccttcagctcctcgcctgaagttagtatcttctcctgagctgaaagctgtattttccattgatgatgtcaagctacctccttggttggacgggatgtgcttggcagaatatcttccaaatctagaagaatatcttgggaaacaggtcttagaggctgtttcattaattgaagttagaaggcacttcattgaagcattatccagtccgttaggaaggccagttgaagctgatgctgtatcttcccgtgacacttattctcaaattgctagggtcttttgcaggaaggcaacttttcttgctgcatctggtgttttctcattcctgttaatgacattggtaacagtaacatgtgaccagggtagggcagaaatctattgttggtatctttcttttgatttgacgggagtctcatgtctggccaaaagagaaaattga

SEQ ID NO: 76836 - DNA, 487 bp, Glycine max
  Peptide Sequence Number=SeqID_193614
atggaggcaacaaaagagaagatgtgtgttgtggaagctgcgaagaagcgtggtgcattgctgatgggaacgaggtcatgcggttttattgcttgggttttgccaacaatgggccctacgaaggtggtggctatgcatgatatgttcaagtcggtgtttttgttttctcgattttgtggtttgatgttcaaattgggattctattttcttggtggcacaatggtgggatatgtgaaagatgaaggtgttactggcgagaagcccctccgtgcaacacgtggcgaaaacgccactgccactgacggaatagccagtggtctcgttgcttgtgctggcgatatagccgtgcactggattcaaacagactacatccagtgcatggctatatcgccagcacaagcagcaagaccacttggctattccgccagtgacaatagcatttttgccacgtgttgcacgcaggggcttcttgccagtaacactggcg

SEQ ID NO: 76837 - DNA, 3222 bp, Glycine max
  Peptide Sequence Number=SeqID_193615
atggagtcagaaggagaagctggggcaaagccaatgaaaacattgggtggcaaaatctgccagatctgtggtgataatattgggaacaatgcgaatggcgatcctttcattgcctgcgatgtttgcgctttccctgtctgcagggcgtgctatgaatatgaaaggaaggatggaaatcagtcttgccctcagtgcaagacccggtacaagaggcacaaaggaagtcctgcaattcttggagaccgagaagaggatgggggtgctgatgatggtgccagtgacttcaattacaattcagagaatcagaatgaaaagcagaagattgagcatatgttgggctggcaaatggcatatgggcgtgcagaggaggccattgctccgaattatgataaggaagtttctcacaatcacattcctctgctctccggtggacaagaggtttctggagaattatctgctgcctcacctgagaggctgtcaatggcatccccaggtggccgagggaagcgtgcccataatcttcaatattcgtctgaccttaatcattcaccaaatatcagggttggggatcctggattgggcaatgtggcatggaaagaaagagttgatggctggaaaatgaagcaagataagaatgttgctccaatgagcacgggccaagctacttctgaaagaggagctggagatattgatgctagtactgatgtgcttgtggacgattccttgttgaatgatgaggctcggcaacccctctctaggaaggtttctattccatcatctaggatcaatccataccgtatggtcattgctctgcggttggttatcctatgcatttttctgcattatcgaataacaaatcctgtgcccaatgcatatgcattgtggttgatatcagttatatgtgagatttggtttgccatatcttggatattggatcaattccccaagtggctccctgtgaaccgtgaaacatatcttgacagacttgcactaagatatgatcgggaaggggaaccatcacagctagcagctgttgacatttttgtcagtactgttgatccattaaaagaacccccgcttgtgactgctaacactgtcctatctattctttctgttgactacccagtggataaggtctcctgttatgtctctgatgatggtgctgctatgttgacatttgaagctctggctgagacatcagaatttgctaggaaatgggttcctttcagcaagaaatataatatcgaacctcgggcacctgagtggtattttgcacagaagattgactacttgaaagataaggttcaaccatcatttgtcaaagatcgtagagcaatgaagagagaatatgaagaatttaaaattcgcatcaatggacttgttgcaaaggcacaaaagattcctgaagaaggatgggtgatgcaagatggtacgccatggcctggaaacaacactagagaccatccaggaatgattcaggttttcttgggccaaagtggaggacttgacactgagggtaatgaacttccacgtttagtctatgtttctcgtgaaaagcgtccagggttccaacatcacaagaaggctggtgccatgaatgcacttgttcgagtgtcagcagtccttactaatggacctttcttattgaatcttgattgtgatcactacataaacaacagtaaagccttgagggaagctatgtgctttatgatggatcccaaccttgggaaaaatgtttgctatgtccagtttccacagaggtttgatggtattgataggaatgatcgatatgccaatcgcaatactgttttctttgatataaacttgagaggtttggatggcattcaaggtcctgtttatgtgggtactggatgtgtctttaatagaacagctttgtatggctacgaacctcctattaaacccaagcataaaaagcctgggtttctttcttcactctgtggtggtaaccgaaagaagagatcaaaatctagcaagaaaggctcagacaagaaaaaatctagcaagaatgttgacccaactgtgcccatctttagtcttgaggatatagaagagggggtggaaggtgctggatttgatgatgagaaatcactacttatgtcacaaatgagcctcgagaaaaggtttggtcagtctgctgtctttgttgcctctacactcatggagaatggtggcgttcctcagtctgcaactccagaaactcttcttaaggaagctattcatgttatcagttgtggttacgaggataaatcagaatggggaagtgagataggatggatctatggttctgtcacagaagatattcttactggattcaagatgcatgcccgaggttggaggtctatttactgcatgcccaagctcccagcgtttaaaggttctgctcctatcaatctttcagatcgtctgaaccaagtgcttcgatgggctttaggttcggtggaaattctttttagtcgacattgtcccatctggtatggttatagtggaaggctaaagtggctcgagaggttcgcatatgtgaacaccacaatctatccagtcacttccattccccttctcatgtattgtaccttacctgctgtctgtctcctgactaacaagttcattattccacagattagtaacattgcaagtatatggtttatctctctctttctttccatctttgccacgggtatccttgagatgaggtggagtggtgttggaattgatgagtggtggagaaatgaacaattttgggttatcggtggtgtctcggcccatctttttgccgtgttccaaggtttactcaaagtgcttgctggaattgacactaacttcactgttacctcaaaagcatcagatgaggatggagactttgcagaactctacatgttcaaatggacaacccttctcatcccacccacgacgcttctcatcataaacctggtgggggttgttgcaggcatctcctatgccatcaacagtggctaccaatcatggggtcccctctttggtaagcttttctttgcattttgggtgatcatccatctctaccctttcctcaaaggtctcatgggtcgccagaacagaacaccaaccattgtggtggtctggtccattcttcttgcatctatcttctctctgttgtgggtccgaattgacccgtttacgacaagagtcactggtcctgatgttgagcagtgtggaatcaactgctag

SEQ ID NO: 76838 - DNA, 324 bp, Glycine max
  Peptide Sequence Number=SeqID_193616
atggtgccagtgaagctggcgatacagctgagtagctgttggcattggcgatttggacgtgtttcgccattggcattggttaaacacgtgacgtggagtcgtggagaaacttttcagaaagggcttgcaagtgggagtggtggaataaccttctcccctataaaacacccttatacgaatgaatggaaacaagctgcggaccctggtgaattttgcttgctgcttgctacgctttggcttggtggttgttaccttatgctggtggccaaaagcttgaagtgggttctcctcttgctttctcaaattttgtattttgtattataa

SEQ ID NO: 76839 - DNA, 219 bp, Glycine max
  Peptide Sequence Number=SeqID_193617
atggaagttctacactttcttcaactcacgaattctcccatgtcgcttcttgccccccaagtccccaatctatctggtgttgggttggctttggtgtcaccaccttcttgtgtagttgaagaacaagaagtgggcatcatatgttgcatggagaagacccttattcgaggagaggaagtgggtgatgctcgagagcttgctcaaccatctaggtgttga

SEQ ID NO: 76840 - DNA, 804 bp, Glycine max
  Peptide Sequence Number=SeqID_193618
atgaggcaagaaggacacatggatgaagagactatctctccaagggttactctaaaggatcatgctacatggattgaacctttgcacttcaacacaattgcaaggccaacattcaccaatgtggtgaaacttgagatgaagctagcattgatacatctcattcaaaataatcaattccacaggcatagtcatgagaatccatatgcacattcgtcaactttgattgacatatgcatcaccgtgaaaataaatcatgtattagatgaggctttgtgcttatgcttactccctttttctctagctggagataccatttcatggttaggatcctttcctccaaatagcttgtcgatgccgcccaatatagtagcaaagtttctacataaatacttcacaaggtcaaagaagcatgagaaatatttagagacttgttcagggggattgagggctcaaagcaagcttatgctagatgccttgactggtgtgaaaatatcctcaaagactcaaagagaagctataaagatcattaagaacatggttgtcaatgctaatgaatttcaaaataatagagtcatggttccatcaaagaaactactggaagtcaatacccaagatggtcttttggcccaacaaaagtttctcactaggaaaattgaagagcttacacaacaaatcacttatcttcctcagcatttcaagcttcaaataattgcctctactcctaaattcaaatgttttatttatgaatcttgtggaggaggccatgcaacaattgaatgtgctaagattcatgaggaagtttag

SEQ ID NO: 76841 - DNA, 333 bp, Glycine max
  Peptide Sequence Number=SeqID_193619
atggacaaagaaatcaaaggaggaaggagagatgagctcaccaatccaaaaatcaaccataaagttctaagagtagagattaagtctcctaagggtaggaactcaaaacccactaaacatccaacaacacaaccaaatccccttatcttattaattagctcattaaataatgtaattaaaattgagtttaatcatacaattaggaaaaactacgatgttacaataggtagagcagaggccaagggaatcatggatgttgtgagggtgatgattcagggtgttgaatgccttaccaggtttataagaaccactagatgggtccttattccttaa

SEQ ID NO: 76842 - DNA, 162 bp, Glycine max
  Peptide Sequence Number=SeqID_193620
atggggagaagaaaaaaagaaaagaacccaaaggattggcgtaatggtttaaggctccgttgtgttcacatgaatgagaatgatctatttagcaagagaactcatgttcgattttcaccgtgttcaaaattcccttgggctagcagcaatcatgcatcatga

SEQ ID NO: 76843 - DNA, 414 bp, Glycine max
  Peptide Sequence Number=SeqID_193621
atggataaaatcgaaataaagcacgctctaccggcattaaaatgcataatgcacatgctgcaacagattaccccaatacctaatgtgggtgggtccacttccccatgtcctcgtcctcgtcctcgtcctcatcctcatcctgagaatttcaccaattcacagtacatggtcttgtattttactctgtcctgtggaaaaaaaagaaaacactcgcaatgtgatgaggacatgaccaaaagcaagggcaaggattcacttgaaggacttggagggcctatgacaagggctagagcaaggaaagccaaggaagctcttcaacaagtattgtccatactatttgaatacaagcccaagtttcaaggagaaaagtccaaggttgtgagttgtatcatggcccaaatggaggaggactaa

SEQ ID NO: 76844 - DNA, 2187 bp, Glycine max
  Peptide Sequence Number=SeqID_193622
atgtgcggtggtccagagaaatcaaaatctctttcaacttcatcttcatcagcggtagaaggttcatctaacagcaaagacatgaaaaatttaacagttcatactgaagattctttttcctgcttacttgagcttgcttctaacaatgattttgaagatttaaagctagctttagatagggatgcttctctaataaatgaagttggcctctggtatgtccgccagattggatccaaacaaattgttcttcagccccgaactcctttgatggttgctgctatgtatgggagtatagatgttctaaaacttttactctcttgtccagaggctgatgtcaatttctcttgcgggacagataaaagcactgccctacactgtgctgcattgggtggttctgttaatgcagtcgatgttgtcaaattgctcttatcagctggtgctgatgtcagttgtgttgatgctaatggaaatcgtcctgttgatgttcttgttgttcctcctaagcttgaaggtctgaaagcaactcttgaagatctactttcagatagtacttccgttgggtctgttggtgactgttttattccagtatcagtgaattcatcatgttctgattcagctgctcatttatcatcacctgaaaatgggttgccattctcagctatggcatcaaagtttgctgatacagctgttaattctgcttctgagaagaaagaatatccaattgatccatcactgcctgatataaagaacagcatttatgcgacagatgagtttcgcatgttttcatttaaggtgcgaccttgttcccgggcatactctcatgattggactgagtgtccttttgttcatcctggagagaatgctcgtaggagagacccccgaaagttccattacagctgtgtgccttgccctgattttagaaagggtgcttgtagacgtggggacatgtgtgaatatgctcatggagtatttgagtgctggctacaccctgcccaatatcggacaaggctgtgcaaagatggtactagttgcaacagaagggtatgcttttttgctcacacagcagaagagctgcgtccattatacgtgtccaccggatctgctgttccctcgcctcgctcatctgcctctactccaaatgtcatggacatggctgctgcaatgagcctctttcctggttcaccgtcatcaatttcttccatgtctccatctccctttgcgcagccaatgtctccatctacaagtggcatttctcactcatctaatgcttggccgcagccaaatgttccagctcttcatttaccaggaagcaatattcaaactagccgattgagatcttctcttagtgctcgtgacatgccaccagaagactttgatgtgttgcaagattttgatggccagcaacaccttttgagtgacttgggctgtttctcgcagccccgtcctggcgccatttcagtgagtcgatctggtcggtctaagacactaaccccatcaaatctggatgaactattctctgccgagatttcttcatctccccggtattctgacccagcagtggcttctgtattttccccaagacacaaatcaactattatgaatcagtttcaacagcttcaaagttcgttatcacccataaacacaagtgtctcctctcctaggaatgttgagcatcctctattacaggcttcatttggtgtctcttctcctggaaggatgtcaccaagaagtatggagccaatctctccaatgagctctcgattatcagcatttgcacagcgtgagaaacagcaccaacagctgcgaagccttagttcaagggaccttggtgccaatgttcctgcctcaatggttgggtccccagttaactcctggtctaattggggttctcctcatgggaatggaaaagtagattggtcagtaaatggaaatgagttaggtcgattgcagagatcatcatcatttgagcttggaaacaatggggaggagcctgatctatcctgggttcaatcccttgtcaaggaatctccgtccgagataaaagagaagttgacaggttctggccctgttgcatctgttgatggaccgagttcaaatccaaagtcaaatccgcaagttgagtctgttgatcattctgttctaggagcctggcttgagcaaatgcagctggatcagcttgtagtctaa

SEQ ID NO: 76845 - DNA, 390 bp, Glycine max
  Peptide Sequence Number=SeqID_193623
atgaaagttggacttcagcctaagaagcgccctgtgttgaaggaaaaatgcttgcctccccctatcacgcttcctggatacacatgggttgatgctgaggtaggtacgtacttctttagatacatctacgagtcagatctactcaatcttttgagttggttgtcgattagtgcaataatgaaactagaatattgtctggttactctttgtacaattcggtcagatgccactcctcacctggagtttgtatatatgaaccgagaggggatgaacatggacctcttttacatggcattggatagaaggctccaagaagattgggccaaaaatgcaagagaaggccctagggttctcatgagccttagggtagatttcgggcccatgggctaa

SEQ ID NO: 76846 - DNA, 2514 bp, Glycine max
  Peptide Sequence Number=SeqID_193624
atgggcgaaaaaggttgtccagtgttgaaagaggttgtcccatgtcgagggagcctgtgtgatgtctggggtagtagtcttgacaagcagagggtgactagtttgtcaagcccccaagtatggatgagtattgtcctatgtcagatgtctgtcatggacatgtctttggcgtgtcaagtaagcatgtgtaacacgtgcaacactcttgcatacgtgtcactcacggagtgggcatgtactggagtggtggatctttccctttcttcttccactaacttccaaaaggtgcttccttccaccagaatgtcttcttttctgtttgattttgccattggtctgggtggcagtgactctgggggctcgattgagcaacccaccatggatcgggaggtcatctcgataggcggttcctcgtctgaggatactcaccgaggtgcctccgatagtgagtcctcctcttctgagagggaaagggcttcatgtcgaataggtgggggtgtttctcgccctcgcggaggggcatggtatttcgttgcttccagggagcttgtcccagtcacggtgatccttcccccttttgctttcgggggtacgaggagaggtagtggcggtggagatgtaaaggtgtctcctcatgtgcatcatagcctaagtgttaggccaccgtcatccaccttggccgttgctggctatgagtgggtgaagttggcgaaccctgaaggctcctgtaagctggccgttcgagcttgcgagagtgatgacttcttgttttttagggtggtgcctggttgttcgtctttcttctttatgtacaaatgtctgtttgagttcctgggtgtcattctacccttgaccatttttcagtgtgctctattggagcacttgaatgtggcctcttcccaacttcacccaaatagttgggcaatggtgagggcttttgaagttttgtgtcctttcttcaacatctggcctagtgtgttgatcttcttgtttttcttcaaaatgaaattgtctggcgaaattggatgggtctccttgaacaatgtgtccaagaagctgttcgagtttgactcaaacattttcggccattttaaggatcatttattcaaggtcctagctactgatgtcgtggctgatggcacgccactgatgcttaacagggatggggagctccacttcctgttctactgggtcgacaaagtaattttggagcagttgtcggcctcactggatgcacgggccattttgtatcatccttcggtgagtgatcatgtcactgcctttgatggcattatgggtgacttcgcctggaggccactcgtgaagcaggttggacttgcaggtgagaccgtgtcactgtctgctgttgctccgtctactggagaagagggtcaacctactggagaggttggccttgttgctattgctattgaggtcaccccaagtgttttttcctctgttttggaaaagaggaagagggatgatggtactgggccatctgaccacaagaagttgaaggcctttatgagtctttatgccttgagacaggttacagggttgatgcccaatgcgggtcgccttttgattgcacaagatgtgcctttggctccaccgaccatcgaggctcctgttgttgctgctagagttactcctgttgctgttgcagttgttatgctagccactcaatctgattttgttgtggcaccgttgtccaccgtcgcgacacctttattatgtgtgggtgtggtggccgctggtgcttccacggtgttgcctccttcctctatggcttcagtggcttctccctctgctcttttggcggtggtggtgttgccttcttcgtcttctcgtcctcgcgtcttgtttgatcacttgtacacctttagagatgctgactcactgtggggtgcaatttataagccagagcagaagaccccaattggctttgtgtcaaccttcgacaagaaccttatcaggtcgactaggactgtgcaaaaggtggcgttcttggaggtggagatcgccaagtggagggctactgctcatactttttggcgagtggagtgccctaaggtggtcaatgccaccgttgcttttgctgagttgtttaaatgctgcaaggacttgcaagctgagaagatggaccttgggggcaaagtggagagcatgatggctgagaaggacgaacttgccaaggtgattgctgacttagaggcccgacttaaagagtcggagttcgagttgcgggctgccaaggagagggaggccagtagggagctaaaggaagaattgattctgtacaagaaggaggccatggatcaacatgaaaaaggatttcagaaggccgttaggcaagtcgatttctttgcgaaggaccttgacttaggtctcttcgatcccttcaaggatgtgaaggatggtgtcttgcttgatgagaaggagattgttgcggatgaggaggctgctgatgaagggcaaggtgttgtggagcaaggcgatgatgcctatgtctag

SEQ ID NO: 76847 - DNA, 186 bp, Glycine max
  Peptide Sequence Number=SeqID_193625
atgacgacgcaattaaaaatcaaagtgtcacatctcaatcacactcactcacactactcacactcacactcacaacagagagagaaccctaaaattctgccgccgcgatggatatgcatcgacaacaacgaagacctctacctcggtgacgtcgatctcgactcgaccaacggaccaacgatttga

SEQ ID NO: 76848 - DNA, 960 bp, Glycine max
  Peptide Sequence Number=SeqID_193626
atgactagcgaggtccctactgagccgcgtgcaatgcctcagtttaggtctaagttacagttggacaagctcttcaatgggttttgggcctctgttggaggtgctgtctcgcgggtctatgtcaaattcattgcccaggctggattgataaacgctcctggcaagcttgccctgaccgaaggtggtcatgaagtccacgtagcctctggtctcgactctcacctgcaaagccgaggagtggacttgtgtggggtacaagatatcaacggaactgccttggtcgatgaggaccctgaacaccataaagtttgctataatgatgaagacaaccacagggtcatcttggttgacgaggttcttgttctagtggaggttgtcgctcacgccgctgttgcagctgtctttgtctgcctcggtcttctgctcttcttctgtttgcttcttggttcctatgctacttctcttgatggcccaacagtcttcggtgttgcgtctgaccccggcctgggagatttcgtctggggggtttttcacgctcgtatatgggccctttggagagaggctggtgcttgtttggcttgtgcctttcgtccaacttttactgaccaaggtggtcgaggtcatgtggtgagacctgctagtagcgtactgtgcactgaatctttcaaacaaggtgtcgaagctgcgatggacctaggtttccctatgtcaggaaggcatctagatgctcttctggatctgtttccccatcgtaccgttggatctgttgtcccattgtaccataaaaggatgtcgatggacagttcgtgttgctggacggtgcatgtaggagaggctcagatcatctgcagtgttgcctgtgcattggggcctctagctggtcatggtcaacttttagctttacaactcttcttcgtggcatcgcttcatctctgcgatgtggttttggagttgctgtag

SEQ ID NO: 76849 - DNA, 273 bp, Glycine max
  Peptide Sequence Number=SeqID_193627
atgcaccggaggccgcagacacactgccaccacctcatcaggctgatccagctgggtcattttgcatggagcagtatttacagcacttggttcgctagcaggcggccaaccacaggggatcagttcagggctgaggttgcatggcccagagattggcctaaggcccaggcaggggaggcgcccgcagaggctcccggcgatgcagaggaggcccgcatggatgaggagatgacagatttactcggtttcttgggagggagtggagccatgtga

SEQ ID NO: 76850 - DNA, 642 bp, Glycine max
  Peptide Sequence Number=SeqID_193628
atgtccgatcagttctattcacaaatccggcaacagcttgagacaacgcggcaggacggattgttcaaacaggagcgcaccctgacctcggcgcagcaggcggaaatcaacgtcgccaatagcccgccggtgattaacttctgcgccaataactatctcggccttgcgaaccatccggcgctgattcaggccgccaaagacggcatggacacgcatggtttcggcatggcgtcggtgcgttttatctgcggcacgcaggacagccatcagctgctggagcgccggctggcggagttcctcggcatggaagaagctatcctgttctcctcctgcttcgacgccaacggcgggctgtttgagaccctgctgggcgcggaagacgcgattatctcggatgcgctcaaccatgcgtcgatcatcgacggcatccgcctgtgcaaagcccagcgctatcgttacgccaacaatgatatggctgagctgcgcgcgcgcctgcaggaggcccgcgacaagggggcgcgccatctgctgattgccaccgacggcgtgttctccatggatggcgtgatcgctaacctgcagggcatttgcgacctggccgatgagtttaatgcgctggtgatggtggatgactcgcacgcg

SEQ ID NO: 76851 - DNA, 250 bp, Glycine max
  Peptide Sequence Number=SeqID_193629
atgtggtttcctggcagttttcccttcaccagttatcccaatttcgtgaatattaatcagtgcacgcttcgtgttcgattaattgcctctgagcctaacttgcgttcatgcttaatggacgaagggctaactggtgaacgtcctgaattgaagctatccttccatggaaagaaggttcagaaatttgggaggcctgctcctgaaattgaagggctagtcactgccataggattaagtcctttgatcgcat

SEQ ID NO: 76852 - DNA, 246 bp, Glycine max
  Peptide Sequence Number=SeqID_193630
atggtgacaaaaaggacgaagtccaagaaatggcgaggatcggggaagaagctgccaaactctgagcagcaagaagatataatacaaaggttcaaccacgagcctttcaacttggtgacctcgtctggtgagtcggaggtgaagccagaaaatattcccgagcgggaaagcttagtcccaactgggaatgcccattcagtgtcacagccagccttgacaacggagcatacaaactacaagaactag

SEQ ID NO: 76853 - DNA, 429 bp, Glycine max
  Peptide Sequence Number=SeqID_193631
atggcgagtggtatgtatgcaagagcacgatgcctaaaactcaggtcagacaatcccctggttgatcctccaaagagcttgcaaaacccaaggcttgacaaaatccagggcaaacatgtcactgatccaaggctcgacaaacccaaggttcacccttggaatacaagtatatcaaaaacccaaggtccacccttggtacacattcttgaaaaacccaaggtggaagtcatacttactcctcataaccatcagaggagaaacttagtaggtcaagaaatctacccccaaactagttggcaagaccttcaactaggggaaagtcaaacatactcctcacaagcattaaggaaaaagctccacaaagtagaaggaagcctcaccaaatgggtgacaagacctttaaacaggttaaaatcaaacctaagatga

SEQ ID NO: 76854 - DNA, 1675 bp, Glycine max
  Peptide Sequence Number=SeqID_193632
cgcccaatacgcaaaccgcctctccccgcgcgttggccgattcattaatgcagctggcacgacaggtttcccgactggaaagcgggcagtgagcgcaacgcaattaattgctgggtcgtcgtcgtccacacttgttgttgctggttatgagtgggtaagggacaatattctgaaatataagtcctttgtcacctttgcggtgagtatcgttgctcttcaatgccaagtgacgctagcaagccttgagggctcctgcaagatagtcgttcaggcttgcgacttctcgttcttgagggcgttgaatgtgtctccttctcagctccacccaaatagttgggcaatggtgagagcctttgaaattctgtgccctttcttcaacattcgacctagtgtgccggaccatttctttaaggtcctggctactggtgtcatggttgatggtctgcctttgatattcagtagggacggggagccccacttcacattttactggcagtttgaccctactagcaatccccttgctaccttggacgataaagtgcctaaccttgtcctcttttgtgtccgaggtattatgggtgacttcgcttggaggccacttgtgaagcaggtcgaacctacgggtgggattgtgccactatttgttagccctattgttattgttgctaaggatgatggtgctgggccgtctagccataaaaatatgagccttcgtgccttgaagcaagttgtagggttgacgcctagtgcgggtctcccttcaagtgtgcaaaatgtgccttcgactccaccaaccgtcgaggcttctgctgctaatgctgttactccttccccttcacctcctcttgttgttcctcttcaggaggccactcctgttgttgctaaagttagtgtgctagctgctttggttggttctgttgtgacgccgccatccaccgttattacacctttgctgagtgtcggtgtggcgaccaccagtgctcctgtggtgtctcctccttcctttttggcattgccttcttcatcttctcgcccccgtgtcttcttagattatctgtacacctctagtgatgctgattcactgtggggtgcaagttacaagccggagcagaaaaccccaactagctttgtgtcatcctttgataagaaccttattaggtcagctggagtgcagaacgctacagattctttctctagagaaagagtggagtgccctgacgtggctaactccaccatcgcctttgttgaggccgtaaagttgaactgccaattgtcttccaaagttggtggtgtgttggccaagttgctgcacgccaggttggatggtgatgaattgttcaaatgctgcaaggacttgcaggtctggcttaaagagtcagagttcaagctagaggagttcgagctgcaggctgctagggaaaaggaggccaacaaagagcttgaggaggagctacttatttacaagaaggaggtcatggagcatcatgaaaaaggattcaacaagaccatcaagcaggccgagttcttcaccaaggaccttgagttgggtctctttgaccctttcaaggatgtgaatgatggtgttctgattgacgaggaggaaattgctagggaggaggaagctgttgatgaggagcacggtgttgcggagcaaggcgatgatgcctgtgtctag

SEQ ID NO: 76855 - DNA, 654 bp, Glycine max
  Peptide Sequence Number=SeqID_193633
atgggtggcatcgattttgggggctcgattgagcaacccatgagggactgggaggtcatttctattggtggttcctcgtcggaggatattcaccgtggggcctccgacaacgagtcctcttcttcggagagggtgagggtttcgtgccgtattggtgggggaacttctcgccctcgtgggagagcacaaccttccattgcttttggggagcctgtcccggttattatgatcctccccacttctgcttcttggggttgggtaagggacaatattctgaaatataagtcctttgtcacctttgcggtgagtatcgttgctcttcaatgccaagtgacgctagcaagccttgagggctcctgcaagatagtcgttcaggcttgcgacttctcgttcttgagggcgttgaatgtgtctccttctcagctccacccaaatagttgggcaatggtgagagcctttgaaattctgtgccctttcttcaacattcgacctagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 76856 - DNA, 258 bp, Glycine max
  Peptide Sequence Number=SeqID_193634
atgtgggatttgcttgagagattctctcaggataggtctaaatatgccatcacatttgttcgggtgtacatgttcagactccttttgacagaagctgctattgctggaggtgaaactcgaacgacaccaacatctttgttgagagattcttggattaaagcttctgatgagctccacattgggattgttcatgatgaaatggcagaatacagtgaattattgaagggttgtggttattggctactgagtcatctttaa

SEQ ID NO: 76857 - DNA, 237 bp, Glycine max
  Peptide Sequence Number=SeqID_193635
atgtcccacgctgttaaggacaatcgaggcaagtgggccccgaattatgaaggacctttcgtggtgaaaagagctttttctgggggtgctctgatactcaccaacatggatggcgaggagctaccctcgcccgaacggacgcaaatggaggatagggtcacgactgaccgatcgtcgtcccttcccggcgttggacaagcagagaatgtcgttgcgaggcagcccagtatcctttga

SEQ ID NO: 76858 - DNA, 202 bp, Glycine max
  Peptide Sequence Number=SeqID_193636
atggaaggaatcatgattcttctgctagagaatttctcatgttctgagttcctgagggtttttccgtggactaagttccctcttactactttggaaagtacaacctatgtccatcgtccaacagacattacaggatctcgtggtgttattgtcacggcaccattgattcttctgaagacattattgtcaccattaaaacaaa

SEQ ID NO: 76859 - DNA, 159 bp, Glycine max
  Peptide Sequence Number=SeqID_193637
atgcccaacattgtgaatttaatgtgtttcaacttcaatttcagctccactactgcatcaggaagcattttattcgctaagccggcccatggcccgccaagcgagagttgcagaccaatcagagctgcagaactcgctaagcgcgatccttcgcgctaa

SEQ ID NO: 76860 - DNA, 360 bp, Glycine max
  Peptide Sequence Number=SeqID_193638
atgttggccatcatcaacaagtacaaagaagaattagatttggccaccacccacgagcacaaggtggcagatgaatatgcctgggtggaaggcactataactaaacgtaccccgaggcatccctatcgccccagatccaagcctaggacgatgggtgacttagaggaagtacaagaacagatgaaagtcgacatgtcgactttgaaggaagacatggcttctatgatggaagccatgctgggaatgaaacaactaatggagagcaatgcgaccaccgccgccgcccctagcacgactatcgaaggagacctaattctcccaactgtggcgtatcatcccattctggacattaggggatga

SEQ ID NO: 76861 - DNA, 402 bp, Glycine max
  Peptide Sequence Number=SeqID_193639
atggaatcgagaaaaagagctagaatgaaggacatcccttcatcatccactctagctcctccgtcagtaactgtaggacaggaggtccaaggctcacaaactttagtccctatgctgcaaagcttattccgaggacagtttattatcatgcacaacctgcaagagttggctcataacaggccaatcataactatggagcattttcttgagcaagtagcctggcctgaagctcaacttccattggtgagacccaacgaggctactccgcctgagcccacctgtgcagctgcccctcctgattcaccaaaaggagaaacagctgaccttcctacttccctagttggaggaatttctgattcgtcatctggagaagcttttaccctcactgattccccagtttag

SEQ ID NO: 76862 - DNA, 180 bp, Glycine max
  Peptide Sequence Number=SeqID_193640
atgagtgcgagagagaagatgcaagccgatcagcagtttccaacaaatgcttggcttagcgcgaggataaaaccgcttagtgaggtttgcagatccgaaaagctgcaactctcgctaagccaggctatggctggcttagctaaaatgatgcatcttaagtacagaggagcatgcgcttag

SEQ ID NO: 76863 - DNA, 183 bp, Glycine max
  Peptide Sequence Number=SeqID_193641
atggcttcacgcttgggtgctgcttttatgccacatggtctggggcatttccttggtattgacacacatgaccctggaggctacttaaagggcctggaaagaagaaaggaacctggattaaaatctttgcggacaatcagagatctccgggaaggaatggtcagttatggattttctcagtaa

SEQ ID NO: 76864 - DNA, 444 bp, Glycine max
  Peptide Sequence Number=SeqID_193642
atgactggtagattacttgctgggtcattaacctttgattgtcgtatcatgcattatatcattgttcgtattttgcttcctcggtcttcaaaccttgctcaagcctctgaggaggatttgattttgatgtgggcctttcaaactggtcgtcagatcgattggacccatttagttcggtaccggatgcataaggcattacgggccaatgcacctctgccttatcctcaccttgttactctttttcttcatcatttcaatgttcctttggatgatgaaccatttgtcaaggtcaaaagttaccgaaaggatgttgatggtcaatgggttcgcaaacatgacttgccttcgcctattcctgacgagcgtaccccatctcctccaccacaacggggtgattccacttcttttctgactgaagtcctcatagaactccgtggtctttga

SEQ ID NO: 76865 - DNA, 475 bp, Glycine max
  Peptide Sequence Number=SeqID_193643
gctcgccccagagaaccctcttcccgcagcatatgaagatagctgggaagctctcaaatggcacggtgatttcaacaggttttacatcgggggtgacactgcaggcgccaatattgcacacaatgcagttcttcgcgcgggtgttgagagtgagagtgtgagtttacttgggggtatggaaataacgggtgcggttcttgcttttccgttgttctggagttcagaaccggtcgaggggtttgaagagagttcagccatgcaagtggcattgatcaatcctttggcttctggggcgcctagcttggcctctcttgggtgccacaaggtgttgatttttgtggcggggaaggatgatcttagggacagagggatttggtactgtgatgctgttaaggagagtgggtgggaagggggtggaactgcttctagtggagggagaggaacattgctttcagatctaccatcctcaaactga

SEQ ID NO: 76866 - DNA, 1269 bp, Glycine max
  Peptide Sequence Number=SeqID_193644
atgcaactcagaaagtgttgtaaccatccctacctcttcgtgggcgattatgatatgtatagacgtaaggaggagattgtcagagcatcaggtaagtttgaacttcttgaccgtttgctcccaaaacttcgcagagctggtcacagagtcctccttttctcacaaatgactagacttatggacactctcgaagtctacttgcgacttcatgattttaagtatcttagacttgatggctcaacaaaaactgaggaaagaggcaaccttctacgaaaatttaatgctcctgactccccgtacttcatgtttcttttgagcacccgtgctggaggtcttggtttgaatttacaaacagcagatactgttataatctttgatagcgattggaacccacaaatggatcaacaagccgaggaccgagcccatcgcattggacaaaaaaaggaagtcagggtttttgtattggttagtgtaggatcaattgaagaggtgattttagagcgtgcaaaacaaaagatgggcattgatgccaaagtcatccaggcaggtcttttcaacacaacttcaacagcccaggacagaagagaaatgttagaagagattatgcgtagaggtacaagctcacttgggacagatgtgcctagtgagagagaaattaaccgccttgctgctcgatcagatgaggaattttggctgtttgagaagatggatgaagagagaagacaaaaggagaactacagatctcgtctcatggaagagcatgaattgccagattgggtgtattctccaatgaacaaagatgataaggccaaagatttcaacagtggtgttactggaaagcggaaaagaaaagaagtggtatatgcagatacattaagtgatctgcaatggatgaaggctgtggagaatggggaagacatatcaaagttttcaggtaaaggaaaaagaagagaccaccactcatctgacagcattgcacaagccagtgataatacaggagcagaagaaagtttagagttgaagactgaaagtgttcccatggaaaatgagcgaacaagtgaagatagtttccatgtgacccctcccgcaaagagattcaatcctgaaggaacattcctgaaacagacatacgaggatgttggaagtggtttgaatcaccatttgttatcatggaatactcacaaaaagaaaaggtcaagctttcttggccaaggttcattatctgaaactagagggcattcttcaaatggaagagcaaactggaactga

SEQ ID NO: 76867 - DNA, 471 bp, Glycine max
  Peptide Sequence Number=SeqID_193645
atgtcttttcataccatatccattaagtgggagtggtctctaagttggagttctgacaattttactgaagatctgtgttactgtgttgatccagaattgccttcaagcaggggagaggacctgcagaccaagtgcttgcttgaactttatggactaaagctggcagagttgcagatgaaggttcggtctgatgtgagttctgaatactggctcaatgctaagtgtgcatatcctgacaggcaattgtttgattggggcatgatgaggttgcgccgtccattgtatggtgttggagatccatttgctgtggatgctgatgatcaattaaggaagaaacgagaggctgagcgcttgctttttgccatgattttggctgcagcagccaggtgtgacgcaactgcccttggaggagtggcagggtgccactctgcttcactccagcatgattgtggcactaccgggcacaattaa

SEQ ID NO: 76868 - DNA, 1077 bp, Glycine max
  Peptide Sequence Number=SeqID_193646
atgtcaggtcataagtggcatgctaagtgcaaacttttaaagactccagaagctccaggggcttccacactaagcgtggttcttcaaacaagtataggcttccatgtggcatggcatggaaggcaaaggcaacgggcaactcgggcagagaaattgagattccaagccttgaaggctgatgatcaagaagcctacatgagaatggtgaaagagagtaagaatgagagattaactttgcttcttgaagaaacaaataaactactggtaaatttaggagcagctgttcaacgtcaaaaggacaacaaatattcaaatggtattgaacccttggaagattctgaagctgatttactggagtcagatgcttctaagaatggagtttctaaggaatcacctcttgatgaagatatagatttgatagattctgatcataatggtgattctagtgatttacttgaaggtcagaggcaatacaactctgccatacattcaattcaagaaaaggcaagaggattcctcatcctccaaatgcattgttgtattattttctgtttttatgaggtaactgagcaaccgtctatgcttcaaggtggagaattaagaccataccagatagaggggctccaatggatgctttctttgtttaataacaacttaaatggaattttggctgatgaaatgggacttgggaagacaatacaaacaatttcgctgatagcacatcttatggaacacaagggtgttactggtccccacttgattgttgctccaaaggctgtgctgccaaattgggtcaatgaattcacaacatgggctcctagcatcactgctattctttatgatggacggctggatgagaggaaagcaatgaaggaagagttgtcaggggaggggaaatttaatgttctattaacgcactatgatcttataatgagagataaagcatttctcaagaaaattcaatggcagtacttgattgtggatgaagggcatcggttgaaaaatcatgagtctgctctggcaagaaccttggacaatgggtatgattctacactattgatgacacagattaattaa

SEQ ID NO: 76869 - DNA, 723 bp, Glycine max
  Peptide Sequence Number=SeqID_193647
atgttaaagctgaaacatttttatcattggcattgctattacatgtttgttattctgctccattgttactatggccaggttttgatatattgcaataacttcataggtgtcacagtaaaagaaagagactcaaactctggggcaacgctagttgatgttgggttagtgaagaatgtaatagttgaccaaatatttgaaccaggaagaagagttactgttgccatgggaactgaccgcaatttggattctgatttaccacgccaggtcatctcatcatctaagcctagggaagaaggaacatattggggataccaagtgcgttatgcacataatatcagcgcagtatttaaggattgtgcatataagcgtggatatgattttataattggtacctctgagcatggtcagattattaagtcatctgatcttgaaataccttctttcagacatttattgattgcctttggtggactggctggcttggaagagagtattgaagaagatgacaacttaaagggaaaaaaggcacaggatgcattcaatttatatttaaatacatgtccacatcaggggagccgaacaattcgaacagagagtagtgttccatcaatacatgttacatcggaaggaatagatgtcaacgttttgtacgattgtgttaagcttcacgatcactctgcgttttccttatgtttggagccttataaagatagttcaaactaa

SEQ ID NO: 76870 - DNA, 981 bp, Glycine max
  Peptide Sequence Number=SeqID_193648
atggctgcaattgtgcaccacggattgcagtcacacctcgagtcccaacacgccgagtcaatagctctcaaactgaggctcccttcctcaaaaccacccctccctcaactcatcgatttagccttcaaaccctccttctgggattcaaattcaaccatcaaaccccacaacgaagaaaacaacaagtccacaccctcaaaccccaactcttggagcttcctcgaagctctctccaacatcacaaaagaaccatcacagaaccaaaccacctacgtgcaccctcagcagaaacgctcctcgctgagcctcagcccaaagagcctccaactctgcaccgaaaacctcggaaacgaaagtggcagcgacagtggcagtgacagcgatgaaaacagcattgacatgctttcttcattgaacgggaattcggggacaagggaacaagcccaacaaaggcaacctcgtcaactttcgacagcgaagaaagcgaaaacccagaattttccaccccctttgacaacgataaggggatctgactctcttcgtgtgagaccccaccgcgaagatggacggctagtaatcgaggtcaccaaggtcccacctagtccctcgtgctttcatgctgaaagaagccatggccgccttcgcctctgctttttgacaaaccacactccaagttttgacacggaagcagcagaagatgacgttgaagaaaacgagccatttgccaatgaaaaagaactcgaaaacgaaataagtggacaagtaaaagataccaaagaagaacacgaggaaacagagaacgaaacaggggaagaagaagaagaagggggggaggaggaatgtgttgcatgtgggtatgtggagagtgatgttattatcatggaaaagtacgagaggctgagaagttgcaacgaaggtggtgaccacgagaactatgaatttttaaattggagtgagccacgtttggtggctacttcgtaa

SEQ ID NO: 76871 - DNA, 288 bp, Glycine max
  Peptide Sequence Number=SeqID_193649
atggcttcaaagttccttccttccaccgagttagacaagtttgaatttcctttgctgagatgtgtgctcttcactgtcaccatcgcacacgtggctgatggatttatagcagatggtaggctctttttccttcctcgtaataggagcaaattgccttccatgtttgcccttgtagaggtccccaccatgagacagaaccttggcccactcaagcaatcacagcgtttagaaccaaacttaaagcagcaacacattgcgggtcctgacatcccacctgtgacgatgtga

SEQ ID NO: 76872 - DNA, 249 bp, Glycine max
  Peptide Sequence Number=SeqID_193650
atggaagtccccatctctcaaaaagctattgctttttacactcattgcaatttgtgtcaccgcccactcaaattttcactagaacttgggcaaagaaaaacaaaaccaatggggcatcacggcgacaccggcaaggggcagacacgtacatacttcatccttctcccacatagactttgtcaaaaagatgcttactgctgctctagtagccctagaagacaaaataaaataactaaaaagaaaagatga

SEQ ID NO: 76873 - DNA, 4546 bp, Glycine max
  Peptide Sequence Number=SeqID_193651
atggccgcaaatggattaaccagacgaagacacaggactaacaacagtcttagagactcaccagaggaagatggagccatggagctgcaagaaccatccaggttgcgagatcgaggaggtagtgggaaaaaggatcgagatcgtgaaagggagagggaaagggagagagatcgattgggtcgaagcaagaagagaagaggagataggttgatgcatagcagcagagaagatggcggagaagacacttctgaagagagtatcaacgatgaggacgacgacgacgatgaagacggtggcggcggcggcagcggcagcggtagcgcttcagtgagaatgcttccgctgaacccctcttcgctctccaaccagcatcatcggaagagcttccctccggcgaaagttttaagaccaacgccgccgacgacgtggaaggccgccgatgagatgatcggagtatccgtccctaggaaagcacgctcggcctctacgaagaggtcgcacgaatgctgggcttcgagcggtggcggtatcgtggcggaacaaaatcaccgacagccgtcgacctccccggtgagggcggctgcgccggcctcgccttcgtcgtcgaacgcctctgttaggaagaagatagtgagtttcggaatccggaatggcggagccaagtttcgaccacccaaaacgacgacgtcgtcgtcgtccaagccgtcgtcttcagcgcaggacgagatcgaaatagagatcgcggaagtgttgtacggcatgatgagacaacctcaaggaccgtcgaaacaagaaatcatcgccaacgattccaccaagttcgattcccgagaatctaataaatcttccaccgatgccaagtcaccgatctcaaacccacaaaattcaagctcttccgccacacccatgtccgctgttgctccgaagaggaaaagaccgcgaccggtaaagcacgaggatgagaatccggcgagtttgatcgttcggagcagtcccatttcgtcaacgacgaaggccgagagcgatcagccttcaaagatggagacttgttcttccaatttggataagaacaacgtggggtctgtttccgagaatctggcgcattctcagacagttcaaattatgccggagccggtgaagccggagaacaacgagtttaagccggcggcgacggaggaagcggagaagcagaaagatgtggggttgagtgaggtggtggtgtctcctcagttgcccaagaaggaatctcctgtgcgacaagtagcagatgatgaccgtgaagatgtgaaagcgactaaagcgaatcactcaatatccgagagtgataatcagcgagaagagaagttccagatagatctgatggcgccacctcctccatcgagatcttctccggaaagggatgtggagaataataataatatggtgattgacgcagaaaaggaagtgaagcctatgacgaaggaggacgagaaagtgctcagaatgaacaaggaagtagcaatggttatagaaatggagaaagtgaaagcaaaagcggaagaaactgattcgcagaaaccaagttttgtgcagaaagaaagaggaattgacttgcagcttgatttggagaaagttgatagggtagatactagtggcaatgttggtagtatggttaacaagaagcagcaacatcagaacgttcagaggcagcaaacgaactcagagaaaaatgttcaatccaattctttgcctctaccattgtctgttcctagctggcctggcgggcttcctcccatgggatatatgacacctctgcaaggagttgtatccatggatgggactcctgtgacatctgcagcaataccgcaaattgcgaggatgaattcattctggccagcagcagcaggttctgcatcactatacggggctaagcccagcaatcttaatgttgtaccctccacagagttgcatgggaatgttcccggcagggctgcaaactcttctcaggacaaagggcatggtattgccatgtttccaggacatattgggaaggacaaagcctctcagcctgccattgtggataattcatcaagaaaacaaattttgcttcagcaagctttacccccaggagcagcacctagtaatatcttgcatggccctgcattcatattcccgctgaatcagcagcaagcagctgctgcggcatctgttcggcctagatctgtgaagtctttgccagtttctagtaatggagcaccctccagtgtctccaattcagccccgtcgaatgcttctggcacaggcactgtggcggtggcagcggctgcagctgccgctgccccaacgatgagcttcagctatccaaatatgcctggcaatgaaactccgtacttggccattttgcagaataatgcttactcatttccaataccagcacatgttggtggtccacctggctaccgtggaaccccccatgcccaggcttttccattcttcaatggctccttctattcttctcaaatgctgcatccttcacagattcagcagcagcaacttcctgctcagtcacagcagcagaatcaacagggccatcaaaatacaagtatgtctagtggatcctcctcttctcagaagcagcatgctcaaaatcaacaacaaaagcctaataataatgctactggatccaatgggggtgcaagtttgcaaggctttcctgtcaccaaaaccccaccatcacagccactgcagttgcaacagcaacaaccgcagcagaggcagaatcatcacacttctcatccagctcgccaggttgagtctgagatgggtggtgaagacagtccatctactgctgatagtcgtctcgcccgtgccaccatgaatatttatggccaaaatttcacaatgcctatgcagtcgccaaactttgctctgatgacacctgcctcaattggtgcaggaggctccaatggcagtcacagtgaaaagaagcaaccccagcagcaccctggtccaaaggctggaggtgaaacagctcctgcatttgccatgtcatttgcatccatgaatggagctactggcgcctctggccttgacctctcatctattgcacagaacaaccattcaatcatgcagagtaatcataactatcatataatggcagcacaagctgccagtgctcagttgaagaagagttatcatgccgccgaggaagggaaaagtgtagttaatccttctaatctagacgaagatagaaaagcaatatctgctggaaaaattccggcaacaatggggcaatccattgcattcggaaggccagatgtatctgatccctcattagcgtcgttatcgggcggcaacaatgtgattgatacctcgggccgtaatctaaaccttggttctgcttcttctcgtgcttctgcttctgttatgcctgctgccatcagcactaatgcagccagttctcagcaacaaatgcagcgaaatcagcagcagcaaattcttcagcatcagaagcagaatcaatttgcagctgcagcagccgccgcggcggcccgcaacaagaccccatcaacaagcaatggcagtgtttactctgataacctcccttctacatcttcaatggctaataagtttcccagtgctgtatccgcattccctcaaaaccttgtacagagcagtaacaccgttgctcagtcaccttctcagtggaagaactctttaagggcaacaaccacttcacagtcgcccccatccatggcttcaacaacaccatcctcatcggtcaaaagtcacccacagcagcaggctcgttcccagcaacctcacacccaaatatctttcgcaacaaatccaaaatcatccgcagcacaagttcaacctgcaagttccacccagtccccatctcccccagtcatggttggctcaccaacaacttcatcaatatcaaaaaatactggtagcccaaggacaacttcagcctcaacaaccaacaataagataagccaaagttcttctttatcctctcagcaagccaagaactcttctgctgtgccggcgcgcaaatcgtcacctgttggcagcaggaatgtgccgtcaatacttaatgttcctcagctaactcccccttccagcactgggagtaaatcccaactgccacagcagcaacagaagcagcagcagcaaataccaaagcaagcattaccacaggcccagcttttcttctctaatccttacatgcatccgcaatccaacagttccacatccaccaccacagttccaagtggttattaccttcaacatcaacaccaccaccaacaacatcaacagcggcgtggccctgagcagatgcagcggccaggctcttccggcacttccccggccgtgaacaatgtgaaaggcagcagtgccttacctacgcagggtcttttgcatccggcacaggttgctgcaatgcaaccctctgggagccaccctcagtttgttcctactggcttttcttatgcttcttatcatgttcattctgtgccctcagttcaagtgaagccagcggagcagaaacaacctgcgg

SEQ ID NO: 76874 - DNA, 1332 bp, Glycine max
  Peptide Sequence Number=SeqID_193652
atggccattagaagcttcaccaatctccccagtgtgattactcatgcccagaactccccttcccttctcaaaactcaaacttgtaccatcaagctgtcaggccaccgtgtgtcgcatttgcacctccgtgccatcgtgcatcaccttctcgtgtcaacttgggtcgccatgtggaacaatagggaagtcattaggaaggaggtggttggtggagtaccaatggcgggcagagagggtggcaaaggagagttcgagccaatcataggtaggacagggggagaaggtgcaaactttcttttcaccattgttgaagccatcaatttggacgagggagttgtcaagtgtttgggcagcataaggaaaagggagagaatcaaaggtggatggggttggaggctatctctgggtttgggcggtttaccggcactacttctcacgttgggggctttcttggtggtggacaccccaaacagtctcatcgagcgtggtcacttggaagaaggaaaatctgtgctgagaaagattcgtggcattgacaacattgaacctgagttcttggagcttcttgacgcaagtcgtgtggctaaagaagtcaagcaccctttcaggaatatcctcaagcgcaagaacagacctcaactcgtcatttccattgctctgcagatttttcagcagttcactggcatcaatgccataatgttttatgccccggttttgtttaacacattgggtttcaagaacgatgcttctctctactctgctgtgattactggtgctgttaatgtcgtctccactgttgtctcaatctattcagtagacagactcgggaggaaaatgctcttattggaagctggagctcaaatgttcctgtctcaattagtgattgcagtcataataggaatgaaggtaaaggaccattcagaggacctctcaaagggttttgcagtgctagtggttgtgctggtgtgcatttttgtgtctgcatttgcatggtcatggggccctcttagttggctcatcccaagtgagatattcccactggagactcgctcagccgggcaaagtatcgcggtgtgtgttaacttgctatgcacatttgtcattgcacaggcctttctctcaatgctgtgcttcttcaagtttggcatcttcttgttcttctctggatgtgtcttgatcatgtccaccttcgtgcttctcctgcttcccgaaacaaagaatgtccccattgaagagatgactgagagagtgtggaagcagcattggttgtggaacaggtttattgatgaagatgattgtgttaaagaagagaaagtagtcactggcaattga

SEQ ID NO: 76875 - DNA, 192 bp, Glycine max
  Peptide Sequence Number=SeqID_193653
atgtcttgcactgcaatggaaggctctggtgtcacctgtggggctcaagtggagtgggctctgaggcctctagaatgtcatcctcttggtccggctgaggcttctaggctgcagaggcctcaccccctcccaaaggagaaggctagactcctggctaggccaccttctgcagaaactcctccatgctcataa

SEQ ID NO: 76876 - DNA, 690 bp, Glycine max
  Peptide Sequence Number=SeqID_193654
tatttggtggagattttcgccaaatactaccagtcatcccaagaggaacctgctcagacattgtaaatgcagcaatcaattcatcctatctatgggattcatgtgaaatattgaccttgacaaaaaacatacggttacacaacaatctagaatcagttgatgaacaagaaactgccacatttgctaaatggattctagacattggagatggaattatagatgatgaaaacgatggttatgctacaattcaagttcctgctcatctactcattactcaatatgatgatccaatcagtgctatagtcaaatcaacattcccagacatagatcagcaccacaataatcctaaattctttaaatccaaggcaatactagcttcaacaaatgaaacagtagaacaaatcaatcattacgtgttatccttcattccaggtgaccacatggaatatataagctctgattccgttgataaatcagaaaccactgaagattcgtatttccaatcaattactactgaattccttaattcattgaacacatccggtttgccaactcattctatcaaacttaaaattggaagtcctataatgctgttaaggaacctcgaccaaaatcaaggtctatgtaatggtactagattagtggtaacaaagatggcaaaacatgtaattgcagctgaaattatctcag

SEQ ID NO: 76877 - DNA, 198 bp, Glycine max
  Peptide Sequence Number=SeqID_193655
atgtatcggaacttcacgtattgtgaaacaaagggtgctaagtacctcgaagcgatcaaacaaaggttacatgccatgaaacaatggtccccggaagaaattaggcgcacaagaccggctcagcgtgcatactcgcagagtggccagctcatgcttagtgtgaagaaggtccatgagaaagcccaaggtcacgcttag

SEQ ID NO: 76878 - DNA, 246 bp, Glycine max
  Peptide Sequence Number=SeqID_193656
atggtcatgggccctccatcgctgctaatgtcagtggtactgagatgctgccgggaagtagtcgctggtcaagtcggcttaagtgctattggtgcaaataaagtctccggaaattttgttgaagagtatgctatggcaactcatcaattttcttcatattgtgagtctaagagtatgatgattcgtacacttcttttgacaatgacatcgatgacgacttggggagaaatgcgagaaacatcgtaa

SEQ ID NO: 76879 - DNA, 710 bp, Glycine max
  Peptide Sequence Number=SeqID_193657
cgattatctacaacgctgtttctaagacggttctgaaggaccgtcttagaataggaggcgcttacgatagtgaagtgagtgagcgagcaagtgagcttccgcagccacttacccactccaccgtcgccgtcctccgggctccggggccggagcccctcacctacctggatgacttcccccgccccgatcccaaccacgacgagacgatccttgtgatcccccgcgccgcctccggcaagaacatctctgccaaggaacgtcgcgccgggcagcttcggagcatcgtgtttgagcaagaagacggccaacacggtggcaagaagtgcctcatctatcctccttcttttgtggcgaagttagtggcgagagaggacgacgttagggaatgcgcaaccactgttcaggctgccaattcttatgttccgtccgggattagattttctcgccccgtttttcaccatgacgggtcatggcccgtggcttactttactgatgctttcgacttggcaagttcaaaaggagggggtgggagtgggaacatttctgccttgctgagtagtgttccgcgggatgttaatatgcaactgttacacgttggtgatgtgaagcagaaagttaattttgtccacaaggcgcctaagaaggttgcaactgttgatcaaaattctggacattccaagctgaagattactatccctagagagccttga

SEQ ID NO: 76880 - DNA, 321 bp, Glycine max
  Peptide Sequence Number=SeqID_193658
atggatgaatggcaaaatggaatagatctacggcaagaagaatcacactatccatgcatcgacgatcctccgctcttcgttgtgaaaacccttgatgggtctcttgagttcatcagcttaggggtcttaggagttggcgatttggtggagatccacgacgacgccgtttggagtgacgaggtcatgggtggagcagaggtcgaatgtgtagagatgagagagaaagagcgaggagctcaaagtgagagagtggtggagtctatgcacgcaagggactccaacttcaacaatgcttcttctacttccatttttgcacaataa

SEQ ID NO: 76881 - DNA, 510 bp, Glycine max
  Peptide Sequence Number=SeqID_193659
atgaaaagtcctcaagaatctattgaatgtccaggaagacgcagtcgattgagggatagtgaagaagttaatgatgcattgagttataacctgggaactgataaggtggaggccatgcaaatagacgtgtctcaaattacaaatttacctttggaagtggacactttaaaaaggatgtctcctctaccatttctcaaatttaatctcccaacacctgctgaggctgagctttccatgtcaccaaaccctgcaccttttcggtcaccagaaaatcaagatgcgttgctttcatctgctgggtgcaaagaactcatgagcattgcaaatgagattcacataaaatgtcatgactaccttctcattgagggctgctcagatccttcactaccttcttcaatagaaataagcaggttgcaaaagataacacaccctgtaatggaaataatattgaactcacccattgggcacctcaacgatcttaaagatttggattatcaacaatttaattaa

SEQ ID NO: 76882 - DNA, 555 bp, Glycine max
  Peptide Sequence Number=SeqID_193660
atggtcatagatgttgttgtgtggaaggaagttgctggtctggacatgggtggagtccataaatttgatgaaattgcagatgtctacaacaagatgcaaacctatagaggaaattttctgggtcctacaaagagattgagaaatcaccttggagttggtggattaactgttgaagacaggatgttggtttacctcatcacctacattttcacaccaaggtcaagcaatcatgctcaagtaacagatgatgatatgcaaatagtttatggtctaaaatcaggaattaagatgaattggattctactgattgaagacatcatgttgaaatgtcgtcgccttgtggattatgagttttcatatgtttttcttacctctagattcattaactattttaaggcatcgcaagaagcttggtatgagtatgctgatcatgaatggataatggccagagagcctactactggaaacattgaagagatggaagaagatgatgaagctgaagctcaacatgatcctacacctaaatggagtccttttgaatctctcatgatttag

SEQ ID NO: 76883 - DNA, 543 bp, Glycine max
  Peptide Sequence Number=SeqID_193661
atgccacgagctgcttcttcttcttccgcgaaccttcctgctgtgccgcaagcctccctgcttcatccgcgaggtggctattcttcttctgcgaggtgcgtctttgtccctcctgcgagtgtgtcttcttcttccgttcttccacgagatttcgttcttcatcgagtatatttcagaatgtcacgctctcatgtgtcgtcatcacgttggaccagcgtgaatgaggaactcgaacaccttgttgcgaatatgcctaagcatggggaatggaaggagttggcaaacatgatgcagcatgtcgtagctccaccagaggctttgttccagaccattagtgccagggaccagacaggatggactcatttgtacttagggaacgttgcagaatgccagctcgtgttcaatcactggaggaagtcactaaaaattggagccggatggaaacatttctatgagaccttgtcattcatcgctgacatggaaatagttttcgaattcattgatcccgatgttaactgcgtgctttgttggccgtgtttatga

SEQ ID NO: 76884 - DNA, 1668 bp, Glycine max
  Peptide Sequence Number=SeqID_193662
atggcggcaccatggctgccatggtggatttctgccaaccactataggcaatatgtgataggaagcctgctgtggtggcaccataggctgcaatgtttatgtataagggaggtatgggtaaaatggaaaaataggataatgttattgcatatgtatcctcgaggagaatgctcacaagtggcattgtctaaggaatcaaagtgggaagttttcatggaaaagtgtttggaggcagatcacactgtccatttggttcgtggctctgctcctgccaatccaactggtgggaccaatactagtagcaccaataccaataccacaacaaataatgctagaggtgctggtgccaatgaaggtgggggcttaggagggcttggttttggagcttcactattccctgggctaggtgtcaatgggactgggggcaatggtttatttggtgagggatttcctgatcttgaacagatgcagcaaccctttatttctaatcccaatttagtgagagaaataatgaattcacccaccatgcagaatctaatgaataatcctgaaatagtacggaatcttataatgaataatccgcagatgcaagagctcatggatcgaaaccctgagctagcacacatacttaatgatcccagcactctccgccagacccttgaagctacaaggaaccctgagatcatgcgtgaaatgatgagaaatacagacagagcaatgagcaacattgaatcttctcccgagggattcaacatgctgaggcgcatgtatgaaaatattcaagaaccatttttgaatgccactacgatggctggtaatacaggaaataataatgcagcagtttcagggactcatggtggccatgcaagggaccgatcaacaaatccctccaccactagttctgaagcaactgctggttctcccttacccaatactaacccgcttccaaatccttggtcctctacgggaactggaggtgctcaaaataaccccagaaggtcgttgactactggtgtggatgccagacagcaaggacctactggcttaggtgggcttggtctgccagaccttgaaagcatgatgggtggtagtgctatgccagatgctgctttattgacccagctaatgcaaaatccagctatctcacaaatgatgcaaagtatgctttccaacccacaaacattgaatcagatccttggtgctaatactgagcagcgtggcatgccggatttaaattctcttagagaagtaatgcaaaatccagaattccttcgtttgttttcttcacctgagacgttgcagttaatattcttacagttctgtcttattgcacaatttcagcaactcttgtctttccagcaagctcttatgtctcagcttggccagcaacaatcaacacgggaatctggtcaaactggcggaggcactggaccaatgaacaacttgggattggagatgttatcgagcatgtttggtggacttggagctggtagcctagcggttccaaatagatcaaatgagccgccagagcagctgtatgcctcccaactttcacagcttcaagagatgggattctttgacacacaagagaacattagagctcttatcgccacttcaggtaatgttcatgcagcagttgaacgactattggggaactctggtcagtag

SEQ ID NO: 76885 - DNA, 291 bp, Glycine max
  Peptide Sequence Number=SeqID_193663
atggaaatcttccggaagaagcttcttccgggaacattccggatgacgttcttccggaagttgtctgtgaatacttccggaagacacaaattattcttccggaagaagttaattttgttgactggattcaatatgtcgaaaaattctttaaggccaaaagatcaccaaagggaggttcataaaacgagaagatttgaaagtaccagaataaattttgccaagagtggatggatgtttgtgggtgcttgcaagaaagggtggtacaagatcaggatgaacctcaacttctga

SEQ ID NO: 76886 - DNA, 324 bp, Glycine max
  Peptide Sequence Number=SeqID_193664
atgtcagaatcagataacaaaggggagatggaagttgccttgctagactatgtacaagtgaaggatctcccagatcagttgaggcttgcctatgctaatctagttcttgagattggtaatggtgacccattaagacctgcagagagaaatcaactaggtacaaacaccagcagcagcaaaacccttataccactacctaagcctgacaggaaagctactggatggccttcatgcagcaaaatagtcctgaaccctttattgaatgcatctatctgcagaataaaatgttttgagaaatttggtattgtgaaactagatgtctag

SEQ ID NO: 76887 - DNA, 219 bp, Glycine max
  Peptide Sequence Number=SeqID_193665
atgacagaggactttgagtcctatgaaagcataaagataggggactttgagtcctatgaaagaaagacgaggactttgagtcctatgaaagataaatgtgaggactttgagtcctatgaaagaaagacgaggactttcagtcctatgaaagataaatatgaatgcaaccttcatcttgaaatactagtaatgcaaaaggttttgattcatgaacattga

SEQ ID NO: 76888 - DNA, 276 bp, Glycine max
  Peptide Sequence Number=SeqID_193666
atgcggaaaatacccaaggggaggggcaaaagggtcattccaggcaattttctggaccctggctcacccaggctagcctctggttcacctgagcccccaaattgcttagggatgaaggaaacagctaacctaggcgagctgcaagtccaacaagtgcccttttatgctataaataggcacttaaagaactacgtaggtctgaattcctcatcgcacctgaggatacgtaaaaataagggaacacccttgtcgaccccaaaaaatagagaaacataa

SEQ ID NO: 76889 - DNA, 267 bp, Glycine max
  Peptide Sequence Number=SeqID_193667
atgtcacaccctctttccattgtcacctccatttctagacacccatacaagatgaagcattctgatgagagttggagaaagaataaatgcaacgagagttggagaaggagaaaattaagagagacattgtcgcaacctacccttcaacgagcgtgcgggcgaaaagccaaaggagcatcttccaaaaaggaaaatgcgtcggagtcgccaccaacgtttattcaaggaaaacattataaaaaccaacaaggggtctgcgaatattga

SEQ ID NO: 76890 - DNA, 201 bp, Glycine max
  Peptide Sequence Number=SeqID_193668
atggatacattaatgaatacctacttattagtggggcgagaaaatatagtaaggtatggcaaatcaatgaaagtgctaagacttcattacctaaggaggacatcggaccagtatatattacatactgctgaggcccagaatattaccctttcattcgcctgcaggcatgcctcaggtgatcgtggagtttctgagccttaa

SEQ ID NO: 76891 - DNA, 276 bp, Glycine max
  Peptide Sequence Number=SeqID_193669
atgctccaaccatgtgggatcagcacatgcttaaaggagcactcaaaccgggtgaccctcaaggcctacactccaaagaatccgttaggacctctccctcctgattcaggaaaagaaaaagttacgatgcaaagggtatttctctcaaatccaacatctttcgtaatttccaatggtgaaaattcttggaaatcagttgaaaacctggtgtttaaatttcacagagatccaacggtcaatgggtccaagatcatcatttttctgagacgggtttga

SEQ ID NO: 76892 - DNA, 375 bp, Glycine max
  Peptide Sequence Number=SeqID_193670
atgctccaatcatatgggatcagcataggcttaaaggagcactcaaacccggtgacccccaaggcctacactccgaagagtccgtcagggcctctccctcctaattcagctctaggtttctgcgggaaagaaaaatgctacaatgagaggggtatttctcttatctccgacgcgatatcgaaattcccaacggtgcgaatgctcagaaatgggtttcgaacatgctgtttaaatttcacgacgatccaacggttaatgagtccaagatcgtcatttttccaagataggtttgatggcctgcgggaaaaagagagggttttgggagagaaagagagaaaaaacgaaattggtaggcagaggaggctgagaagttag

SEQ ID NO: 76893 - DNA, 129 bp, Glycine max
  Peptide Sequence Number=SeqID_193671
atggaggctgggaagaaggatggtgaagtgaatggcaatgagaaaaaggccatagggatggtgacccactttagaatagcttccttcctacctcggagaggcaccacaaacaatgccattattctataa

SEQ ID NO: 76894 - DNA, 216 bp, Glycine max
  Peptide Sequence Number=SeqID_193672
atgtcaattttggatgatccagttgttaaggttcacctttataaaaatgggtacaagcctaactatcggattcagactgatcacagtgaagagatgtcacatgatgatttacttgttgatgataattttgtgggtgcttcacgtagtgatgtacatttagcccatggtggacaatttgtgtcaatgcaggaaaggttgtgtgttagccttaagtaa

SEQ ID NO: 76895 - DNA, 246 bp, Glycine max
  Peptide Sequence Number=SeqID_193673
atgacatcgacacagcctggggatccacccagacatccatttgtcgtgcacgatgatagatatgttgaaccagatattcctcagtacccagtggcggcaacagttatggaggaaacacctgtagatgcacattctaatgtagaccagcctcgacatgcactggttggaacggttgttgaacctaaggatagtgacagaaggtacagaagcatacaatgtcatggaagactacctaaggatcactag

SEQ ID NO: 76896 - DNA, 421 bp, Glycine max
  Peptide Sequence Number=SeqID_193674
atggccgcatcgattcaggacgccaagaaccgcatctcgcagatcgagcgtgtcttttgctctaagctccaccctctctttaaatccgacatcgcattgaaacgccgccgcatccactgcgagggcgagaaggcgacgctgctggcgagaattgacgagttggacgagaaattgagattgaagacgcgggagattgaggaggcggacgggaagctactcgagcgcgtggaggcgctgacgtgcgagttaagggatgagaaattgaagaggaatcgcgtgacggaggcgtataagaggcttaagtctcagcacgtttaccttcggagaaaggttggtctcggtgaagagaatgtggttcaggaaaacaaattggagtgtgcaagtgaattggagatgcttcagagtccaatcgtaaaacctg

SEQ ID NO: 76897 - DNA, 394 bp, Glycine max
  Peptide Sequence Number=SeqID_193675
gttttacgattggactctgaagcatctccaattcacttgcacactccaatttgttttcctgaaccacattctcttcaccgagaccaacctttctccgaagcagcgtcgccttctcgccctcgcagctctcgagcttcgaaaacgcggcgtttcgcttcgcctaggagtcgcggagcgcggactctttggagtgcagcaactcctcgaggtactggatgcggcggcgtttcaatgcgatgtcggatttaaagagagggtggagcttagagcaaaagacacgctcgatctgcgagatgcggttcttggcgtcctgaatcgatgcggccatgatggtgctgaggcctgtgatgaggtttccgtcagcggcggcggaggaggggaggggaaaccctag

SEQ ID NO: 76898 - DNA, 234 bp, Glycine max
  Peptide Sequence Number=SeqID_193676
atgatatcatttaatacttcagaggtttttgttgagcatgtttatcttaaagacttcaagtctcattgtagaagcaagcttcatgatgatgaaccaaacaattttgatgatgccaaaagcccaagtaattttgatgaaccaaacaagacttcaagatcaagcatcaagaatccaatccaagattcaagattcaagagaagaaatcaagaagcaacaagtcaagacttcatatag

SEQ ID NO: 76899 - DNA, 177 bp, Glycine max
  Peptide Sequence Number=SeqID_193677
atgaagccaaaagatgtttatgggttgcaagatgtagaagttgatcctgaagaagtggacatgcctgatcgatcaacaatccaagagcaatgggataaagaggcatatgatttggtagaatctggcaatgtagtaggggaacttgtcgatgactttgaaattttctttgatgaatag

SEQ ID NO: 76900 - DNA, 483 bp, Glycine max
  Peptide Sequence Number=SeqID_193678
atgctaactcgatctcagaagggtgaaattgttgagtgtgacctcgagataaaaaaagcctttcgcaggaacaatgttgaaacaacgagaagaaaaaatggccgctggtggagaacaggagcgaaccttgtagaatcacctcaccccttgtatggaaatcactatagccatacaactccccaatttggagaccaaagctgtgagttgaggcatgggctgatcaacatgattgagaggatacaattccatagtctactgttagaagatcctatggtccatttgaggaaattcctaagattcacaaacacgatgaggagccttgccaatgtttctgacaacattagattggctaccttcgcattctcattagggggaaaggctggagattggctcggtgattttccaggcataagcattatcacttcggaccagtgctcattagcattcttgacaaggttcttcccagtggaaaagtctgagtag

SEQ ID NO: 76901 - DNA, 663 bp, Glycine max
  Peptide Sequence Number=SeqID_193679
atgacagatgtagcagtagagatcattgaggttgtgacctctaatgctaataatgataacatttacataggccctcagtatcatgatcagaggcctaagcaggaagagaatagaccaaccttccaagacttagtgatggagtatataactaagagtggtgaaaggttcaaatccttagaatccaccatgtcaaaccttgtcactctaatgtatcaaagaactcctggcacacttccttcccaaactgaagctaatcctaagaatgaggaggtgaatgttatgagcaccaggagtggaaaatctaaggcagaaccaaagaagaaagagaagaccactctaacactaggaaaatggctttcatcgaggaaactaaaagatgagcagaaggatagacaattttctacgtttgttgaaatgtttaagaaattgcatgttaacattcattttgctaaggcaattgcaaaaatgccaaagtatgccaagtttttaaaggagattatttcaaataaaaagaaattggatgactttgcaatagttagtctcaatgaggaatgttttgttgttgctctaaagaaactacctcctaaacttaaagacccagggatttttcaatcccttgtgtcattggaaagttatcctttgattaagcattgtgtggcttaa

SEQ ID NO: 76902 - DNA, 1227 bp, Glycine max
  Peptide Sequence Number=SeqID_193680
atgccaatattcggttcggttccacttccactgtttccaggttcagcaagcactaactgcaaaaacgtgggaatcaccaaaaccacgagcagcagcaccgaaaatagacagtttaccgtgattgcgagtggaagcatcgacgacgaagaatctattcattatcttcttcgtcgtgtatatcatcgtccccttcgtcttcctcttcctccaccggatggtcagattctgaaatggccaaacttgaaggttttcgattttgaggagttgaaatctgccacaaacaatttcagctctgacacattgctgggtgaaggtggctttggcagagtttacaagggatggttggatggggataccctcgcccctaccaaagcaggctccggaatggtcgtagccataaaatggttgaacccccaaagcacgcaagggtttgaccagtggcagacagaactaaacattatgagaaggttttctcaccccaacctggtcaatttattgggttactgttgggacgatgatgagcatcttcttgtgtatgagttcatgccaaagagaagcttagacaatcatctattcaaaagaaatcgtaacttaggatttctttcttggaacacacggcttaaaatagctattggtgcagctcggggattagctttcttgcatgcttctgaaaacaacatcattcacagagatttcaagtcctcaaatatactacttgatggaaattacaatccaaagatctcagattttggcttggcaacattggtgtcttatgagggacaatcccacaattacagtccagagatctcagattttgacttggcgaaatgggggccttctgagggagaatcacatgtaactaccagggtcatgggcacggttggttatgcagctccagaatacgtagcaacaggccacttgtatgtgaagagtgatgtctatggatttggtgtagtgctgcttgaaatacttacaggcatgcgggcacttgacacaaatcggccaacagggcagcagaacctagttgaatggaccaagcctcttctctcttccaagaaaaagttgaaaacaataatggatgctaagatagtgggtcaatattcacttcaggcagcatggcaagcagcacaacttactatgaaatgcctacaatctatccctgaagaacgtccttctatgaaagatgtagttgaggcattggaagccattgaagctatccaaaattag

SEQ ID NO: 76903 - DNA, 462 bp, Glycine max
  Peptide Sequence Number=SeqID_193681
atgggttcgattcctctgttttcaggttcagcaagaactggcagcaagaacgtggggttctccgcaaccgggaagagtcagttttcggagattgcgagtggaagcgacgatcgcgaagagtctcttggtcggattctgaaatggccaaacttgaaggtgtttagttttgaggagctgatttctgcctcaaggcgtttcaggtatgacatacaggggttagtgatcggtaaaggatgttttggcccagtttacaagggatgtttggatgagaatacccttacccctgccaaaggaggctatggaatggccgttgcaatcaaaatgtttaaccaagattacgtccgagggtttgaagagtggcaggaaatgaaaacagacgaagttttcttaaaccaaacaggacttagtgcaacacaaacagtcgatgctgtggaaaagttgggagaaggcagactaaaataa

SEQ ID NO: 76904 - DNA, 934 bp, Glycine max
  Peptide Sequence Number=SeqID_193682
atgacttcaacaaacccttccccaaatgcttcccctgttgcagtgcctcctgcacttggtggtattttatcaccaccaccttcttcatcttctccaacaaattcatccaaatcaccgtcacctcccaattctcctcagcctaatcaaacacaaacacccaattcccctgctccttcatcaccttcagctccacctccttctcctccttctcctcctcaggcagtgcctgtaacccctcctccttccatatcactctctccaccaccaactctgccccctccttcaccaccagattctccaccaccattgccaccagcatctcccccctcaccaccagctaccactgcccctcctccagctgaaactccaccttcccttccaaatttgtctccaccatctccaccagatggttcccctcctcctcaatcacctcccacaacaattccacctccttctcgaccggtttcgccgtctcctcctcctccagccaatgttccaaggccaccatccactagtactcctccacagaaacagagtccaccaaaaactactccttcacatgcatcccctccatcagtttctgaaagtcctcctaaacctccttcctctgatgttcacccaccatccacattgccttcagacacttcaggatcttcacctccagctactttgcctgaccctccaactaatacaacagctgcccagggtcccacggtgtcgctgccgtctcttccaactgaaaaacccactgctagaccaactaatgatggtactaacagtatgtcttcaaacaacacaccttcacattcaggagggttgagcactggaggatctgtggctattggaattgtagttggttttactgtcctcagccttgttatggccgtgtggtttgtacagaagaaaaagaagaagggaacaggatcaagaggtg

SEQ ID NO: 76905 - DNA, 243 bp, Glycine max
  Peptide Sequence Number=SeqID_193683
atgctattgggatacactaaaaagggatgcaaccctagccttctatatttatattttattgttcccatccatgtaccagataataacaagatacctttactcaatttggagatgcttgaaacaccaatatgttgtcatttgcaaccagattgtgttgcggatgaggatgaggacaagggaaaaaaatccctcacatatggaatcggagacaaggacagagggttagttgggggacgggagtag

SEQ ID NO: 76906 - DNA, 450 bp, Glycine max
  Peptide Sequence Number=SeqID_193684
atggctgccttcgcttcttccatgtcgactatggaccgcatcgaaacttccattacggaactcacctttgaccaactccacttcatcttttccaatgtgctaaaaccttcttcgacctcctcatccgagaaaaccgccatcggcatggttcctcagccaaacatcaaatatggaggtaccccatccaagcctcaagttgtccctaacccacccaacactctccttgataccaagtggctgattggtaggcgctttgatgatgctcaaacacaaaaggagatgaaaatagttccattcaacattgataaggctccaaatggtgatgtgtgggtggtggccaatgggcaacaatatttccctagccacattaatgcctttgttgtcaccaagatgaaggaaattgcagaagcatatctagggaaggctgcggaaccaggtgagcttagctag

SEQ ID NO: 76907 - DNA, 402 bp, Glycine max
  Peptide Sequence Number=SeqID_193685
atgatgaggacactcgccagtttttcaagaactcttaagtacgagtgcttctttgcccatgagctggtggaaaaggacatagttgggtcaaaacgcagaacctcctatcgaagaaaagtcgaagaaaaccctacactgctgttggaactgtgtgggtcgaaaaaaccctacactgctcttggaacagtcgtgggtgctcaaagctcaaagctttctacgctgccagttaacaagttgattgtgctttttctggttttcaagcttgacgagagttacacgccgagcaaagtttccatccgtgccgatgatggttttcacaacttgaaggagattaagaccgtggaactcgtgaaggcaactgggtgggtttatttatccttgtctggagctgatcctaggtaa

SEQ ID NO: 76908 - DNA, 450 bp, Glycine max
  Peptide Sequence Number=SeqID_193686
atgagtgatgcgaaagaaatgaaaactcctatgcatcctactacacatcttggactagacgaggaatcaacgaaggtggatgggaaccattataaagcaatgattggcttactgctctaccttactacattccaaaaggaactaagggaatttcttttaacctcagttaaacgtgtattcaaagatttaattgggacttctaaccatggtcttctgttcaaaagaagagaaagtttcaggctcacaagctattgcaatgcggactatgctggtgataaagttgaaaggaaaagtacaagtggaagttgtcacttgataggaggcaacttagtcataatgatatgcaagaagcaaggatcaaatgcattatccatggttgaagcaaaatacatgtcagcagcaagttattgcacccaacttctatggctaaagaatcaacttgaagactag

SEQ ID NO: 76909 - DNA, 321 bp, Glycine max
  Peptide Sequence Number=SeqID_193687
atgtcccccaacaaggcctccatcgtcgccccccagattgaggatgaggccttctttgttgtcgataaatccaccgcctccaacaatgacgggatcgtgattcacgacatggaggtcttagggagtttcgacttacacatggggaagatgacatggatgtacgggtccaacgtgtggaacaagaaggtgaaaaagaggctaagttttgaagtgcaaaaagtggcagttgggctaagcgcgcatccaccgctaagcgcagcttcaacgcgcttagcacgaaggagaatctggcaaagcatcagcatcaaggccgcacactaa

SEQ ID NO: 76910 - DNA, 1752 bp, Glycine max
  Peptide Sequence Number=SeqID_193688
atggcctctgcaaacacccctatcatggaagctatcccaaccctggaaatcactgccatacatattgacaatgaacctttcattcacgtagaacacctttcgatatccaagaactcaaaaaaaactgataaagacctttggcgacatgttgagttcatcaacaagaagaccatagcctccaaggttttgggactaaaggtcgttctatacagcaacaccgttactaaagcaacaggctatgactaccacgtcactagagctctttacaaagacaatgctaacaaggttggtgatcagaagaccatcatctacaacttaatgtgtgagaaggagaaaatttgggtcaacattctgaacaatagtgtattttttaaggccgactccaagaaaaccctctttgacctccacaaggatgaagaagagaaagagcttttggccaaggaacacaagaccaagagaaggcatgagtctgttgcgtccgtttctgagtgtccactcacagtaaacccactcgcccaaaggttgaaagacttaagtgaaattgatgatgatgataataaaggactagtacgagtggcccttcaaaagcagaaaattgttgttcttgatgcacctgctcccaagaaagccaagaaggctcaacttgtagctaaaccatataatccaaagattggtgaaaaagaatggacagtttccttcactaaaaacaaggaagatgtagcctccttcttattagatggtgaattcactaacagtactccaatcatgctcctccacaagtccacaccaatcactcaaccccatccaccttcctctcctttagacttggaaaggttcagaagggaagctctaagggatccattatctaatgctcaaagattccccctggccttcgttcatagtaatcctacacctatcacccccttctctgaagccattttctttgaacccatggtaagggaaaccatcaaagttcattggctacctccaatgtggactcgtctagtgcaaccatctttcatcaagatgcctcctcattggctagcacatggcattcaacagcgagtcagaccttccactgagggactcttcgcaaggagtgaatcctcccaaggtttagttcaaaaaaaaggttcacctatggaagcctattacaagactgttgccaccacgacgtatcctcctggtctacatactagggcaactaacatcaagatggttgttgatggggtttacccttgcttaccagtatgggatgctgccacgaagaagggatttgagctatattgcaaggaacaattgccttcaaggcaaatgaagagtcagataatgtggatgaattcccaaaaagcctccgcctctagcaatgatggaagtgatattactgtgtcatgcaatgttgttcaagtgttacaactttccaggaagtatcataccggtgaagcgtccaatgcggctatggctgatggagttgaaccactaattttggatctagtgtctaaaaagtcaataacttcaaatgaagccacttctcgagataaggatgaccatgatgtcctaattgtctactcaactagttctggcactaccattcttaattatgctcaatctaccaccatcatttgtgatcagaatgtcattacaatgcaattttccaaccttggtgtcatcctttcactgaacatccaacaagctcaactgaaaatgcttggagttgttgttgcacctgcacctgcttctgctcctacacca

SEQ ID NO: 76911 - DNA, 204 bp, Glycine max
  Peptide Sequence Number=SeqID_193689
atgagggcacctgaaagaagtctacctaggaaatggagagcacaagtaacaacgctaagagcattaaagaatcttgagtcaatgtctcatgaggaacttattggtacccctaaggttcatgaacaggagctccaacaagatgagggtcttgaaagagaaaaatctcttactctcggtagtcagaagaacaagaaagaaccataa

SEQ ID NO: 76912 - DNA, 486 bp, Glycine max
  Peptide Sequence Number=SeqID_193690
atggttcaactgatttatgataccatctattgtttgcagaaatcgcacccacaaagacacccagtggacccggagaagtccagcagggccctggggtttccagctctggttacaggcctctgtagtcctacagggtgcccattccccctagcaaggtcacgtcatcatgacatagggatcgcgcccgcaagacacccagtggacccgaagaagtccaacagggtcttggagttgccaaactctaattacgggcctctgtcagttctacggagtgcctgtcgcccccagcaaggtcatcaggccccttactattcgagctttcatcaagaagtactgcgtccccaggtaggcgcagggcgaaacaccacagcagcccggggatggccggcagcgggcaacagacgcaccgccatcacctctagagttcatctcagctcatccacaaaaaggttagaacgttgcttacgacccatggccgaccaatag

SEQ ID NO: 76913 - DNA, 411 bp, Glycine max
  Peptide Sequence Number=SeqID_193691
atgtatcttggtcataactccaaaggctcatcaaacccaaggtttgccctaggtgagtctcgcatctccaaaggctcgttaaacctaaggttcgcccttagtgagtctcacaagctcatcaaacccaagctccacccttgggtgaaagcgcacctagtccaaagctcggcaaacccaaggtccgcccttggtgtgcctctcggtagcaaaaattttgcattcgtagaaatcttaggaacactacaaacccaaggtctacccttggtacgcacaatcctacaaacccaaggcacacccttgattgcatcactccttggcaactacgattacaatagtcaaaggtctaggtttgacaagtcagaacaacctaccaccagactggttgacaagaccttcaaccagtttttataa

SEQ ID NO: 76914 - DNA, 360 bp, Glycine max
  Peptide Sequence Number=SeqID_193692
atgagaaggaatgcttatgagccttcaacattgtacaaggaacaaattgaagtctatcatgacatgaagattcaacacaaggagattaggcttggccaatttgtgttattgttcaattccaggttgagacttttccttggaaaacataaatgtaaatggtcaagtcctttcttggttaaggatgtcaagccatacggggcagtggaattggaataccccattacaaaaaggtcttggattatggcaccaccaaggaaacatacacacaccattccttcaagcaagaaaatgaaggggcaagcttcctctcaccaggaactagaacccatgcacaaagaggaagaacatggcaatccttag

SEQ ID NO: 76915 - DNA, 590 bp, Glycine max
  Peptide Sequence Number=SeqID_193693
atgtatgatacattggaaagtgattcgaagaatcctttgtatcctgggtgcaagaagtcattgacactattgttagaggtgttaagtctggttaatgtgaaggccaaatatgggtggagtgacaaaagtttcacttcattgcctaaggtggtcactgcaaggaggttcatgcttgcaagttacaaggtgctcaaggtggtggcttttagtccgttggttcgcaaggtgctcgtaaggtgcttcgtgctcccaagaattgtgatttctggaggggtagattgctactgggctttgtttgagagtcagataagttgttgtttggtggacctcaactattgggactctattaatactcttgctggggaagtggttttgggctattttttccctcttttggttgccactggtgttgttcctctcaatagggagttgtggactgacgggtacttctcaattattgctgagattgttggaggagtgtggttgaggtggtggcttcaagctgctgctgcaatgtcaaacatggaaatttttgttgccgaaatgagcagtgactcattccagcttctagggatggcagagaggggcat

SEQ ID NO: 76916 - DNA, 720 bp, Glycine max
  Peptide Sequence Number=SeqID_193694
atggggggtttgcgtgcctcgggtaggaaagagatcaccggaagtatagcacaagatcgccttttttttcttgctgccatgggacgatccaaaaagcgaaggctcacccagctgagatcggcagtgagggatgcttaccttcttcttagagaaaggggaaaggggcaacctatcttactaataataagaaagggggtggcatcgactggggttttacacccagttggtgtaagggatgaatcaccctttgcggtcggattgccagaaatggtgccgactgtccatgaggcgaacaatcggtgcccccccacgactgatgcgacattcagtcgtttaggcgagttttgggcggtgatctggaagccatcccagtggagtgaggttaaacaaccaaatgttgagatagaagacccagatctctccggatctgtatctcgctaccgattgttcgcctcatggacagtcggcaccatttctggcaatccgaccgcaaagggtgattcatcccttacaccaactgggtcgaccccatggcagcaagaaaaaaaaggcgatcttgtgctatactccggtgatctctttcctaccgaggcacgcaaacccccatcgtgtcccagatcacattccgtaaatcgaaaggggaagcctactcatccatcagctcctctcgtagatcggtgcggttttacgaagcgtctaagcacagttcactcgcgttga

SEQ ID NO: 76917 - DNA, 297 bp, Glycine max
  Peptide Sequence Number=SeqID_193695
atggagcatttcaggtcttcatatatgataagaggtttcattttactatgcaaatactctgagcctctagctgcaccagctgctattttgattcttgattcctttaaggagcagtcgtcacagggatccttcgtcccccatggacgtcaggatgttctcaccgctgctattgggcgtccagagcaccctggatgtgtccatgctgctggagccagtgtcaccatcaagcaatactttggatcggctccacggatgtcccgcagctcttccttgctgcctcctgaagaattacagtag

SEQ ID NO: 76918 - DNA, 144 bp, Glycine max
  Peptide Sequence Number=SeqID_193696
atgaatttgttttttttgctcagcaaaaagtttgattggggaactggtgagacccccaggcgatcaacaaggatcaatgagaaagtgaagtcaactccaccaacagatagtgatactccaaagaaacgtgctcggaaatcatga

SEQ ID NO: 76919 - DNA, 258 bp, Glycine max
  Peptide Sequence Number=SeqID_193697
atgaaggtagcaattcaacttgttcttcaaatgtttagttggaggaggtctgtatattctagtaatcaggaaatcttgatgtttgaattgcttgactacatattgagggatccaaagcactgggatgaccatcttgagtttaggccagaaaggtttcttagcgatgatcatgagagtggaaaaatgggtcaagttggggtcaggggacaacattatcaactttttccttttgggagtggaagaagagggtgtccttga

SEQ ID NO: 76920 - DNA, 201 bp, Glycine max
  Peptide Sequence Number=SeqID_193698
atgggttctattggcgcaccatttttagagatgctcatcatttttctaccacctagttgctacaacttatcatcccaaactaatgggcaagcagaggttcttaataaagagatcaagcaagtgttgcagaaggtagtgctgcccaacaggaaggattggagcaagcaacttgaggatgctctatgggcccacaggacttga

SEQ ID NO: 76921 - DNA, 760 bp, Glycine max
  Peptide Sequence Number=SeqID_193699
atggcaagacactggctttataatcgaaatgtgctgttgaatgtgggcggatttgacccagcctaccataaagcatcagagttcgaacttattgttcgtctggtcgagcaatatggtatcaatagtattggtcatctgccagaacctctggttatttctgaaagttttttattaactgacgaaccagagtatcgggatattcttcagaagcatttgcacaggcgtggatacacaaatggctgggtgaaaaacacatggcctggtttatatagtcttcgctacgaacacgcaaatcagccgctggtttcaattatcattcctactaaagaccaattgccagtactcatcacgtgtgtcacttctcttttagaaaagacgcattataaaaactacgaaatcattgtcgtagataataacagtgaatccactgaagcgcagcagtggctggccggattagctgaaattgatccgaaacgcataagagtacttagttatccccaccccttcaactactcagccataaataattttgcagctcgtgaagcccgtggtgagtatttggttttactcaataatgatacagcaataatcagtgaaaactggttagacgaactgttgaatcacgcacaacggcctgaggttgggatcgttggggccaaattactttatcctgatggtcgtgtacagcatgctggtgtaattctcggtttacgtggtccagctgagcatccttttattggcgaagctgcagacgcacctg

SEQ ID NO: 76922 - DNA, 1087 bp, Glycine max
  Peptide Sequence Number=SeqID_193700
atgtttgatccacgaagaaaccaacccacaatttcgtttccattgtccaatgaaataggacaaataactcatggttatgacacatggggtgccacaaacactgattttatggcatcaaagaaaccaccaaaaaattacaagaattgtcacagctacaacgacatggaagtgcaattgggaacaggatcaaaggtggatgataatgaatctggtatttgttcacctcctctatggactacaaatccaccaaagagtcctcatcaccgcaaaaactattataggtgcctttctcctgcttccaagactcaagccattgcaagaggccaaagggagctcatggaaatggttaagaacatgcctgagtcaagctatgagctttctctcaaagatcttgtggaacatccgagagttgaagttgcacaagagaaaggggcagaggagaggaaaaaattgggtaacaaaaatgtgggtaatagaaaaaaggttgatatgaataagaagggtcaagtgaagagaagtgggaacattgatagtggagggttttatctcaaaatggtgtttccaatttctttggggtttaaaaagaagactaaaaatgagtctttggtgaatagtggttctaacaaggtgtctcctagaacttcggtttctgatggatcaaagagccttgataaggagtggtggaagaagagcctttcagcttctggtggagagagtgatagtggtgtatcgagcattaatagtggaagcaagaagagttctggtagcagcaacagtagcagtagcagcagaagtaatagcaggatgaccttggccaacgtggactccgccaacgtgaactccaagatctcgcacgttggaccaagagttccatttgttaagagggaacatgcaacttgccacgtgtactttgtggaccttggacagtatacaagccccccaagctctaagtcggcttgtgagaaaaagaggttgtctagtgtcgaggcccccaaatgtggacaagtattgtctggtgctgatagtgttgtccaaggtggacatgctttggttttgcaagcgaggcctgacgtgtcaggtgggagag

SEQ ID NO: 76923 - DNA, 265 bp, Glycine max
  Peptide Sequence Number=SeqID_193701
gccaaacaactacctaaaaggaataattaacagtgctttgaaaggacttgacgatattccacaacctaaatccaaggctggtgctaggtggattgttgttaaatgtaatagacaaaaaggaagcactgagtgtggctattacgttatgcactggatgtccactataatcttaggaactttcaggaataattgggaaatgtattttaatgatgttagaccattggaagcagagagattgaaggcgcttcgcatccagtgggcatag

SEQ ID NO: 76924 - DNA, 414 bp, Glycine max
  Peptide Sequence Number=SeqID_193702
atgggcgacgacccggaagaactgatccgtgacctggaaaagcgttttccgcaggccaatctcatcggtgcggaccgcgatttcgaggatatggtcgccgaggtggtcggtttcgtcgaagcgccgcgcatcgggctcgacctgccgcttgatctgcaggggaccgcgttccagcaacgcgtctggcaggccttgcgagaaattccggtcggtaaaacagtaagttatacagaaattgccgagcgcatcggcgcaccgaaatcggtgcgtgcggtggcccaggcctgcgcggcgaacaagatcgcggtcgcggttccgtgccaccgcgtggtgcgcaacgatggcggcctttccggctatcgctggggtgtcgagcgcaagcgcgatctcctgaagcgggagggtcaggcatga

SEQ ID NO: 76925 - DNA, 159 bp, Glycine max
  Peptide Sequence Number=SeqID_193703
gatgaggggtgtgggacgcgtctgccctgccgcgtggcaccgctccaggaaggcatcatgggtgggcggaaaccggacatccgatcccagtctttcgctccaccgattggcgatgggagccagctgaaaatagagcttctggcgcagattccaaattaa

SEQ ID NO: 76926 - DNA, 225 bp, Glycine max
  Peptide Sequence Number=SeqID_193704
atgaagaatgtttttgggaatggtgttttgggcaaggatgaacattctcaccctgggtcaaggtttatggtgagttgggattttggctcaaggcttgtagaacggctggacatgatatatgtcaaggcgttgattttgttggaccttgtggcctcaataatcttaagagggataggcttagaatgcagaagaagcaacaacaatcaatttaacaatgttctttaa

SEQ ID NO: 76927 - DNA, 456 bp, Glycine max
  Peptide Sequence Number=SeqID_193705
tcattcggagttcccgtcacacctagtaaggtgatccaatcgccgatcacccgggccttcattgagaagtattgcacgcctaggcaagcgcagggcgatgcaccacaggccacagacgcaccaccaccacctcatcaggctgatcctgttgggtcattaggcatggagcggtatctacaacacttggttcaccagcaggcagctaaccaccgggggaaggtgcagatacatgagtgtctctaccagctcagcctcagtcagcagggccagggtttcgttccttttgcatgccctactccagatcagtttagggctgaggtcgcatggcccggagactggcccgaggcccaggcaggggaggcgcctgcagaggctcctagcgatgtagaagaggcccgcatggatgaggagatgacggatttgctcggtttcttgggagggagtggagccacatga

SEQ ID NO: 76928 - DNA, 162 bp, Glycine max
  Peptide Sequence Number=SeqID_193706
atggggttgtgggatgataatgagagtgtgtttttctttcgaaagatgcaaatgtttatagagttttcggttgaagtcttggaagtggttttcgaaatctcggaagtgattataagaaggttttggtgtctgctgggtaaggataagatgattgttaattaa

SEQ ID NO: 76929 - DNA, 318 bp, Glycine max
  Peptide Sequence Number=SeqID_193707
atgggtgagtttggggaactcatgctcactgtaattatttttcaatatttctgctgcaagggtttggtttgtgaaactcgtggtcactgtaaggtccgtttggggtgctcactttgcaatccatttagacagctcacaaggtctcatagcaaggcccaacaactagtgaatgtcaacattcatgtttgtaaggtattgtgcatggttgagaggtttgggactaggagagttccaatgggtttgcacaatgttgacattggtgatgttaaacactacgtgtctcttcaggctgaaacacctggaattatcaagtcctga

SEQ ID NO: 76930 - DNA, 855 bp, Glycine max
  Peptide Sequence Number=SeqID_193708
atgggttgctgcatcagcacacccaccaagcaaacccaaaaccaaaacaacaaaaccactcagaaaaaccaccaccatgaaccaccaccacccttggaagaagaatctgtgaaagaggtcctttcagagaccccaatttccaaacctcaccaagttccaattttgaagccagaaacgaagacccttttgcctctaattcaagacccacctccgaatttcgaagcaaacccaaaggctcctcccatagaagaagtctccgaggttatttctcagctttcagaaacatgcagcatcagcgacagcttctccgccgccacaaccgctaccaccgccaccgctacaaccaccactgtcacggttgctgataagagagaagaagacgaagcaaccagcaaaattcacaagtgggatcgatctccgtccaggaaaaggccctacgcccccggcggcaacctcgcctgcgggagagactggaggctaaaatcgccggcgatgcgcccggagccgtcgccggagaagaaaatcaagggcggttcgaggccaattcgagggagggaaattagggactccggtacggcggcgaatcggaagcgcaatgtgggccccgcctcgctccggggggacgccggcgagggttctggtcggaggtcgaggtcgccggcgtgtgccaggaatggtaaggtgggtgccggaggcaagcgaaaagagtttgctccggcgaaggtggtggcgaatgaggtggaaaagcagaagaatagtgagagtgaggaagttggggagaaaaacgacgtcgtttcgcaggaggagtgcctcgagaacccgcatgtttcgatggagtgctttatttttctgtag

SEQ ID NO: 76931 - DNA, 567 bp, Glycine max
  Peptide Sequence Number=SeqID_193709
atgggttttgaagccactactccaatggtggcaccctttggtagtaatactcagagaccagaccattggaagcattttgatgactcggtgaatgcagtgtcttttgggtttgttgccactgccatcctcatttctatgttccttcttctggctatctttgagaggtttcttaggcaaagatcaagtgaagccaacaatgttgcaactccaatggatcttgaacaccaaatgcacttaggtggaaagttggaaaatctatcatccaagataaatgtgactgatgcaagcgcaattacggtcacaaaaaaagtccaaaattttgacgacatggccaaaatcacgtgtaaggtaccgattttagtttctgttgaagttaatcagatgaccatttatggaagaggtgtcttagtgttgatgcctggagagcagattccttccttcattgcacttccttctccggcaccatgtagccgccagcccatgtcatggcctattcaagttcaacataactcatgcttccatgcacctttagcattaacgaggaactataatctaacaagtaactag

SEQ ID NO: 76932 - DNA, 477 bp, Glycine max
  Peptide Sequence Number=SeqID_193710
atgatgctttacggcatcatcaccgagcaagatggtgtcattgccatgagggattttgtggcaagggcagtgaagcggggaggcgacaacagagctatgggtgcgactgttttgagtttgggatggtggaaaacatccaagggaggcggagctgatgtgggtgctgttgttggtgggggttgtgcagaggaggaaggaactgacgtgggtgctgttggtggtggtggttgtgcggaggaggatgaaactgtcgtgagcggcgggggcagcggcggagttggcatggtcatgggtgtggtaagcgtgggtgacagagttggcttgaacggcgggggcagcgacgatggagaaaggcatccaatgaggattcgaggcggcgttgagcggtggcaaggttggccaaggcagcctcaaggcagtcctcgacagccatggatgctttgtttgacgagtggcagctatggaagacagccatga

SEQ ID NO: 76933 - DNA, 1715 bp, Glycine max
  Peptide Sequence Number=SeqID_193711
atggaacctattctcagctacaacaatggcaatggcaacaacagtgactatgatgtcatgaactggtttgaggatttatctcaaaacgctggttttgttcagactcagttgctgtgccagattctggagcagaactatggggtggaatatctcaagaaatggttggggagctacaacatccttgagatggatgcatgtgcattggaatcacttttctcttctgtggttccccttgcttcacatgctgattttgaaccatttatgcaacggattgcagatggggacacaactcctttactcactcaacaacccataaccactctttccttaagttctggaaccacagaggggaggcagaagttcgtaccatttacccgccatagtgcacaaaccacgcttcaaatattcaccttagctgcagcatatagatcaagggtttatccaataagggaaggtggaagggttcttgaattcatatacagcagcaacaggttcaaaacaaaaggaggtttaacagtaggaaccgctacaacacactactatgctagtgaagaattcaaaatcaagcagcacaagaccaagtcattcacttgtagccctcaagaagtgatttctggtggagactacaagcaatccacatattgtcaccttcttcttggcctatacttctctgaccaagttgagtttataacctcagcttttatctacagcatggtgcaagctttcaccacttttgaggaactttggagagaaatttgcaatgacataagagatggaactcttagctcaagaatcaagtcatccaaaatgagaaaggctgctttggatatcatctctccaagcccaaatttggcctcaaagttagaagattcttgcaaggagctagaaggggtggattggtttggtttgattccaaaactttggccaaatgcaaagtatgtttattccataatgacagggtccatgcaaccatatttgaaaaaacttaggcactatgcaaatgggttgcctttggttagtgctgaatatggctcaactgagagctggataggggttaatgttgaccctagtttgccaccagaagatgtaacatttgctgtggttcccactttctcttactttgagttcattccacttcacaggcatgaaaaaaaattgagttcaggaggtgatgatttcatggaagataagccaattccactgtctcagatcaaagttggacaagaatatgaagtagtcctcacaactttcacgggactgtacaggtgcaggttaggggatgtggtggaagtagccagcttccacaatgggatcccaaagttgaactttgtgtgcagaagaaagttaattctgacagtaaatatagacaagaacacagaaaaggaccttcagctagtggtagagagagggtctcatattctgaacaaggcaagtagagctgagctaattgatttcacaagctatgcagatgtctcaaaccaaccgggtcactacgtaatttactgggagatcaaaggagaagttgaggacaatgttcttggtgcatgctgcaacgaaatggacaagtcttttgcggatcatggctatgttgtgtcaaggaaaaccaactcgataggacccttggagctttgcgttttggagagtgggactttcaagaagatcttggacaacttcattgctaatggggcagcacttagccaattcaagacacccag

SEQ ID NO: 76934 - DNA, 789 bp, Glycine max
  Peptide Sequence Number=SeqID_193712
atggtggcactcactgtcttcaaaatcctcactgccttggtgtcatgtgcaactaccataaccctcctcacattgatccctatgctgttgaaagtgaaggttagagaattgatgctgaagaaaaaaacatgggatcttgggagggaggttggcatcataatgagacagaaggaggctgcaatgcatgtgaggatgcttactcaagagattcgcaagtcgttggataggcataagattctctacaccaccttggttgagctgtctaagacacttggtttgcagaattgtgcagtgtggatgccgaatgttgagaaaaccgagatgaaccttacgcatgaattgaatgggaggaacgttaactgttctatacccattactaatccagatgttgtgagaattaagggaagtgatgaagtgaacataattgattctgattcagtacttgccactaccagcagtggaatttctggtggggcaggaccagttgctgcaatccgaatgccgatgcttcgtgtttgcaatttcaaagggggaacgccggaactaaggcagacgtgttatgccatattggttttgattcttcccagtgaggagcctagatcgtggagcgctcaagagatggagatcattaaggtggttgctgatcaggtggctgtggctctgtctcacgcctccattcttgaagagtctcagctcatgagggagaagttggaggagcaaaatcgagctttgcaagtggagaagatgaatgctatgatggcgagccaggcgagagcttcctttcagaag

SEQ ID NO: 76935 - DNA, 159 bp, Glycine max
  Peptide Sequence Number=SeqID_193713
atggtccatgacatcttcgtcaaggtgaaactggaagtaacagggacatcgacagccctaaatgtgtttggcagtagacgaagcagcgataaatgggtttatgatcccaacatggttggctcatggtacctaacacatgcaactaagaatgcatcatga

SEQ ID NO: 76936 - DNA, 273 bp, Glycine max
  Peptide Sequence Number=SeqID_193714
atgaagaaactggaaggtagtgaatcatcaacagatggaaaaacgctttatgtttttaatctagatgatagaatcaactcagacgacaaagtttttgagaaaggagttaaattggttgttgacaacatatcatacgattttgtaaaaggggcgactgttgattatgttgaggagctaatccgttcagcttttgtggactttattattgtggtaacaactagggaggaaagtttctttgtgcatgtttgggaattgatggcttttgaggaataa

SEQ ID NO: 76937 - DNA, 180 bp, Glycine max
  Peptide Sequence Number=SeqID_193715
atggataatgttgatatctttgtccctcatcctctcacaaacacatctttgcttattcaacttccaccggaatgtgagtacgttcatgtgacctcattttatcattccggaaagtttgtcttcttagagaagcgagttgtcaagaataggatgttggacaaatggcctcagttatcttaa

SEQ ID NO: 76938 - DNA, 426 bp, Glycine max
  Peptide Sequence Number=SeqID_193716
atgaatctaagagggagacaagtagagataagtgacccaatgtgcccgttatgcaacaattcggaggaggttgcagcacaccttttcttcaattgcagtaaggtcttccccttgtggtgggagtcactctcatgggttaattcagtgggtgctttctcgaaagaacagaaagatcatttcatgcagcatagcagaaggaatgctacacaaacaaaagatataagatggagctattggtggatagccctcacaaggaccatatggaaacatagaaataaggtggtctttgataaccaaacttttaatgcaagcaagctgatggatgaagcacttcttctagtctggtcctggcttaaagctatggagaaagatttcgatacacattttaatcagtggtcttccaatttgacagatgcctttgtgtaa

SEQ ID NO: 76939 - DNA, 579 bp, Glycine max
  Peptide Sequence Number=SeqID_193717
atgtcgctgctgaaacttgatggcgggaccggcgaatccaacggcgtcgtcccgatcgctggcgaccctgaggtatgccggacagttgacattaatatggtaatttccggaaacccaagttccaaccttccacttcactcttccgctgactttgacgttaaccagaattcctccggaggttctgtcctgctggaggatctggagagtgaaagaggagacggggacggcggaggcgtagaggtagggggaccagacggcggtttctcggtggccctggtaggtggcggggagggaggtggcgatggagagctgctggccgcggtaggcggagtaggtgtcaagtttggtgtagatgactccgatgcggtggttggggttgaaggaagcgagggtgacttgcaaggtgagggtgagggtgttgggggttggattgatgggggaaggggtggggccggaggaggagaggttgaaggcgtagacggtggcgtcttggaggatgaagaggggtttggtggggcggaggatgatccagatgaggaagatgaggaggaggatggagccgaggatcgccgcgaatag

SEQ ID NO: 76940 - DNA, 247 bp, Glycine max
  Peptide Sequence Number=SeqID_193718
attcgatgacgagtcttgtgaaggtactaataccgaggaccctgccgttgattttgaacgagaagcaaataggcttgaggttgaagaagatgaaggtatggaattccccgccgagctagaaatgatggttgctcaggaaggccgagagatgaagccgcaccaagaagaaacggaagtcgtaaacttagatgttgacaatgagaagaaagaggtaaaagtgggtacgggcatgaccacaccaatctga

SEQ ID NO: 76941 - DNA, 306 bp, Glycine max
  Peptide Sequence Number=SeqID_193719
atgttttctcttgttcctgaacttgcggataggttattgatgggattggatgatagtgcaagggggtggcggtggaagaatgaagaagatgaaccagtttgggcggcggcggggccaggggtgaattgggggctagattgtgaaggaggaggaggggagggaggaggcggcagggacactgttggtggcggtggccacagtggagagcggtggcggcattgggcggcgtggggagaggaagcattaacagctaacgtagactccctatgtctccttccgtgttgcaatagcaccccatacccataa

SEQ ID NO: 76942 - DNA, 156 bp, Glycine max
  Peptide Sequence Number=SeqID_193720
atggatacgaaaaatttcaagcccagacaagtatcaaaggaaataggaaaaaaaaggttaatgccaccctttttcactgtggcaaataagctttactctgtgatgttcagggctccaaacatactaaggaagaaaaacgtagacgacaaaagttga

SEQ ID NO: 76943 - DNA, 186 bp, Glycine max
  Peptide Sequence Number=SeqID_193721
atggtaatcgattacagctttgtaaatcaatttgaaaaacaatgctggctactggcattgtttccatatcctgaggatcagactacaccagtcttgtctccgaacacctctcttacagctacacctatgcttcacttaacaggcgaggaggatgttcaaacacaagatactcaggatcgatcatag

SEQ ID NO: 76944 - DNA, 390 bp, Glycine max
  Peptide Sequence Number=SeqID_193722
atgcataaggcattacgtgccaatgcacctcttccatatcctcaattggtcaccctctttctccgtcattttcaaatttctcttgatgatgaaccttttgttcaagtcaagcgttcctttgctataggtgctggtgctgtcacttcatttggttaccgtaaggatcacaatggtcaatggctgaagaaagatgcactccctccacaagacaagcatactccttctcctcctcctcagcgagatgattcagcccttatgactgaagttctttcagagttacggggtcttcgcacttatgtaggaatggatatccgtctcatgcagcttgaagaggatgtgggttatattcatcagagcttcgatcttccaccaccaccaccaccctcttag

SEQ ID NO: 76945 - DNA, 859 bp, Glycine max
  Peptide Sequence Number=SeqID_193723
atggcgtcactcctacaccttcccatcactggcgcgctgcatacgttcgagccgcttgtcacttcagacgccattggtctactgacggagcttcttgagggccagacgatgggttgtagcagcccgcacgtatctgctccacttggtgggttgtactgttttcaccaacaagagttcaacccatgtacatgtcgtgcacctaaaggctttcagggacctggcccagctgcattagtccacatgtacgaccatctgaatgacgcgtcgctggcctctacacggcagttgggcggttatattacacttctccattgctggatatacgagcactttcctacagtgcatacatccgtcgttcatgatgcttatgatgaagggagcccacatgcttgcaggtggcttacaggtaaggctcatatgatgaggatcaagggagcctcgtatcggagacgtttggatgcactgagtgtgactgacattgtggtgtacgttcgacctgagcgggttcttcgacagtttggctaccttcagacggtccctccgccgtcggtggcgccagactacatggagtggttttttcggatatcgcacccattcgtcacgcggaccgaggagacagctgtgcggagacatccgcctccccctcatcatgaggagttcgtcgagccacccatctccgaggtttcagttgcgaccgatctccctacacattcagtggttcactgcgaaggatgtcaggggatggctcaggatttaggagcgattgctgaggatttggagcgggtcatcaacctcaggatggtcactgagggcactgacttacatgacatcatgactcgttgtctaaggagagctagag

SEQ ID NO: 76946 - DNA, 345 bp, Glycine max
  Peptide Sequence Number=SeqID_193724
atgtcgcgaaacttcacggattgcttaacgatgggtgtcaagttcctcgaagcggtcaagcgaaggttgcataccattaaacaatggtcctcagacgaaattagggttctaaagagaaatcttggtcagcacaagtttgcatgccctcttaagctaatgctcaccgttgtgattatatttatgaacctagtgctcgggtgtggttgtgatagcaacaatacaaatgcaatcctccctaggaagggaccagtcactagagccatgagcaagaggctccaagaggattgggctagagctgctgaagaaggccccagggttctcatgaaccacagggtagatttctga

SEQ ID NO: 76947 - DNA, 240 bp, Glycine max
  Peptide Sequence Number=SeqID_193725
atgtcgggaggaaaatgtgagtcgcgactttacaacgaccgatgtcggaaatgttcgatcggcgtcatccggcgattcttcctttttaaacctcgatcgttgatctttcctcatccacgtcggctagcatttttgtcgatcagtatcggtgaatcaagtttccttccgaggtgggctaatgttgtcgttgccgagcaaatgaaaacatgccggtgtcgatcgaaccacaacttcggttga

SEQ ID NO: 76948 - DNA, 848 bp, Glycine max
  Peptide Sequence Number=SeqID_193726
ggctgggcgtcctcacctttagaggactacacgtcctcgccttcagagggctgcatgtcctctccatcagaaggctgcacgtcctcaccttcagagggctgcacgtcctcaccttcagagggctgcatgtcctcaccatcagagggttgcacgtcctcacctttagagggctgcatgtcctcaccttcagagggctccacgtcctcaccttcagaggactagacgtcgtcgccttcagagggttgcacgtcctcaccttcagagggctgcacgtcctcacctttagaagactagatgtcctcgcctttagaggactagacgtccttgtctttggagggttgcatgccctcatcttcagagggatgcacgtcctcaccatcagagggctgcacgtcctcaccttcagagggctgcacgtcctcaccttcagagggctgcacgtcctcgcctttagaggactacacgtcctcacctttagagggttgcacaccctcgcctttagaggaccaggcgttctcgcctttagaggactagacgtcctcgtcttcagagggctacatgccctcaccttcagaggactacacgtcctcgcctttagaggactacatgtcctcgccttcagaggactacacgtcctcgccttcagagggccacacgccctcgccttcagaagactacctatcctcgccttcaaaggactacacgtcctcgccatcagagggctgcacactctcgccttcagagggctgcacacccatgccttcagagggatgcacgcccttgcctttagaggcgtacacatcctcactttcagagggctccacatttgcgccttaagagaatttaag

SEQ ID NO: 76949 - DNA, 402 bp, Glycine max
  Peptide Sequence Number=SeqID_193727
atgttaggattcacaagtgattctcctcaattttcagccaacccgcatcaattagactttgcaccttacgcttcaaggccctacaatgctcaatggaatgccccggggctcctccatgataagcacgcatgggggttgaggaaacctagcagggggatggcctttgtggataattgggtggtaggtaaggagaagggttgttatttgctatgtaatgacattgttgagctggtgggggagttcccatgtagaaacagcagtcgcaggatgggtttctctttcattctcaccctcttcatttgccccaattttctcattcgtccaagcaggatgattaaattttcctcttttcagatccgcttcgaccctttccccggcgaagaccaaatccgcaaagcttga

SEQ ID NO: 76950 - DNA, 542 bp, Glycine max
  Peptide Sequence Number=SeqID_193728
atggataggttgacgaccatgatgaatgcactcctgtcagcccagaactctcaagctgccgccgctgctgtagagcagcctttggtgagcacaaccccgctatctacagtgacttctccacccctctttctgcctccaggttgtacatggggaatgccacctccggtctgtggaagcccccaacccgccgtatctgaagttccacttcctttcgctcagcagtcagcaccggttccgcaacccggtacctctttccctcaagctgcaatgacctattcagcaccactgatccacactattcaacaagaggttgagccaattttccaagctgaaaatgttgtagccttcgacaagatggaagaactccaagaaagatttgatggtatgcaaagagaagtcgaagccctccgaggaagagatctgttcgggaaggacgcctgtgaattatgcttggtcccaaatgttactatccctcacaagttcaaggtgccagacttcgagaagtataaagggaactcctgtccccgcagccacttggtgat

SEQ ID NO: 76951 - DNA, 141 bp, Glycine max
  Peptide Sequence Number=SeqID_193729
atgacaacctcacaatcactcacagacttagctcaagctctcaagacgacttcctcttcaagttttgttctctatgaatcaagatggattcaaggatttttgatgatgacaaaaagctcaaaagtcaagatcacctcatga

SEQ ID NO: 76952 - DNA, 735 bp, Glycine max
  Peptide Sequence Number=SeqID_193730
atggttggtccctcaggtcctcgtgtcagcacaaaggagtgttgtgttgatccctcaaggaacgatcttgagacggcaaatcctccccgcctggttaccctaggaatagtttataagggatcaacaattcacaacattcctttgttgcctggccaagtgaaggttggtgttgaggaggttaaagatgcacaagctcccgttcttgtacccactgatgaggttaccttagtggggcagacacttaacaccttccttgcttggccgacacatctcgtgaagcctttatcagaacatggtaattatttaactatgtttgatcagcatgcagctgtttctccaacaaaacctccacaaaggccggatcctgcggtcgatgatccgctatatctgatgacattgactatcccagagcttttcttgaagcccttccaggttaactgggatgctaccatgttcggtgtgtttaatccacacttcccattgtacataaagcacgaagatctctctggaattgcacacagtggtcaatgtctgagcacatttgtcatacagttgtggattttgcatctgactgaaacaagtatgcgagcggggaattccgatgtgtatggattcctcaagccacagtctattcagagatctgggcaatcacaattttgctccgaaagttacatcaagagttggatgcagagttcaaaacgcgatgtataccttggagcctacttaaatgggtaa

SEQ ID NO: 76953 - DNA, 273 bp, Glycine max
  Peptide Sequence Number=SeqID_193731
atgaagtacagagcgtttgtttctggtttttggatactgccactctttcacggtgaaattcaagctcgttttcctttcaactcaaaatccctaatcatcaacacgaagggtttgtggaccaaaacgctgcgtttccatttcactcacaatctcaagctaacccagctctatcttatggcgtatcaggtagagataatgcaggaaatttccatcattgcttcaaaaggattagcagaagtcatgttttcgagtcctttcaaggagaaccattga

SEQ ID NO: 76954 - DNA, 441 bp, Glycine max
  Peptide Sequence Number=SeqID_193732
atggccttggaagattcagtgtctcatcacttcaatcttaatgacctggggcttcctgttactgatttgaatacccctagtatggctcctgtttctattcaccgggatgatatactggtcattgctttaattgactatcatttatcgatgcaggttgtccttacttgtttcaagtctatgacttggatcatctcaaataagaattcaagctcatccagtaaaattgcagtcatcaacatgaagcttcaagattatggtaagggccctttaggagagacagaagtgcaattcagggtgacaagggtcactttggagcctatgttgaggtctatgacttacatcagtcaacagctaaatgcaccagtcaatagagttgctatcatcaatctgaggaaagatgttctgtcaatgaccaactaccctaaacccttgaatttctaa

SEQ ID NO: 76955 - DNA, 1161 bp, Glycine max
  Peptide Sequence Number=SeqID_193733
atgaccaccgctgaagagtgtaaaaggggtaagggcttcctgggtcttacagggtactaccgggagtttattagagattatggcaagagggctagatctctatcagaattgactaaggaggaatggtttaagtggactccaagggcacaagaggcgtttgattggctcaagcaacagttgacaactgctcttgtattggctctaccgatttcacacaagaattcgtcatcgagaggtcaccacgatggatcaacagaattgggtggccaaactattggggtgcagccattggtccaccagccagcgtgggagggcatccaagaagccattgaggaggtgcatagtgatgagaagttgttggctattatcgatgcattgagacaaggtagagagtccaagccagtgtttacttacaagaaggggactttgttttatgaaggacgtttggtgctgtcctctacgtcatcatggattcccaaaatgttaaaggaattccatgagacacctcaaggaggacactcggggatggtgcagcaatttgtgatgggctgtgatattggtctacgaagaaagtacttggcagcagctcctgggggctatcttggtagtggtggatcgactttccaacctccatacttaagtgaccgagacccaatttttgtcaactcctttttggctggagctgttcaagttgcaatggactcatctcaaaatgagtacagcatatcatccccaaacggatggccaaacagaggtggtcaatcactgtttggagacattctcgcgccaccagtgcttagtcgtttcctgtccgaggtgtgcgtggaagcagtgacgagaaagctgaatgatatagatgaagctctccgtcaattgaaataccaacttcaggtggccgctgtagcttacaaattgcgattgcctgaggctgctaggatctgtcctgttttccatgtgtcattgttgaagaaagtggtgggcgagcatagtgttgaggagactcttccttccgaattggctagtgacaataccatgacaccagaacctaaggcaggacttaaggaagcaacctgggaagaagagttcaacatcaaaagtcaatttcctcagttgcgacttgaggacaagtctccttttgaacttttgaaggaggggtattga

SEQ ID NO: 76956 - DNA, 450 bp, Glycine max
  Peptide Sequence Number=SeqID_193734
atgaaggtgagagtaaggatcaatggggttcctgccctcatgttggtggacagtggagctacgcacaactttgtctcccggaagttggtcaaagccatggggtggcctgtggtagcaagcaaagtcatgcaaaccaaatcgggagatggatataaagctcatgctcaaggaatgtgcaaaggagtcaccttggagacggattcgctgcagtttatagtggacacggtgttatttgatttggagggtattgacttgattttgggggttgcttggttggtccctttgggggaaatgcaagtggattgggttgctggggacagtaccactgtgggaaaaagggagcaagagttacagaatttgctgcaaggatttgaggaggtattcaaagaacctcacggactacccctaaggaggagcaaggagcatgccatcaccttgttggaaggttag

SEQ ID NO: 76957 - DNA, 156 bp, Glycine max
  Peptide Sequence Number=SeqID_193735
atggctgttggactcgccgacaatgtgggagaaggaagttcctatccttcgctgttcgcgcggcccattgccttcaacaatgtcgccttgaacatttttgtcaatggagacctcatcggtcgtcactgggcgagagtcggaacacaacacatttga

SEQ ID NO: 76958 - DNA, 199 bp, Glycine max
  Peptide Sequence Number=SeqID_193736
atggaggaagagagaagaaaaagaaacctctcctctctctatggccgatggcaccaagcacaagggaaaggggggggtggaagtggtggcctgccaggcgctaccactagtggtggggcccctggcgcgaccactagtggtagcctgtcaggcgcgtccactagtgctgagttgaaacgtgttgaagcgctttataccg

SEQ ID NO: 76959 - DNA, 381 bp, Glycine max
  Peptide Sequence Number=SeqID_193737
atggaggctaaggttccagcactggagaaggaggttgtgggactcaaaaccactatgcaaagtatgcagctcaaggctaaggagaatcatgagaggttgattgcgttgctgtccaaaacaagtatggaagatggttctgctatgaaaacctcatcacagttccctaaaggagtgttggaggaatttcgtcaattggtgaagaacgtcgaattaccaatgttcagcattgaagaccccgcaggatggattgttcgtgctgaggtatgtttccaagtccaggagagttgtcctcacgtgaaggaaggcatcaaaggccgtgcccatagtatgtgcaccctgggaccatcaccgcgctcaaggatgatgaacctcgacagggcg

SEQ ID NO: 76960 - DNA, 138 bp, Glycine max
  Peptide Sequence Number=SeqID_193738
atgtcttgcatgaatgggcgagcattcgctaagcacgacactcagtggctaagcgcaaggaagaatccagaagaagatgagctatcaggttcgctgagcgcaccgctccaggtcatcaagcttcagctcatccgctaa

SEQ ID NO: 76961 - DNA, 466 bp, Glycine max
  Peptide Sequence Number=SeqID_193739
atgcctttcagcggaaccacacctagtttatcttcttatttcatagtaccttcttatcatgcttatcttgagttcttctggaaccttagcttttaccttttttacaaacccccaacaagaaagaaccacaacttacgaaccagcatgagtcatcattcatgtagtgttaatggcgagggaaggcataggtcaaatcttagacctcactcccataggagagaaaaggaaagaaagcctcaagagactaacattaacctcccatacttccatgggaaggacaatgtagaggctaacttagattggaaaataagggtagagaaacaacttaaaaggaagtctacttcaaaatcttatggctctaactcttatccaaagaaataccaaggtcaaggcatcttaggggtgacaccttctaagcccaaagatgataaggggaagacaatagaaaagcaaccccttaaggcta

SEQ ID NO: 76962 - DNA, 273 bp, Glycine max
  Peptide Sequence Number=SeqID_193740
atgcgtctaccggggaaggagagtctgctgatgaaatctcccataaccataaatgagattttggatgttagcatttcgtttctaaatgatcatttagaggaaacactgggttcgacaaaaatagaagaaatccactcaaagtgtatcaatctcgcacaggtttatggtgagtcaggattttggctcaaggcttgtagaatggctagacatgatacatgtcagggtttggtttggttcaaggataaaaagggatgccccacattatttccatga

SEQ ID NO: 76963 - DNA, 726 bp, Glycine max
  Peptide Sequence Number=SeqID_193741
atggtcgacaacaatgtgaactggattctagataccggtgcttctaaacacttatgcgccaacaaagagctttttcaccagattgaggatgctgatgacggagaatgtgttttcatgggaaattcaactacagctggagtgcttggtaaaggaaagattctccttaaacttacttctggaaaaacattatctttgagtgatgtattgacatgtgaacatggtagactaggacatgtgaatgtgaattctatcaagaagcttagaaatatgaatctaattaatgtgctagatataaataacttttctaagtgtcctatatgtgtggaagctaagtatgcaaagaagccttttaaacctgtcaaaaatagaactacggaactgcttgaattaattcacacggatttggctgacttcaaaacacaatatgccaaagtttatcttctaaggacaaaagatgaggctgaagaaatgtttttaaaacataaggcagaagttgaaaaccaattagatcgtaaaattaaaagacttaggtctgataggggtggtgaatatggaactatttttcttgagaatttttgtgaaaagaatgggattatccatgaaactagtgccccttatactcctcaacaaaatggcatagcggaaagaaaatatagaacacttaaagaaatgatgaacgctatgttattaagttctggtagctctaccagatatcaagaggactaa

SEQ ID NO: 76964 - DNA, 414 bp, Glycine max
  Peptide Sequence Number=SeqID_193742
atggggacgaggggttgcatcagctataatctcgttcttgctataagacaacttggctaccctatgagaggggcgccgctagaggatgagcttgcgcctgtcatttcacgaggcttcaataagaccaacgtggagacacttcagaaggtccgcaaggcatgggaggtgttgcaaaagaaggacaaggaactcaggggaagtaacaatgggcccatcggtggctatcgtaagtggttaaaagcccacgtgcaaggtttggattggcttccaagtttgagaaccgctaaaagagaggaagttgaggcaccggaggaagacgaagaagtgcaggcccttagggaagaactcgagcaagcccaaacagttaaagaaaggttcaaatcagaagctctgaaaatccgaaaagagatgtaa

SEQ ID NO: 76965 - DNA, 423 bp, Glycine max
  Peptide Sequence Number=SeqID_193743
atggcagctatcatgcattcctatggagtggtgaaggcgctagagagagagacaatgacagaaaaggagaacacaacgtgcacgttggttcaattatcgcaaaacaaggaagaagagaaggcaacaatagggaaggtgggagtgattacacatctggtgaagcttctagaaggaaggggattgcgcgggaagaaagccacagtgattgcgttgtacgcaccgtgcttgcttctaaaaaaatggggattatgcaggaagaaggactcgacgattgtgcggtacgtgctatgttcagcggcgaaggagaataaggtgaatgtgggggttatgagggcgttggtcgagtatggtgtacttggtgagcgtcgtggtggcgatggtggaagggagggcggagctggtaaaaaagcctctctattataa

SEQ ID NO: 76966 - DNA, 852 bp, Glycine max
  Peptide Sequence Number=SeqID_193744
atggtattgacacttaagacgtactttaatagtataataaaagtaaaaggaaatttaatagatgatgaagccttacaatttgtggtagttgaaggtcgccaggatgtagcaaaagtggtgggtgaaagatatggtgtggagaggtttcccttctgtattgacatgctaatcctttttttggttgttgttggagaggagatagagcatgtaagagtgatcactttgaacaggccaaggcaattgaatgccatctcaccagaattggtttctctgctagcaacatatttggaaaagtgggagaaggatgaggaagcagagctagttatcataaagggatctggtagggctttttgcgctggaggggatttgagagtgttctatgacggcaggaaaataaaggatgcctgtcttgaagtggtctacagattttactggctttgctatcacattagtacctataagaaaacccaggttgcgcttgttcatggaatttcaatgggtggaggtgcagctttgatggtcccattgaagttctcagttgtaacagaaaaaactgtttttgccactcctgaagcaagttttggatttcatattgattgtggcttctcatactaccactctcgtttaccagggcatttaggagaatacttggcacttactggaggaaggttgagtgggaaggaaatagttgctgctggactggcaacccattttgtcccttttgagaaaattgttgagctagagaaccgccttattagcttgaattctggtgatgagaatgccgtaagatcagtaattgaagaattctcttcagaagtcaaacttgatgaagagagtatcttaaacaagtaa

SEQ ID NO: 76967 - DNA, 2514 bp, Glycine max
  Peptide Sequence Number=SeqID_193745
atggccaacgtctccgtcgcggcggagtggcagctcctctacaaccgctactaccgcaagccagagctctaccctatgccgtggaagcacgtggacctcgcccggaccaaggtcgccgccgcgcccttcggcggccccgtcgccgtcatccgcgatgactcaaagatcgtccagctccacgccgagtccgctctccgcaagctccgcctcttctcctcctccggccgccccctcgccgacgccgtatggcgccaccccggcggccgcctcgtcggcatgtcctggaccgacgatcaaactcttctctgcgtcgtccaggacggcaccgtttaccgctacgacgtccacgcgaacctaatcgaaccaaacctctccctcgggaaagagtgcttcgaagacaacgttgcggattgcgcgttttgggggcacggtttggtctgcatcaccgaggcgaatcagttgttctgtattgctgatttcaggaaccctagcgcggtgaagctcgcggatcccgggatcgacgagatgccgcattgtatggccgtgattgagccgcagtacacggtttcggggaatgtcgaggttctgctcggcgtggatgatgctgtggtgctcgctgtggaggaggatggcgtgcagaggcttggagagggattgttgcgggggccgctgcagaagatggtggtttcgcgcgacggcaagtggctcgcttcgtttacccatgatgggaggctcttggtgacgacttcggacttgactggagttatcatcgagagggattgcgagtcagctcttcctccgcagcagattgcttggtgtggaatggatgctgtgctgctgtactgggatgatatgcttttaatgatgggtcctgagggagagccagttcactacctttttgatgaaccaataattcttatacctgagtgtgatggagtgaggatattgtccaatactagtatggaatttctacagcgggtgcctgattccaccgtttcgatcttcacaattggaagtacatcacctgctgctttactatatgatgccttggatcattttgataggcgaagtgccaaggcagatgaaaatttgagattgataagatcatcccttcctgaggctgttgaagcatgtgttgatgctgcaggtcatgaatttgatgtttcacgccagcaaactctcctaagggcagccagttatgggcaagccttttgtagcaattttcaacgtgatcgtatccaagagatgtgtaaaattctgcgggtcttgaatgcagtgcgcagccctgagattggcattcctcttagtattcagcaatacaagttgcttacaccatctgttctgattggtcgcctgattaatgctcaccaacatctgcttgcactgaaagtatcagaatatcttggaatgaatcaagaggtggtgataatgcactgggcatgttcaaagataactgcttcactggcaattcctgatgtgactcttctggagattctgctggataagttaaaactgtgcaaaggcatttcctatgcagcagttgctgctcatgcagacaaaaatgaccgacgaaagttagctgccttgcttgttgaacacgagcctcgttcatcgaaacaggttcctctcctgttaagcattggagaagaagatatagccttgataaaggcgaccgaatgtggtgatacagatcttgtttaccttgtactttttcatatttggcaaaagaggcaaccattggagttctttggcactatacaggcgagaccattggcacgggacttatttgtaacttatgcacggtatgtggccttggaccatattccagaaggcaagacagatgtggcatttcttttgtggaaagaatcatgggaacttgggaaaaatcccatggcaagcaaaggatctccacttcatggtcctcgaataaaacttattgagaaggcacatggtctttttgctgaaaccaaggagcatacctttgaatcaaaggcagctgaagagcatgcaaaactgttaagaattcagcatgaacttgaagtgactacaaagcaagccatttttgtggattctagtataagtgatacaatccgtacttgtattgtcttgggaaataatcgagctgcaatgaaagtgaaaacggaatttaaggtgtctgagaagagatggtattggcttaaagtttttgcattagctacaatcaaggattgggttgccctagagaaattttcaaaggagaagaaacctccaattggttataggccatttgtggaggcatgcattgaagcagacgaaaagggagaagctattaaatatatcccaaaacttgcagaccctcgagaaagagctgagtcatatgctcgaattggtatggccaaggaagctgccgatgctgcttcacaggcaaaagatggtgaattacttggtcggttgaaattgacttttgcacaaaatgcagcagcttcatcaatatttgatactcttcgagatcggttgtctttccaaggtgcttaa

SEQ ID NO: 76968 - DNA, 177 bp, Glycine max
  Peptide Sequence Number=SeqID_193746
atgggaaagggaagagggagtttcaccagtaccaggttgtgggggagagctcttcccactgaaactgatgtgcatcctaagatatacaggatgaagctgtgggccaccaatgaggtacttcttgagaaagctaaagaaggtaaagaaaagcaatgggcaaatgttagccatcaatga

SEQ ID NO: 76969 - DNA, 306 bp, Glycine max
  Peptide Sequence Number=SeqID_193747
atgggagttcaagctgcacgatacttatacaatgagagtttgggatatgaagtccttgatcctgtcgtgacttcacaccaatcaagagatatactaactaaacttcgtaccccattgcccagaggctcttcgctatgcaaaggtatgggggagggatgttgtacgcagccttacccttgcatatgcaaagaggctatttccggattcgaacccatgaccaacaggtcaccaaggcacaactttaccgctgcaccagggctcgccctcaagagatatactaacaatataggaaaattaaacttttga

SEQ ID NO: 76970 - DNA, 324 bp, Glycine max
  Peptide Sequence Number=SeqID_193748
atgggattcattgtgcaccccaaagaggaaaggaggatttggtctcagaaaagcgagtttggtgaaccaatacctctccttatgaaggctgggtggaacctctgtacgaaacccaatgacatatgggttaaagaagtttgtgcaaaataccaatgcgataatgatatttttcctgttgttgatcaacgtagacctggaagttggcttattcaatccaaccatgaggataatatcttggtgtgcttctatgtcaatgctaatgccgcatgggatatgaggagaatatcaaatgaacttccattgaatattgctcatagtatttaa

SEQ ID NO: 76971 - DNA, 216 bp, Glycine max
  Peptide Sequence Number=SeqID_193749
atggcatggttggcggcacgagcacaagcacgagcacgaccagatcgagcgcagatttgtgatggcatggttggcggcatgagcacggatttgcggttgcaaccaagaatgacggcggatctgcagtggtgcagtgacgtggtggcggccaacaccgttgaacgcgagcagggactgccaaacgtggatttgtgtgttgtggtgtgtttttactaa

SEQ ID NO: 76972 - DNA, 1230 bp, Glycine max
  Peptide Sequence Number=SeqID_193750
atggttttgagggtttctctgattctggttctccttgtgttacactgttcctgcactgtggaatccatttgggggcatcacaatgatctcaacaagaatggatcttctcttgctgcagtcaagtttcctgatcatgcacacttcaatgctgtttcttcttccacagaaactgggtgtagtttctccaagtcagagaaatttgagccttcagttgctaccatggcatcaaatgaagacactgatggtaaagagggagaggcttttgtggcagcaaaacagcacaagcaatctgtgaaactcaatttgagacaccactcagtgagcaaagattcggagcctaaaaaatctgtggttgattccacagggagagacttgaagagaattcagacccttcacagaagggtcatagagaagaagaaccaaaacacaatttcaaggttggagaaagcacaggagcactcaaagaagtcctataagccaccgacagtggctgcggcggccccgccggagtatttatccggtcagcttatggcaaccttggagtcaggggtcagtcttggctctggtgagtacttcatggatgtgtttgttggcacaccccctaagcatttttctctaattcttgatactggtagtgaccttaattggattcaatgtgttccttgttatgcttgttttgagcaaaatggaccatattatgatcccaaagattctagttcttttaagaatataacttgccgtgatccaaggtgccaattggtgtcatccccagaccctcctcagccttgcaaaggtgagactcaaagctgtccatatttctattggtatggagatagttccaacacaacgggtgattttgcacttgaaacattcactgtgaatctcaccacacctgagggaaagcctgaactcaagattgttgagaatgttatgtttggttgtggtcattggaatagaggactttttcatggtgctgctggattgctagggttggggagaggcccattgtcatttgctactcagcttcaatctctctatggtcactccttttcctattgccttgtggataggaacagcaattcaagtgttagtagcaagttgatatttggtgaggacaaggagcttctcagccaccccaatttgaatttcacttcttttgttggtggcaaagagaaccctgttgacacattttactatgtccagataaagtccatcatggttggtggtgag

SEQ ID NO: 76973 - DNA, 312 bp, Glycine max
  Peptide Sequence Number=SeqID_193751
atgggtgccaagtacctcgaagtggtcaaacgagggtcgtatcccaacaacggatggtccctggacaaaattaggactaagaagaaggatgaagacaaaggaaatgtgataaagggtcctatgagactgagaaaggaagaaggacttcaaatgcgcgtcacgactaatgtcgacagtgttgttgcaatgcctcgagaggttccaatgccatcgatgaccgagttacagtgccacgagaggttgcaaattagagtgccaaagcgttcgagtaagagtggtcagaatgagagtgagaggattcaaagttactga

SEQ ID NO: 76974 - DNA, 582 bp, Glycine max
  Peptide Sequence Number=SeqID_193752
atggatgtaaagacagcttttcttaatggtgacttgagagaggaaatttatgtggaacaacctaagggctatgtgattcaaggtcaagagaacaaagtgtggagtgttatgtttctcatgaattgtactagacctgacatagcatatgctgtgagtagactaagcagatatactcacaatccaggtggaggtgccatatcatggaagtcttccaagcaaacttgtatagcacgttcaactatggaatcagaatccattgctcttgatttagcaggtcaagaagctgaatggttgagaaacttgttggcagatgtgccattgtgggggaaacggtctataccagtttctcttcattgtgactctgaagcagctattggaattgctaagaacaatgtttataatggaaaaaggagacacatacgcattagacacagttcagtcagagaattgttaaaaaatggtgtgatctcattacagtttgttagatcagagaacaacttggtagatccgttcactaaaggtctaacaaagaaagttgtacttgaatcgtcgagggggatggggcttaagcctttgtgttga

SEQ ID NO: 76975 - DNA, 156 bp, Glycine max
  Peptide Sequence Number=SeqID_193753
atggcggaagatcttcacagaattacccacgggaatgtttcggacgtgttacggaagcgcctcagcgtggattttcttcatggaaacgatttttttttcactaatttcaagaaaatgtgggaggagcttgccaccgagcttgcccaggcaagctag

SEQ ID NO: 76976 - DNA, 399 bp, Glycine max
  Peptide Sequence Number=SeqID_193754
atgaatcgagttatacggaaaagaagttttcaagggggagtaaggttgcagatgtgcagaaagctttcaactgtccaactaactgaaagacttgactattctaatttgcctggcctgaatcccaacatgaaaaatggaagtctgaaggaaggaacacttaactgggaaatgttgcaattcaagccaaaatttccacgtcaagtattgctttgcagagttggggaattttatgaagcttggggaataaatgtatgtattcttgtggcatatgagggtttaaatccttttggcggtctgcaatcagatagtatcccgagagctggttgtcctgttgtgaatcttcaacaaactttagatgatcggacacaaggcggttattcagtgcattcttcaaaatga

SEQ ID NO: 76977 - DNA, 660 bp, Glycine max
  Peptide Sequence Number=SeqID_193755
atgagggagatgaacctccaactactcactaaccctctgatttggtctgatgtttcacagaactcagaagaaaaaggatgtcgcttctatgcattagagaaggcccatgtaatggatccattatcagctgggcgtggtgttcgtcggttcaagacttacctattgcaaaaacttgaaaaggaaaatgagcttacagtaagatctattgaaagaagtgatccttgggagctgcagacctactaccaacagttctatgaaaagaaaatccgggatggggaattttcccaaagaccggaggagataactaataatgttcagattgccactgtattgtatgaagcgctaaagactatagtacctccacaaaagattgaggctaagacaagaaggtatgctgaggatgttgagcgtaagaggggactatatgaacactataacatccttccattatatgctgttggtgttaaaccagcaatcatggaacttcccgagatcaaagaagcatttattgctttacgtagagtggataatcttccaatgcccataattcgagcaagacctgatacttttcatgatgattccacaatgcctacggataggcttaaaaaagtgaatgatatacttgattggattgcctcagtttttgggtttcaggtatga

SEQ ID NO: 76978 - DNA, 360 bp, Glycine max
  Peptide Sequence Number=SeqID_193756
atggaaactttagcttcctctactattcactcaaaccacaatatctgttgtgctttctgggtggtggaggaggagaagaaaattgaggaggaaaccataaaccttgttgcattggttgtggcagtggtggcaggaccatggccagcaccagtggcacaaatgatacttttgggattgcaagaggttgctgatctaatacgatcgttatttactgataactccaatagacggttaatgcaagaaggtgatgatttggacattggagatgttccttcttcacttgctagccttgtgcctattgtcatagcagcccttcaaattgaggaggagaatccaagagttgcctatctttgtgagtaa

SEQ ID NO: 76979 - DNA, 261 bp, Glycine max
  Peptide Sequence Number=SeqID_193757
atggcactgtatggtattgtagcaatggagcaggaatacacatgtaaagttaagctgaatgttgttgcatacagtaacagcagaacgatatttgttaggaagtcccacatcgcctgcctcaattcttggggtgcaacttatatatttgctgggcaacttcactcagtataccctcttctggatcatgctgctaatcagcaagctagcattcagctactatgtggagacactaccacggttacttcaactattcaagcctaa

SEQ ID NO: 76980 - DNA, 258 bp, Glycine max
  Peptide Sequence Number=SeqID_193758
gcggccaaccacaaggggcacgtgcagacctatgagtgcctctaccagctcagcctcagcctgcagagccagggttatgctccttttccgtgccctactccagatcagttcagggcagaggtcgcatggcccagagattggcctgaggcccaggtaggggaggcgcctgcagaggctcccgacgatggagaggaggcccgcatggatgaggagatggcggatttgctcgatttcttgggaggaagcggagccacgtga

SEQ ID NO: 76981 - DNA, 555 bp, Glycine max
  Peptide Sequence Number=SeqID_193759
atgaaagtctatgcaaaagatggaacaactgtgaaagatttcattgttaacggttcttggaccccaagtcctgaggctcagtatcaaataaggtggaacgagactgattctggaaccctctccttaaaggaagcatttttaattcggaatccttctggtttaaagttgagtgtcttaaacgcagagtgtgcatcatggtatctgcctgtagtttatacaaagcagcagaggaaaccaagaatcattatttctttgactgcccttttgctaaaatcaggtcatccaaagaaagctccttcaataattcaggttgattggacccctccaatttgcaactggattaaatgtaatactgatggcgctgccaaaggagctcctggacctgctgaacttttgggagctataatggacattgaaatagctaacgacaagggttggtgcaatttgtggccagaaagtgacttcaagtttgttattctagcattgcataatcctaacttggaaattcttgtgccgataagcttgcctcctttggcacctctgcacaaggcttag

SEQ ID NO: 76982 - DNA, 285 bp, Glycine max
  Peptide Sequence Number=SeqID_193760
atgtcaaacctgaagaccagcttcacaaagggagccattactctgatgcaaattgaacttctgatggcaatgacggcagaagatcaacctttgggtcttgcatcttctttggacccaaccttatccatatcgtggcctggtccagcactaaaggctgagtatcacagccttgcagccactgaatcttatggattcagtcattgttgcaagaacttcaagtgcacatccccccttatacgatctacgtgtctcctagctaatcctgctcagccacctacagcttga

SEQ ID NO: 76983 - DNA, 774 bp, Glycine max
  Peptide Sequence Number=SeqID_193761
atggatggccaaaatgaagcagttggaggtccttcaacttggtcaatattcgagctgccaccctccattttccaacttgagagcctagcagttctaggtctcaaggcctgtcacaatctagaaaccctacctaatgatattgaatcattgaaaaatatcagatggtcggatttgtctcaatgctacttgttggagagaatgccaaaaaggattgagaagctgaccaatgttgaagtactcaagggatttgtaattggtagttctagcaagagtagctaccaaatatcagatcttgcagatttgaaaaatctggagcgactcagcatacatataggaagtggggccataatcgatgaaaatgagtttgaaagcttgaaagggttgtcaaaacttgagcatctcataatatcatggggtgtgtgtggcacaaggtataccgatgatatccggatcagtttgctttcaaatttgaaaaagttgcatcttgatgaagactttcctgaagaaagtattccaagattgttgaagcctaccaatctacccgtgagtttgaaagatctaaatttagccggagggaaactagcaagtatggatcatggaaaattagatcactcggactcctgcaagttggagatcatacatcttaagtacctaaaacatttgattgttgacccagaaaaattgcagactttgtttccttcatcggtatacgtagaaataaaagacctacaaaaccttctataccatgaatggattaaagatgaagagaggtga

SEQ ID NO: 76984 - DNA, 204 bp, Glycine max
  Peptide Sequence Number=SeqID_193762
atggaagtggaaatgtggtatggaatgagatttcaaacttgtggggttcactttggcaggctttctgtgttgatggaggagagaatgtggacttgcagagctaaagtgcgtcagatttcaatagagacaaagtgggtcgtgctagatttacatggtagtgaacattatcttttgcttcccacttttgaatacacatcattataa

SEQ ID NO: 76985 - DNA, 201 bp, Glycine max
  Peptide Sequence Number=SeqID_193763
atggtgaagctttcagcaagcagtacaagtacaacatcgactttactcctaacagatttaagttgcaaagcatgtcaaagaaggaatgtgaaacattcaaggagtatgcccaaagatggcgatattagagatagggagagcaacatgagcaacatagtgaacaacctaaggctaaagcttgaagctcaaggaaaagcttga

SEQ ID NO: 76986 - DNA, 230 bp, Glycine max
  Peptide Sequence Number=SeqID_193764
acattcgccatggtggtcttgaaagctctaacattataagagttggtggtcaacagtttccctaccatccatgcttccctgtctatggaagggtctctccatcagaaggtcataaaatgacctgcacaagcaagagtggttgccgccttgggaaaaacctcttagagatagggcagcaacatgagcaacatgaagacttagccttgaagcttgaagaagagcttaaataa

SEQ ID NO: 76987 - DNA, 426 bp, Glycine max
  Peptide Sequence Number=SeqID_193765
gaccgtgaatgtgctgaattgattggtgaaacagctgatgatgtgaatagggtcaagattgaactggtgaatttgtgttgtttttggcaagatggtgatcttgatttgaatgcttcccctcaagcacttgacaaattgttgggtcatgtgcttgcttttaaggtcaggattcaatcaaaattcaaaaatgcagttgtacttagatactcaaaagacctggatttgatcaatgttgttctcgagatgctgcctgatagtgagcaatctctgtctgtcacagctgaccatgatccggttgcgggattgcctttaacacccaaaaagcggatgtcatctgatgaagccgatgatgagttagggagctctcaaatttcgccagcccaactatcgtctaacaaattaacaagacattctcataagagctaa

SEQ ID NO: 76988 - DNA, 453 bp, Glycine max
  Peptide Sequence Number=SeqID_193766
atggaaagagctacacatttgaatggaagcagaatcgcatttggatggaagcggtggcggaggggctatagggaaagtagtgaagtgcctcgagctattccaccgcagaaacaggtcttgcacaagggactcgagctcactacgtccattggagaaagatcggtcgtggcgtgtttggcgctgtacgtgttgaagaaaatcaggctcgcgcgacagaatgaacgatgcagaagatctactcatcaagagcatccctacattgtgcaatttaaagaggcttgggtggagaagggctgcattgatgaaaaaatcaattggggtttactttccagagagtgttccaacatctttctaaccaaggatcaagatgttcgcctaggattcatgctaactattattctgtctagtttctacaacattgttgaatcctacatgttagcatcaaaggaatga

SEQ ID NO: 76989 - DNA, 387 bp, Glycine max
  Peptide Sequence Number=SeqID_193767
atggattggcttagacgcggcctatctaggggttcaaggaatagcaaaaccccaaatatccaaacgcagtccaactccgaagtacagcaacacctagaagaaagcatatacgggattaccgaggaactcatcaaccacatcaagaccttcacccttgacacctttaagaatttccctctccaagatgaagttgaaggcagttatggggaagacactcaatcctcttcaaccaaagttcgaaatgaactttctcagtggcaagagaaacatgcaatcctcgtactctcaagagtcaaggttaagggtttcaacaagttttacattgactgtcgagtttctaacataacggtcctttactcgagccagggaccagctatgagaccatag

SEQ ID NO: 76990 - DNA, 237 bp, Glycine max
  Peptide Sequence Number=SeqID_193768
atgaagacaaattgcccagtagcaggaaaaggtggctcagttctgttagtgaaatgtgatacagatagttacatatatcaaaggaagttacaatgtagaaaatattatcaaagattcaaaaccagtatgtcacaggtggagggcctaaatagaagagtctcattgggaagagcttgtggatctagtgtcttggtgaagctgtgcctgggtagaaggaatgggaaggtggtggtgtga

SEQ ID NO: 76991 - DNA, 1389 bp, Glycine max
  Peptide Sequence Number=SeqID_193769
atgggagaaaacaaatcaaacaagtttgttaacagtcacaaactggaattctggtcccatgagtgcattttcttgggatactcaacttctcataaaggctataagagtctatccccttcaggaaggtcgcttatctcaaaagatgtggtctttaatgaactcagatttccttataaagagttgtttgacatcactcctaaccccaatccaaccccttcaccatctactcatttttctcccacctctattcccattattcctactgttcagattcccacttcggtatccccacagagcccttcatccaattcccttgagtctcatcattctcctgtttctggtccctcaaatgttcctgcacggtcctctgaggctgtccctaatgcttctgaacattctgcacagtcctctgaggctgttcctaatgcttctgaacctcccagtgataattctgatcctcacatccagtttctccacccttacacacttctcccactccatcacatcatgtctcgccttcctcagattccacttcctcatcttccaattatgtttctcctcgctctaaacctcctaacactcattcaacgcaaaccagatccaattaaagagaatgcagatggatcgattaacagatataaagctagactagtagctaagggatttcatcaagttcaagggtttgattttcatgagactttttctccagtggtgaaacctgtcaccattagactcatcatcactctagccatcactaatcattgggatctttttcagctagatgtgaataatgcattccttcatggaattcttgaggaaacatcaaactctcacactatatatcttctagcctgcgttgatgacattgtcatcactggaagctcatctcagactttgaaagactattctctagtgcttactcagagtaaatacataaggaatcttcttcagaaaaccaaaatgactaatgctcagctcatttcttctcccaaggtcaccaactgcaagttaactaaatctggggcagatttattctctgatcctacattctacagatttgtgattggagccttgcaatacaccacaattaccagaccagagagatcagtaggatggtccaaaatatggagggtgtatgctaggagaaacaagggtgagaaaaggaaaggtgaggtggcagttggcataacagaattgccaaagtctgctgttttgggtcaccctttccctataagagccctttgtgatgctgactgggcatccgaatttgatgatagacgatccacctctggtgcagccgttttcttgtgtccaaatctcatttcatggtggtcctgcaagcagcaagtagtggccaggtccagcacagaggcagaatacagaagttag

SEQ ID NO: 76992 - DNA, 564 bp, Glycine max
  Peptide Sequence Number=SeqID_193770
atgtatttacaaactgaaaagcttgcctctaaatctaccgtcgatggccttcatcaaccaagagaaatcccaaggaactccggcaaagaagaagaatcagcaagaaccattttatataggttgcagatgtgcagaaagctttcaactgtccaactaactgaaagacttgactattctaatttgcctggcctgaattccaacatgaaaaatggaagtctgaaggaaggaacacataactgggaaatgttgcaattcaagccaaaatttccacgtcaagtattgctttgcagagttggggaattttatgaagcttggggaataaatgtatgtattcttgttgaatatgagggtttaaatccttttggcgtgcctgccatcttaccagtctatgagtacatgctgctaataaattttggtctcaacactgcattgtggaggaggcaggctcagggcccaactcaagctcgatccaggaaacgtctctttatatctggattaaaagaaggaaggggcatatggacagaggttaaggcatcatccataacagacagaaatccaacttga

SEQ ID NO: 76993 - DNA, 2439 bp, Glycine max
  Peptide Sequence Number=SeqID_193771
atgggcaagctaaaggagattagctcccgtctcctacagcttgatccaatgattattgtactaattgaaactagagtgaagaaatcaaaagctacaaatattaggaaaaaactaaggttcaaaggtatgtatcttgataattatgttgatcatgataatgggcgtatttggctgtgctgggataacaatagaatagacctaaaatttgtccatagttctagccagttggtgcactgcggtgtgtatggtctggatgggatttttagatattggctcactgcgatttatgcattaaataagcttgagaatcgtagaagtctatggaaggatattgtgactttgcatagccaccagcaaggtccatggtgcctgataggtgactataataatgtcacaaaagctcaagatcgcataggaggtaaaatggtgacggaagccgaatatactgatttttctgatatgcttgagcagactggtctggccaaaatggatagtcaaggagactattttacttggtcaaataagcatgtagaaggcaccatttactcgagaattgatagagttatggcaaacgtttcatggtttcagaacaatctggatgtgaaccttcacatcatgcccccaaatgtctcagaccacgctcttctatggctgcaacaccgcgatagggctcaacttgatctctccatcgacctgatgaatagtaccaatattgctaaggtaaaaaagtacactgatgaacttatttactttcaggaacttgaggaaaatgttcttaggcagaaggcgaagattgattggctaaaattaggtgatggcaacaattcatttttctacgcaaccgttaaatcgagggctaatgctaaagggatgaacatgctaaggaagattgatggtacagtttgtgcaactcaggaagatattgagaatatggtcctggagttttatggtgagctgatggggaaaaaatctaccaatctgaagcatatagatgcaaatgctatgcgaagagtcagtgatcaggaaatcctaaaagtgctgaatggtataggcgatttgaagtctcccggtattgacggatccggggcaaaattctttaaatccagttgggatactatcaaagatgatatcaataatgcacatgagaagattgtctctgtgaaagactatagaccgattgcaggatgcactatcttatataagattatctcaaaaatacttacagctaggcttggaaaagttttgaatagtattgtaagtccgtgtcaagcggcctttgttcctggacagcagatccataatcacattctgctggcctatgagcttataagagggtatgctaggaagaatggaaccccccgatgcatgattcaattagaccttcagaaagcgtatgacatggtggactggtttgctctagaaactattctgctggaaacaggtattcctaaacaatttgttaagtggattatgcttactgtcacttccgtcacctacaggagattgcagatagtagagatgttgatgcagaccttgaataccttctctgaaacaattggtttactggtaaactcgagtaaatgcaatatttactttgggggggttgatgctcctatgaagactgatattatgaagctgacaggttttaaagaggggcccctccctttcaaatacttaggtgtacccttgactagtaagaagttgtctatttctcattatctcagtctagttgatagaataactggaaagattaatcattggagtaataagttgttgagttatgcaggccggctacaactcattaagagtgttaccttttccatagcaaactactggatgcaatgttttccgttgcctaagcctaggaaatatgggggtttgaatgttattcacctccaaacgtggaatcatgtcactatgatgaaactactttggagtcttagtgagaagagtgatttggaccagaaggataagggaaaattcagtatgaagacactgtatctgaagatgcgatgtgaaggctcgaatgaggttgtgtggaatagacttttgtgtggtaaccctgctagacctcgcgctttaatgactctatggcaagcctgccacggtaggctacccacaaaagatcatttgctaagatttggaatgctaggtgataagatttgttgcttctgtgagggaccagaatcccatgatcaccttttctttggatgtagtgtccttggtgatgtgtggaaacaagtccttgagtggattcaggtaaagcatcatcctcaggaatggaatgaagagctaaaatggattattaggcacggtaaaggaaagggacataaggcctctattctaaagctggcgatgactgagagtgtctatggcatctggaaacaccgcaatgctaagatttttgaagaaactatagataatacgaacaatagttga

SEQ ID NO: 76994 - DNA, 135 bp, Glycine max
  Peptide Sequence Number=SeqID_193772
atgttgatatttgaatgtgactacttgccaatatgttgcttgaatggacttgctgacccattcttcttagagattatagcaaaggttctgatagcctctagaatttctgtcttattacttgaattgcagccctaa

SEQ ID NO: 76995 - DNA, 219 bp, Glycine max
  Peptide Sequence Number=SeqID_193773
atggttgtcattttgcctaaggaaaatgttttcatctggttttgttcgttgcataataggtcatacaactacctcaagggaattattaacagtgctttgaaaggacttgacgatactccacaaagtaaatccaaggcagctgctaggtggattattgttaaatatttcaatgatgctagatcattagaatcagagagattgaaggcgcttcacatctag

SEQ ID NO: 76996 - DNA, 192 bp, Glycine max
  Peptide Sequence Number=SeqID_193774
atgagaaaaagaaagaagaagagaatattactcaagtggattttaatgattatcgaagtaattttgaatgaagtgaaaaataaaattaagggtttcctttctcttgatcttgttacaggcgatccacctcagcagaagagaagtctaataattgagatagaggaagaactcaagaatattacaaaaggttag

SEQ ID NO: 76997 - DNA, 222 bp, Glycine max
  Peptide Sequence Number=SeqID_193775
atgacgctgccaaatataatcattgcaatacagtcatcaattacagataatggtgttacgcctataattaataccctttggtatcgttgtcctgtatatcaattaaatggtgaagttcaatatagggcaattcaaattattgacgaagaagtaataatagtctacatatgcatcatttcagagatgcggagcaatgtcagacctaaccctcacatgcactga

SEQ ID NO: 76998 - DNA, 126 bp, Glycine max
  Peptide Sequence Number=SeqID_193776
atggcatcatcaggcttaggaggggtgagctcatcctccccctctgctactactgctgctagctcctcaaaagcaggctcctgggctgcggaggccctaccaccccctccagaaagagaaggctag

SEQ ID NO: 76999 - DNA, 678 bp, Glycine max
  Peptide Sequence Number=SeqID_193777
cagctgacccagcagatcagggaccagctagaggagtccatcacagagaaagtgacgaggcaggtcatggcatccttcagccagcttcagtcacagatgcaatctcagggacttgcagtgcctcctgagcctctagttggtccctccggtcctcgagtgagcaccaaggggagttgtgttgatccctcaggaaacgatcctgagatgggtgactctgacaggtgcggcttgtacataaaagcagatcctgcccgcctggttgccatggggagagtttatgagggatccactattgttcataacacttctttgttgcctggccaagtaaaggtgagtgtggaggaggttacagatgcagatgctcttgttcctatacccactgatgcggtttccttagtggggcaggcacttcacaccttccttgcttggccgacacatctggccaagtctttatcacaacagagttcacaaagcgatgtctatcttggcgcctacctaaatggcggacactggcagatggtggtcatcctgcccaaggaagacctagttgtctggttttgttcattgcataacaggctagacaactaccttaaggggattattaatagtgctatcaagggtcttgatgatgctccacaacctaaatcaaaggcttctgctaggtggattgtcgtcaag

SEQ ID NO: 77000 - DNA, 390 bp, Glycine max
  Peptide Sequence Number=SeqID_193778
atggatgggaaaattgaaaggtttgccgtttacagctttccggttgttgtaaaagaactggcagacgagtatcaacttggatcttatgtcggagtcggaatcgatgatccgggtaagtatctgaggttcagtttggcgccgaatgattttcagtctatgatcatcaaaaacgggatcgctgaatttgtagaacctctaaatagagaaaagacagtttacggtgtgcatccgaaaactgataagagcaaagaaggttttctatgctctatgaatgaaagccttttggataaggaagagatcaacaaactttatcagaagggatctgcatttagcaatcagaccactaattttgcgaagtcttcagataagaagtacagaacgatgagattg

SEQ ID NO: 77001 - DNA, 1389 bp, Glycine max
  Peptide Sequence Number=SeqID_193779
atgcgctgcgctacggattgcgacgagtatctcgacgtggtcgccggaccgctgaatattggccgtaccccgcagggacgtccgattgtctttcaggccggcgcgtcggacgacgggaaaaaactggcggcgaaacatgccgacgccattttcacccaccatgaaaccctcgacgaggcaaaagccttttaccgcgacgtgaaacagcagctggaaactcacggccgccgcccgtcggatttgcatatattccagggcgtcagcgtgattgtgggaaaagatgccgatgacgtggaaaaccagtatcaaaccacggcggcgctggtgtcgattaatgatgcccttaattacctcgggcgttatttcgaacatcatgatttcagccagtatccgctcgacgaaccgttcccggatatcggcgacttaggcaaaaacagcttccgcagcaccaccgatgagatcaagcgtaacgcccgcgagcgcaacttaaccctgcgtcaggtggcgctggaagccgcttcgccgcgtccacgcttttccgggcggcacgccggacaccttcccgcgctttgtggaccaggtcgtgccggttctgcaggcacgcggcctgttccgcaccgattacccgggcaccacgctgcgcgaaagcctgggtctggaccaaccgaaaaatcactttacacaacaataaaagagaacaccgctatgcagaaaacatcgcttattctggcgctcgcgctggcctttacccctgccgtctgggcagagaatgtgaacattaacggcaccggcgtgagcatcgaggccaataaaacgccgatcaacaccgccaaaaacggcgatgccatcgcccggttgccgaaagactatcgctttgccgtaccgggaaaatttaccgtggcggtggcggggctcaaccagccgccgctgacggtgttttccgatgacaacaaaacgctgttaggcagcgaggtcgacgttgctcgtctggtggcggacagcctcgggctggagctgaacgtggtgcccacctcgtgggaagactggccgctgggggtcgcctccggcaaatacgatgcggccatcagcaatatcaccgtcaccaaagaacgcaaacagaaatttgattttgccacctaccggaaagactccctcggtttctacgtgaagtccaccagtcctattacctcgctgcagaaggcggaagacatcgccgggctgcggattatcgtgggctccggcaccaaccaggagtccatcctgctggcatggaacgcggaaaacctgaagaaggggctgaaaccctttaccccgatctacaccaaagatgatgcggctcaaaccctggcgctgcagtccgggcgtgcggatgcctactttggtccgaac

SEQ ID NO: 77002 - DNA, 432 bp, Glycine max
  Peptide Sequence Number=SeqID_193780
atggtccttgagatttcttttcaaccttataaaaatccttttacaagcaaagatccacaagggatgtaccctcccttgttctctttgaacaacctagtggatgtaccctccactagaactgatccacaagagatgtaccatctcttgttctcagtcacaacaacccaagtagatgtaccctctacttataccacaaaggatgtaccctccaatgtgttaagacaaagttctcaggcggttagtcctttgaaactttgtcaagggggaaacaaaagaattctcaagcgggagaagggagacacaaaagaattcaggcggttagtccttcgttcttttggaaaagggagaagagagacacaaaaagaattcaggcggttagtccttggcgaattctttttggcaaagggagaagggaatgaaaaagatgaataa

SEQ ID NO: 77003 - DNA, 322 bp, Glycine max
  Peptide Sequence Number=SeqID_193781
atggtggggtacgcaccttcaagctttgcgaatttggttttcgccggtgaaaggatcgaagcgggtctggaaagagacaaatttgatcatcctgctttgatgaatgagaaaactgtggcaaatgaagagtatgagaatgagggagaaacccttgctgtgactgtcattcctacatggccaaatttcccatcaatccaacaatccaaggttcctcaacctccatttttccgaggatatgactctaacgcaacatgtgcttatcatggaggggccccggggcattccattgagcattataggaccctgaagcataaggtgcaag

SEQ ID NO: 77004 - DNA, 392 bp, Glycine max
  Peptide Sequence Number=SeqID_193782
cctcactgtctccgagactatgcgagatattataactccaaacctcttccagtgtagattcttgaccttgaactttgacacatcacttgatattgtcaatgttggtaaaagatggggatggagtagtgttgttagaaaaatgggtagtggtgggaagagggagatggagattaagaggaagaaggatgtcattagttttgctatggtacatgatgagtggtggaagttttttgaatctttgaggttattgttgttgttgttcacggtggacatgagtggtttcatggatttgagttattttgatgatgccaaagaatcaagcgttaagcaaattccaaagattcaagaatcaagtttcaagattgaagaatcaagtttcaagaataatcaag

SEQ ID NO: 77005 - DNA, 294 bp, Glycine max
  Peptide Sequence Number=SeqID_193783
atgctgagtttgtcgagaccacccggttgtgcacgtaacagcccccctcccataggtgatcaacctgggagcccaaaggcagatatccccatagctaggttccctgaccctaactatggtgttaaaacgggttcctctcagtgtgggttttcaatggagaacaatgatggtttgtggtggctaatggtggctgtgggtgatggagaaagttcttggaactttagaaatggctttggaagaaagaaagaagaagaaatgacatttttcctaagctacacgaaagcaaaggcttaa

SEQ ID NO: 77006 - DNA, 174 bp, Glycine max
  Peptide Sequence Number=SeqID_193784
atggtagaggcttgtatggaatcgacaagcaaggacaaaaaggaatcttcaagtgacgcgacgaggaatccgcgggggtctttggcactagcttttggtcacgttcataggttggatgttgtgtatggtcgtggggggcactgtgcactgaccttccagggtctttggcactag

SEQ ID NO: 77007 - DNA, 225 bp, Glycine max
  Peptide Sequence Number=SeqID_193785
atgcctaatgatgtcgaagtaagatgcatatcaatcaaagattgccaggcgatgcgtggtcgcaaagatgatgtggatcatgtgggatatccaacaggttttgatgcttgtcatattgtttggtggtttacatggggattgaaagctcacccacacaaccaattgttaggttttgacggtccaatatgtcatgattggacgatccatccctacccaatgttttga

SEQ ID NO: 77008 - DNA, 1634 bp, Glycine max
  Peptide Sequence Number=SeqID_193786
atggcattaagatttccaaggtttagtcaaggcttagctcaagaccccactactcgtcgtatttggtttggtattgctaccgcacatgacttcgaaagtcatgatgatattactgaggaacgtctttatcagaatatttttgcttctcatttcgggcaattagcaataatttttctgtggacttccgggaatctgtttcatgtagcttggcaagggaattttgaagcatgggtacaggatcctttacatgtaagacctatagctcatgcaatttgggatcctcattttggtcaaccggctgtagaagcttttactcgaggaggtgctctaggcccagttaatatagcctattctggtgtttatcagtggtggtatacaatcggtttacgtactaatggggatctttatactggagctctttttctattatttctttctactatatctttaatagcgggttggttacacttgcaaccaaaatggaaaccaagcgtttcgtggtttaaaaatgccgaatcccgcctcaatcatcatttgtcaggattattcggagtcagttccttggcttggacagggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaagtttatggctgaccgatattgcacaccatcatttagctattgcatttctttttctagttgctggccatatgtatagaaccaacttcgggattggtcacagtataaaagatcttttagaagcacatactcctccggggggtagattggggcgtggacataagggtctttatgacacaatcaataattcaattcattttcaattaggtcttgctctagcctctttaggggttattacttccttggtagctcaacacatgtactctttacccgcttatgcatttatagcgcaagactttactactcaagctgcattatatactcatcatcaatatatagcgggcttcattatgacaggggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttggttcatcatgctattgctcttggtttacatacaattacattgatcttagtaaagggtgctttggatgcgcgtggttctaa

SEQ ID NO: 77009 - DNA, 204 bp, Glycine max
  Peptide Sequence Number=SeqID_193787
atggaggcgcttgtgggaacagcaaggagaagacgtagaagagctgttctttttggcttgttgggctgcgtcgcgcgtgtctacttggtgggccgcgtccaaccgcgcgtgtcctactattcaaccgtgtccggtgatggcggaggcaacgggcaccgcgtcgcaccggagtcatatctgcatgcgtgtctggtgcgagtctga

SEQ ID NO: 77010 - DNA, 603 bp, Glycine max
  Peptide Sequence Number=SeqID_193788
atggggtttgttacctggtgggaaaaatattattcgacccgttcggttggagacactactatcatgatctccaggcttgagagtggttttgcacaaccaacgatcgagaatattcgctcaagccttcaagctcgaggcaaagcacccataacgaagaggagtgctgaaacgtctcgagccgacgtgagacccaagaaacccactggggtgaaaatccaagaagggaaacaagaagagaaggaagaagaggagagacctctcataagaaaaagaaagttacctacgacttcaaccaaatctgctgaccaaacagaagcaggcaattcccaggctcaaatgcctaagaagaaaaagaaagtgaagcaggtcgagcctgaaccttctgtggctgtcgagggtggtgagccagccaagaagaaaaagaaaaagaccaagtcttcaaaagaacaaggtgacaaacaacccgttgacgtccaaccaccttcgaccgatattgacggcactgaggtagaagctgctccttctattgctgagatgggcaaccctgtcgagcaaccgaacttaccacaagaacaacctgccgtcgaggtatcgttctcttaa

SEQ ID NO: 77011 - DNA, 261 bp, Glycine max
  Peptide Sequence Number=SeqID_193789
atggagagggagatgataaaaatgatagtagacacgttatcggtgttctactatgagaagatggtgggttacacgccttcaagctttgctgatttagtttttgccgacgaaaggatcgaagtggatctgagaagaggcaaatttgattatcctgctatgatgaataggaagccttgggaaaatggagaggataagaaggagggaggaacccatggtgtgactgtcgttcctacatggccaaatttcccaccagttcaataa

SEQ ID NO: 77012 - DNA, 1626 bp, Glycine max
  Peptide Sequence Number=SeqID_193790
atgctactggtgatgctgttgctcaccgcctggccgctgctgcgcactatctggctgagttttaccgacgccgcgctgattggcagcggcggtgaagcgccgcaatggattggcctggagaactatctctacgccattaccgatgcggattttcaaacctcgctgtggcgcacgctctacttcaccgtggtgtcagtagcgattgaaggcgtcatcggcgtgctggttgcgctgctgctcaaccagaaattcgccggacgtaacgtgttgcgcgtgctggtgattctgccgtgggcgctaccaaccattgtgaacgccatgatgtggcgcctcaatttcaatccggactacggcagtatcaacgccctgctgacacaactcggtatcatcgatggctaccgcagctggctggggtctccggcttccgcgctcaacgcggtaatgtttgccgacatctggaaaaactatccgctggtgacattgctggtgctggcggcgctgcagtcggtgccggaggatctctacgaagcggcgcggctggatggcgcatcggcatggcggcgttttcgtgccatcacctttccggcgattgttggctcgctcagcgtggcgctggtgttacgcaccatcgacgcctttaagatcttcgacatcatctatgtaatgacgcgcggcggtccggtcgacagcaccaaaacgctgagcttttacgtctatcaggaatcattcagctacctgcgcgccggcagcggtgcggcttatgccatcgccgtcggggaagtgcctatgaaggttaaactgcgtacctgcgctaaatacgcggcggcgctgctggtggcgctctccgtcgtggctccgatgggctggctgtttctgatgagcgtcagcgccaccagcgatctgacacgcgtgccgctggagtggctgccgcgccagtgggatttcagccgctacggcaggctgatctcgctggaacccggccagcccggcgcgctgttcctgcatgcgctgggtaatagcctgctggtgtcaaccggcgcaacgctggtgtgcctgctgctcgcgatcccggcagcgttcagcttctcgcgctatcgcggccgtgacggctggctgttcgcgtctctggccatctatatggtgccgccggtggcgtttgtgctgccgctctactttctgctgcagcagttcgatctgctcaacacccgacccggtttgatcatcgtgtactgctcgctgattctgccgtttctcacctggatgctgaaaaaccagtttgatgccctgccgcaggatatcgaacaggccgcgcgtcttgatgggctgcgcgtctggcaggtgctgctgcgcattacgctgccgctggcgaaaccggtgctgggcgcggcggcgctgtttggctggctgctggcgtgggatgaatttttctacgccctgctgttcaccagtaacatcgccgcgcaaaccctgccggtcaccattgccggctttaccgcaggccgcgccaccgacgatgggctgattgccgccgtcggcattctggcgtcggttcctcctctctttatcgctatctggctgcaaaaaacgctggtcagcggccttgccagtggcgggagcaaaggatga

SEQ ID NO: 77013 - DNA, 210 bp, Glycine max
  Peptide Sequence Number=SeqID_193791
atgacatctccgggaagggtacaggtgacgacgttagtcactgcttgcaatcgtggtgacgacgttagtcagtacttgcaatcgtgcttagcgtcttatggataccaaatgagactttttcatagtgtcggccggaagacgtggacatctccggaaagggtgcaggtgacgacgttagtcactgcttgcaatcttaaggatagcaaatga

SEQ ID NO: 77014 - DNA, 779 bp, Glycine max
  Peptide Sequence Number=SeqID_193792
atccgcaaccgcgccaccatcggcggcaatatcgtcaacgccgcgccctgcggcgattccattccgcctgccatcctctatgacgcgcgcatcgagctgcgctcgctaaatggcgtacgcaccctcggtctggccgagttcttgctgtccggctacaagacccagcgccagccggatgaactgctgaccaaagtgatactgccgccgccggtgcgcccgcgggctaaaggtttctatcaccagttagggcggcgcaacgcgctcaacatcacccgtcagagcctgagcgcgctgctcgattttgctgatgatggcacggtgagctactgccgtctggtggacggcgcgctgttcagtaagccgcagcggttactggatattgaacgctgcctgctagggaaaccgttaaatagcgacacgattaatagcgcctgcgaggtgctggacaagcttatctatgcggccatcggtaggcgctgggcgccagagcgccctgtacaggatagagctatgagcacaattaaagtgaaggtaaacggcaagctggtggaagcaaaagtagaaggcaatatgcgcctattggatctggtgcgggatacattgcatcttaccgccaccaaagagggatgttcgattggcgaatgcggcgcttgtacggtgctgatggacggtaacgccgtttgttcttgtctggtactggccgaacagtgtgatgaagcggagatcgagacgctcgaaggggcggcgtgcagtgcgggttctgtacgccgggagtactg

SEQ ID NO: 77015 - DNA, 165 bp, Glycine max
  Peptide Sequence Number=SeqID_193793
atgaacgcgctaagcgcgcctgctgcacttagcctattcatcacaactgttaaaattttggatttccagatgaacgcgctaagcggaccagcgctaagcctgacctgtcaggctaagcgccactttgcttttgctaagcggcagcctgctgcgcttagcacctga

SEQ ID NO: 77016 - DNA, 159 bp, Glycine max
  Peptide Sequence Number=SeqID_193794
atggtaacccaaagaagaactggtgttagattacctattggtgttccaatgctaaactcttcagcaaaagatcaaagtctttcccaatctcctggatcatctcagtactcagagaaagacaaattcttctataaagttgaggtcaagagtctagcttaa

SEQ ID NO: 77017 - DNA, 552 bp, Glycine max
  Peptide Sequence Number=SeqID_193795
atgggtgaagtagaggaggtgcaagagcaggtgaaggccgacacggaggccttgaaagagcaaatggccacaaggatggaggccatgatgagcataaaggagataatggaggtcaatgcggttgcaatagccgttaccaacaccattgttgaggtggacctgaccccctcatatggcctcaaccaaataaatcatccaacctcagatatggtaggtctggaaggcaaagagttgggaggtgcgggcggccctcatttagtgcgaaaaacaggcataccttcccaccatatggcttgcctcccaattatatgccacccaatgtggcgtacactcccaatgagaatgtcaatagctccactcctatactcattgagagccaacaacctcaatctgatcatgcacattttcgcaacctacccttcggcgggagggcgacgcatgactcgtgggatcatcttccaagaaagaaatatgcgcggagtcgccaccaacgtttatttgaggaaaacatcggaaaaaccggaaaagacgtggtctacgaactttaagtga

SEQ ID NO: 77018 - DNA, 255 bp, Glycine max
  Peptide Sequence Number=SeqID_193796
atgatgataattcataatatgaggatttttacattgacgttgtctatgttctgtttcttttttgtttcccagaattggtgtttctactctacagcagttggaggattgagatgctatgagaatccaaagaataagattactgcaatacctgctgaggaagaggaaatctggggtgcattcttcaaggtaatcttagagcttaagaagttagagttgaatatcctttatgtaactaggattgtcagttgcaactaa

SEQ ID NO: 77019 - DNA, 306 bp, Glycine max
  Peptide Sequence Number=SeqID_193797
atgggggaggcacatgaaattccccaccacaatctagccgacttcgagccttgcctcagatatgccactgaagggcaagcagttggtggtatacccatgccaaacactttggagggccctcagtttcgcccacaaccacaacccttgcattttgcggtgggaagagcccctcctactatggctgaaaagggaaaggtggatcatctaaaggaaaggctcagggccattgaaggaggtgaagattatgcctttgctaacctagaagagttgttcctaatacccaaacatggtcattaccaagtttaa

SEQ ID NO: 77020 - DNA, 219 bp, Glycine max
  Peptide Sequence Number=SeqID_193798
atggtggggtacgcaccttcaagcttggctgatttagttttcgccgatgaaaggatcgaagcgagtctgaagagatgcaaatttaatcatcctcctggggcgaatgagaaaactggggcaaatgaagagggtgagaatgaaggagaaacccatgctgcgattgccgttcctacatggaaacttcccatttgccaaacaatgtcattactcagccaataa

SEQ ID NO: 77021 - DNA, 147 bp, Glycine max
  Peptide Sequence Number=SeqID_193799
atggcatatccagggcacggcgcagaggatgttccggtattgtcaaaatcagataggaacgaggtggcattggataagcgaaagaagaggttagaaccagctccaccggctaaaggtacatggactcttcagaaggctcaggtttaa

SEQ ID NO: 77022 - DNA, 252 bp, Glycine max
  Peptide Sequence Number=SeqID_193800
atggaggcaggcttggtggatttgacgttgagttggtgttctaaagggggcgaaatgagtccaaccgagggtggtggggtgagggttaaggctaggggtttggggcttgatggagggacgtgtgaaggcggagaggacaactttgaacccctcaagggacggtggctccggggagtggatgcaggagaggtagtggccaaggaggaagaggatgaaagagaggtctaccaggtggaggtgggggtcagatga

SEQ ID NO: 77023 - DNA, 255 bp, Glycine max
  Peptide Sequence Number=SeqID_193801
atggcgagggcgtgtaaccctctgaaggtgaggacatgcagtcctctgatggcgagggcgtgtagccctctgaaggtgaggacacgcagtcctctgatggcgagggcgtgtagccctctgaaggtgaggacatgcagtcctctgaaagtgaggacacacagtcctcttaaggtgagggcgtgcagccctctgttggcgaggacgtgtagtcctctgaagaccagggtactagtacccgagggtccatccttatga

SEQ ID NO: 77024 - DNA, 1724 bp, Glycine max
  Peptide Sequence Number=SeqID_193802
atggcgcagcagcggctgcagcgccaccacatcagcggcggtctgccagccgagctccacgccgggcgcacgctgatgtggccgcataaacagctgctcaaaggcggtgcgctgcgccggggtgcgcaggcgaaagcgctcgctgacgctggtgccatcctcatcataataggtggcttgcagccactcgcctttatcatcgcgtccgtgcgccagcgtcataccactgcagcgcagtacgcgcgcgtctttcagcttcagcgccgctttcagcatatcatcggggtcgaccagtaccttgtcgcactgctggcagcggcgcgcggcgatatcattttctgcaccgcagtccgggcagcttttaaagcggaaacggtagtcgcactgcgcgcgattgccctcgtcatcgtcgagcacgccctgacagcggcggccaaagtgctcaatgacgtggccatcttcggtcgccttgccccagaaggtattcgcaaagccgcaggccggacaaaacacctgcaccggctggttatcgctggcgcctttcggtgcgccgacttcgggcgtaaagagatcgtgcgggtttccggcgtaatcgaggatcaggcagtcggttttgcccggtgccagccgcaacccgcgaccgacaatttgctgatacaggctgaccgattcggtcgggcgcagaatggcgatcaaatcgacgtgtggcgcgtcaaagccggtggtcagcaccgccacgttaaccagaaacttaagctgctgcgctttgaactgctgaatcagccggtcacgctccttcaccggggtttccgccgataccagcgcactgttttccggcagcaggctgagaatttcccgcgcgtgttcaacggttgcggcaaataccatcacgccgcggcgcgtctcagcgaactcgatgatctgtcgcatgatctgcggcgtgacgcgctgctgctgtttcagttcgcggttaagatcggcctcactgaacaggccattattctgcgggatcagccgactgaaatcatactgcaccaccggcatatccagccgctcgggcggcaccagaaagccatgtttgatcatatagcgcagcggcaattcgtagatgcagtcgcggaacagcgcattatcatcgccgcgcaccatgccgtgatagtggtactggtaaatccagcctttgcccaggcggaatggcgtggcggtcagccccagcagacgcagctgcggattgtgctggcgcagatgggagaacagctgctgatactggctctcctcgttgtcgctgatgcgatggcactcatcgacaatcaccagcgaaaaggcgctgtcaaaactggccagattgcgcgccaccgattgcacgctgccgaacaccactttaccgtcgctctgcttgcgctgcaggcccgcggcgaagatgtccgcctgcaggccatacgcctgatatttactgtggttctgctccaccagttctttgacgtgagccagcaccagcacgcgaccgcgcgccagccgcgccagttcggcaatcaccaggcttttgccggcgccggtcggcagcacaatcaccgctggcgtggcgtggcggcgaaaatgggcaacggtggcatcaacggcttcttgctgataggggcgcagggcgaaggttcaggctatactgcccacactttttcaacggttaaccctgctcacaattatgccggggcccgccgcgctacgct

SEQ ID NO: 77025 - DNA, 1146 bp, Glycine max
  Peptide Sequence Number=SeqID_193803
atgccggtggtgcagtatgatttcagtcggctgatcccgcagaataatggcctgttcagtgaggccgatcttaaccgcgaactgaaacagcagcagcgcgtcacgccgcagatcatgcgacagatcatcgagttcgctgagacgcgccgcggcgtgatggtatttgccgcaaccgttgaacacgcgcgggaaattctcagcctgctgccggaaaacagtgcgctggtatcggcggaaaccccggtgaaggagcgtgaccggctgattcagcagttcaaagcgcagcagcttaagtttctggttaacgtggcggtgctgaccaccggctttgacgcgccacacgtcgatttgatcgccattctgcgcccgaccgaatcggtcagcctgtatcagcaaattgtcggtcgcgggttgcggctggcaccgggcaaaaccgactgcctgatcctcgattacgccggaaacccgcacgatctctttacgcccgaagtcggcgcaccgaaaggcgccagcgataaccagccggtgcaggtgttttgtccggcctgcggctttgcgaataccttctggggcaaggcgaccgaagatggccacgtcattgagcactttggccgccgctgtcagggcgtgctcgacgatgacgagggcaatcgcgcgcagtgcgactaccgtttccgctttaaaagctgcccggactgcggtgcagaaaatgatatcgccgcgcgccgctgccagcagtgcgacaaggtactggtcgaccccgatgatatgctgaaagcggcgctgaagctgaaagacgcgcgcgtactgcgctgcagtggtatgacgctggcgcacggacgcgatgataaaggcgagtggctgcaagccacctattatgatgaggatggcaccagcgtcagcgagcgctttcgcctgcgcaccccggcgcagcgcaccgcctttgagcagctgtttatgcggccacatcagcgtgcgcccggcgtggagctcggctggcagaccgccgctgatgtggtggcgctgcagccgctgctgcgccatcccgattttgtggtggcgcgcgccaaaggccacttctggcaggtgcgggaaaaaatgttcgattatcagggacgctatcgccgcgccaacgagctgcgctaa

SEQ ID NO: 77026 - DNA, 252 bp, Glycine max
  Peptide Sequence Number=SeqID_193804
atggcaggtaataatcctaatgatggagtggggctttcgcaagtccaaatgcaagctttgacgcaacatttggagaggttaatgaagcaacgagatgatgccctccatgagaggttggatcaaatggagaatagagatcataatgaagaagaaaagaggagaagagggaataccgaattgatggtattaaactcaacattcctccctttaaaggaaagaatgatctggaggcctacttggagtgggagatga

SEQ ID NO: 77027 - DNA, 356 bp, Glycine max
  Peptide Sequence Number=SeqID_193805
cgcgtgccggagccggcggttccggcggcggaggaggagatgtctctggttccggcggcggaggaggagaggtctctggttccggcgactgtggtctccgtcgtgccctcccgccgaccatgccgcaagaagatgcggatgggcgcggcggagtggaggccgtcgctgaggtcgatctcggaggatgttgcggcaccgccgccgagggagagagagagtccccgaaaaggcgcggtggcctcggccggaagggatgcgaagaggaggagcagcggcggagccgccaaggttcggcaccggagttacagcgacggttattacgggtcagtgaaaataataactttttcgcggtttaa

SEQ ID NO: 77028 - DNA, 432 bp, Glycine max
  Peptide Sequence Number=SeqID_193806
atggggaccaccaaggcatgttacggaacttcacgtattgtgcaacaaagggtaccaagtacctcaaagcggtcaaacaaaggttgcatgccatcaaacaatggtccctggacgaaattaggggatcgtgcccgcaagacacccaatggactcggagaagtccaacagggtcttggggtttccagctctgattacgggcctctgtcatcaggccccttactaaccgagctttcatcaagaagtactgtgtccccaggcaggcgcagggtgagacaccatagaaccccagggatggtcgacagcgggcaaccgatgcaccgccgccacctccagagcccctcagctcatctacaaaggctggagcattgcctacgacccattgccgaccggcgggtgaccatgtccaaagccaaagataagcaaaagtactag

SEQ ID NO: 77029 - DNA, 267 bp, Glycine max
  Peptide Sequence Number=SeqID_193807
atggcattcttaggagagacttcgtcccagacgatcgtgaactcgaggttggcattcatttttccaaatggaaccgtcattcacaacgagtgtggggtttattttcaaagttctagtccagtgcccatgcgagtaccaaacctatgcgatttttcaactctcaaaagcagaatacacattagccttctgctaaacaacaatcaagttgtggatgaatttcattaccggcgaccagtggaagatacagaacagcagatgcaattttaa

SEQ ID NO: 77030 - DNA, 286 bp, Glycine max
  Peptide Sequence Number=SeqID_193808
atggaaaaatccgacaagatgaatttcaaagaaaagaaagcatacatcacttgggaagataatgtcataaattcttcaagtgattcagagaataaaatcataagtctgggtatcatgatgaaagactatgaaaacggagaagagcaaagtcgatacaacaacaaacaaaggccacatttctccccaagaaaagtgaatctcaagaaaagcgaatatatgatttatggagacaacaaagaccacttgatcaacaagcccaacaagtggtatcaaatgataccaacag

SEQ ID NO: 77031 - DNA, 1104 bp, Glycine max
  Peptide Sequence Number=SeqID_193809
atgattacccgagggcaaaaggtgacggagatttccgagcagcttaacctgagcccgaaaaccgttaatagctatcgctatcgcatgttcagcaagttgaacatcagtgcctttctcagcactgtgaccagtcagcccggcgtctaccgcatgtatgacgcgacaggcacggtgatctatgttggtaaagccaaagaccttaaaaaacgcctgagcagctatttccgcacgcaggtgggaagccgtaagaccgaagtgctggtcagcaacatccataatattgatgtcacggtcacccataccgagaccgaagcgctgctgctggagcacaactacatcaagttgtatcagccgcgctacaacgtgctgctgcgcgatgataagtcgtacccctatattttccttagcggcgatccgcatccgcgcctggcgatgcaccgcggtgccaaacacgctaaaggcgaatactttggtccgtttcccaacggctatgcggtgcgtgaaaccctggcgctgctgcaaaaggtgtttccgattcgccagtgcgagaacagcgtctaccgcaaccgctcgcgcccgtgcctgcagtatcagattggccgttgcctcggcccctgcgtcgccggcctggtgagcgaagaggaatatgcgcagcaaaccgactatgtgcggctgtttctggccggtaaagacgatcaggtaattaatcagctggtgcagcgtatggagcaggccagcgtgggcctgcgcttcgaagaggcggcacacctgcgggaccagattcaggcggtgcggcggattacagagaaacagttcgtctccaatcagggcgatgatctcgacgtgatgggcgtggcctatgacgccggcatggcctgtctgcacgtgctgtttatccggcagggcaaagtgctgggtagccgcagctatttcccgaaggtgccggcggacacggaactcaccgaagtggtgcagacgtttgtcggacagttctatctgcagggcagcgaagcgcgtaccttaccggcggacatcctgctggacttcaatctgcctgagcgggaactgctggccgcatcgctgagcgaactggccgggcgcaag

SEQ ID NO: 77032 - DNA, 354 bp, Glycine max
  Peptide Sequence Number=SeqID_193810
atgaggatttttacattggcgttgtctatgttcttcttctttttgttccccatgattgtaagatgtttctactctacagcagttggaggattgagatgctatgagaatccaaagaataagattactgcagttcctgctgaggaagaggacatatggggtgcattcttcaagaacagagaatcagtgatcagtcccaacagtaatataaggttaatgtcagttgagactacattaggtacaaaaggaaaatgtgaggtcagagacaatagaataggagttcataaaaagcccacacatacagcgaaaatttcactaaacggaaagtgtagtgtccaaaatgaatggttagactaa

SEQ ID NO: 77033 - DNA, 690 bp, Glycine max
  Peptide Sequence Number=SeqID_193811
atgccatttggtttaaagaacaccccttcagaatttcaagaaattatgaatgtctccaaatcaaagatcaatctttttcaaacaagaatcagattccttggtcacaatatttatcaaggcataatcattccaattgacaggctgaagaaaaatccgccagcttggtctgacatccacactcaaactgtcaaagacatcaaactcaaagtccaatttataaaatgtttgtatctcccaattccacaggcattcaaaatcgttgaaactgatgcgtctgacataggttatggtggtatcctcaaacaaagagtccatgaccacgaacataaacggccatgctacctaaggcaacgggaacctccctacggggaggtagaagtacaggtaaaggcttcaaattggctctaccagagccaaccatcaaaacagagttcctcaacttcttctgggtcaccaacccaggttgggtcatccacccagaaatcaaaaattgaagggtcatcgacccaaatagttacaatcaaacctgagtcatccactcaggaaagcccaaaacctgcaaccgcaaaacaaaccaaggctgactatgtctggtcagtacaaacacttcaaggccttcaagaaatgggtctagccaaacttccaaaattaaaccaaaaagacttgggcagacattgcctcagaatctaa

SEQ ID NO: 77034 - DNA, 456 bp, Glycine max
  Peptide Sequence Number=SeqID_193812
actgagttggagaggcgtaatctccataaatgcctcaccaatttggttgatgggagcatagatttggctttggtgaaagagttctatgcaaacctatacagctctgatggtccttcaccaaagcaagccagggttagaggccatctagtgaagatcgatgctggcagcctcaacgcattcctagagacacctgtggtgttggcagagggccgagggttcatcttgaacgcggagggccattctgggaggattcttaggaaagatttgactactttagcccaggtgtggagtgttctctcatactctaacctggcccccacatcacatacctctgatttgacagtggacagagctaggctgatctttggcctagtctctcacatggacatgaacataggagctcttatttcaggccagatgacctctatttcctgctctgatcaccgccctatgtag

SEQ ID NO: 77035 - DNA, 855 bp, Glycine max
  Peptide Sequence Number=SeqID_193813
atgggtgcggtcgtcgtcgtccgatacccgctcacccgcggattcctcagggattccacaactgacaagagtgtagttccctactcgcgcctgatatccaccgacttatccacagtatccacagctgttaacaccgttaaggagttaagtcattcaaggcgcgatccgatcaccagacggaccgacgacgcgtcaccgttcgatgacaagggagcacccgtgaggtttcaggtcaaccgcgatgtcttcagcgaggctgtctcgttcgtcgtcaagcttctcccgcagcgcaatccccagccgatcctggccggtgtcctgatcgaagcggacggcgcgggcctcacactctcggcattcgactacgaggcttcggcgcggacgaccatcgaggccaccgtcgagacgccgggaacgatcctggtccacggccgactgctgtccgacatcgccagtcgactcccgaacgcaccgatcgagatcgccgtcgaagaagacgggagcatcacggtcagctgcggctctgcgcgattcacgctcgccgccatgccggtggaggaatacccgtccatccccgaggtcaccggttcgtcgggtgtcgtcccggctgatgacttcggaacagcgatcgcccaggtgggcttcgcggcctcgcgtgacgacgtcacgccggtgctgacgggtgtgcagctcgaggtctccggccacaacctgagcctggtcgccaccgaccgctaccgtgtctcgctccgcgacgtgccgtgggacggcgaagctgtcgaggcgacagccctcgtccctgctcgcaccctgctggaagtggggaagaccttcggtcacgccggaacgatccag

SEQ ID NO: 77036 - DNA, 270 bp, Glycine max
  Peptide Sequence Number=SeqID_193814
atggatatctatcacacagagctggatgaattcaaaggcgagctagagaggcgtaactttcacaagcacctcaccaacttagctgatagtagcattgaccttgcgttggtgaaggagttctacgccaacctctacagtctcgagggaccttcacctaaacaagtcagaattcggggccacttaataaggattgatgcagacagcctcaatgcttttctagaaacacctgtggtgcttgctgagggtgaatctttgcccgcctactcatga

SEQ ID NO: 77037 - DNA, 162 bp, Glycine max
  Peptide Sequence Number=SeqID_193815
atggtgagccaagggaagtgtagaggtggcaaaagagaacaaactttaggggagaaagtggcgggtgatgggagagctagcaaaggcttggtaggacaaagaatattgtgtgttgatcaagcttggggtagagcttggtttgcagaggcaaagtggttgtga

SEQ ID NO: 77038 - DNA, 153 bp, Glycine max
  Peptide Sequence Number=SeqID_193816
atggcagaaaaagagatgagggatgggtcgtaccctgagccacttgaagcaaaacagacccctgtgatcaaatcactagattggagattgggtttcaaatatgctggcagaagctccttaatatccaattcttcaactgttttgttacaataa

SEQ ID NO: 77039 - DNA, 330 bp, Glycine max
  Peptide Sequence Number=SeqID_193817
atgtcctttgaaggacattctattttgaggccaccatattttgatggcaaaaattacactgagtggaaggagcgtatgataatattcatacgatctatcgattttaagctttggcttgtgataaaaaatggaccgaaaattccaacaaaactaataggcaatgaagaagtggagaaaagtgaagatgaatacgatgaagaagacatgaagaatttggaactagaagcacaagcaagaaatattttatgccgtgccatgaatcaagatgcttttgaaaaattctcaaaggacaaaacagccaagcaaacgtgggacgagcttgaaaggtga

SEQ ID NO: 77040 - DNA, 291 bp, Glycine max
  Peptide Sequence Number=SeqID_193818
atgtctcctccacctttagaaacctcacaatcactcaaaatctcatccaatgctccacaagatagcttcctcttcaagctcacgccagtaatgctcgctcagcctggaggttcaagcagtgcacttagcgaattgattctcgctgagtgcatcattgaaaactcatctgcttccaggattttctatgtgcttagccatgaactgctgcgctcagcggatggctcgctaagcaagagaattgacttagcaagcggctcaaaatcagcacttccaccaaactttcctaattag

SEQ ID NO: 77041 - DNA, 2055 bp, Glycine max
  Peptide Sequence Number=SeqID_193819
atgaccttggacctcctcttcgtcatggacaggcctgtcgcatgcaatattccagatcaaggcgttgagcctcaatatggcctgttgcatgttgatggatgggctactggacaagagggagaagccccactgcctaggtcattgttggcactcggcttacatgtatctaatgttgaaatagaagccacaactcttatagttggatcactgggttcggaaaaggaagtgcgatccacaaagcatggccacgagaaggagcacaagggccactcgtcatctacgctcgtcaaagacatttatttgggatttccccattttgatggccatacacctgttctggaatggattttcaaagctgaaaagttcttcaattatcatcatactcctgactctgatagagtggagattgctgcaattcattttgagaaggatgtcataccgtggtttcaaatgcctcagtgcatggagtcggtgaattcttggtccgatctaactcttgctttggagtctcagtttagaccatctccttttgattgccctatgagtgaattattcaaacttcaacaaactggtatagtttctgactactatttgaaattcatggctctagctaatagatctgaagggttctctaatgaagttgttttgaattgttttttgagtgggttgaatgctgatattcatagagatgtgattgctcagacgcctatgacattaattcaagttgtgtccttagccaaattatatgaggaaaaatattcccctatttctgctcacacttttaatttcaattcagctccttctaatgctgttaaaaatactaccaaagcatctttgcccccattgttgcctacgcctaatactcctcctcttagaaataattttgttaagaaaatttctcctgctgagatgcaattaaggcgtgaaaaagggttgtgctacttctgtgatgataagttcacatttaatcataagtgccccaacaggcagatgttaatgttacaacttgaggatgatgaaggtgaagctcagaagagttttgatgttaggtctgaagataataatagtactgctgaaactgtgattgacaatcctcaacatctttccttgaatgccttgaaaggaggtcttggtgttggcactattagatttgtagctcatattaataccttacctacgagggtacttgttgatggtggtagctctgacaattttctccagccaagagttgccaaattcttgaaactacctatagaaccagcacccttgtttaaagttatggttggtaatggtaactacatgactgttgtaggcatgatcagagaacttagcattcaagctcaagaaccggagttggcacttcttttgcatacatatgaatttgtatttgagaatcccacatccttaccacctccaaggtctcatgatcatgctatacccttgttggagggatcaaaaccagttaaagtcaagccttacctatatttacttagtcaaaaagatgaaattgagaaattggtgcaaggaatgcttgaggaaggcatcatccagccgagtatgagcccattttcttctccaattattttggtcaagaagaaggatggttcttggagagtgtgcactgactatagagcattgaatgctattacggttaaagacacatttcctattccaacaatagatgaattgattgatgagctgtttggagctaaatttttctccaagttggacttaaggtctggttatcaccagattttgttgaaacatgaggataggtataaaacagctttcaggactcaccatggacattatgaatggctagttatgccatttgggctcactaatgcccctgctacattccaaagtcttatgaatgacatatttaggggagtcttgaggaagtttgtattgctccattggagcttgcaggccttggatcttcttcatcaatggagtcctttgagaagaagaagagttaagaggagacgccacttcaaggagaagatgagtcaagaagaaactcaccaccataggaagccatggataagagcttga

SEQ ID NO: 77042 - DNA, 1191 bp, Glycine max
  Peptide Sequence Number=SeqID_193820
atgatcaaccccggtaaattcttactttcatgttcagagcaacaaactcccatcatgatcaaccctgataaattcttactttcactaattgctgaagataaattaaagttggtgaagtttgtaggacatgaatccacatctgtgcgtggcatgaaaaaacatgtaatttttcaactggttaagtttctctgggaaacaattcttcgggaaaaaaccctcaaagaggcaattaagatcataagtgaaccttctcaactactatttgatgctgcagaagttggtaattttgggttcttgtcagagcttattagtgctcaccctagcttgatatgggaagtggatgacaaaaagcaaagtataattcacacagcggtttcgcatcgccatgccagcatcttcaatgtcgtacatgaaatagggtcaattaaggatattatagtagaaggtttcgtgaaaggaaacaacactttattgcatttggcagcaaaattagccccatcagatcgacttgaattagtttctggagcagcattccaaatgtcccacgagttaatatggtttgaggaggtgaagaagataatgccaccatcattcataatgttgaaaaattctgaagacaaaaccgctcaggaattattcacaagggaacatgaaggattgcgcagaaaagcagaagattggatgaaacgcactgctgagttctgtatacttatttcaactgtcattgctacagcagtgttctctgctgcgattaacataccaggtggcatcgatgatcaaacgaaaaaaccaaattacttggacaaaacatcgttcctggtgtttgcaatatcagatggaattgcattcatctcatctgcaacttcaatattaatcttcttgtcaattctcatctcgcgttatgcggagtatgattttcacaagtcactgcccttcaagttaatatgtggattggtaactctgttcatctccataacatgcatgatggtagcctttggcagtgccttcttcataacgtacgactctggtttgaaggtggttcctgattcaatttcaatacttgcaagtgtacctattcttctatatattactttgcaattttcgttatggaaagatatcatctactcaacaattcattgcaggaatctatttaagccaagcaaacgaatgattcatatatcttctagatga

SEQ ID NO: 77043 - DNA, 390 bp, Glycine max
  Peptide Sequence Number=SeqID_193821
atgacagttgtcgactctccaactcagcaacaacaaccgcaaatgggcaatgccgcatcagctcgtcataatcgtcctaaccttgagtttatagaggcaacagacgaagaagcaaaggacaaatttctaagcctttgtgtgcctctttacaagtttgctctagaaggcaattggccagcagccaaggtcatcttacaaaaagatgttagactcaagaacgcagcaatagcagttggttgggctacacttctgcatgttgctgtaggtgcaaaccatgctccctttgtgaaggagctgctgcaagaactcgacaaccaagacattaaattgaaagatatcaagggaaacaccgccttctgcttcgcttctgcatcagggaacatggaaatt

SEQ ID NO: 77044 - DNA, 240 bp, Glycine max
  Peptide Sequence Number=SeqID_193822
atgggaaatgcaagatttcttgaggaagttaagtttgggaaggaagataatataaggaaagttgtttttgaggaagaacctattattgacagtgctcaagtcctcatacctattgctgttcaagaaacaacttcagtaatagaaaacaatgttcaaactattgttgatgacattgttcaagaacaagacaacgatgaggttcttcctcaaatacctatacaacaacctcaacaaccttaa

SEQ ID NO: 77045 - DNA, 111 bp, Glycine max
  Peptide Sequence Number=SeqID_193823
atgcatcttatgagccatatttccaatgagatccatggcttcttcaggggtcttcaacttgatttttccccctgcagaggtgtccaacagttgcttgaactacagtcttaa

SEQ ID NO: 77046 - DNA, 123 bp, Glycine max
  Peptide Sequence Number=SeqID_193824
tggtagctgatcatgcgtcattcatgccaatgattgatctgctacctattgcttatagggatgctggcagtggaattgcactgaaaactcttaagcatgtgcagaaagcctggggccaaggaa

SEQ ID NO: 77047 - DNA, 419 bp, Glycine max
  Peptide Sequence Number=SeqID_193825
atggggtcgcgtggttcgtactggatgtcaaactctgaaagttcgatggagcaggccaccatctttcttacgagttcaggatttctcaaaaacctgcttgatggggtagttcgtcttgactaccacttgatgactcgggaagtaaggcttgagtcgttgggccaagggaatgagtgggctgagctgacaacttcgtcaattactgagagatacaagagcaagggtgctcttggccttgatcgactcaaagatggtagtgtggttatggtcttcttgaaagctagaaaggcttgttcacaacttctgaacttcttgtatgttggttgggctatgcatctccagtatgacagtgcatttgtcggggttagcttcaatcccctgttccccgaagacttcttccttgtccgccacatgttggg

SEQ ID NO: 77048 - DNA, 363 bp, Glycine max
  Peptide Sequence Number=SeqID_193826
atggaaatttcatctgcacttcgtagaccaccaacgtgcccaacatcatccactgcaattgatgctccctcagatctcttccttgcctcaccttttgtgaagaagtcaccattgaaatcacctcctcccattatccgcattacttcttcatcccgctaccatcaaaatggtgctcatcgagttggtgaagtgcgggatgaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 77049 - DNA, 555 bp, Glycine max
  Peptide Sequence Number=SeqID_193827
atgtgttccggtggaggcagcatgctttttttgagaataaatatcattggagagagttccaatgatgaatcctttaataaccacatcagttctaatgttggtagtgataatgagtccaatgttcccaatggtgatttcaccactaccggtggtgttgctactagtggtagcattatttgtccgaacattgaggaggaagaggtcgaatcacctctacctattcctcttcaaaatgtcattgacttggatttggaggccattgttgtgcatgttctagtccttcatcccatcattcatccttctactcttcccccttcaaaacctaaaacgactacaaaggaataccctcccttaacccttataggttactcttgggtttatggcaaagttgtatcctatgccaatagtttatgttcttatgaatcaatcatcgaattcctagaaggtgtcaaattctgccatgttgattgttcggatgcgatgatcatcaagtcttgtcttgccaatgtgtgcattttgtttgaattggacaatccattcatctttgagttttga

SEQ ID NO: 77050 - DNA, 687 bp, Glycine max
  Peptide Sequence Number=SeqID_193828
atgagaggggcgccactagaggatgagctcgcgcctatcatttcacgaggcttcaataagaccaacgtggagacacttcagaaggtctgcaaggcatgggaggtgttgcaaaagaaggacaaggaactcaggggcagtaacaatgggccgatcggtggctaccgtaagtggttgaaagcccacgtgcaaggtttggattggctcctgagtttgagaaccgctaaaagggaggaagttgaggcaccggaggaagacgaagaggtgcaagcccttaggatggaactcaagcaagctcaaacagtcaaagaaaggttcaaatcagcaactcttaaaatccgaaaagagaatgccgaactgagagatataaatatagctaccaccaaggctttggaacaaatgaccaagagggctcgtagggaagagcacggccggaacaagttcagaggggctctatggggcagcaacagggaccaatcaggagtagacagtttgatcttgaaagatgagttgaatgtttgctcaaggtccaaaagaaacttgtctcagcgattatgtgaaacagagaccaacatgttagctatcatcagcaagtaccaagaagaactaaatctagctacggcccacgagcatagagtggcggacgagatgcccaaatgtacgcggagaaggaggctagaggaagggtga

SEQ ID NO: 77051 - DNA, 399 bp, Glycine max
  Peptide Sequence Number=SeqID_193829
atggcttcccataagagaaaagccacaactttagtgtctcaggacgattatgatagatcaagatttatatcacaggaggcctgggaccgttactcagataatgtgcttgccaagaacattatgccagaaagaaatggaagcattgatgtggcaattgtgaaggaattctatacaaatctatatgtccttgaggacaagtctcccaagcaagttagagttcaagggcacctgataaaatttgatgctaattccctcaacacctttttggagactccaatggtcgtggagaaaggggagagcttgccctcttactccaggtttgctagactgaggcctgatcctcaggagcttgcaacccagctgtgtatccctcgtaggggatttgttcttgatgccgag

SEQ ID NO: 77052 - DNA, 546 bp, Glycine max
  Peptide Sequence Number=SeqID_193830
atgtcgaaaaactgggtcttgaaaaagcatagcaagactttccttgattggtttaaagatacagtcttttctgatgaaaatgcttttgaaacattaagaaagctagcagatgagcctaaaagaaatgttataacttggcaaggatacgacataaacaagtattccttttatacaaaagcacaagacgagaaaagtacaatgcaaagcagtggggtcaccctaagggctgaatctcaacactttgtcaatgtacatgatgacaatccctatctaaagaaactagcttacccgaataacacttttatcatggcagaacaagcaaaacaggtattttatgttcaagacccttgtgatgaaaggtggtcagtggttctacaccggaaaacaattggtgttaatgtagaagatgatgattcatacattgatacttatgttagtcttttttccacacaagtgtcacctaacgtcgtcagagaagaagaagctgacgacgttcatgctaatcgtaatggtcatgatgaaggagaattaattaacatcatctaa

SEQ ID NO: 77053 - DNA, 1110 bp, Glycine max
  Peptide Sequence Number=SeqID_193831
atggaagcggcagcaactccatcagaggaacctcaatcttctaaggcatcttctagttttcctgttgcagggaattctcttgttgaactttttgaagaaccaatcatggctgaaaaaccaagaagagtaaccctggaggattattcaagttctacggtgccacgatttttcaccagtatagcaccaccagaggatgaagtagtagagaagttcttaaagaaatacttccctgactcaaagactgtagaaggcaaagcttccatctcttcttttcatcaattcacaaacaaatctttgagtgaggcacttgaaatatttagaggattgttgagaaagatgcctactcatgctgggggtaagatcaaaatgaagacccctgaggaagcaatgaatttaattgaaaacatggttgctagtgatgatgccattttgagagaccgagcccacatctcaaccaaaaatagtttattggagcttacatcacaagacgctttgttggcacaaaacaagttgttatctaagcaactggaggcactaacagaaaaacttagatgctcaatctgtggtggagctcatggctctgggagttgcattcctaatgaagaacaaatgactcaagaggttaattatatgaggaatcagcccagaggcaatttcaatccaggtggtgaatcaacaaggccacaacagcagatgccaaatctctatgaccgaaccatgaagctggaagagactcttacacaattcatgcaagtgtcaatgtctaatcaaaagagtacagagtctgctattaagaatctagaagttcaggtgggtcagcttgtaaagcaattagtagaaaaatcatccagcagttttacagcaaacacggagaagaatccaaaggaagagtgtaaggctgtgatgacaagaagcaaaatggaaatccaagccgaggaaggaagagctgatcagaaggtggaaggatttaaacaacagctggttgctcagccagcactggacccagttgatacttttgttgaacttgaagaaattgatgagaagaagaaaggcaagagtgaggccgctaaagagaagaagaaggaagctactcctatggaaggcaaggag

SEQ ID NO: 77054 - DNA, 360 bp, Glycine max
  Peptide Sequence Number=SeqID_193832
atggattcaggtcgtcaccaagtggaaggcatgttgaaatcaatcgctgaacttgcaggcgctgaacttgagctttctggtgcttatccgggctggaagccagatgctgactcagaaatcatgcatattttccgtgatatgtatgaaggcatttacggccataaacccaacattatggtgatccatgcaggtcttgagtgtggactgttcaaaaaaccttatccaaatatggatatggtttccttcggtccaaccatcaaattcccacattcaccggatgaaaaagtaaaaattgataccgtagatctttactggcaacaaatggtggcattgttagcaaacattccagcaaaagcctaa

SEQ ID NO: 77055 - DNA, 595 bp, Glycine max
  Peptide Sequence Number=SeqID_193833
atggggttatacttgcaacgacaacgtactacggtgttggtggccatagggaaaatatgtgaggggggatcttccattcacaatgtcacttatgctgatgatgttgtaagggtgagtgttgacgaatttatagaaggtgatgccgaagtgcccttcccaacatcagagattcaatatgtcaagcaggctcttcaaacattcattgcatggccaaaaaatcttgtgaaaaaagtgtcacatgaggagtcccatacaagtccaaagaaacttcctaaaacagatgaaagggggatgaatgatattgaacatgatccattgcgtcaacttattaagagcctatattacatgtacgacacacctattgagttgaagtgggatggcagcaaatttgggcttccaaatgttgatgctttgttcttcttgacattctctgatgtaaatgaaatagtagcaggatacaaatgtttgaacatatctatactacaattatggatgttgtttttggatgagtggagctcaactttgggtcatgcttccgtgtatggattccttgagccacaatcgatacaccatgcaaaggaccgacgcactgaat

SEQ ID NO: 77056 - DNA, 108 bp, Glycine max
  Peptide Sequence Number=SeqID_193834
gcattctcggaagaactcactaagcgcaaccaccgcgctaagcgagttcgtcctatgaggatgaacactcatcctcttgctagactacctgtggctaagcgaggctga

SEQ ID NO: 77057 - DNA, 1014 bp, Glycine max
  Peptide Sequence Number=SeqID_193835
atggaagatgagttgagatcaattgaaaggaaccatacttgggatcttgttcaattacctaagaacaagaaaccaataagtgtaaaatgggtattcaagttgaaattggatcctgagggcagaattgtgaagcacaaggctaggcttgtggctagaggtttcttgcagaaacaaggagttgattatacagagatctttgcaccagttgcacgacacgaaactgtgagagtgattgtctctctagcaagcaataaggggtggagtttgacacatcttgatgtaaaatctgcatttttgaatggggcactagaagaaactgtgtttgtgactcaacctcctggctttgagttagaaggcaaggaggaaatggtatacaagttgaacaaggcgctctatgggctcaaacaagcaccaagagcatggaataggagaattgatgcatatcttgctcaacttggcttcaaaaggtgtgtggtagaacatggagtttatgtcatgttgaaggaggataacaaggtgttaatggtgtgcctatacgttgatgatttactagtgactggtaatcatacaacagagattgataatttcacttcactcatgatgagtgaatttgaaatgactaacttagggaaattgtcatatttccttgggttagaattcttgtggactgaatatgggattgtcatgcatcaaaggaaatatgctggtgaaattctgaagagatttgggatggaggattgcaatgttgcaatcacaccggcagaaacaaaccagaagcttgaagacaagcctgaggaagaaggtgttgatccaactggttacaaacagttggtaggctcactgagatacctctgcaatagcagaccagatatctgttatgccgtaggcgtgctgagtaaattcatgaataggccaaagaaatcttatttcttggctgccaagagggttctaaggtatgtgaagggaactatgcagtatggtgtgatgtttccaagtagtgttgatgggtgctga

SEQ ID NO: 77058 - DNA, 372 bp, Glycine max
  Peptide Sequence Number=SeqID_193836
atgagtagcatgacaagtgggggtgatacccggaagatatccaaaggtcgttggtcatcatcattagatgaaaaagttggagttggaggtaacgtgggaggagaaggtcctctgaagaaaggcccatggactgcagcagaggatgcaattttggtagaatatgtcaaaaagcacggacaaggcaattggaatgcagtacaaaagcattcaggacttgcccgttgtgggaaaagctgccgtctacgatgggcaaatcatttgagaccagatctaaagaaaggtgcatttactgccgaggaagagaaccgaatccttgaactccatgctaagatgggaaacaaatgggctcgaatggctgcagaggtctgctag

SEQ ID NO: 77059 - DNA, 255 bp, Glycine max
  Peptide Sequence Number=SeqID_193837
atgtcctcgaccctaacgaaggtgacattgttgtacttgatgaaagtcgagcgacaacatgttgtcgtaggaggtgaagcagaggctgctgagttaggtgatcacatgcgacacacagagagggcattggtcgttggtgatcatgagatattgagaggaggcaaggacggtgaagttgttgtgattgatgaaggcgatgaagttgacaaaggaggcgatgagcaagttgacggtgtttttgtaggtgagatttga

SEQ ID NO: 77060 - DNA, 477 bp, Glycine max
  Peptide Sequence Number=SeqID_193838
atggcaagacacaaggtcacacgcacacacacacacacacactcacgcaggcacaagggggaggaggggcttggtcgtccgtccgcccgggcacacactagggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 77061 - DNA, 198 bp, Glycine max
  Peptide Sequence Number=SeqID_193839
atgaagaagaaactaaccggatgttgcacaaggtgcaaggctagcaagagaagcgatgtagggaatgacaacagtcgtaatttcacagcgcctcggcttcacttttcttcttcttttcctcttcctgggcagctcacccaggcgagctggtttcttaggctgaaggacctagctcacccaggcgagctggttgcttag

SEQ ID NO: 77062 - DNA, 279 bp, Glycine max
  Peptide Sequence Number=SeqID_193840
atgaagcttttgatgctttttgcaaacttgccaagggcatataaagtattcaataaaagaactctgaatgttgaagaatttgtacatgtggtttgtgatgaaaccaactctattgttcaagaaaattctttagaggaagatgcaggttttgaggaaaaggattctactcttgaagatgacatcaaggctgaagaacttgaacaaaacaaagaaatctctacgacaatgtgtaaagaatttcctagagaatggagaactcaaaaattttggataacataa

SEQ ID NO: 77063 - DNA, 246 bp, Glycine max
  Peptide Sequence Number=SeqID_193841
atgataacttggttcataggatactttaagggtttcagcagtagacttccaatcctggagcatctgcagttaccaagaggactgtcagggcaaaagactcatcttcaactgctgttactggtggataaggcgtatgctaagaaccacaatgatactaaactgctggtggaagtaatgaggcttctgaaaaagaatgatttaccagtgcaaccaggcacagcagatatagttttcagtgaagactag

SEQ ID NO: 77064 - DNA, 394 bp, Glycine max
  Peptide Sequence Number=SeqID_193842
gttaattaggcaaattggcaaaagtgttgttttcaccttctcgataagccaatttgttggcttagcaagcattcctaagcgcgacactcagtggttaagcgcgaggaagaagctagaagaagatgagctatcaggttcgctgagtgcaccactccaggtcatcaagcgcacacctttagctcatccgctaagcgagacaagcgcgctaagccaaaatacagttatgcaccctaagcaattcagatttgagctaagcgtgagtttggcattttttcttgagaagcctctgcttgcacgagagtctagccttggcttgaagcttttgcatgttaaggaagttctagagagagaaaggtccaagttccaaaaagttttgagagattttgctgtgtga

SEQ ID NO: 77065 - DNA, 294 bp, Glycine max
  Peptide Sequence Number=SeqID_193843
atggaagaaggagcttcaccaccaaaaattgccttggataagaagcttgaagaggatgctttaatggaggaaaagaaagagaaaagggacttgatagcttccttgagaagctttcatgagaaaacttccttgagaagcttctttgcgaaaatttccttgaaaagccatagcttagctaagcacacccatctaaaaactaagctcacctccttgagaagcttccttgagaagctcgagcttagctacacacacccctctaataactatgctcacctccttgagaagagaagctag

SEQ ID NO: 77066 - DNA, 540 bp, Glycine max
  Peptide Sequence Number=SeqID_193844
atggtaattacaagagtttcggatgctaataacattcccgcaggaaacagacttaaggtattgctaataagctcaggcattaatgcccaggttgcaatcggtaagaaaagcatcacaaataataataccatattagaattcggtaattcctctaacaggggaatcgtacttcctaaagtagaaaatgccaccacaatgaatgcaagtgagggtactatggtttgggataccactacaggaagcttcagatattatggaggtaccactccggcctggaatccacctgctgcaggaggtactacgggaggtgcgccttcgggttcggatgctaatggtaaaaaaatgattatcgggtcagatatttctgatgcagatggaatacttattctagaagcaaaacagggagataaggcccttgtattgccatcgataagccagccgtcggaaagattctcttctccgccaactggacttatggtctatgatacggcaactaatcaggttgctgtgttcaatggcaccaagtggacatacttttaa

SEQ ID NO: 77067 - DNA, 1216 bp, Glycine max
  Peptide Sequence Number=SeqID_193845
cggtttctggcggatatcctgcatccgcgggggtagtgcgggcgcggagcctgccgtccgcccggcgttccttgtggaccggacggcgcgcagccgcgcgcctgtcgacgataatgtgagggttcttcatgcatttcacgtccaccgccgcgatgtacaccctcaaacagttggaggcgttctactggagctcggaactgggcagcttcagcgcgtcctcgcgcaagctgcacaccacccagtcggcggtcgccaaacgggtaggggaactcgaagccttcgccggcgcgccgctgttcgagcgccgcgccaagaagctggtgctgacggcccagggccgcaagctgttcgagctggcgcgcgagatgctggacctgaacagccgcatcgtgcagaacatggccgacccggccagtttcgagggcgtggtgcggctgggcgtgaccgagctggtcggcatgacctggctggcgcggctggtcaaccagatcagcctgcgctatcccaaggtgcagttgatgcccgagatcgacggcggcatcacgctgtacgagcggctggagcaggaccagttggacctggccatcatgccgggcccgttctggagctaccagtacgactgcgtccacctgggcgcggtgaccaacgtctggatggccagcccgtcgctggacatcgatttctcggcaaggctggcgccgcaggacctggcgccgtacccggtgatttcacagccgaccaattcggcgctgtcgcatctgtacgatgcctggttcgccgagcagggtctgtcggtcaagcgggtgctgacctgcaacagcctgggcatgatggcgcagttgaccatgctggggctgggtatcagttacttgccgggggcgtatttcgcgccgctggtcgagcgcggggcgctgtgccagctggatgtgcagccggatctgccgacgatcaattactacgcggtgcacaagaagagcatcgtcaatccggtggtgtcgcgggtgatcgatattgcgcgggaggaatgcgggttcgaggtggcgggggcgttcctgccgcatgtgccgccggcggtacggtccgcttgaacttcaatcggcggcatggacggctaccgctgtgtattccaaaagaacaagcaatttttctagcgcctgcggtcacacagtgctggccatgcgcgcgatcggggcttgacaatatctctgctggttag

SEQ ID NO: 77068 - DNA, 762 bp, Glycine max
  Peptide Sequence Number=SeqID_193846
atgactgaagacatttttgtctttgaaatatgtgcggattaccgtatagggcgtcttcgcatgctacttgacttctcacagataaccgttgggtatatccgtctgccacctgactcatgggccaggataaaaggggcactcttgagtcacggtaacaaaagtgtgtgtgcggataaccatcggacgctgacatctctaggaacggtgcagatgaccacactggtctctgcgagtcaacgggctcgcatgcctcttgttgacaaaggtgcgcataaccctaagtctcggtcggaagacgctgacatcccaggggaaggtgtagatgatgacccggaagacgcttacatctccgggaaaggtgcaaattatgactctccgtctgaagacgctggcatccacggggaagggatagcaaatgagactttttcgcaatctcggctggaagatgctgacatctctgggaaagtcttacggatagcaaatgagactctttggcaatctcggttggaagaagctgacatctctaggaaaggtgcagtcatacggatagcaaatgagactgttttgcagtctttgccggaagacgctgatattctcgagaaagtcttacggataggaaatgagacttattcccagtctcggccggaagatgctgacatctctggcaaaggtgcagaagaagctgacatctctgggaaaggtgtgggtgacgattctcgaccagaagatgcttacatctccagggaaggtgcagatgagaac

SEQ ID NO: 77069 - DNA, 294 bp, Glycine max
  Peptide Sequence Number=SeqID_193847
atgcctatatctccggggaagacttggagtctgacggatcgcaacagatacatttcgcagtctcggccggaggacgctgacatctccagtaaaggtgtaggtgacgacgttagtcactacatgctatcgggcattgagtctgacgggtcgcaaatgagactttttcatagtctcggctggaacacgctgacatcttcgggaaagtctccaccggaagacgcctatatctctggggaaggtgcagatgacgacgttagtcactgcatgctattgggctttgagtcttacggatag

SEQ ID NO: 77070 - DNA, 624 bp, Glycine max
  Peptide Sequence Number=SeqID_193848
atggccttttcactacaagtgttgggtgcaccagcaaaaatgttgggtgcacctagcagcactcaaaacacattcagctgtttggaccatagacctcatggaaaatcaaaattagtcctccttaaaatagattctaaagttaacaggacaaacaataaagacggagacaaattcctacatagagtggcaactaacacaccctatggtggtcaatacatgtgcaattctattaaaggtataaaggggtatcgttacaaggagcacaaagagagccatattacaactcaggagaaaggtgttatggaagcatcaaaagaagaaaggtgttatggaagcatcaaaagaagaaaggatacatcttcaaagataggtatgactatgagcaacacgaatcttgatgggcacattgggatttgtaatgatgagttttggttgaagaacaataaaaaagaagtagaagatgttagtgcggtaggggaaactttgggggtatccttaggaggtgtcaataaggacaaaataattaataaaattcaggaattggaatctagagatagaaagctcaaagaagaaaattgcatgaagaaggactcgatggaaggactcgatgggaaatcacaataa

SEQ ID NO: 77071 - DNA, 144 bp, Glycine max
  Peptide Sequence Number=SeqID_193849
atggcctctgtggagacctctgccatggctaggtcccagatcttaccaaatgtgtatggcacagatgcattttatgaatatgggagcccgggagattgtccccttcttagatacaacattcgggcagcatggtgcccgatgtaa

SEQ ID NO: 77072 - DNA, 640 bp, Glycine max
  Peptide Sequence Number=SeqID_193850
atggataggccagaatatgtgtggaaacaaacttggcaatggatggcagatgatattgtatttaatcatagaagacaaggcatccaactaacaaacaaagaaaaaatgcatctttgtttaacggaaattcaaaacctcttgcaagccaacaggaaaagcctacgagattttccttcaatgccatacccactaggatatgccgccaacccacaccaaaataatctcatctacaatgaactggcttacaacagggacatattggtcgccgaatttgacaaatgctaccagtcgctaacagatgagcaggcttctatttttaataagattatgcatgtggttgcaactcaatcaggtggagtttattttctgtatggatatggtggcacaggcaagacatttgtgtggaaaactttatcatctgctatacgctctactggcggcattgttttaacagtagcttcaagtgggattgcctcaatactatttcctggcggtagaacaacacattctaagtttgttattcctgtccctgcaacaaaaaattctacatgcaatatccatcaagggagtgatttggctgaattgttccatatcacaaaactcatcatatgggatgaagctccaatgtgtcacagataca

SEQ ID NO: 77073 - DNA, 291 bp, Glycine max
  Peptide Sequence Number=SeqID_193851
atgagggaggagcttggcacccagctcgccttcctccagaagcaaccgccttctggaggaacatcttggaaggcccaagtgggcctgaatgttacagaacctcacggattgcgtaacaatgcttccttttggtttccggcatgttgcggaatttcacggatcgtgcaacaatgctttcttttgacttctggcacgttatggaactttacgtattgtgcaacaatgggtgccaagtacctcgaagcggtcaagcaaaggttgcatgccatcaaacaatggtccccgggatga

SEQ ID NO: 77074 - DNA, 177 bp, Glycine max
  Peptide Sequence Number=SeqID_193852
atgttcagccctcctggtttcttgggatcagttgaaattagtgaaaagaatcgtttccgtgaagaaaatccaagccaaggcatttccgtaactcgtccgagacgtttccgtaagcaaatccgtgaagattttccaccgtctttcgttcgttcttcgttgttcttcggtcttcaatcg

SEQ ID NO: 77075 - DNA, 369 bp, Glycine max
  Peptide Sequence Number=SeqID_193853
atgcatggcgccaatggtggtggcgctttccggcaggccgtgccacgtggcgttggtgtcgccattctcgctggcgacttggctttttcctatgtggcattggagtcaccattcttgctggcgatttggccatgcatgggacgtagtggtagggtcagggacgcagtggcaggttcagggatgcaacaggcgagaggcgccattggtgattgcgatttgctttcaaaaaaatttagccttataaatggttctccactccattgctccgttactcctcatatttccaccttcatcttgcttcttcaggtagcttcgttgctttggttcttcatccttctttcgttcattcctgttgcttctaacttcttg

SEQ ID NO: 77076 - DNA, 729 bp, Glycine max
  Peptide Sequence Number=SeqID_193854
atggcgacaccggcggcaatggaatggggagaggcggaaagcctgagcaggcgcaacttcattctatttcatcaccccggccgagccaagagcgtggtaggcaacaaagaacttttgcccggttatcccacgctgatcattgcagatgcagcatacccgatcagtcacactggacagcggcatggaggagacgcgctgaggcgcgtatctcctgggcttgcggtgcacaggaaaacacaggccattaccgccgcgctttccgtgtccatacgcatggcgactggctgccatgcgctgagcgcattaccggcggaacaggccgcggtcgatttcgcgctgacggaactcgaggtcgacattcgataccgagccgctgagatattcgaattcgcgttcctgggtggtcttgccacgaacggcgcgggcgatcttacgaagcggagtaaacatgattttcggtcctttcgagacaggaaaaggccgctgccatgcgcagaacgcataacagcggccttccgctatctcaaaggcatcaaaaatgcctcaatcaaaggcacgcgtgaccgtggagacgcaatccagatccttgagctgcgacagaagctggttcagctgcctgagatcccagacttccacgtccagcgccaactcggagaagtcggtaccgatgcggaccatgttcagcccgcgaatattgacgtcgagcgttgcgatcgactgcgcgactga

SEQ ID NO: 77077 - DNA, 210 bp, Glycine max
  Peptide Sequence Number=SeqID_193855
atggacactattgtcctgtcttgcagtaattttcttctcctcttggctctgttccttcttaacatctatgcatataaaacactaacagaaacagcgattatccagttcaagaggaaaacaaatacaaatatgaatcgaagaaagaagttccctggcaacagcgccaaaaacttgttcggtcgtggcaagtgcattggatcgcgcaagtag

SEQ ID NO: 77078 - DNA, 798 bp, Glycine max
  Peptide Sequence Number=SeqID_193856
atgggttccattgtggtcgtcccggccatgtcagtccgccacccaataaagccgggcgccgcggcccaggtcggtgaacgtcggcgcgtcgtccggcgattccgcccccgtcacccgcagcccgccggtgaaaccgaggtggcggtactggcccaacaggttcaggccggccaccaacggaacgccgcataccagcggccggcccagatcgtcggccacgtccaggatccagccgtcgcggtattgcaatgtcagccgatagtcgtcgccgcccagcgaaatcgcgaacacctgcggaatcggcgacacgggtatctcgaagtagttcatgcgtatctcctagttccagtgcagcgacccgccgttgggcgccgccacgggccggggcgtcttcacgcccaggttctgcttgtccgcggtcttttctttttccttctggcccgcgtacgggggcagcgaggtgctgcgcgtctgtaccaccaccacttcgcgcagcgtcaccgtcgcgaacacggcgccgaagctgtctttgttggtctcgaccgagagcttctcgatcaacatgtcgctgtagcgccgccggctggtgaccacggtcaccggctcgcgcgattcctgcaggctgagcagctgcgagtagatggcggtcgcgtagtcgtcggccgcggccttgccattggccacgtccttggcctgcgcgccggccagcgcctcatacgaggcgttgctccacgcgcacttcaaggtcagcgtcagcggctgctgaaggcatggtcgctgatcgccgatttgccatag

SEQ ID NO: 77079 - DNA, 636 bp, Glycine max
  Peptide Sequence Number=SeqID_193857
atggcttcaggattaattttaaccgccgtcggggccgaggcgatagaggcggcatatcaggccggtgaggtggtcactatcccgatcgtcgcgttcggtgatggcggcggggcctctgtgacccctgaccctgccgtaaccaaactggtcaataaatttggggatgtgccctttacgcagggcgaatcgggtagcggcatgattgccggccaggcggtgattaacgcccgtgagcacccgggtaaagtggttcgggagtttgggctgatgagtagcgccggcgttctgattgcctatggcgcctatccagacacctacttaccggaacaaaacgactcgatcgtaaaagagctggtggtgaattttgccatgccgttggtacacgctgaaagcgtggtgctcgagattgaccccaatatttcggtgctgacgattgaagaggctgatgcccgctatctcttcaggaagggcgacacagcgacgggggatctaggcgccccaatgttccaggcaaacggcacgaacggcataccggccggcgccggcatgtacaaggagcaattggacaaccacgccccattttattcgcccgattatcattggtccgtgacacctggaagcacttatatccccctg

SEQ ID NO: 77080 - DNA, 264 bp, Glycine max
  Peptide Sequence Number=SeqID_193858
atgaatggtgttgatggtgccacaaagaagaggaaggaagaggagaagaagcatggggaaaacaagaggtgtcatcgccaaaaatcatcttcggcactggcacacgacaacgcaccgacgaagagggtggtgcatgtagagggaatcgaagaaggaatctggtggggagaacacatgatacctaacccagtgtgtggatttctctttcattactctagtgttgaattgcaccactactaccaacttgtctctaaagtggaatag

SEQ ID NO: 77081 - DNA, 228 bp, Glycine max
  Peptide Sequence Number=SeqID_193859
atgaatattggttgggtcagaactgattacttcatattggcatgtgcagaagacgacggtgggaataggccagaccggcctacaggggcctacgacctggcctacataaagcctggccaggctcaggcctcaaagattcatcgtaggctaggctcaggcctttcaaagcctggcccggcctggcctattcccacccctatccgcctgccacctaacttcacgagttag

SEQ ID NO: 77082 - DNA, 228 bp, Glycine max
  Peptide Sequence Number=SeqID_193860
atgggtggagtgaaattaagaacatatttggggattgtggcacgtgataaggtggacgtcacctacgagaaggtggacgaaggtccctactgctcagaaggacctgatttgggaggatattcagaatttgaaatcctagaggcttctaatagtacgacgaaaaggaagttacttcagaccatgggcgagagatggaggcaatttaaatcagacctcacgaggaaatga

SEQ ID NO: 77083 - DNA, 276 bp, Glycine max
  Peptide Sequence Number=SeqID_193861
atgatacgcggagataccttacggttatccgcacccttttgtcatccagaggcggcgggcccgatgacaagcagagaccaaatttggtcattctgcacccttgtatcatccagaggcggcgggcccgatgatacgcggaaatacccgagtggttatccgtataaacattcttttgctatctgtgcttggcacccatcgttaggcaatttgtggaaatccgggaacgacaagtcatggtcacccgcgactctcgtcaaccgagaggagcgaaattag

SEQ ID NO: 77084 - DNA, 468 bp, Glycine max
  Peptide Sequence Number=SeqID_193862
atggctcaggaatccaggagaatctcatctaaatgggagcttattgatgatatacatgataatggatggccatctatcactcacgatttactatatctaaagatgggtagcactttctggaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggagatgccaggaagatacttaa

SEQ ID NO: 77085 - DNA, 213 bp, Glycine max
  Peptide Sequence Number=SeqID_193863
atgatgatttggaaattttatgcaaaactggtcatacatgcacccatgtggacactcaagcatcaagtattttgctacctaaatgtcgcaacgtgcccttcgcggggcgaggctcacgggtgcgctttccaaaggaggaaagatgcgcggagtcgccaccaacgtttatttgtggaaaacgtcggaaaaaccgaaggaaaccggtcaaaataa

SEQ ID NO: 77086 - DNA, 330 bp, Glycine max
  Peptide Sequence Number=SeqID_193864
atggaaaccatatccaaaagatttgaagaacttgatgtttgtggtaagtttactctaaagaataaacttcgggaaattgcataccctgatcaaacttcgatgtgtcctcctccagcaaagtcacttatccacgactttattgataatattgttgatgtcaaagttgatggaaattgtggatatcggttagttgtcggtttattaggtatgggtgaaaattcttggtcgatggtccgtaaccatatgcttaaagaacttgacaaattctcaaatgactcaaataatcacttatggacaagaaagacacataattttagagtatacaattag

SEQ ID NO: 77087 - DNA, 267 bp, Glycine max
  Peptide Sequence Number=SeqID_193865
atgaaagataaatggaatgtgcatgaattacatggtatgttagttcaggaagaaacgaggcttaagaatcaaggaagtcactcagtccattatgttataagccaccaaggaaatcaaggagctggaaagaaatttatgaagaagcatgataaaggcaaatggtcattaaagaacaatgacgactctttgcaaatccaaaggaaggaaatccgaacatttctagaaggattacctaaagtgcaagtcttggttcaaaaagaaaagtga

SEQ ID NO: 77088 - DNA, 836 bp, Glycine max
  Peptide Sequence Number=SeqID_193866
atggcgcaggcgcttcatcgcggcttattccaggttcaccgaggaggccagtacatagccttcgttgcgtacggtcttgatcagcccgtccgggccaccatcgtcgcccagcttgttgcgcaggcggctgacctgcaggtcgatcgcgcgatcctgtgcctcgtagttgcggccactgctgagcgcgaccagctgctcgcgcgacagcaccttgttggcatgggcgatgaacacccgcagcaggcggaactcggcgccggacagcaccaccacgcgatcgtccgggtccaccaggtggcgatgctccagatcgaacacccaccgcgagaagcgcgcacggcgcaccgccagcggctccaggttggctggcagcgcctcggtccggcgcagcacgttgcggatgcgcgccagcagctcgcgcggttcgaacggcttggcaagatagtcgtcggcgcccatttccaggcccagcacgcgatcgatcggctcggcgcgtgcggtcagcatgatcaccggcgtgttcgagcgtgcgcgcaggtcgcggcacagggtcaggccatcctcacgcggcaggttgaggtcgagcacgatcaggtccacgtgctcgcggtccagcaactggcgcatggcggtgccgtcggcagccgtgctcacctggtagccggcacggccgagctgctcggccagcagggtgcggatgtcgttgtcgtcgtcgacgatcagcagtcggtgcatcgtgttttcagtctccatgtcgcgatcatcccgtgtcggcagctgaaccgcatccggggcaatgcgtaccagtgtatccacccgtgggcgggatacctgtg

SEQ ID NO: 77089 - DNA, 2121 bp, Glycine max
  Peptide Sequence Number=SeqID_193867
atggcgctggctggcattctgctggccgcacgcgcgggtggcgccgcggtcggctggggctttcagctacagtccccgctggtgatcgccctgctgtcgctggtgatcctggctgccgcgcttaacctgcttggcgtctttgaggtgggactaacggtgcagcgcgtcggggccatcgacatccagcgcggcgcttttttgcgttccgcgctgaccggtgcgctggcgatcatcgtagccacgccctgtgccgcaccctttatggccagtgccatcggctacgcgctggtgcagccccctgcggttgcgctggttattttctttgcgctggcgctcggcttcgccgcgccctttaccctgctgtcgctgttcccgccgctggcacgatttttaccgcgtcctggcgtctggatggatatccttaagcgcgggctggcctttcccatgctcggtgcctgggcctggctggtgtggattctggcccagcaggcgggcagcagcgcgctggctgttgtgctggccgcctcggtggtgctggcgtttgccggctggctgtatggcatggcgcagcagcgccgctttgccggaaaagggcacaaagcgctgttcagcgtcacggcgatattgctgattgcggtgatcgcgccgctgccggggctgatcaagccaggcgcggcgcagcaaggcggtatgcaggcgcaggtcagcaaacagacgtggacgccgcaggcggtggctgctcagcgcgggcatggcaaagcgatttttgtcgattttaccgcatcatggtgcatcacctgccaggtgaacgagaagacctcgctgtcgacccaggcggtgaaaaccgcactggcgaaaaccggtacgctgtacatggtggcagactcgactaaatttaacccggacgttgatgacgtgatgagtgagtttggtcagggcggtttaccgatgtatctcgtgtatccggctgatggcggaccaccgaaagtactgccgcagcgtatgcacacaggcgatagcgcacgtgaaaactggcccggactgatggaacgcgcgcaggccggggatcagtgtgcctatacccggctgctgcgggcgctggtgccggtgatacgcgcgcaggtgcggcgcaggctgagcgatgaagccttaacggaagatgtgattcaggatgtgctgctcacgctgcatcgcgtgcgccatacctacgatcccgcttacccttttctgccctggctgacggcgatagtctcggcgcgcgccgttgatgccctgcgccgccgcggccgccagcagcactgtgcgcttgacgacgctcaggccgccgatcccgccagcacggcagaacagcagcagctggacacccggcaggagctggcgggctatctcagccagctgccgctgcgtcagcgtgaaatcgttgagcatgttcatttgcatgaaatgagcctgaacgaggcggcggcacaccataatctgagcgttggggcgcgatctgtgcccggtgaaacgcccgccggcgaccggaaaacgcgtgctgggctggctggcgctggcgctaccggcgggcatcgcggccagtttgctggtgccgcgcactctgaccgactgcgcaaagctgttgttgccgccgggcctgctgtggctgggattgagcgccagcagtctgctgcaaacggccacgccgctgcagcagcacgacacactgccgtgctttgttttcctgctggtggtgagtctgccgatgctgctgctgaccatcctcagtctgcgccggacgcgggcgctctatccggcccgcagcctggccatggcgggcctgggcgtcgcctgcatggcggtaagcctgctggcgttctgtcatccggtgcacctgcatgcgctggatttgctgcagcacctggcggccatcgtgagcatcatcgtgctgaccgtattgcttggccggcgctggggaatgatgcgctccgcacgcagtcggtcgaacagctgggtgaaggaatccagcgtcgcgcgatagccggtaaagccggctttacggctcttgctcatatcggtaaacgcctccatcggccggcccaaatccgcatcggtgtgccaccacgacgccagtttatcgat

SEQ ID NO: 77090 - DNA, 900 bp, Glycine max
  Peptide Sequence Number=SeqID_193868
atgccttcgccttcagaggactacacgtcctcacctttagaggactgcaggtcctcgccttcagaggactataagtcctcaacttcagaggagtacacgccctcaccttcagaggactacacgtcctcacctttagaggactacaagtcctcggcttcagagggctgcacttcctcatcttcagaaggctacaggccctcaccttcagagggctacatgctctcaccttcagaggactacacgtcctcgccttcggagggctacacgcccttgccatcagaggactacaagtcttcgccttcagagggctacatgccctcgcctttagaggactacacgtcctcaccttcaaagggcagcacaccctccccttccgtggactactcgctacacgccctcgcctttaaaggactacttgtcctcacctttagagggctacacgccctcgccttcagaggactacatgtcctagccttcagagggctacacgccctcgcattcagaggattactcgtcctcgccttcagagggctacacgccctctcctttagaggacttcacctcctcaccttcagaggactacacatcctcgccatcagaggactacatgtcctcgccatcagaggactatacgtccttatctttagagggctgcacgccctcgcctttagtggactacatgttctcaccttgagagggctacacgcccgcaccttcagagggcaacacgtcctcaccttgagatggctacatgccttcgccttcagaggactacacgtcctcacctttagaggactgcaggtccctcgccttcagaggactataagtcctcaacttcagaggagtacacgccctcacccttcagaggactacacgtcttcaccttttagaggactacaa

SEQ ID NO: 77091 - DNA, 306 bp, Glycine max
  Peptide Sequence Number=SeqID_193869
atgcaaagcctattgctgaatccagtttttccaaggctaaaccagaagattctttggactgacaattcaaactgccagaagcttcacaactactttgagggcaatgctggtgcactcagaaattttgaggtccttgatttcttacgagctaaaggagcttcaaaggatccaacaagagttattgccaaagtagcgcagtttgaatacaaggtttatgattatttggttgacactgttgcctccactactaaaaaacttgttttttacgacgcacattctaaggcggttataagaaaaccgtcttag

SEQ ID NO: 77092 - DNA, 333 bp, Glycine max
  Peptide Sequence Number=SeqID_193870
atggaagggttagtggacctagcagcgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtgtggctggtttcacaccttttttctccaagaaggagtcaagaacttccccgattgctagccaaggccaaagcagtggcggacacctactccgcccccgaggagatccacggacttctcagctattgtcagcatatgatagacttaatggaccatatgattggaaatcgctag

SEQ ID NO: 77093 - DNA, 216 bp, Glycine max
  Peptide Sequence Number=SeqID_193871
atgaaaaccattaaagctatgtcaatcgccgctgttgccgctctttcactgatgtcagctgccagctttgcccagagcgtaaccgtgacttcctctacgctggacggtgcagaagctaaaatcgcagcgcaggcgcaagagcagggcgctcagtataaaattactgaagccaacaccaacaaccgcgtgcacatgacggctgaactgtataactaa

SEQ ID NO: 77094 - DNA, 465 bp, Glycine max
  Peptide Sequence Number=SeqID_193872
atggttattattacctccatcgaaggcgcagcgccttctcatcaaacactaaggaatatgaccatgaaaactatcaaaacactgaccattgccgccgccgccgcgctttccctgatgtctgctgccagcttcgcgcaaaccgtttcagccacctccaccacactggatggtgccgaagcgaaaattgccgctcaggctcagcagcaggggatgtgccagaacgggtcgcctaacgggcggccttttttgtcgtgcagtcaggctcgcagcgtatcaagcattctggcgatattgctgaatttgcagcgcagactgtctggcaggagaacgcaatatgctgaacaacgtggatatcaaccggcaggcgctggcttttgcagatgcattacgcacgcaacgccatgctcacgttccggtgattcgttttgcccactggccgcaatttatcgcaacggtgcgcgctga

SEQ ID NO: 77095 - DNA, 351 bp, Glycine max
  Peptide Sequence Number=SeqID_193873
atggcagcaaataaccaacaatttggtactagagttgttgcaccattaaggactactacaagtgaagtttttgtttctatggttgctgataatcagaggctggagaataaacttaaagagtttacatcccttgtaaggcagctagccattggtcaacaaaagaatatgatgatagccaatcaaccaaggttgtgtggtatatgttgtgcttctgatcattcaacagatgcatgctccacaatccaggaaacaaaacaagctgctgatgtttctgccatgcaacctggacaaccattcaaacctcaacaacaacaatataatccttattccaacacctataattctggttag

SEQ ID NO: 77096 - DNA, 564 bp, Glycine max
  Peptide Sequence Number=SeqID_193874
atgtattccaacctttattactgtagagctgtagaattaacagagaagctggatttttcttctgctgtggcattacttggattcaccctcattctagcaatactgcgagcttttaacgtgagggatgaggctactagagtcatgatttctgctcccttacttgcttttgtgacaactcatatcatgtatctgaatttctatgaacttgcttacggtttgaacagaatagtttgcacaggaatggttgttgtccagcttcttatttgggccatttgggccggtgcttcgaaccacccggcacgatggaaattatgggcagtagtagtgggaggaggattagctatggtgttggagacatatgacttcccaccttacatgggatatgtggatgctcatgctctatggcatgcaacaagcattcctctcacatttttttggtggggttttataagggatgatgctgagtttagaaccactgctctgcttaagaaggcatactttcttagtgaaattaattgcaattatacacctgttcaaaacaatagaagctgcgtggattcttaa

SEQ ID NO: 77097 - DNA, 1228 bp, Glycine max
  Peptide Sequence Number=SeqID_193875
atgacacatgagagagttgatatcatcagtgttttggttgtggatgacgataaaacttctttggccattgttagcaatatactcacctcattaggatacaaagttctcactgccaacagtgccctaaatgctttggagattcttagagagttcagaggctttattgatctcctcattacagaacttcatatatctgggatgaatggatttgaatttcaaaagtatgttgaaaatcaattccacttacccgtgataattatgtcttcagatggaagaaatagtgtaatttccaagagtttagcaaatggtgccgcacactatattttgaaacccttttctgcagatgacttcaaagacatttggcagtatgcaaggaaactaacttttcaaaatattgaaggggggtcaataccaggtgataacacttctattcaggatgttcactctgcaatatcatcgaatgtgagcaagagaaaaaggaagtgtttcccaagaaagagtacccaaatgaataaggaaggccaaagtggagaaagctctacgcttgtaaagaaaccaaaggttgtttggacaccatatcttcacaaccgctttctgcttgccataaaacaaattggattggagaaggctgttccaaagacaattcttcaagtcatgaatgtgccaaacttgacaagagaaaatgttgccagtcacttacagaagtatcgcatattcctgcgaaaagtagcagataaaggattgcttgagggcttatctaacagggatctaaggtcaaggtttgcctatggcctttcagcatcaatgatcaaagacatccaagcaaaaactgcgaagtcgcgtgttactgcgcagcaatatatgaaaagaatagcacatcaatcagtgtatggaggaatagccaatgctgttaaatcttacaaccatgtttcaagtgtgactaatactccacttggaagaagccatcaatttccccatccatatcacaaaggcttgaatatgatgcttcacaaccaacatggtagttcttcggatcaagcaaggcttagagcacaatcaagctttggaagcaatgttgggaccaataatatccagcaaaatacgttgggaagctatgcaaaccaaccatattatgcacaaagctcttacaacaatgttggtgttgtctttccttcagatggagtaacgagacatggcttgatgacttccacaaatggcctaagaggag

SEQ ID NO: 77098 - DNA, 345 bp, Glycine max
  Peptide Sequence Number=SeqID_193876
atggatcttcttaatgagactgaagagaaccataatgcaaatgacttcttgaagtctgacttttcaagctctaatcacgctgtgcagtcccttgaacagtcttacaaagctctgacaaattaccaagctactactgatgtgattattaacccaactaaaggcacatcaaatctgccaaacgagacctcaacaagctctgacaagaattctaaccgattaatgggaggtgatgatggatatgcaaacatggaacacttgaacaggattgggatttcgaacttattgaagccctgttcggtgacgagaaaaatcagggagaatgagaaggatgctccagaatcatga

SEQ ID NO: 77099 - DNA, 402 bp, Glycine max
  Peptide Sequence Number=SeqID_193877
atggctccgaagaaactctccacgaagaggtctagaagagacaccgcagtggaagggtccagtgccaccctcgagtttgatagtcatcgtttccggagcgccgagcaccagcagcgcttcgaggccatcaaaggatggccgttccacagagagaggcatgtccagctcagggaggatgagtatacggactttcaagaggagatagctcgcaggcgttggacgtcgctggtgactcccatggctaagtttgaccctgagatagccatcaatgtgagttcagccagaggaggaacagggccgacgggttcgacgaggaggccattgcccaattctaacccaaggagaaattgggcttcacgcaagctgtctggcttagtgcacaccttcagcatgaatttatga

SEQ ID NO: 77100 - DNA, 297 bp, Glycine max
  Peptide Sequence Number=SeqID_193878
atgcacaaaaataactgcagtggggaggcaacaaaaagatcttccgcaggtgatttggttcccattgatttagagattaatgccacttgtagaaggcgtaatcaggaaagaattataaaaattttgcaggacttagaggcaacagcaattctagaggaagaacctcaatcttctgaggcatcttctagttttcctattgtagaacattctcatttagatcctagtgaagactacatcatggctgaagagccaagaagagttactctggaagattattcaagttctaatgtgccataa

SEQ ID NO: 77101 - DNA, 1236 bp, Glycine max
  Peptide Sequence Number=SeqID_193879
atggcgattttggatatccaaatcgccaattcatccatgaaagtgattcaaggcgcgctttctgcgacgctgaatgacagttcctggctgatgacgtcttattttaccgcagagatagtggcaattccgctttgtggttggctttgtcaggctctggggaccgggcgttatgcgctgtggtgcattgccggctttttgggggcatcgctgctgtgttctgccgcatggaatctgagttccatgatcgtgtttagggcgcttcaagggttcagtggcggggcgctaattcccatttcatttcgcttgattattgagatcctgccattaaaaaaacggccgttgggcatgtcgctgtttagcattatagggactttcgcgccggcggtagggccggcattgggaggctggttgacggataatttctcttggcacgccatattttatatcaacgcgatacccgctttgttgtcctgggggttgattcactatgctttaaaacaccctgttatcgactggaatattattcgtcgcggggactttgtcggcatcatttcggtcatgctgtgtttgggcgcgcttgaggtgattttagaaaagggcggtgaagaaaactggctagaatcgaatatgatatgcgtgttggcggtcatttccgctgttagtttcttaatatttatgtatgcccaattgacgcatgcccagccgcttatcaatattcgcttattccgggactacaatttctcgtgcgccatcttggtttttgccatgttgggtgtcgctatctacggtacgttattcttggtgccgtattacctgacgatggtacatgactacaatgcttctgatatcggtacggtggtgatctggatggggtttcctcagttaatcatcctgccttttatcccgttgcttattcaacgatataaccagaagtatctaatttgcatagggtttgttggtctggccatcagtgcctttatggactgtgcgatggacggtgactttgccggcccacagatggcctggtccatgttgatccgcgcattaggccagccctttatcatggtgccgctttccttgctggctacccgcaatattcagcaaaaagacagtgcctcttcggcggtgttgatcaatatattccgcagtctgggaggctcctgcggcactgccatcttaagcacctttttcatcacgcgcatttatacccatgtcgacgtcgttaagacgtcgttg

SEQ ID NO: 77102 - DNA, 402 bp, Glycine max
  Peptide Sequence Number=SeqID_193880
atgggctacgtgggagtacgtgagctcagttggaggtgggcaacaggggatggtgggtttatgcgcgcattgtggatgtggaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgacccaacccgggcatagtcggtcagcttgaaaacgaggtcaggaaactaggggagcttctggtaatcgattaccagggggatgtaatcgattaccaggctttagaaaggaactggaacactgtggaggcctctggtaatcgattaccagcctgtgtaatcgattacacagaggaatga

SEQ ID NO: 77103 - DNA, 210 bp, Glycine max
  Peptide Sequence Number=SeqID_193881
atggctgaagtaaacaaggtgcaagagcggatgaaggctgacatggagatcatgaacgaacagatagccacaatgatggaggccatgatgagcatgaagaagataatgaaggtcaatgcggctgtagttgccactgtcagcactgtttttggggtggacccaactcccccatatggcctcaaccaaataaatcatccaacctcagatatg

SEQ ID NO: 77104 - DNA, 663 bp, Glycine max
  Peptide Sequence Number=SeqID_193882
atggggtggttcgagtaccaaggaaatgtttggaagcgaaggcgagaaccttggcaagccgagacgaatgggcttcattcattgatgtcctcaattgatgcttttcttgcctttcgcgactgcaaggaaagctcgttcgttgctatcttggccgatctatatgacacattcgaccgaagatgtgagaagaacacaaccctctatgtatggttggtctcacaccttttccgccaagaggagagacacgtttgcccactagaaggtcatcgttcatgcgtcgagaagaaggaggcaaactgggaccgactcttagcaagcaaagaaggagcgtccgtcaattggttccctcaatggaaggaaggaagaaccgacattctcgtctcatgtggaggatttccaaatgtttccttgatggggacgaggggttgcattaattataatctcgtcctcgccataaggcaacttggctaccccatgaggggggcaccatcagaggaaggcctcacaccttttattgcacgaggtttcaatagccccaacgcgggggtgcttcagggggtcaacaaggcatgggaaatggtgccaaagaaggacaaggaactcaggggaagtagcaacagggccgtcggtggctaccgtagatggttgaaagcctacgcataa

SEQ ID NO: 77105 - DNA, 177 bp, Glycine max
  Peptide Sequence Number=SeqID_193883
atggcggtggcaacagcaaaggagaaggagaaggcaccaaaacaacgtcgtgatagaagaggatccatcactggtgaagacaaaggattacgagagctgcacaccattgcacacggtggaatcaggatcatgttatggttgttgcagttaaatgtagtcattgtcgttggccattga

SEQ ID NO: 77106 - DNA, 993 bp, Glycine max
  Peptide Sequence Number=SeqID_193884
atgtcgcgcacccacagcggctggtcgctgaacagcggctcgacctgctgccacagcgtggcttcctgcggattaaagcgcggcgcgaagtcgggcaggtgcagccagccctgtttctgccgcagctcgccttgtgccagcatctggtcgattaatcccggcaccagcggtgccggcgcatgcggcagcgccacacggcgcaggcgatcgtggccgatgcccggcagctccgggtgctgctggtggaaggtgctcagcgcttcccgtaaacgctgctgccaggcgctggccattgtgtcgctcatcaggctgacacccagccgcgccggattcagcggcagcagcagcgcgtccagcgccggcgcagtagtccggctggcgtttaccgcgctttttgctgtcgcacagcagtacgcgtccgccgcccagcgtgtgctgcgcattgctgtcgcgaataattatccgatcgttttccgccagccacagcggctggctgagcaccagttcagccacatccaggcgcagtgcgacgatcagccgctgcgtgccggcgggacgtggctgcgccagcagccagtcgccgcgcgtaatctgtgccttctccacgtcaccgacgatattcagcgcgatgcgctcgcccgcctgggcgcgcgtcaccggctggttctgcgcatgcagcgcccgcacgcgcagcggcaggttcaggctgctgagccacagcgtgtcgcccaccctgacttcaccgctcagcgcggtgccggtgaccaccagcccggtgcctttcagcgtgaaagcgcggtcgatggcgagccggaaacggcggccaggctcaaacgccggtgcgttcaggctgctgaggtgctggcgcagcgtttcaatgccctgctgcgtatggctgctggtaacaaactgcgctgccgctggccagccgagctgctgcgtgagctgcgcgacctgctgctgcacctctgcgatgcgtgcggcgtcaacgcg

SEQ ID NO: 77107 - DNA, 1819 bp, Glycine max
  Peptide Sequence Number=SeqID_193885
gaacagttctgccgagtggcgccacagcttcgcggttacaacaacatcctctatattcccaaacactcaattcaccaaccatgagtctcttccatcacttcatgaatcattcaatgagttcaccaaagtgtaccctcagtattctgagactgaacaagttgaccatgttagagccaagcactatttccacctctcactctccaaccaaacttgccttgattacattggcattggcctcttctcctactctcaacttgaacaccatgaaacatcaaaaagccaagtaccctcatcttcaattcctcaaacaccccaattaccaccacctaattactcagatattccattctttagcttatcttgcaagactgggagtctaaagactttgttgcttcatggtgggcaagactcagaatttgaggctgcaatgaggaagagaatcatgtgtttccttaacatatctgaaaatgattacttcatggttttcacagccaacagaacctcagctttcaaacttgtggcagattcataccaattccaaactagtaggaggcttttgacagtttatgactacgagagtgaggcggtggaagcgatgattagttcctcaaagaagagaggagccagggccatttcagctgagttctcatggccaaggctgaggattcagactacaaagttgaggaagatgattgagcgtaagagaaagaagaagaagagaaagggtctatttgttttgccacttagttcaagagtgacaggagcaagatatccttatctttggatgagcatagcacaggagaatggatggcatgtattggttgatgcatgtgcattggggccaaaagacatggactgttttggcctctctctctttcaaccagactttcttatttgctctttctataaggtctttggggaaaacccttctggatttggatgccttttcatcaagaaatccgctatttccagcttggaatcttcctcttctgcaggaattgtcaaccttgtaccagaaaagcagcctcatcaattatcagatgattcttctggcactgacttagaaattaaaaacaaatcattaccaacatgcctacatgaagagaaaccatttcctttgtcatctttctcaggtccaatgcaaactaaacaatctgaaactgttgaagaaggagaaccacctgactcaaaactaaaagctcctcaatgttctgaaattgaggaggtacaacaagagccagttcagactcctaagacaagcaatgtccaagaaagtgacattcaatttaggtgcttagaccaagtggattctttaggattgattctcatcactaacaggtcaaggtacctgataaactggctggtgaactcaatgttgaagcttaagcatcccaacacacaaggggttcctttggtcaaggtttatggtccaaaggtgaaatttgatagagggcctgctttggcattcaatatatttgattggaaaggtgaaagggttgagcctgctcttgtccagaaacttgctgataggagcaacatatctatcagctatgcatttctgcatcatatttggtttgcagataagtatgcagaagagaaaggaagagtcctacataccaaagtggttggagaccaagaagtggtgacaacaaccaacaagaagaaagatagtgttggaatcagtgtggttactgctgcattaggcttcctggctaattttgaagatgtctataagctttgggcttttgttgcaaggttccttgatgctgactttgtggagaaggagaggtggagtcatggaagaatccatgaagtgtga

SEQ ID NO: 77108 - DNA, 1644 bp, Glycine max
  Peptide Sequence Number=SeqID_193886
atggcctcttcacgccctgccaatgtgggaatccttgccatggacatctacttccctcccacctgcgtcacccaggatgctttggagggtcatgatggggtgagcaaagggaaatatactattgggcttggacaggattgcatggccttctgctctgaggttgaagatgttatctcaatgagcttgacggtagttacttcacttcttgaaaaatttaatgttgatccaaagcaaattggacatttggcggttgggagtgaaactgttattgacaaaagcaaatcaattaagaccttcctgatgcaagtttttgaggcaagtggtaatactgacattgaaggtgttgattcaactaatgcatgctatggaggaacggctgctttgttcaactgtgtgaattgggtggagagtagctcatgggatggacgttatggacttgttgtttgtacagacactgcggtatatgctgaaggacctgctcgtcccactggaggagctgctgcaattgccatgcttgtagggccagatgctcctattgcttttgaaagcaaactcagaggcagtcacatgtctcatgcatatgatttttacaagccaaaccttgctagcgaatatccaattgttgatggaaaactctcacagacctgttatctcatggcacttgattcctgttaccggctttactgtgagaaatttgaaaaattggaggggaggcctttttcaatgtcagattctgattattttgtgtttcattctccatataacaagcttgtgcagaaaagttttggccgactatacttcaatgacttcttgagaaatgccagttttgttgatgaagttgccagggaaacccttgcaccatatgcatccttatctggtgatgagagttatcaaagtcgtgatcttgaaaaggcaaaccagcaagctgcaaaacatctatatgatgcaaaggtgcagcccagcacactaatcccaaagcaagttggtaacatgtacactgcatctctttatgcagcatttgcatctcttcttcacaataagaacagttcgttggtaggtaaacgggtagttatgttttcatatggaagtggtttaacagctacaatgttctccttccagcttcaagagggtcaacatccgtttaacttgtcaaacattgtaacagtgatgaatgtttcggacaagttgaagcagagagttgagcctatcatttgtaggatttgtgtgtttaaagttgttgtacttgagaccttgtgcatctcagtaccaaaaattgacatgggaaccgatgcattttggcctcaagttttggatcaaactaatccattgacccaaatagttcatgggagaaaattgagttatttgggccctggaggattgatggagcgaactgctagttttcagggttggctctggtggatccctaattcgacttcttctacatatgagtcatgttttcatcgaaagaagtttcccattatgattcctcctgaaaagttcgttgaaacattgaagatcatggaacaccgttatgggggtaaggactttgtgacaagcaaggactgtagctacttaactccaggcaccttctatctcaccaatgttgattccatgtacaggagattttatgccaagaaggactag

SEQ ID NO: 77109 - DNA, 1413 bp, Glycine max
  Peptide Sequence Number=SeqID_193887
atgacgaatgaattaatagctgaaaaatacttcgaagcaataaactttaaagaaactaaagagctgaagaaagctattgtttttgcagctagtattaagcatgcagaaaatctcaggctagcttttattaggaaatataatgaattaatgggatactctcctgataatgctgaggctgaagaaattttccgctctattcattccgctattcctaatcatgaggaattagttagagaattccaaagtcctaactctaggatcaaagttgcttttactgtagatttactatccactggtgttgatgcccctgacgtagaagtaatagttatggcaaggcctacaaaatccagagtattatatttacaaatgaaaggtagagggactagaatatataaagagggaaataaagtaaaggacaaattctatcttattgattttgtggacacatggagattagaaaatgaagaagacaagccgataacgaatgaggacatcgtgaaagaagaagaggaagaagagaaggaaataagcgagcttatgggttccacagaagaaccgcaaaggactactgccaagaaggaagtgaagagagaacaaaagagagaagagatggtaatcttagatattccagtaagtatagtttatgctgaagtaattactcctgagaattttaagaatgaattaaaaggaataagtgaacaagtagtaagacaagtaaaggcttatttacaagcacaagaagaagtacaaataaagaagacacaatttgaaaccgcagtcagatccttcgactatttttataggaaaaatggaggtaaaacgttaaacgagaattatttaaaggagcttgaagctttccttaatgaacaaggcataacagaggatgttttaaaggatacttatggagaacccgacgctaccctaaaagacttcgtagaagtggctttgggattgaaaactttcccgactccagaggaaaggaaaaggaatcttatcaaggaatggtataacaagaaaggatatcctaaagaatgtgaaagattattcatggcactctatgactttagaaagagaaacccaaatatagataagaaggcgtttttcaacgctgaggtggttaagcaagctggaggattttctaaggaaatttaccaggaaaacatagctaaagagttgggtgaagactataagtccactataccaagtgagtacagattctttaactgggcatgtgatcctagaaattatgctagaagtaaggggttcaaaacagtaacagaatttttggataaaatgtttctcgatttggctaatttaccagataccggagatccaaaaatagatgaagatagaagtataatcaagaaaatattctccaacaaaccaggagaatgcaaaacgataatacggtaa

SEQ ID NO: 77110 - DNA, 330 bp, Glycine max
  Peptide Sequence Number=SeqID_193888
atggagaatatgagttcttgggcaattgggttccaacgaaacctgtggtttttccaaaagaagaattatcctctggagaaggcaagcagattcttaagcggtggtttcataaaggctaattttaagagggaaaaggttgttgggaacaattatttggatattgtagttaaggattgctctagttttgtgaattctagattctccaattctctggtttttgttcacagatcagctagtagagtcacagatttcatggctcatttttcttttgagtgtaaagaaagattttggattaaggacatccctcaccaattagaacctattatctaa

SEQ ID NO: 77111 - DNA, 429 bp, Glycine max
  Peptide Sequence Number=SeqID_193889
atgagtgattatgttgagattgatattggtgaatttcctaaggattgggatgtaagaaaattaaaagatgttataataaaagcaaaatctggaggaacacccagaagaaatgttcctgaatattggaacggaaacattccatttgcaaagatacaagatataacgaaatctgttttaaatagctcagttcctatacttcccctagaagaacaaaagaagatcgtagaactacttcaaaaggccactgatatttattacaccttaaaggattatattattcaaattagaaattctacagaaactataacgaaagtaataagaaaggaattattgactaaaggtatagggcatagagattatgttgagactgatattggcgaatttcctaaggattgggaaagaggaaaagagatgagaatagtaaagtaa

SEQ ID NO: 77112 - DNA, 306 bp, Glycine max
  Peptide Sequence Number=SeqID_193890
atgggtggaatcgtctctactcctccgacacacaagtttccgttgccgaccatggaaacttgtgactatgttcggccatcgaaacttctactaaatgtgactatcgagaacagcttgggtgcaatacaggtgctgttgtcgcctgaagacaccgtcgccgatttggtaaatgcagcgttgctaatttatgaaaaggagaagaggaggccactcttgaaggacactgacccaaagtgctacgaccttcactattccccctacaccctccaaagtatatgtttggctgcagcaggattggccatgtga

SEQ ID NO: 77113 - DNA, 369 bp, Glycine max
  Peptide Sequence Number=SeqID_193891
atggcccttaaattacaattacaatccctttcctccaaaaaagacttcgacgtaaagacgcaagcaaagtcaacaagaatcaagaaggcaaggatgcgtgggcttgaaccagtgtcatggttccttttaataatgttagcgttacgattgatacccaacatggaagagtgttcttctcccgctattgatgtagagaaacacactttggaagaaccatgtaaggaattctatgaggtcagacaaggggaaaccttgtacagcattgctgagaagtgtagggatccccatatatggttgtggaacccgcacgttgaagaccccgatgatgtttaccctggtgtcatcgtccgattaaaacctgttcgatga

SEQ ID NO: 77114 - DNA, 210 bp, Glycine max
  Peptide Sequence Number=SeqID_193892
atgaggatgctaaaggtaaagatgtcagggctaatccctgtttatgctggaacccttgagctaccccctcgtcgtgaaaaagtgcagtgtggtgagggttattgcatctgggtgataaaccctctcgagaatgttggccaattcagaaaaagcaaaagtgatgtgagctttagatgccagaaacaattgatgaggatgctcagagtatga

SEQ ID NO: 77115 - DNA, 402 bp, Glycine max
  Peptide Sequence Number=SeqID_193893
atgagtgaagatatcagggctaatcccttgttgactgtaatggttgaaaaggggaatcacagtgggatagtgcttcatcttcacgtgagaactgagaagactgttaaagtggatgataggagggggagatcgcttaaaaagcatgcggttgaacaaggcaacaacatgatggttatcaaggtgattgtcagtttaagactgagaatgagaatgaagaaaacgtggaaacacagagagggagggaagaaacctgaagaaggaagacactgtgacgggccaggccggaaatggaaagagtgtggtgtgggctttatggcaaaaggaggccgacacacctcatgcataaggacagctcaagaaaagtacaagcatccaggatattctcacagattttgttactaa

SEQ ID NO: 77116 - DNA, 834 bp, Glycine max
  Peptide Sequence Number=SeqID_193894
atggttgcatctgaatatacaattatttgtgctctatttgataaagatgagaatgataaggcggagaaaatgattgctagaggcttactactttccaaacctactctcatttgcttgtatatacaaacatctaaacacatttatgatactgactttgctggaccctttaagccatgggaaggcattcgaaagcagtggcttaactatgtagagactgccacgcattctcttgaacacccaaaacaaactctggagatcatgatcaagtggcagccaccttctcaagggtggtttagcataaacactgatgacaaagtccagggtcaggatggtatagtaggctgtggaggattaatcagagacgccaatggacatgtttgcggctttgcaaaaacaaataagcttgtgcttgatcttcattgcggagcttatgaaggtctttgtatggcacaaaatagaggccttacagccgtgggactcaaaatggatgcccaaacagtgagtcagagcttggaaagaacacaggaaggatgttcctctagacgagttgttagccaatcagtgtccaagcctgatagcaccagcagcagaaggagcaaggaagacatctcacgtaaagctgcatgcatggcccttagtcaaatgcgcaagaggttgcctcgaatcaaggcatttcattttcttcctctcgctcataacaaagccttaaacagattgttgcagacagattggcaagagccatgcttgtgtcagtgcaaatatccatctggacagaaaactgaaggaagtgctccacttctttattctgtatggggagtgcttatcacttattag

SEQ ID NO: 77117 - DNA, 1032 bp, Glycine max
  Peptide Sequence Number=SeqID_193895
atgctccactctcaatctcattataacaatcacaatgatcacaatgatgctgttgccttattcaaccgcatgctccttatgcgccctcccccacccaccttccaatttaacaacattttgagttctcttgtcaagatgcaacgtttccccactgccatttctctttctaaacatttggatttcaaagggattacatccgaccttgttactctgaacatcctcatcaactgtttctgccatctgggtcagatcactctttccttttctgtattggccacgattctcaaacggggttatcacccagatgtaataaccctcaccacactcatcaaaggcctctgtcttcgtggggaggttaagaaagcactgaaatttcacgatgatgtcgttgccctagaattccagttagaccgaattagttatgggacattaatcaatggtttgtgtaaaataggagaaacaaaggctgccatacagttgatgaggaatctggaagaacgctccattaagcctgatgtggtaatgtacaatataataattgatagcttatgcaagaataaacttgtaggggaagcttgtaatttgtactctgaaatgaatgcgaaacaaatttatcctaatgttgtcacctacacgactctgatctatggcttttgcatcatgggttgtttgatagaagcggttgctttgttaaatgaaatgaaattgaaaaacatcaacccagatgtctatacctttagcatattgattgatgcattaggtaaggaaggaaagatgaaagcagctaaaatagtgttggctgtaatgatgaaagcatatgtaaaacctgatgttgtcacttacaacagtctagtggatggatacttcttggttaatgaagtgaaacatgcaaaatatgtattcaattctatggcccaaagcggagtgacacctggtgttcagagctatacgatcatgattgatgggttatggagaatagcttatgtttgggatctcgtcgataagatgcgtgatagaagtcaacttgcagat

SEQ ID NO: 77118 - DNA, 1344 bp, Glycine max
  Peptide Sequence Number=SeqID_193896
atggacgtggacggtggcaacaagcgcgtgtacaaccgcctcggtggggacgccaagcaccagaaagtgtgcttccactggcaagcgggcaagtgcaaccgctacccgtgccccttcctgcacagcgaattgcccgcgaattctcaccacgccaatggcgcctcctcgaagcgggcatacgacaattcgggcttctcgggcccgcgccgcagccccagtttcaacaacacgtggggccgtggcgggagccgtggtggcggtggtgccggtgccggtgccggtagaggggtggtggtgaaggcggagaaagtctgtaattattggattcaggggaattgtagttatggagagaggtgcaagttccttcacacttggagtgtgggggatgggttttctttgctgacccagcttgaagggcatcagaaggctgtgagtgcaattgcctttccctctggttcagataagctgtataccggaagcactgatgagactgcaaggatttgggactgccaatctggaaaggtgtgtgtaggtgtgatcaatcttggtggtgaagtaggttgtatgatcagtgaaggcccttgggtctttgttgggatacccaattttgtcaaggcctggaacacacaaaatttatcagagctaagtcttaatggtcctgttggacaagtatatgcacttgttgtgaataatgatatgctctttgctggtacacaggacggatctatattggcatggaagtttaatgtagctaccaactgctttgagccggctgcatcacttaaaggtcattctcggggtgttgtttcattagttgttggtgccaatagactttactctggttcaatggacaatacaataagagtatggaaccttgaaaccttgcagtgtttacagacactaacagagcacacatctgttgtgatgtctgttctctgctgggaccaattccttttatcttgttcattggataaaacagtgaaggtatggtatgctactgaaagcggaaacttggaagtgacatatactcacaacgaagaaaatggtatacttaccctatgtgggatgcatgattcacaaggcaaacccattttgctgtgcgcttgcaatgataatactgtgcacctctatgatctgccatcatttgcagagagaggcaagatattgacaaaaaaagaggtacgagcaattcagatagggcctaacggcatattcttcactggtgacgctgcaagaagggaattcgggctgaggttgggattgggaagaggcagaaaaagacagaaaaagagaggggaatctgagctgtggaagtatccttggcacaaagctgtgctcaagtag

SEQ ID NO: 77119 - DNA, 732 bp, Glycine max
  Peptide Sequence Number=SeqID_193897
atgagttgcaaaataaactccttaagctcaccaattccatgcaaattttacaccaacaaaccaaagcttagaagaacaaacaccatcttattttcctttccctcaagtgaaaaacagcaaaaaaccatttccaccagcacaagtgaaaccccaacaactgaggcttacactgttagcttcaagacagaaaagggttgcaagcttggcatttcaaggtatcctgactttgaatatgatgcagaagggggaatgggaactggagttggtgcaaaggtcacagagaataataatccagccaacaatgaccttcctgtttcatttgatcttgaaactttgtatattccaccactaacaagttctaccaccaagtttcttggttttccattgccaccatttttgaagattgatatagttccagaggcattccatggaagcattaaccaagaatctggcaaggttgatcttgagttcaaggccaagttcttgttttctgccggtagtctctataaggctcccccattgatggtgaagacagtgttgacatctgaagaaacaaagggcacaatgaggagtggaagaggcaagagattggataaagaggggaagtgcagactggttggtgtggcaacaattgaccctattgatgatttctttatgaattccttccttggtctcccaactgagtgccttgctgagttaaaggctgtaatctccatttcttcctcatcttaa

SEQ ID NO: 77120 - DNA, 986 bp, Glycine max
  Peptide Sequence Number=SeqID_193898
atggcggaggagctgctacaaggaatgatgaataaggggcagattgaaatctatagtgcgaagaaaggcgaaggaaatctcttcactgtcaagatgccgacgcccttcccttataaaaatgataaggcactgccatggaaatatgccgcacaagggtccaacaaaaggaaggacgtgtccttcgtacgtgttaaagaggacctgccgttcactaaagttacaaatatttccggtatgagtggcatgactcatagtggacggatcttcgctgcgtccgagctaccagtatggtcaaaggacaaagggaaggtgaaggcggacataggtgaaagagataaggtgggcttgacctcaaatgatgaggtccctattggaaatatcacagaggaaagggacgacttcgacaagaaagtgatatcagtggaggaggcgaccaagttcctaaggatcattcaacaaactaggatctctctgttgggactgctcatgaactctgagcctcatcgagcactgttggtcaagatcttgaatgaaccccatgtagctcaagacatatcagtggagggcttcaggggcatagtcagcaacatcactaccaacaactaccttaccttcactaatgaggaggtaccagtcgaaggcaggggacacaacaaagccttgcacgtgtccatcaaattcttggaccatatagtgaccaaagtgttcgtcgacaatggctcatccctcaacgtcatgcctaaaaccacgttggataagtttccttttaacgcatcgcacataaggctgagttccatggtagtgcggacttttgatgatccactcggttggggtggtcccgtcaatgctacaccagaaattaaagtttgtagtggaagggcagctggttatagtatcaggggaggaagacatactgcaatgcttatgtggatctcctctgatgcacctacgcttatcggtaccgctttgatggtggctcgtgttat

SEQ ID NO: 77121 - DNA, 252 bp, Glycine max
  Peptide Sequence Number=SeqID_193899
atggagccttacacattcatagagtgtctttatgattcaactacagaacatattcctcctagttacagagaggatgatagaagcagaggatgctcaactccttgtttcgaggacaaggtacctcctgagataagaattgggataaatttctctgtgtatttcattgatatcagcaaccttcttatatacaactctgtaataacagcttttctaacaaactctaacaactttatcaatattccaatttactaa

SEQ ID NO: 77122 - DNA, 312 bp, Glycine max
  Peptide Sequence Number=SeqID_193900
atgacaaaaggcgcaaaagatgacattagtctctgcgcgtcacatgaccccagggtcagtatgacagagattgtggggcgaccgacaaaagcgaggctcttgctcctacgtatcctcaatgaggaactcagacctacgtacttctggataaattatgagactaaaatagtctcagtgttttctttactaaaatgcgaacatgctttagtaaagagacaaaacttccaactaatcagagcaacatatgctttttggatgaaaaacaatgtgtctaccggggaaggagagtatgctgatgaaatcttctcataa

SEQ ID NO: 77123 - DNA, 363 bp, Glycine max
  Peptide Sequence Number=SeqID_193901
atgtggacgcttcactgcatgcagatcatgggagtatggggatgggaatgtgcatttgagatgatagaggagagtttgttcgggcttgaacgaacttcaagaagtttctacctcttccccacgagactgaagcagtggcgctactggaggcaattaaatgagtttggaagcattgttcaacaatgtaaacccctgttaaatttgttgccaaatgttaggattggcattgggaggagacaaacaaacatggttgctcatagtttaactaggatttcatgtttacatgctagtcccaaggtttttagcaggatacccaattgtattgctgattacattttaagggaaatgaaccaagccttttga

SEQ ID NO: 77124 - DNA, 195 bp, Glycine max
  Peptide Sequence Number=SeqID_193902
atgaaccacttcttccggaagactcccggaaaaacctcttccgggaactttccggaagaagtggttcatccggaagaattccggaagacgcgcacctccggaagaagtttcaaatttccggaagacctttccggaagaaccccttcttccggaaggtttccggaagaaccacttcttccggaaatgattttatga

SEQ ID NO: 77125 - DNA, 537 bp, Glycine max
  Peptide Sequence Number=SeqID_193903
atggctctacttctactttcgccacacattcctcttctgttcatgggagaagaattcggcgagtccaacccgttcctgttctttaccgatttccgtgatgatctcgcaaacacaatccgcgagggtcgaagaagcgagtttgacggccattccggttacaaaagcgagactgttcccgaccccaacgatcgcaccacgttcgagacgtcaaaactggattggagcaaggcccaaaccgaggcgggggaagattggttaacgctcacgggcaagctgcttttactgagacggacaaagatcgtgcctcttcttcgaggagataatggccgcgctggcagagttgtggaggcaggcgacggatgtattgcggtcacctggacgttttctgccggcgcgctttcgatcgccgtcaatcttggcgatgaaacaagaccgctgccggatcagcccggagacgcgattttcgcatggccagaagagcaagccgccctgccaaaaaactcaatcttggttcgcctcgccacggaagcagtataa

SEQ ID NO: 77126 - DNA, 579 bp, Glycine max
  Peptide Sequence Number=SeqID_193904
atggtactctcagtcctactatgtgctctcatatgctcactggggctaaactccatcataaggtgtgcactaaggtgttcaaattttgttgtgagtgactcagtggcaaccaacaacaataaccctccagcagcagcaagagtggccaacacaggagtgaagaagaaagctctcaagactttccccacggtgagttactcagctgagctaaacttgccaagtttggactcagagtgtgtgatatgcttatcagagttcacaagtggtgacaaagtgcgcattttgccaaagtgcaaccaccggttccatgtacgctgcattgacaaatggctaagttcacactcgtcatgccccaaatgcagacagtgcctaattgagacttgccagaagattgttgggtgcagtactcaacaagctagctcatcacaacaacaacaacaacaacaacatgtgttagcagtgccagaaaccattgtgaccatagtagccccacttgagccagaaggtttgaccttatcgattaatgacataacggttgaagtggatgaatggaatggaatggaccctagtcagccatag

SEQ ID NO: 77127 - DNA, 237 bp, Glycine max
  Peptide Sequence Number=SeqID_193905
atgcgaaaaataccaaaaaaaagggggcaaaagggtcttttccttggtttcctagaccctagctcgcccaggctagcctctggtgaagaaaccaactctcctaggcgagctcagaaatggagggaattgagagaggagagaaacaagatgaagaaagaagaggaaacgaggccgaggcgctatcaaattgcgaccgtaatcgacttctacatcgttcttcgttcatcatcctattag

SEQ ID NO: 77128 - DNA, 939 bp, Glycine max
  Peptide Sequence Number=SeqID_193906
atggcgaatagagaagaaaacaacgagggtcacaaattcacagtgaaatatgttggactcaacggaatggaatgcgaaggcaaattgccgaggagggtggtgggagtgagaaatcactgttaccttttgaaatccaaaatcggagagggttcattctccgccgtgtggagagcggagcagagaccaccaaccggcgttgacgtggcggtgaagcaggtcttcctctccaaactcaaccctcgcctcaaggcatgtttggattgcgagatcaatttcttgtcctccgttaaccaccccaatattattcgccttcttcacttcttccaggatgatggatgtgtgtacctggtcctggagttttgtgctggagggaatcttgcttcttatattcagaatcatgggagagttcagcaacaaatagccagaaaattcatgcagcagcttgggtctggtctaaaagtattacactcgcatgacattattcacagagacttgaaaccagaggtaggaatattatatatgttttccggacatagaattgagttcagtaaacttttgaaaatggaaagcttcactagtttatgtcaccgctttaatgcaaattgcctcatacagtggcatttattgaagactgaagagcattgtttcaaaaacattttgctatcaagccacggggttgaagcagtgctaaagatagctgattttggtctctcaaggactgtatgtcctggtgaatatgctgagacagtttgcggttctccattatatatggctccagaagttcttcagttccagagatatgatgacaaggcagacatgtggagtgttggggccattctttttgagcttctaaatggctacccaccttttaatggcagaaataatgttcaggattggatcctgactgtcttgatatttgttcaaggctactacgcttaa

SEQ ID NO: 77129 - DNA, 372 bp, Glycine max
  Peptide Sequence Number=SeqID_193907
atgggcaaaaggaaccatcgtagaatgacacctagtggcaattttgtaacaataacgacggtctttgttaatgaccgtctttgtggcgtgagtaaaataagtgccctaggtcacgcgcgcttgtccgatcgaaaaccacatcaaactgctagttgttgccctgtgttgtgcctctcgccctcattagctaggcctgagtttgcacgtttcgtaagtacagacagagatatagaaagcgcatgcaggtccaacagttctaaaaatataagacctgacttgcttgatgttgaggacagcggcttagcagcttttgttcggcttagcaatggtgatatgagaaaggctttgaatattcttcaggtagtttgctga

SEQ ID NO: 77130 - DNA, 1005 bp, Glycine max
  Peptide Sequence Number=SeqID_193908
atggacttgaagttgcatggagccaagttcagattgatgatgtattaccgacaccagggcataaagtctgttggtctttccaaactcaaagatccagaagtaaaatcatttattgagaaatgtcttgtcccagcatctcaaagattgtcagcaaaggagcttctgatggaccattttctccaagtgaatggttcactgaagaatcgttgtcttccattaccagatatccttcttcctaaatatggaaccttcgaaaatcattgtcttatgtcagaaggtcctgccagtacacgtgttagatccatttcaatggatcttggtgatgccagtgagccgccattgaccactttactttataattctgttgattctgttgatgatgcattgccttccccatgtgttgagatacgaaggttgaaggaagtcaacagagactcaaaattagcaaaatacaagcatagctcagaaggttctagccaaattgtggctgaagatgtaggtctctctacctcgcctggaagaccagcagaaatggaaaacaatgataatgtgatttgtgacaagtttatgtctcgtgcaaacattggtcttcgaagagaaacaaagacaaatgatttgtattttgagaaacataggtcatacagttctgcaacatctgacttcaatgataagcatttttcgacagtttcattcatgtctgctaaatcaggatttacagactttgacttgcctaaagttagtagtcaaagctcacttacatctgaattcagggcatcatctgattataggagttttccatgcgtggaaagcaatggtacgatgaatttctcttgtcatcccgttagtacttcctccttctttgaacctggggatgagttgagaatagagttagagatgattgaacaacaataccaggatgaaatagaagatttattgagaagaaaacagcaggacatcacggagactacaaggaggcatttacaaaacaatgcaagcataaaatag

SEQ ID NO: 77131 - DNA, 402 bp, Glycine max
  Peptide Sequence Number=SeqID_193909
atgtgttctgttgagtggtggttgagtgcgcggagcaagtggttgtgtgcggcgaggttcaagggacttctgttggagaaaacattattgttggatttgttcaacgatggtgatctcaatgtggtgcatagaagaaatatcaatgctttgctggataataccctcaaaccagctccaaaaagattgcgcaaaacaacaatcaaagaaaagatgtgtagtttcaacactggctttacaaaggctccacatgaacaccactatgcaacctctactccaaagatattcatcagtggacattctattgtgaataatgcgccaaagaagaaaggatttataaggagctattcctctgagccaaatggccttatcccaaagaacttcaagtgttcgggttctgactga

SEQ ID NO: 77132 - DNA, 267 bp, Glycine max
  Peptide Sequence Number=SeqID_193910
atggtggtagtacttgatcacacaagttcaaaacctcttgaccttgattcacaaatagatgagactgaatggttaagccaaatgaagaaacatgtacttatcaacttggtagtgatcatcagaaagtcaaatgagaaatggcgtatgtgcatgaattacaccaacctcaacaaggcatgtctgaaggatgcataccctttaccaaacatagaccaattggtggatggagtcattggtgataattgcttttcacaccttattttgtga

SEQ ID NO: 77133 - DNA, 210 bp, Glycine max
  Peptide Sequence Number=SeqID_193911
atgtcgaaattagcaatcgatcaaggaaccgatgtacaaatagaagcaacgactaaggcaatccaacaaatcccacaacaactccaaggggccatcttaaagaaacccaaacaagcgttcatctatgaagaatgcgggggaagccatccaacatcaaggccatgtttgcatgttttgcctagagccaaaaagtcaaccctatattgttaa

SEQ ID NO: 77134 - DNA, 522 bp, Glycine max
  Peptide Sequence Number=SeqID_193912
atgttgctagctaagactttggatctagaaacaatgatgtttctggatcagcaggtcaaatggaaccagagcttttccttgagcttaattgtgggattgggagatggttctcggacatggcatagggagttgacccctttatcagcctacaccaccctactatcgccatgtagttcttgtggaggattccaagcattcgatgatagcctcacttgctccaaaacacatgttgaggaggacgatgagattgaggaggacttggagatcaacaacgtcgatgcggagcttccccagggaagagtagggtggcttgtggagaaaagtagtgaggaggatcccgatgagaataggattgggttagtggtgactactctaggattgggtgccttggatcttcttcatcaatggagttcaatggtaggggaatggagaaggaagagagatgattggagatgccacttcaaggagaagatgagtcaagcacaagctcaccaccataggaagccatggataagagcttga

SEQ ID NO: 77135 - DNA, 315 bp, Glycine max
  Peptide Sequence Number=SeqID_193913
atgatggagtcggagtatggggacaagaatccctttaaggcaactgcaaaagctttcccgcagggattccattacaagccgacgaccctcaacaaaaccagaaaattctatgagttcatcttagtggatacagattcagtatccattaaacacttcaaagactccaaagatccaaacctgaatacccattcaaccatccaaatcctaaaagtaatgcaaccacaacattacggatcaaacctaaaccaacccaagaaattctttgctccatttgacccgacaggatatacgtattgggattacattgatgcctag

SEQ ID NO: 77136 - DNA, 387 bp, Glycine max
  Peptide Sequence Number=SeqID_193914
atgacgtttttccaagggacaaacgggtctactttcatgacgaaagaggtgcaagaccagccatacataaagagcgggcatgcaacagacaatccttgcaccgctcttctcgcttcttcggtcaaatgtgtcataggcgtcagcaaaaacagcaacgaccaggctatctttactatggtggttttgagcttagctcatcagcgggcaaagcatgcatccaccgctaagtgcagcttcaacgcgcttagtgcgacagaagaatctggcagggcatcaatatcaaggttgcgtgctaagcacgagattagtgttctaagcgcagcaggtgtcttcagccaggctcagcgcacgactggcgttaagcccaaacccacttactcgcgctaa

SEQ ID NO: 77137 - DNA, 489 bp, Glycine max
  Peptide Sequence Number=SeqID_193915
atggtaggggcatccattaattggttcccccgatggaagaaaggaagagttagggttttgtcctcatgtgaagggttctcaaacatccccttgatgggaacgaggggttgtatcgattataatcccgtcctttccataagacaacttggctaccccatgagaggagcaccgtcgaaagaaagtatcacgcctttcatcgcacggggtttcagtgaccccaatgcaaggatatttcaaagggtccgcaaggcatggagcgtggcacaaagaaaggataaggagcttaggggaagcaacaatgggatcattggtggctaccataagtggctgaaagcttggatgcaagagttagattggctcccgaagctaaggacctcaagtgaggaagaggctgaaacccctgaggagagtgaagaggtccaagccttaaaggcagaacttgaaaaggcgcaagcggtcaaggaaaaattcaagatgatagctatcaag

SEQ ID NO: 77138 - DNA, 474 bp, Glycine max
  Peptide Sequence Number=SeqID_193916
gttgcaggatgtaccatctgtgggggagctcatgaatctggatgttgtattcctattgaagaacaccccactcatgaagtcaattacatgggaaatcaacccagaaacaattttaatggacaatggaggaaccaccccagaaatcagttcaatagagatcaaggtggaccatccacaaggccacaacaacaagggcctagtctctatgatcacacaacgaagctggaagagactttagctcagtttatgcaggtttctatctccaatcagaagagcacagagtccgccataaagaatcttgaggtccaagtgggacaacttgcaaagcaattggcagatagatcatcaagcagttttatagctaatacagagaaaaatcacaaggaggaatgtaaagctgtgatgactagaagtagaatggcaatccaaggaaatgatagtgaagctggaaagaagatggaggaacataaataa

SEQ ID NO: 77139 - DNA, 180 bp, Glycine max
  Peptide Sequence Number=SeqID_193917
atgaagagtagtactagtgtaccagcaattgggctgggtgcacaaagaaattccctgggtgcagctatcaggcttcggctaatgatttgggctgcatcaaaccaaataatgagaggctttagagtgttgctagatgcacccagcattattgctggtgcacccagcattctaacaaaatga

SEQ ID NO: 77140 - DNA, 156 bp, Glycine max
  Peptide Sequence Number=SeqID_193918
atggctttctatggtggtgagtgctcggtcacggcaagtgcaccggatcgcgcaaattcctcttattggactaaactcgaccagaaccgcattaagacaaacatacaacaactaggttaccgtaccccaatccctcgtgataatacgataaactag

SEQ ID NO: 77141 - DNA, 657 bp, Glycine max
  Peptide Sequence Number=SeqID_193919
atggtgccgaaacccattttgtgtgtaacccttttgtcattaataatttctctgaccactctttccttggttgccgccgatcccacatatggcttcacccgtcttccactaagtaactcaaacttccaagtccaaaggccttacgacgttccagtcagccaacgctacagcttttcaaatggagtgcacagatttttggtatactcctcggacaagcctcacatgcaaggcagtgcaacggagccacgaactgagattcgtatcactggatacgattatacatctggtgtgtggcaatttgaagggtatttttacgtgccaagtggcacaaccgggacgtgcatccaacaagtgtttggtggagtatcctcagccacaacctcgcagagtagagtctatggtggttctctcactcattaccaatcgattacactggaacaaaacatctacaataggtggattcggtttaacgtgatccatgatgtgggtgctaacaacgtgaagatttatattaatggggggaatgctcccaggtacaatggacctggccgtggagctagcactcactacttcaagtttggggtttatgcacaacctggtgctgcttccaactacatggaatctcaatggcgggatatcaagattttaagaaaatag

SEQ ID NO: 77142 - DNA, 228 bp, Glycine max
  Peptide Sequence Number=SeqID_193920
atgaaaagagaaaaatatattttgaatgacatagtgcaatctgtgcagtttaactctcatggctcatctgtttcttctcaatctggtattggactccgggtccagtccacaagtctcggtggtatttcttctgcttcactgcagcagccacccaatcctgtccattccccctctagtcaacagccattgatgccagatgttggcaattctaagattgaagaacagtag

SEQ ID NO: 77143 - DNA, 396 bp, Glycine max
  Peptide Sequence Number=SeqID_193921
atgccccgtgttgatgcaacaaagccaatcacccatgcctactccccaccttgccgccaacaacaagcaccacatgccccacgcgccgtcctccatcatcaaccaactcgtaccgttgtttccctcaacaacctcttaagtgttgttgttcattatggtcgtacagcggctctgcatgacaagcttttggaacatagagacatgacactgtttgagatgggagttgagtcctatgggtctgccatggttgcacgcaagcgccaaccaactgtttttgcactatggatgactactaaattaggtgagttttgtcggaacagaccttggaatcctggtattacttttggtaaccatggtttgaagccccaacaccttgaggacaagtaccttgtgtga

SEQ ID NO: 77144 - DNA, 348 bp, Glycine max
  Peptide Sequence Number=SeqID_193922
atggggcaagaatttactccatcttggactgagctctggtctattacttgctatctgttatggcaatggagaaaccaccagattcatgatcctcatttttgcagaccgtattgtccttggtgtgtggtgggtttgcctggtctcaaggagcatggtagcaagcaattaagcactaactctgcctttgttgctcagttgtgggggaatgttgttgggagttcaaatggctcgagacgggctttaaatcagagtggaactatgatgtttgaacaacttccgactctgttgagtccgttgcttgttcgagatgccttggactgtttcttgcccaggctgattcctgtgtag

SEQ ID NO: 77145 - DNA, 1483 bp, Glycine max
  Peptide Sequence Number=SeqID_193923
atgaccgacggtggggttgcacagctcgctctcggcccagcgtgcgcccgcttccaccgcatccagtgcgctgccgccctgcgccagcaccttccatgcggcctggttggccggcacgccgaagtcccaggtcgaaaccaccttggccccaccctgcgtgcgcgcctgcacgcccggcaaagccgccatgcctgcggccagtgcgctggcctgcaggaactgcctgcgatccaccatcttcccctcccagtctgcaatgcacggccggcccgatgccggtcgtgccgatcagtcgtgcgtgggctgtcgtgcggcgtgccagaccgctgcaccaagtacgcccagctggccgtgctccacgcgccataccggcacctggcgcagcacctcggtcagcacgcccttgttgaggaagcgctcacggaagcggccatcggccaggaaatcctgcacatgcgcggaaatgcctccggccaggtacaccgagcgtgcaccgacggcgatcgctgcgtcgccggccaggctgcccagccaggcgcagaacacctgcagcgtctccaccgccagcacgtcttcaccgctgcgggcggcaccgatcagtgcttcggtactggtccacaccggggtgacgccgcgcagctcgcacaggcacggatacaggttcatcaggccactaccggacagcacgcgctcgttgtccacgtgcgcccagcgctgcagcaacttgcccagcacctgcagttccagcgcgttgccggcgccgagcgcggcgtggccgatctcgctggccagcaccgggcgcccgccatcggcgaaacgcagcgcagcgcccaggccggtgcccgcgcccagcaccagcgccgagaacgcctgtgccggatcagcgtcgccgttcagtggcaccagggtttccggctgcaggtacgggatggccagcgccaccgcttcgaaatcattgatcagctgcagctcatgcagcccggactgcgcgcgggtggccgacagcgagaccgtccacggcaggttggaattgatcagtacatcgccatcgagcaggccggcgatggccaccaccgcagtctgcaccggctggccaaggcctgcggtgaaatcggccaggatcgcggccaggctggggtgctcggcgcaggcataggtgcgatggctgcccagcagcggcgcctggccgggttgggtttcagccagcgcaaggcgggcgaaggtgccgccgacatcggcgaccaccagacagcgcggaggaccgccgcgggcggagtcggaggaaaccggggacgctgctgcgatggtcacgctggcctgcttggatcgattgaatcgccccgattctcaggcatcggggcggctttgcctagcacgccgatgattcaggttggcctacatgccttcctgttcggccacctgcacaccatccaccagcacgcgcagccgctgcgggcggaagccggcaaacagcagcggccgg

SEQ ID NO: 77146 - DNA, 475 bp, Glycine max
  Peptide Sequence Number=SeqID_193924
atgccgcaaggagacggggtgcggatcatgcgcaccagcatgacaacccttacacagatatggatgacattgctacttagcatgattctgcctagcgaccacaactctgacctccctttgctgaagtggacggcgcctacgagacaccctgtggactcggagaagtccaatagggccctggggccaggcatcgcaacaaccaaaggaggaccaacatgtagaagcaagcttcatgatgatgaatcaaagggtacatctacttgggttgttgtaactgagaacaagagagggtacatctcttgtggatcagttcaagtggagggtttttacaaggttgaaaagaaatctcaagaaccgcaggttgcttggggactggatgtaggcacggggctcacgggtgcgtcttccaagaaaggaaaatgcgcggagtcgccaccaacgtttattcaagaaaaatgtcgaaaaaactggaaag

SEQ ID NO: 77147 - DNA, 423 bp, Glycine max
  Peptide Sequence Number=SeqID_193925
atgtcatttttagatgattccaccaatatatataaccatgaaaccaaaactgctgaatcggtaacccttgccgtgagaattgaaacagatgaacaagactcatttcctgcttggttgagccatattatgcaagttggtgatgttcacagcactgtcaagtatcatcccctcccctggcttggcccaccgcccccgacacgcctccccaccatctatgtcgcgatttcccgcaccaagaaagcggtgacgtttccgttctccggggcgacgaggctgatgaaggagctagagcagaaacaaaaatatgcagtgtggaaagccgccgaaataagaaaagctttgaaagaaggaaggaagtccagtgctggcccccctgatggtgatgaggacctctcagttcctttgagttcttcaagtgaataa

SEQ ID NO: 77148 - DNA, 913 bp, Glycine max
  Peptide Sequence Number=SeqID_193926
atggctggagaattatcctctccccctccagctaacaatcatagagatgaaaagtatggataccaaggtagattttccaataaagatcaaccaaagtctggtcaaccaaaatctggtcaacattctggtggaaaaccacaaaagaaaagtaaacgaaaaatcagaagagaaagtttctccgaggactttgacggccatactgagcaaatattccaggcaacatttggtaacaaatggtatacatggtccttcaacaattggagaagttcttcctctgaacattccacatctgggtttgaatggagggaacattcaaataggacaaacaagtggaaaaatgaaagtgatactgagcatgaagatgatgactcttgttgtgaaggatcaagttctgatagaactgttctgggtctgcctccaacaggtccattaaagattgaagatgttaaaaatgctttccggttatcagctttaaaatggcatcctgataagcatcagggcccttcccaggctacaaaagaaagatcacaagatgctcttgagaaagtgtttggggacaaccaatggggcgtggggttagttccttcttgtgtaatgcaaactacactgaagtggaaattaaaagcaaagaagaacgacagaggaagagatcataaaagcgtagatcaagatcaagaagccgaaatgcagagcccaattcctcttaaactttccgaaatagctccttcttctggaggtcgatggcacgcttcttctcgaagtggagctggattatggtgttcagggcctggaaggctgtttctttcgagtggtgctggtgctggatgctgctttcgtactctgccatggatggaagctaagctcttcccttgtccttgtcccgacaacaacgttgccacatttcttcgcccag

SEQ ID NO: 77149 - DNA, 811 bp, Glycine max
  Peptide Sequence Number=SeqID_193927
tggtggcggcagcgactgtaacgaggccggttaccgggtctgcggcggaaaccgtggttgtcgtgcccgaggggaaaccgagaagctgcgcttcggtaaacacctttgcggtatagggtgttgttgtggggacacctgcgggcgtcgttgtcgtgatctcgaaatcgcgaagagcgccggtatcggagtaataggcggcgctgtcgagaatgccgtttttcgtcgcgccggtggtcgtatcgaaaagcgcggtcttgttatcgacctggatgttgatggtcttgacggcgacattgcctgcaccgtcacggatgaaggagccgacgacctgcttggtgatgggcgtcagattgccggaggcgtcgctgatcttgcccttcagccagttttcaccggagaaggaggcggattcgccaatgctcttcaactggtcctgaagctggcggatttcttcctggatcttggccttgtcaacgcctgcttcgcgggcggcaaccagcttcttgctgatttccttgacgacatcgacggtggtttccatggcggaataggcggtatcaacctttgcggcgccgaggccgagagcgtcctgtacggcggagagggcgccattatcagaacgcatggtggtcgcgatcgaccagtaggcggcattgtcggatgcggtcttgacgcgcatgccggaggaaacgcgcgactgggtttcttccatgttgctgccgatggcgcgaagagtctggagggcggccatggccgcaacgttggtcaaaatgctggtcataatgatttgccccttgattggctgaaatga

SEQ ID NO: 77150 - DNA, 240 bp, Glycine max
  Peptide Sequence Number=SeqID_193928
atgaagaacgtcgaagaacggtcgaaaccttcccgaaattccttatggaaacgttacggaaacgtttcggaagcgcctcggcttagattttcttcacggaaacaatttttccaagcaaattcgaaagagagagaagtgcctatttttccaagcaaaataggggaggtgcttgccgcccagctcgcccaggcgagctcagctcgcccaggcgagccaggttgcttcctccagaagcaatag

SEQ ID NO: 77151 - DNA, 198 bp, Glycine max
  Peptide Sequence Number=SeqID_193929
atggtttctgtggcttccgtaaaatttctgaaaaccttggaaaatccaagccaaggtgctttcgtaaacgattctgtggaaattcttcctcgttcttcatcattcttcaccattcttcgttcgttcttcgtcgttcttcagtcttcaactggtaagttcccaacattgaatctttcaattcattctatgcacccttag

SEQ ID NO: 77152 - DNA, 387 bp, Glycine max
  Peptide Sequence Number=SeqID_193930
atggcctcttcaaatcctttgtttcctgaaggaaattccattcgtagaccgcccattttcaatggtgagggttaccattattggaaaacccgtatgcagattttcattgaagccatagatttaaacatttgggaagcaatagaaataggaccatacatacccactgtagtagatgtaagcacaagcactgtagaagcaaggcttcatgatgaatgtgatgaacaaaaagctcaaagatcaaacaacaactcaagagaatcaagaacaattcaagagttcaagaatcaagaagaattcgagactcaagaagaaagcctagaatcaagaatcaagattcaaggttcaagatctcaagaatcaagatcaagactcaagaatcaagaatga

SEQ ID NO: 77153 - DNA, 398 bp, Glycine max
  Peptide Sequence Number=SeqID_193931
atgggtgaaatagaggaggtgcaagaacggatgaaggccaacatggaggccatgataagcatgaagaagataatggaggtcaatgcggctgcagttgtcgctaccaacatttatgctttcccaccatatggcttgcctcccaactatacaccacccaatatggtgcaccctcccgatgagaatgtcaataactccactctcatactcattcagagccaacatactcaatcttatcatccacatgtctctcaacccatgggggagacacatgaaataccccaccacaacctagccgacttcaagccttgcctcggatacgccactcaggggcaagcagttggtggtgtaccctgttcgaacccgacaagtgcaccggattgcgcaagtagtatgaaatg

SEQ ID NO: 77154 - DNA, 330 bp, Glycine max
  Peptide Sequence Number=SeqID_193932
atggctaatttatcgtattattacgagggatcaaggtatgtaattactgtaaataaatttggctttatggataaagttgtctctagaatatgtccattggatttaatgatgaaatatgtgcaatttcagagcttagctcatcagtgggctaagcgtgcatccaccgctaagcatagctttagcgcgcttagcgcaacagaagaatctagaagttcatcaatatcaaggccacgcgctattcgtgagactagtgcgctaagcgtagcagctatcttcagccaggctcagcacaagactggcgctaagcccgaatccacttacccgcactaa

SEQ ID NO: 77155 - DNA, 162 bp, Glycine max
  Peptide Sequence Number=SeqID_193933
atggacgctttggcttatccattttaccttcatcgtcccatcgtaggggatggccatggcagtgagaatgtcgatgtccttgacaacaaccttatggaaggcgttgacagagaggtggccttggtccctctcgtgacaccgcaatggcatgatgaaccctag

SEQ ID NO: 77156 - DNA, 348 bp, Glycine max
  Peptide Sequence Number=SeqID_193934
atgacgggagatgcatcaaagttcactcatatctctcccaagaaaaatgaacatctgacttatggcgacaacaataaaggtagaattcttggagttggaaaaatagatatacatggacattatttcttactcataaaagtgatgcatttcatgcattcaagatacttgccaaagttattcattataagaaaaatcttaaaattgcatctatcaggagtgattatggaggagaatttgaaaacaaagattttgaatcattttgtgatgaacatggcattgagcataatttttttgcacccagaactcttcaacaaaatggagttcttgagaggaaaaatagatccttag

SEQ ID NO: 77157 - DNA, 1265 bp, Glycine max
  Peptide Sequence Number=SeqID_193935
ttccactgttgtcacttttgcaatgaacacagggctcgttgcaggtgcagccttgcttgcactcttggctatcaccttctccttgttgaaccctcaaaccctgttttctccgcctcatgttccgggctcgaaggatcaccttcacgctgctcggttgctccatgtcaccggagccgtcgggccggagagtcttgtcttcgacgccgacggcggagggccctacaccggcgtcgccgatggccggattctcaagtgggaaggggaagagcgaggttggactgaatttgctgtcacaagttccaatagttcgtttgaattggacaaggaattgagcagggatgattcgattgattcgttgggaatgggttatctttactattttttaactatgaagattgcatttttaagctactatagagattatgatagttactgcattaggtcggactgtgtacgcccatttgcaccagagttggagcacatttgtgggaggccattaggactaagatttgacaagaaaaatggagatctgtacattgctgatgcctacctaggcctaaaagtagtggggtctgcagggggtttggccaccgaagtggtaacagaagttgaaggtcagcccttgcagttcaccaatgacatggacatcagtgaagatgaagaagtgatatacttcactgattcaaccacaatcttccagagaaggcaatttatgcttgtactcctaagtggagacaagactggccggttaatgaaatacaacaagtcaacaaaagaagtgacggtcttattacgcggccttgcttttcccaatggtgttgctttaagcaaagacggatcattcgttctggtagcagaaaccactacttgcaggatcttgcagctttggcttcgtggacctaaggctggccatgtggatacatttgcagttctgcctggctttccagacaatgtgagaagaaattcacaagggcatttctgggtggctctgcatgcaaagggaagtcgtttcgcgaagtgggtttcttccaatccatgggcgggaaaggcgttgcttaagattggatttaacttcaagcagttgcactcatcatttgcagggtggaagcctcatgctgctgctgtaaagctgagtgataaaggagagatattagaagtcttggaagattgtgatgggaagaccttgaagttcatcagtgaagtggaagagaaagatgggaagctttggattgcatcagtgttgatgcctttcattggcatttatg

SEQ ID NO: 77158 - DNA, 372 bp, Glycine max
  Peptide Sequence Number=SeqID_193936
atggtgggttacacaccttcaagcattgcggatttggtcttcgccggtgaaaggatcaaagtgggtctggaagaaggcaaatctgatcatcctgctttgatgaatatgaaaattggggcaaatgaaaaggatgagaatgagggagaaacccttgctatgactgccattcctacacggtcaaatttcccatcagcccaacaatgtcattactcagccaataatagtccctctcacccaatcatccacaaaggccatccccaatcatccacaaagcctgcccgccgcacatccggtgccaaaacaccaaccaaaaaggaattttatagcaaaaagcctgtaggattcaccccaaattccggtgtcatatgctaa

SEQ ID NO: 77159 - DNA, 274 bp, Glycine max
  Peptide Sequence Number=SeqID_193937
atgactcacccgtgccggcgaccatcgtactgtcagcttgcgccgctgctgtttgatggactgcggcaacagagactggctgcgcagctgggcgaccaactcccgctcggagccagcatcactcacgccagtatggcgattccctctggggtctgtggctacccagcgaaatttcattcaccctgctccgctgatatctgcccatcggacgtaacgcgcagcacctcctgcagtgaggtcaacccttgtgcggctgctcgcaatccgtttgcca

SEQ ID NO: 77160 - DNA, 984 bp, Glycine max
  misc_feature (903)..(903): n is a, c, g, or t
  Peptide Sequence Number=SeqID_193938
atggctgcggctctgccgctggatgaagcactcgccgcgattcagcagcagaaagagaacaagaatcttatcggcgtgatcggctcgcttcgtcaggctgtgcttgaaggacaatccctctccagcgcaatgcaacagcacccccgggtctttgatacggtgtattgcacgctggtaaaagcaggtgaagcggtcggcaaggctggcaccgtgctggaaaggctggctgattttaatgaagctcgccagcgaatgcatagcaaactgatgcaggcgctgatctacccctccctgctgaccatcgtcgccattgtggtggtggtgattttactcaccgccgtcgtgcccaacgtcgcggcacagtttattcatctcaaacacgaactgccgcttacgacccggatactgctcgcgatcagcgactttttgtcggtctacggtccggggatcttaggtctgctctttgtgggtggtggcctgttttcatactggctgaagcgggaaggcaaccgccaccgctttcatcgtctgctgattcactttcgcgctactgcaccactggtctgcgctatcgacagcgcccggtacttacgcgccctcagcatcctcaacgtcagcggcgtgccgttgctgcaggggatgtcactttcagcggaaggcgtgggtaaccaggagatacggcagcgactgagcgacgccgccgagcgcgtacgccagggaaacagtgtgagccagtctcttgagaaaaccgccattttcccgcccatgatgctgtacatgatcgcttccggggaaaaaagcggccagctcggagaactcatgcaacgagcagcggataaccaggacgtccggttacagaaccgcatcaccctgacgctggcgatttttgaaccggcgctgatngtcgtcatggccgccatcgttctgtttatcgtggtggcggtcatgcaacccattttacaactcaactcattgatgaactga

SEQ ID NO: 77161 - DNA, 306 bp, Glycine max
  Peptide Sequence Number=SeqID_193939
atggagaagatgaatgtgcccataacaacaagggggtggggacccgtaagggcaaaaggccactttagagctgttgcagctcgcccaggcaagctgaaccttaggcttgaagtaactagctcgcccaagcgagctaatttcttaaccatgaagttatttgatggcccaggcgagccaaatgctagcctgggcaagctagggtgcagaaaaacccaaaaaagacccttttgtccccttccatggtatctgtcgcaacctacccttcgacgggagggcgaggcaaagttcacgggtgcgtcttcctaa

SEQ ID NO: 77162 - DNA, 468 bp, Glycine max
  Peptide Sequence Number=SeqID_193940
atgttgcgaaactttacggattacgcaacaatgctctttttgacttccggaatgttgcggaactttacggattgcgcaacaatatttcttttttacttccagaatgttgcggaactttacggattacctaacgatgggggggatgacaagaacatcaacatggttcttcttcttccagcagcaacacttcacactgttgatgagttgcggaagcttttatctaacaaagatgtgtatcagcagtttttaagttcacttgatgaggtcaagattcagaataattttaatatcataatattcttcctggttgtcgttaactcatatttgcgaacagccataggtaagtcagtgggagattcaggtggaactagaataggtgaagacgctaaagcaggagatgaatcactagactatagaaaggggctacttctggaggcatctgatgaggatgacactgataagaattaa

SEQ ID NO: 77163 - DNA, 309 bp, Glycine max
  Peptide Sequence Number=SeqID_193941
atgcaaactatccgcaagaatcattgcattcagtctcaaacgggaatctacggttcactcagcatgaacaacagttatttatatagcaaattacattcatcacgtataacaacattcatgacatacaagaacattcatgacgtacaagaacatacaaggacatcaacagttgtgtgtggtagcaaaggatcattaaattgtaaacatcatgaaccacatgatgagggaagcagtatcaaatcaatgctttacaagcttttggtcaatctaaggagtggtgtcttcatgctgcaaattgatggtttctga

SEQ ID NO: 77164 - DNA, 111 bp, Glycine max
  Peptide Sequence Number=SeqID_193942
atggcacgcaacatgtccgctccgtgcccctattcaagggacctatatgggagggagctaacaaggtctctagaggtatcatccccttcgaagaacatactgcagcagtag

SEQ ID NO: 77165 - DNA, 159 bp, Glycine max
  Peptide Sequence Number=SeqID_193943
atggaatatgttaatgatggtaggcctttttggcaatacatagttagttattccactggctgttcagatcctcaatattttgaagaactttataactattatacaacggacaaggcatggcacctcaatgatactggtgcagaagaactttttgtttga

SEQ ID NO: 77166 - DNA, 1132 bp, Glycine max
  Peptide Sequence Number=SeqID_193944
agcatacatctacttgggttgttatattgagaacaagagaggatacatctcttgtggatcagttcaagtggagcgtacatccacttggttgttcaaagagaacaagggagggtacatcccttttggatctttgcttgtaaaggattttacaaggttattggaaatctcaagaactggtggttgcttgggtactggacgtaggcacgggaaagaatgcgctttacggtgcccttaccgaacgcatgccagagctagagtaaagagtgaaatagaggaggtgaaagagcagatgaaggctgacatggaggccatgaaaaagcaaatggccacaatgatggaggccatgatgagtatgagaaaaatgatggaggtcatcatggctacagtcgttgtcgcaagtactgccacagaagtggacccgactcacccatctggcctcaatcaaaacaaacattccttcccaccatatggcttgcctcccaactatacaccacccaatgttgcacacactcccaatgagaatgtcaacaactttgcacccaagcctattgagagccaacaaccccaatctgattatgcacatgtctctcaacccatggaggagacacatgaagcatccctagaccataatctagctgacttcgaacctcaccttggatatgccactgaggggcaagcaattggtgtccctcctgctatggtggaaagggtaaaatttgatcatatagaggaaaggatgagggccattgaaggaggcagagattatgcttttgttgacatggcagacatatgcctagtgcctgacatcgccatccctccgaagttcaaggtgctagactctgataagtacaaggggactacttgccacaggaatcagctgagggtgtactacaggaaaatgggtgcatatgcaaaagatgaaaacttatggatgcatttcttccaggaaagtcttactggggcagccgtcacctggtatactaatttggaaccttcccgagtccattcttggaaagacctaatgattgccttcattaggcagtatcagtacaattctgatatggctccggatagaatgcagctacagaatatgtgtcacacggagcacgaatctgtcaaagaatacgcctaa

SEQ ID NO: 77167 - DNA, 291 bp, Glycine max
  Peptide Sequence Number=SeqID_193945
atggttgctttgttttctcctactgtgttctcaaccaagggatggctcttagaggaggagccattaagctatgatgtgtcctcaaagaactcatttccctatcaattttattcactacagacacagattgaggttgaaatagaaaggtcaactgcaccatcccctgatgaccctgccatggtcaagaagcttagccacaacgctagtgaacgtgatcgccgcaagaaggtcaataatctggtttcttcacttcgtttacttcttccagtggaagatcaaacggtactttaa

SEQ ID NO: 77168 - DNA, 195 bp, Glycine max
  Peptide Sequence Number=SeqID_193946
atgccacagccaaactctgccaccagttgccaccatctctggaaaccaaacatgggtgagcacatgagtctatgttcctcacagagcatggcaacgagcagaaaggttgtcgcagtgcttgctgatgcaccaaaggaaccagttgtctatgttcctcaagttgttgccgagaatgatgttgatatacttatctag

SEQ ID NO: 77169 - DNA, 183 bp, Glycine max
  Peptide Sequence Number=SeqID_193947
atgtattacaacgggaagtggaacataccacatcaaggtgagtttttgggttactcctttactggaactaatccaataagatttgacattccttcgggatgtggcatggagaaactcaaggatttaatcaagcaagttgcacctataggggttccccctaatggaattcatggatcacaattg

SEQ ID NO: 77170 - DNA, 356 bp, Glycine max
  Peptide Sequence Number=SeqID_193948
atggcactgactgagcttttgcaatcagaaaaaaatgagataaaagtttatgacatgggtgacagttgttggagaaaccttgaaggttttcctgatctctggtctttaccgaaagttcgtggagtgtatctgggtggaacccttaattgggttctaattaaggcaaaaattgcagctacttttgaaattgtaattatttctgttgacctacaaaaggagacatgcagatcattgtgtctcccagatgatctttgggctgttgatataaatattggagtgtttagagactcacagtgtgtttggcaagattacaacaacacccatattggcttgttgagggagtttggagatgacag

SEQ ID NO: 77171 - DNA, 201 bp, Glycine max
  Peptide Sequence Number=SeqID_193949
atggaaaaaacaatgaaaatgcgatataatggtggtgatagtagtagtggaatggacaatagtggtggtgctgatgacggaggtggcgttggcaatggagatagtaatggtggtggtattgataacaatgataatgggtggaatagtggtaacgacaacaacaataacgatggtggtgacatattggccatttaccattaa

SEQ ID NO: 77172 - DNA, 267 bp, Glycine max
  Peptide Sequence Number=SeqID_193950
atggtggtgatgatggtggggatgacagtgatagggtggtggcgaaatgatgttggtgaaaatgtggtgatagcaacaacgatgattgtcagagtggcagagacaacggtgaccaacaacaatggtgggagtagtggtgatggtagttgcggaaaaaatggtggaaatggtggtgctaatggtgatggtgacactagtagtggcagtgattgtcaagttgaagatggtgatgatggtagtggcggtaaaaacaatggtggaagttga

SEQ ID NO: 77173 - DNA, 405 bp, Glycine max
  Peptide Sequence Number=SeqID_193951
atggtgttgcaacctaccattcggcaggagggcaatgtgagggctcacgggtgcatcttccaagggaggaaggcgcgcggagtcgccaccaacgtttattcgaggaaaacgttggaaaaaccggaaaggtgtggtctacgaactttaagtgtgaaaggttcgggagttgtttttatgcacggagaaggagaaaagagggaggtggttgccgaccagctcgcccaggcgagctggattgcttccaccagaaggcaccgccttcttttggaacactcaagaagacccaagtgggcttggttgctatttgcacccctcttttcactaaattacgcaacgatgcttgtttcgtgggtttcgaagggagcaaacaaggttcaaggaccgaccgcaagtactcccggatga

SEQ ID NO: 77174 - DNA, 196 bp, Glycine max
  Peptide Sequence Number=SeqID_193952
atgatgcatgcacctgacctcaactctcagatgcaatgtggtacgtaccgtatccaataccaaggaaatagccctaagcgtgtctacacgacacctcacttagaaaaccatgcagtatttgtcgaggccacccagtcgtgcaccgtaactccccccctaggtgctcaacctggggccacaaggagttccctaccag

SEQ ID NO: 77175 - DNA, 164 bp, Glycine max
  Peptide Sequence Number=SeqID_193953
atggcatcctttagccagatgcagtcccagatgcagtcccagggacttgcacgacctgccgagcctctggttggtccctctggtcctcgagtaagcacaaaggggagttgtgttgatcccccaggaaacgatcttgagacgggtgactcagataggtgtggctt

SEQ ID NO: 77176 - DNA, 249 bp, Glycine max
  Peptide Sequence Number=SeqID_193954
atgaagaaacaacaattgaggagaagaagaagaggtgagaggaggcgccatccactagagaataagccattgaaggagaagtttcaccaccaagatagtgtcttggataagaagcttagagaggaagcttcaatggaggattgctttacaacaagagaccctcagtctcttaatccctttttagaagtaagaagagaagaagaaatctctcttgaaagagatagattgaacaatggagcactcaaataa

SEQ ID NO: 77177 - DNA, 441 bp, Glycine max
  Peptide Sequence Number=SeqID_193955
atgatccaacaattattattaggggggccagaagaccaagggcaaggccagctaaggctcctttctacagcaatagctcctcatctagcttctacatcaacagctcctcctccagctcgtattgcagcatctcattctaccccatctcctgaagattttcagtgttttgaagccatgcttcgaagcatacatcaggggcagattattttgctgcaaacctggccagggactcagcctcctcctcacagggacgacaagaatcctgccactcaggtaccacatcaaccagcggatgagtcatcagagtcttccactcctaagcccttgatcaggaagaggagggtagttgtaactcaagaagccacaaccactcctgaaaagtctcctaaggccactccagagcctccggcaccaatggcagataccacttctccacagtag

SEQ ID NO: 77178 - DNA, 168 bp, Glycine max
  Peptide Sequence Number=SeqID_193956
ataaaagcgaggactttgagtcctgtgaaaaataaagggaggactttgagtcctgtgaaagataaagtgaggactttgagtcctatgaaagataaagtgagaactttgagtcttgtgaaagataaagtgttgacttcgagccctgtgaaacaagccaaaaggtactag

SEQ ID NO: 77179 - DNA, 258 bp, Glycine max
  Peptide Sequence Number=SeqID_193957
atggggatcaaaaggtcttttaaggttgtaatggggccaaggacaaggcttgtattgagcttcaaaacaaggaaagggaaacaaggctcaaaagggctatcaaaggaattaattcaaggtaagtccatttggctagaagcttataagaacaaaattgcctcaatcatttccaaatatgcatgtgaattaggaagcatcaacaagaatcaagccaaggctattgtgcaagcaatcaattgggcaaaacacaccaaatga

SEQ ID NO: 77180 - DNA, 312 bp, Glycine max
  Peptide Sequence Number=SeqID_193958
atgtttttatcagaaacattggcacatgcaaataaagtggaggaaataaaaaggacagtcgggtttaataattgctttgttgttgatagagaggatgataaatatggaagagtcgatcatccatcttggctaatcaatggattcaagaaagttgtgttagaatgcaatctagtggacattcctatggtgggttatcctttcacttggttacatagtaaaggcctaggatcttcttcatcaatggagaaggaagagagagaggagatgccacttcatggagaagatgagtctagaagaacctcaccaccatag

SEQ ID NO: 77181 - DNA, 750 bp, Glycine max
  Peptide Sequence Number=SeqID_193959
atgggtatagtgcctctccaacttcagcctaaacatggcttaggtttcaacaaatctacttacgctagtgaagtgagtgagcgagcaagtgaggttccgcagccacttacccactccgccgtcgtcatcctccgggctctaaggccggagcccttcacctacctggatgacttcccccgccccgatcccaaccacgatgagacgatccttgccatcccccgctccgcctccgacaagaacatctccaccaaggaacgtcgcgccaggcggctttggagcattgtgttcgagcaagaagacggccagcacagcggcaagaagcacctcatttatcctccttctccttttgtggcgaagtcagtggcgagagaggacggcattagggaatgcgcaaccactgttcgcgctgccaattctaatgttctatccgggattggattttctcgccctgtttttcaccatgacgggtcatggctcgtggcttactttactgatgcttttgacttggcaggttcaaaaggagggggtgggagtgggaacatttctgccttgctgactggtgttccgcgggatgttaataagcaattgttacacgtaacctcaggaatgacctttagcagtaagacaattggcggcaatttgaattctaaggttaaatctgctgtgatgaagggttcaacactaatgaaacctactgctagtctgttggctaagcaaaatcagccccatccaattgttagctcaaggtga

SEQ ID NO: 77182 - DNA, 276 bp, Glycine max
  Peptide Sequence Number=SeqID_193960
atggagtactcaatctgttattaccattttcaagaccaaatgatgagcccgacaccgcctcccacattttgcattgatgctgatgagaccaagtgggaacataatgacatgctccatgtggatcactttttcaagtttctatgttttcatcgtaagccaaatgtaccaggagataggattcatattattgacttttgcttttcatggacccagcctatgtcatcctactttcgctttacaacacccgtgtttgaggtggttgatcattccatctaa

SEQ ID NO: 77183 - DNA, 315 bp, Glycine max
  Peptide Sequence Number=SeqID_193961
atgtcacaaaactttatggattacgcaaccatcccctttttttttttacttccgaaatgttacggaacctcacgaattgtgcaacgatgcttgcttttgatttctggcatgtcacggaacttcacagattgcttaacgatgggtgtcaagttcctcgaagcggtcaagcgaaggttgcatgccatcaaacaatggtccccggacaaaattaggacagcgcgtggacccttttatgacttcgtaggggcaggactaactagtgtgaagatcaagggactaaacaatgggacaatagacttgtcttcgtatgtctag

SEQ ID NO: 77184 - DNA, 192 bp, Glycine max
  Peptide Sequence Number=SeqID_193962
atgaactgcaaaggatgtgagtttcataatggtagtgtaaaaaagtttgcaatacttttactgatatggaaaacccttcaccttgtaagtgtttacctgatggctccaaaagggttcggtaagaaggaagaactactattactggggaaccatattgaaaaagaagtgagagaggagaagcaagtgccatag

SEQ ID NO: 77185 - DNA, 231 bp, Glycine max
  Peptide Sequence Number=SeqID_193963
atggctttgttggtggagaaaaccacacaagtggtaccgcaagatgaagaacgtcttgttggggtttcagtgttaaaatttgatgtggattccacgatattggcttgtattgcgttctcgtgccctaatttggcattcttggagatctcggtctctgatcctgcagttaatcggatcagcagagtactaggaaggagtcatgagcatttcacaaagcaccaagttcactga

SEQ ID NO: 77186 - DNA, 618 bp, Glycine max
  Peptide Sequence Number=SeqID_193964
atggtggaagaacaaaatgacaaaacgaccctcactccgaacgaggatattccagtgaaagatctttcagagaaaagggatggcggtggcaagaaggaagtattgctagaggaggcacgcgagttcctccgcattattcagcaaagcgagttcaaggtcattgagcagctcaacaaaaccccggccagggtctctcttttggaactaatcatgagctctgagcctcattgggctttgctagtaaaggtcttgaacgaagctcatgtggcccaagatatctctgtagaaggctttggaggactcgtcaataacatcatcaccaacaactatctcgcctttgccgaagaagaaatccctgtcgaggggagagggcatatcagggctttgcatgtattagtcaaatgcatggaccacgtcatggccaaggtgctcatcgataacggttccagtttaaacgtaatgcccaaaagcacgttggagaaattaccgtttaacgcttcccatctaaagtcaagttccatggtggtacgtgccttcgacggcacccgccgagaggtcaggggagagatcgacctccctgtacagataggctcccatacctgtcaggttaccttccaa

SEQ ID NO: 77187 - DNA, 261 bp, Glycine max
  Peptide Sequence Number=SeqID_193965
atggacgccatgattcttattgaagttagggaaccattgacaaggagattgttgttccagcaacagcaaaacgaagaaaatattagggcaacaccctctcctcctcacacttctcttatcaagacaagagcacccatagttgtagctccaaggctcttaaagcccaaggaccgcccttggcacgtatgcaagagtgtgccattacgtctcctgtatatgccacccacggtgagtgacatatatgcaagagcacactactaa

SEQ ID NO: 77188 - DNA, 291 bp, Glycine max
  Peptide Sequence Number=SeqID_193966
atgtgggtgcaattgcatgcctctactactagtttaaaaacataccgtgttgtcacgggagtaagaagtgtggaaaaaataaggaacgcagagacaatatggcaattagcaatgaagggcaactgcaagttgtgcggaagggaggaagggacaagttggagaatgagtgtgagagtgatgaaaggtggtagtgctgcatttgatttgttcgtggggcccacaagtggaggagacacccacaggctgggttggcgccaatgcctgaccacatcactggttgtgccaatgtga

SEQ ID NO: 77189 - DNA, 156 bp, Glycine max
  Peptide Sequence Number=SeqID_193967
atggagtgcaggggtgctcactcaggcgagctcagctcgcccaggatactaggctgccttgcagcggcgctttccgtttgtccagagctaggcaagggacgacgacttatcggtcgtgaccctagcctctacttgcatccgtccctaagtacttga

SEQ ID NO: 77190 - DNA, 260 bp, Glycine max
  Peptide Sequence Number=SeqID_193968
gaactgttgcagtcttctttgcagctcacaagtccacctctttttcaagcattgttgtcctgcgtagaatagtcttcaagtggggcatattctgtggaagcaatgacttccaagattatttggatgatgccaaagaatcaagagttaagaaggttcctaagaatcaggagtcaaaaagcttcaagaatcaagtttcaaagaatcaagattcaagaataatcaagtttcaagaatcaagattcaagaataatcaagattaa

SEQ ID NO: 77191 - DNA, 231 bp, Glycine max
  Peptide Sequence Number=SeqID_193969
atggcatcattcagccagatgcaatcccagcttcagtcccagatgcaatctcagggacttgcactgcctccagagcatctagttggtccctcaggtcctcgagtgggtgtggaggaggtgaaagatccagatgctctagttcctgtacccactgatgaggtttccttagtggggcaggcaattcacaccttccttgcttgcccagcacatctggtcaagtctttatcatag

SEQ ID NO: 77192 - DNA, 180 bp, Glycine max
  Peptide Sequence Number=SeqID_193970
atgaaagaaaaagatcagagaaccttccgaccagataaattttcggcaaggtcgttctcgactggcgatatcccaccccacatgaacaaagaggaaaagaccgaaacacccagcttcctctccaaaaacactaccctcgagaaaatcctattggtccgtgatcgtgcatttgatctttga

SEQ ID NO: 77193 - DNA, 378 bp, Glycine max
  Peptide Sequence Number=SeqID_193971
atggaggcctctggtaatcgattaccagtctatgtaatcgattacacagaggaatgggtcattggtaatcgattacgagatgaacctgtgcgcacgcttcagcgtactgtggagtggatactacccacgcctacaccataccgtcttgtggagccagtccaagtgatcgaggtgacgtcatccgaggaagaccctgaggaggatcccgaggagctacctcctgagcctgctgtggatgctcttgacttcctagagggtgatgaggacccacttcctgaggtggattctcccgaggaagtcatgtcggcatctgaggcagactctacggaggatagtggcccgagagagatggcgaccagtggaggctcttcatcatag

SEQ ID NO: 77194 - DNA, 459 bp, Glycine max
  Peptide Sequence Number=SeqID_193972
atgattatggggggccaagacatttatagtagccaagatgaggctactacttcaccttcctctagtaaaagtgaagaagcaaaatgggaagaatctagtgaagagatctacccccaagaagaaggacaacctttaatggttaaggaggagtgtaaggaggtaagtgtcttctccaagagatttcaaagctcatttagagcacaaaatttcatgctcttctctccctctcccttcattcatctccttcttcctccaagctctcatccatggcctcctatggtgtggtgtctcctctctctcttcctttctccattccactgccattcatcttccaagaagcaaaggaatctattgatgaagaagatcctaggcctacaagttccaatggagcttacatcacgaagtagggttgaaaagagggaagttcgattacgtttcctccacaagtgccaatgctaa

SEQ ID NO: 77195 - DNA, 288 bp, Glycine max
  Peptide Sequence Number=SeqID_193973
atggtaaccattcgtgcaggtaccgtacttcaagtaggcgacgatattgctcgtatttatggtcttgatgaagtaatgacgggtgaattagtggaatttgaagagggtactataggcattgctttgaatttggaatccaaaaatgttggtgttgtattaatgggtgatggtttgatgatacaagagggaagttcagtaaaagcaacaagaagaattgctcaaatacttgtaagtgaggcttatttgggtcgtgttataaatgccctggctaaaccaattgatggttga

SEQ ID NO: 77196 - DNA, 956 bp, Glycine max
  Peptide Sequence Number=SeqID_193974
tgaatgttgaggaacagggtgaaggtcaaggtattggacccagcagtcctcagggatcgagtcaaagaagttcatctgaagaacacttttccgatgaagaggccatacaagaggctgaagctggaggttcagacattttcccagcgtcttcgacatctaagctttccgctagcatagggatcgcagaggatacattcattcaaatgcaagacgaagaccctgctgcagcccttcgactcctgctgaacaccagtcaagccaacacctcaagtgaaaagaatcctggtgcttcgtcctcatctgatgctgatataacctctacagtacgccaagattgcctgcttttgaagttatcaatggaatacgcacgggcagacgtacttaaatccattgaagagaacccttctgctgcttttgggcacctgaactttttgaagaaattgcataacccccttacttctgatgagattctgggcaaagttatacaaatcgagtccattatcgatcaatttgcaaatactgtgcagaaaaaacgcgaaaatggcgccagactcgatgcccagaaacaggcacatatccttctgctcgagaaagcccgagcggctcaacgtgaagtcgagcgtctcaccaaagaagcgaaagaaggatcttctgagatcaaagcctgtgatgataacatctcctcctgggaggcaactattacaaatttgctgtctcaggtcgatgatctaaggcagaaaattgtaacagagcaggccaagcgcaaagaactccaggagaaggccgctgattcgattcagaaacttgttgctgaaaaagggagggaaggcttaaaggccttcagtgcatctcaagcggtagcagatgaggcgagagctatggagagtgctgaccaggttttgagcaaagagatggccaccttgaagaagctatatgaggatttgatcatgacttag

SEQ ID NO: 77197 - DNA, 108 bp, Glycine max
  Peptide Sequence Number=SeqID_193975
atgaatagcacagagtggaaaaaggttagcttgaaggaacaaggtcataactgctacttagccaaaatgccaacccaacataattttaccccttgcacccacgattga

SEQ ID NO: 77198 - DNA, 360 bp, Glycine max
  Peptide Sequence Number=SeqID_193976
atgtatccgtttatctccatgaaacttccattttaccctgaattggttaaagctttatattcaaacttggaaattcaagaagatttcttgatttccgaagtctatgggattaagatggtcatagaccagtcccttttctttgatctcactcaattatcaagtgacggtgtaccgtttgagaattcacttgatgatgagttgaagtttgatttttctgtgtctgatgcccaccggttggtttgcaccaaccaagcggatatgaccggaaggcttcttgtcggatcattggctcttgaaagccgcatccttcactatcttattgttcgtattttacttccaagatcttcaaaccttgcttag

SEQ ID NO: 77199 - DNA, 297 bp, Glycine max
  Peptide Sequence Number=SeqID_193977
atggctttagctgtacgtgttaatccgctaaatatacatgatatttcttataatggcctcatagttgtcttttattgcccatcgataaaaggaaagactcttggtgaggcaatgagctcaaatcaagctagagaaattcctgaaccagatagtgtgacggcggaacttattgctatctatcaattcccagagtttagttcagaacctcgtaggccgggaatgccatcaagaagccttttcctctcggtgtcagtgtcagccaagttagcatcggcttcgccaaagccatcattttaa

SEQ ID NO: 77200 - DNA, 225 bp, Glycine max
  Peptide Sequence Number=SeqID_193978
atgcggagttaccttatggttatccgcaccttccgtgaaccaggggaaaacaagcccgttgacgcgcgaagactaacattgtcttctgcaccttttgtcgtcctgacccttgaagtcagattaccttatggttacccgcacctttcgtcaaccaggggcaaacgagcctgtctatgcgcggagactaacatcgtcttctgcaccttttgtcgtcctgacccgtga

SEQ ID NO: 77201 - DNA, 1148 bp, Glycine max
  Peptide Sequence Number=SeqID_193979
gttcttagagattgggagatggactgaacaagatgctgcaattttggtcccaagagacataatcagcatcaaactgagagatatcattcatgctgatgcacgtcttctagagggtgatgctttaagtgttgatcagtcttctttgactggagagtctcttccagtaacaaagaatctctctgaagaagtgttttctggatcaaccgttaaaaaagtgggaataatcattgagccaatgtggttaatggcggatggcggttcatggcggaaagtcgcggttctgggtcgtcttctccgttcgcgtcgccgccgttcacgccatgggtcgtcgctgctggctgctgtgtgcagcgggtcacgcgcggctggttccgaggctggttgcaggggtcgtggctggttccgaggtcgcgctgtgttgaagcttcgagggttgcagcagcgttctgaaagcccaactcctaccgcggacaaaaaaaaaaattccgccattttccgcctccccgccacatccgccatggccgccatggctatggcggccgccatggcgccgccatctttaacccgtcacgccaccgctattcggtggcgttttttcagaaaaccgctacgcaactccgccatggcgccgccatggccgccatttaacaacactgacgtggtggctgggacgatgaggggtcacgtgctagcaaatctgaagttgggaacagcgcacgacactaatagtgtaaggtcaatgttgcacgacgaggtggtggtgtgtgaccttggtgttgggataagagggagggagaagcccgaagaaaacctctccctcttcaatgttgatgttagggtccatgccttgacgcctaaaggagtgtgcagactcgaagaatggcacgacatggatgcgctaatggtagagtcaaccttgcaagtaaagtccatcgatgccttcatgaataacgtcgcgttaagaggaggtcggagagggcgaaagcaatggtcatgcttaacgaaaaatttgagatactgtctccaccaacaccaccataggttcagagttgaggtgcaaggaaagggaagggttgcgttaaatcacgaaggagaaggaaagggagctagggtcaaggacatatttgtccattcacttttcttatggg

SEQ ID NO: 77202 - DNA, 294 bp, Glycine max
  Peptide Sequence Number=SeqID_193980
atggattttctaggtttgagaagtgaaattgagaatgagaatccagatttaaccttccaactctcaaagcctcactctttttccactcatggcaccacattctcactttctaaccctagaagactagcaaaactacccatcatatctcccaaaaccccatacccacgaaaatcaagagagaaagaagtccacccaaacctgaaatttcgaagtcccacacgtagagacgcgcttcacgactccgaaaatgccctcctttcgcgatttggagcagaaatgggcaccaaaggttga

SEQ ID NO: 77203 - DNA, 189 bp, Glycine max
  Peptide Sequence Number=SeqID_193981
atgaaatatggcataggagtggagatattattggatatacaaagctcagaggaatgtaatactgtgtgttacagcatgtcttctctactggtctatcagccgcatttgcaagtatcagaaggaaatccagagtctggaggaagtggagaagagaatcaaggcccagtagattcttttagtcatgattag

SEQ ID NO: 77204 - DNA, 907 bp, Glycine max
  Peptide Sequence Number=SeqID_193982
aaacatcttgccagagaagaaggtgaagctttaccacactgagtttgatgtttttaaaactgagttggagaggcataatctccataaacgcctcaccaatttggttgatgggagcatagatgtggctttggtgaaagagttctatgcaaacctatacagctctgagggtccttcaccaaagcaagccaggttcagaggccatctagtgaagattgacgctgacagcctcaacacattcctagagacacctgtggtgtggcacaaggatcctgaggaaggacttgatgactttagcccagtctctcacatggacatgaacataagagctctcatttatggccagatgacttctatagctcaaaataactcttctagatttgggtttcctgctctaatcaccgccctatgtcgagccagaggggttgtctctgatagcctcacttttgagcgcctgagcccggtggtggcacctccaggatccattccttccattgagcagtttctggagatggtaacctggcctggggcccaaccttctcttcacagggaatatgaaggtcccacagcccaagtaccacagcatgtagaggatgcgtcatctaaggtcactgttccagagccattcattgtagaggaggaggcaggtgagacacaggttagacaggaagctgctgctactcctgagaggtcacgagaggtcacatcaaatccacccacactagtggtggacctatcctcacctcagcatgcagcagacccctccactcctatactcgagataccagaggacccaaccacaccagtcctgactctgaacacttctcctctagctactccagtacttcatctgatagatgaggaggatgttcagacacgggacactcaggaccagtcacaggaattctaa

SEQ ID NO: 77205 - DNA, 548 bp, Glycine max
  Peptide Sequence Number=SeqID_193983
atgatttataatcgccatttgctttcttctgctaccaatctctacaaactcacccatcaattctctcttctctctcgcgcttattccttcgtttccccaccaccctttacccaaaagtttacgtttttgtcccctccatggagattcccctccaccccacgtttgtgcaatggttcaaaccttgtggggatgagaatcatgagatgttactgccatgacagtggtggggctaaggagtggactgaggaaattgagtacttggatgaatctggtggggttatttacaagggtaagggtgttaggtctgttgagcctggtgttgatgatcatgtgatggttggtgaggtgaagaagccctttgtgaatgccttggctgtggccaaaattgttgaggttgtgaagaggtggaagtggggtccagaattggatacccagttggacaaactgcagtttgtgcctaacatgactcacattgctcaagcattgaaggttgttggtgatgttgatgcttgtttgagtttgtttaggtgggccaagaggcaggcttg

SEQ ID NO: 77206 - DNA, 154 bp, Glycine max
  Peptide Sequence Number=SeqID_193984
gggcaaggaagcacccatcatcagcgaagaggatccacactctgttctctgtggaatgtcagaactatttcgactggcaaacggtggggctgatgaacagttacaggaaggccaagcagcctggaccaatcacaaggctcctcagttgcactga

SEQ ID NO: 77207 - DNA, 1146 bp, Glycine max
  Peptide Sequence Number=SeqID_193985
atgatcagcatccttggaacatcagggagactcaatgagatgagggatgtgattgagcagatgaaagaggattcatgtgaatgcaaagattctgtttttgtgtctgttatcaagacatatgcgaatgccgggctggtggatgaagcaatctctctgtataagagtattcctcggtttaactgtgtgaattggacagaatccttcaacaccatgttgcagataatggtcaaggagaaccggcttgaaattgcacaccggctttttgtggagagctcttgtggttgggaagtgaggtctctggttcgagcattgaacttgcttatgtatgctctttgtcaaaagagtcgctctgatctggcattgcaattattccaagagatggattatcaaagttgctaccctaatagggatagttatgcaattttgatgaagggactgtgccaagacaggaggttgcatgaggccacccatttgttgtattcaatgttttggaggatctcacagaaaggaaatggtgaggatattgtggtctatagaactcttttggatgctttatgtgatgctggaaaatttgaagaagctgaagaaattctgggtaaaattttgaggaaaggactgaaggctccaaagcgatgccatagccgacttgatcttgaccagctctcggatggtaaagatatagaaagcgctaaacgcatgattcacgaagctttgatcaagggctcagttcctagtttggctagttataatgccatggctgttgatctgtacagcgagggtaagatagatgaagctgataaagtcatcattgaaatgcaagtcagaggctttaaaccaacacattctatctttgaggcaaaagtagctgcattgtgcaaggttagtaaagtggatgaagcaatcaaggtaattgaggaggacatggtgaaagtcaactgtctaccaactgctaaagtgtacaatattctcttgaaaaacctatgcaatgttggaaattccacagccatactcgagagcttgaacaagatgtctagcaaggtcggttgcacaggcgacagagatacttacagcattttgctggaaatgctttgtggtgagagaaggtatcttgaggcaagccaacttctggagaaaaatgtccattaa

SEQ ID NO: 77208 - DNA, 135 bp, Glycine max
  Peptide Sequence Number=SeqID_193986
cctaaatcaaaggctcctgctaggtggattgtcgtcaagtattttaacgaaactagaccattggagccagagagattaaaggcgtttcggattcagtggacacagtattatctccgagttagagctgagagctag

SEQ ID NO: 77209 - DNA, 828 bp, Glycine max
  Peptide Sequence Number=SeqID_193987
atggcttggtcccatgactatttaaaagaaaaagaaaaacagaggacattgagggccttatctatttgtaagggaagtgctttcttcattatgcacattctattattggctcttattctcaagggagtgaacaaaattaagtcttatggtgtccactttcggttgaaattaaggcatactgtaaacaatgagatactgatatacccgggatatgttcctgtaccgggtgtcaagtatagagtctttcattacggattgcgattcagtgttgggaattggagctttgacaaagcagactggcgcaacgttgatgtagtcaacaaatgctgggccaagttcccagacccaccagattcctcaccagttgatccggcaaacaatgaggatttacagcgagatctgctcagcattgaatgcgctaagatgttgaacgaggcactgaatctgcaccaccagaaaaggtgttctagtgataattccttgtcaacatcaaaagaggaggagaaaaaggaggaaggtggagtctcaagggtcagcaacatagatgcaaatgatgattcaataagcaataatatctcaacaaaccgattggaggaatcaacggatgttcggaaagatgaggtgcctagttctttcaggttttgggtgatatgcttgtgggcattttctggagtaggtttcttggttgtcatttttgtggtgtattcaggtcatagaagaagaggaacaaggttaaaacatggtagaaggagaagaagcttgcatacaggattcatggaaacaaatggccgtgaccggcatagtcgcggtgtcgaggttcctctgtag

SEQ ID NO: 77210 - DNA, 1554 bp, Glycine max
  Peptide Sequence Number=SeqID_193988
atggaaacaaagtaccctgcaataaacaaacctgctggggttgtacactggcttaaacatagtaaggaggcaaaaaatgttgattgggttgtcattctggatgcagacatgataatccgagggccaattataccttgggaacttggtgcagagaaaggaagacctgttgcagcatattatgggtacttaataggttgtgacaacagtttggctaaattgcacacgaaacacccagaactatgtgacaaagttggtgggcttttggcctttcatatagatgacctgcgagtttttgcccccttgtggctttcaaaaaccgaagaagtacgggaagatagggctcactgggcgacaaacataactggtgacatctatgggaaaggatggatcagtgagatgtatggatattcttttggtgctgcagaagttggacttcggcataaaatcaatgataacttaatgatctacccaggttatgttcctcgtgagggaattgagccgattcttcttcactatgggttgccatttagtgttgggaattggtcattcaataaactggctcaccatgatgacggaattgtatatgaatgtaaccagctctttccagaacctccttacccaaaagaggtaagacagttggaacttgatcctaatcgaaggcgaggactatttctaagcttagagtgcataaacattataaatgaaggtcttttattacaacatgcagcaaatggttgccctaaaccaacatggtctaaatacttgagctttttgaaaagcaaagcttatgcagaactaactcagccaaaatatgtgaatcctgctactttacaaatgatggaggatatcaaagaagaacatgtcgatgatggtgctggaaagccacatcccaaaatccataccattttttccacagaatgcaccacgtactttgattggcagactgtaggacttatgcacagtttccgtagaagtggacagcctggaaatatcactagacttctcagctgctctgatgaggacttacagcagtataaaggccatgatctggctcccacacattatgtcccttctatgagtcgacatccattaacaggagattggtacccagcaattaataaaccagctgcagtccttcactggcttaatcatgtaaatattgatgctgaattcatagtgattcttgatgcggatatgatcttgagaggcccaataacaccatgggagttcaaagctgctcgtggtcgtcctgtttcaactccctatgactaccttatcggctgtgataatgagcttgcaaaattgcatactagccatcctgaggcttgtgacaaggttggtggtgtaatcattatgcatattgatgatctccggaaattcgctatgctatggctgcataaaactgaggaggtccgagctgatagagctcattatgcaagaaatataacaggagacatatatgaatctgggtggattagtgagatgtatggttactcatttggtgcagcagaggaagagctaaacttcatgaatttagggtatggcttgctatag

SEQ ID NO: 77211 - DNA, 279 bp, Glycine max
  Peptide Sequence Number=SeqID_193989
atgaagttgaactgcttaataagctggaagctggataggaatcaagatgcagttgcaccaaaacagaaagagcttcttcaatatgttgaaggggctacgagtgaaaacagtgaggttatgctggcagggtgtcattatcgtcaagctaaacaccttcaggatatgggacagatgagaaagcggtgctattggtattgggacacaggaatgctcaacaaaggaaggaaatcagagaaacttatcggcagctttacaatgaatcgctcattgatcatctga

SEQ ID NO: 77212 - DNA, 462 bp, Glycine max
  Peptide Sequence Number=SeqID_193990
atgtcaatatggccaccgccaaagccttggaacgagaaaccaagagggcccgaaaggaagaacacaaccgaaacaagttccaaggggctttatggggcaacaattgactcattgcacggagagggaagcatgggaatggggagtaacaccataactaagcgagctccaaggcacccctatcaaacccgttctaaatctagggctatgggtgacgtagaggaagtgcaagaacagatgaaagcttacatgttggctttgaaagatcaaatggcttccatgatggaagccatgctagatatgaaaagattgatagagagtaatatggtcacaactaccgccactgaagcagacccggtccttccgtctacagcaaatctagcacatcaactcgccccagacatggtgggacgaggaagagacacattggggaataccagcagcccgcatttagggtacaactaa

SEQ ID NO: 77213 - DNA, 405 bp, Glycine max
  Peptide Sequence Number=SeqID_193991
atgggggcacactcaagggatgagaagctactcatgcatttcttccaagacagcttggccggagccgcagttgtttggtacaccaacttggaagcatcgcgcattccctcgtggaaggacttgattactaccttcattaggcagtatcaatataatactgatatgactcctgataggactcgattacaaaacatgagcaaacgggaacacgaatccttcaaggagtacgcccaaaggtggagggatttggcggctcaagtggcacctcccatagttgaaagggagatgattactgctggatttctcctactgttgctttttgttccactttttcttcgttcaaatatattcaagggaaatctggtttgccggaaagcgcatcggatcgtcaacctaaattactaa

SEQ ID NO: 77214 - DNA, 240 bp, Glycine max
  Peptide Sequence Number=SeqID_193992
atgtggttttgtatatataactacaagtataaatccttagcagtggaacgtggaataaaagaaaggactggaattacatttacagtgcaaaaccaaaaccttaacccaaccggaccggggctatcaaaggcagaggagagagtaacgaaggttgcttctaactgttcagaatcatgtcttggtgcaccattgagtccgatcccggtgtgtttacagaacttattcagcaaatgcaagtga

SEQ ID NO: 77215 - DNA, 405 bp, Glycine max
  Peptide Sequence Number=SeqID_193993
atgtggatgaacacagactgtgatcagcgtttcgaagagagaagtaaggtactattgtactgtgaaatattatatacttacattcaagagcaagtattcatgagactgagatctaaattcgacgacaaagcatcacctttatacccctcctctactttggttccttattcttcaccatgcatcgcttgtcaacatctaaatctcaaaactctaaccacctttccttttctaattcaagcaacagcaagcaactattgtctattggttatactagtgttcaggaagctcccagaggaggtacaattctactatatcccaactgtgctcgacaagctctttcttttcggcattttggaattggctcatgaggtattgtatgattcttatccaccaaccaccttttaa

SEQ ID NO: 77216 - DNA, 222 bp, Glycine max
  Peptide Sequence Number=SeqID_193994
atgaatgaaatcaatgctgttaatgtgcctgggacaactgcaaaagatgtcatggatatggtccttgccactcagtattttgacaccatgaaagaaattggtgctgcctcaaagtcttctcctgtgttcattccacacggacctggtgctgttcgtgatgtagctggtcaaattcgtgaggaacttcttcaggcttctcatctagcctctactccaccttga

SEQ ID NO: 77217 - DNA, 660 bp, Glycine max
  Peptide Sequence Number=SeqID_193995
atgtctgactttagtgcttttgctgctgcatccattacagtagatgaacttgtacctggattcaagagccttttcaaatgcaccatacctgattctgggaaggtggaactacagcacttgagcaactacactgggattactggatgcattggattagaaggaaacctagaaaaaggatatgaccctgttctaaacttatcaggtcttgtaggaacaaacattctgtctcttggaggcaatgttgctcttgacctaccaacaagaacaatcagcaagctgaatgctggcttaggcctcaacactgacttccttgttgcttccttgaccatgcatgacagctttgacattgtgaaagcctcctgttatcatgaagtgaaccccctaaccaagactgccattgcagcagagctgaatcatagcttgtcaatgggggagactagtgccacagttggtgctcagcatgcatttttaccgcaaacgttggtaaaggctcgatttgacacctttggcagggcaggtgctcttattcaacaagggttctgggagagatgttttgtaactatggctggagaagtggagtttaatacctcggataataatttgcatcccaagatggtagctgctgtgttacttctgttctttacttcgttggatacttga

SEQ ID NO: 77218 - DNA, 3075 bp, Glycine max
  Peptide Sequence Number=SeqID_193996
atgacgacgccgtttcagcaaccgccccaaaccgtacggagactggtcgtggaagtggtggacgcgcgcaacctgctccccaaggatgggcaaggcagctccagcccttacgtggtggcggacttcgacggccagaggaagcgaaccacgacccggttcaaggagctgaacccggtctggaacgagcctttggagttcatcgtctccgacccagagaacatggagttcgaggagctcgaagtggaggtgtacaatgacaagaagttcggcaacggaagcggccgcaagaaccacttcctcgggagggttaagctctacggaactcagttttcaagaagaggcgaagaagctcttgtttactacacgctcgagaagagaagcgtgttcagttggataagaggagaaattggcctcaggatttattactacgacgagatgcttatggaagaggagaaaccgccgccgccgccgcagcagcagcaggaggagcaaggtgagagaacggaacaagaccggaacaagccgccgccgggggtggtggttgtcgaggagggacgggttttcgaggctcctggagcgatggagcaatgcgtgcctcttccttcaggtcctcctcattcgccgcgtgttgtggtcgtggctgaatctccgccgccggtggttcatgtttcgcaggatccgccgttggcggaaatgtgtgagcctccggcgtcggaaatgcagttccaccccgaggtgaggaaaatgcaggccaacagagggaatagggtgaagattttgaagcggccgaacggtgattacttgcctaaagatatttctggaaagaaaactggtaatgagtctgagcgagttcatcccttcgatctggtggagccgatgcagtacctgtttgtgaaaatctggaaggcccgtgggctcgctcctcccagtgaaggcccaatcgtgagggttaggatgtcgagccaatccaggagatccaatcccgcaagttacaggcccagcgagccccccgattcgccggaatggaaccagacattcgcgctgagttacaacaacacgaacgatgcaaacagcgccacactggagatttcggtttgggattccccgacagagaatttcctcggtggcgtttgcttcgacctctccgacgttccggtgagagatcctccggacagtcctttggcgccgcaatggtaccgcctcgaaggaggaaccgccgatcagaatcccgggagagtctccggtgacattcagctttccgtgtggatcgggacgcaatccgacgacgcgttcccggaagcgtggatctcagacgcaccctacgtggctcacactcgatccaaggtttatcaatcgccaaagctctggtacctgcgcgtgacggtggtggaagcgcaagacctgaatattgctccgaatctgcctccactgacagcgccggaagtgagggtgaaggtggaattagggttccaatcgcagcgaacaaggagaggatccatgaaccaccgcagcttatcgttccactggaacgaggaccttctattcgtagccggtgagccactggaagattctgtcatagttctgttggaagatcgaaccaccaaggaaccggcgctgctaggccacatcgtgattcctctgagctcaatcgagcagcgaatcgacgagcgccacgtggcagcaaaatggttcaccttagagggcgggccctactgcggcagagtccagatgcgcctctgcctggagggagggtaccacgtgctggacgaagcggcgcacgtgtgcagcgacttccgtcccacggcgaaacagttatggaagccggcggtggggattctagagcttggaattcttggcgctcgggggctgctaccgatgaaatccaaaggcggtggaaaggggtccacggatgcttactgcgtggcaaagtatgggaagaagtgggtccggacccgaaccgtaaccgataccttcgatccacggtggaacgagcagtacacgtggcaggtatacgacccctgcacggtcctcaccgtgggagtgttcgacaactggcgcatgttcgctgacgtgtcggaggaccacaggcccgattgccgcatcggcaaggtacgcatacgcgtgtctacgctggagagcaacagaatatacactaactcctaccccctcctcgtcctcacgcgaaccggcttgaaaaaaatgggcgaaatcgagttagcggttcgcttcgcctgcccctccctgctgcccgacacgtgtgcggtgtacgcccagcccctgcttccgcgtatgcactacctccgcccgctcggggtggcgcagcaggaggctctccgcggcgcctccacgaagatggtggcgcagtggctggcgcgctcggagccgccgctggggcacgaggtggttcggtacatgctggacgcagactcgcacgtgtggagcatgaggaagagcaaagccaattggttcagaatcgtggcggtgttggcttgggcggttggactggcaaaatggttagatgacataagaaggtggaagaatccagttaccacagtgctactccacattctttacttagtcctcgtttggtatccggatttgattgttcccaccgccttcttatatgttgttttaatcggaatatggtattaccggttcagacccaagattccggccgggatggatacccgcttgtcgcaggccgaagcggttgatccggacgagctggacgaggaattcgacaccatgccaagttccaaaccacccgatgtaattcgaatgcgatatgataggttaagaatgctggctgcaagggtgcaaacagtgttgggtgattttgccacacagggtgagaggcttcaagcattggttagttggagggaccctagggctacaaaattgttcattggagtctgccttaccataactgtagcactctatgctatgccaccaaaaatggtggcggtggcgttaggcttttattacctccgccaccccatgttccggaacccaatgccctccgccacgttgaactttttccggcgacttcccagcctctcggatcgcttgatgtag

SEQ ID NO: 77219 - DNA, 354 bp, Glycine max
  Peptide Sequence Number=SeqID_193997
atggcaacaacaactccacccactcaaatagacatcgaagcagtgatgcatattcttaggcttaatccttcgaatgccaattggtacatggacactggtgccacctcacacatgacatctgagcaagctgatggtgacaatggggatgacaataatggtgatagtggaagtggtaacaatgtcaatggtgatggtaatgttggtggtgatagtggtgatgatagcagtgctaatgatcgtgatgacaatgatagtgtcagtggcattgatagtgatagtaatgttggtgacaataatggtggtgtagtagtgatcgtgatagtgatagctaattatgacggtgacaacaaatga

SEQ ID NO: 77220 - DNA, 1671 bp, Glycine max
  Peptide Sequence Number=SeqID_193998
atgaaaggaagtaagaaggacagagccgctgaggtattggagaacctagcatttcttgccaatgcaagcaaccttgttttatatctgtccaagtttatgcacttttcaccatccacctctgccaacattgtcactaacttcatgggaactgccttcctccttgctattcttggtggatttctagctgatgcgtttatcaccacttactccctctatctcataagtgccggaatagaattcatgggtttattaatgctcacaatacaagctcacaagccgtcactcaaaccaccaaactgcgtaattggaaacaccgacagtccatgcgataaaattcatggtgcggacgccgttatgctatttgcaggcctctatcttgtggctctgggcgtaggaggtataaaaggttcacttcctcctcatggagctgagcagtttgatgagaatacaccagagggaaggaagcagagatctgcatttttcaactactttgttttcagcctgtcatgtggagcattaattgcagtaacttttgtggtatggattgaagacaacaagggatggaagtggggtttagtagtctcaactgcatcaattcttctctccattccagtttttattcttggctcacacaagtacaggaccaagattccagcaggaagccccatcacatccatgttcaaggttcttgttgcagcaatttgcaacaactgcaaagctaagaattcaaccaatgctgtcagaagcatgactacaagtccatctcatgcaactgaaagggaagatggagaagaagaaagtaagactacaaaagaggttgttcaaggccaaactctaactgagaaccttaaattcctaaacaaagcagtgatggagccagcagttcacccaatgttagagtgcacagtaaaggaagtggaagaggtgaagattgtgacaaggattcttcccatattcatgtccaccataatgctaaactgttgcctagctcagctatctaccttctcagtccaacagtcagccacaatgagcaccatgcttggttccttcaaggtcccaccagcttctctacctgtgttccctgtcctcttcgtcatgatccttgccccactctacaaccacatcattgtcccatttgctagaaaagcaaccaaaactgaaatggggatcacacacctacaaagaatagggacaggcctgtttctctccattgtggcaatggctgtggcagcattggttgaaaccaagagaaagaaaacagcttttaagtttggtttgttggactcagccaaaccactccccataacattcctttgggtggcattgcaatacatttttcttggctctgctgatctcttcactttggctggcatgatggagttcttcttcacagaggcaccatggagcatgaggtctttggccacagcactttcatgggcctcactggccatggggtacttcctcagcactgttcttgtgtccaccatcaataaggtgactggtgcttttggacacacgccatggctcttgggtgccaacttgaaccattatcaccttgagaggttttactggttgatgtgtgtacttagtggactcaacttcgttcattttctcttctgggccaattcctacaaatacagatgttcaaccaaaccgggatatactagctag

SEQ ID NO: 77221 - DNA, 537 bp, Glycine max
  Peptide Sequence Number=SeqID_193999
atggaagggtgccaacctcttgctgaacaaatgcagtcctccaatgatgtcgccaaaacggtgaagcttccattgccatttgatcttaatactatacctaaggaggatgaggaagcaagaccggcaacttctgatgagacttggctccccgattctgaatccgatgacaacttccgacccttacaacaaccatcatctactccagatgctcctgttgacattgatgatgttgaagaccgagctagtattgtggagggaggatctgactctgggaacaggaagaggaagagatccttggaggaatctgataaagggactgcagggaggtctttccatggagaaacagaattgacagtgcgaattggtagcaaaaaagagatagatgatgatggatatcgctggcgcaaatatggccagaagattatgaagggatgtctataccctaggtatactgttcagctctctcttcactcgctgcatgtgcaagtttgtttatatatatttctttacaacatggatgatatgatgcatatgtga

SEQ ID NO: 77222 - DNA, 1200 bp, Glycine max
  Peptide Sequence Number=SeqID_194000
atgactttgctagaagtaattaaggatgcttcagtcaattcaaaaccacttgattcacctttggactacccaattgttctgaacccaggtggtatcttacctaatttaaagcctgaagttgaagatgaatcttcttcatccctcataaaaccccttattgggtggcaaatttcacaaactgatgctgagattattgacgttagcaaaaagttctttacacaactgaaggctaagcttaagaacactaataatttggataagggtgagtttattagtagtttgaattcctatctagaaaacattagggacaaattaggggttgtgattggggttgattcatcctgtagtggttataccaggattttgattgaaaagcttggagttttcataggtaaagatgttgctggcctggttttggatgggagtgtttctttggagatttgggaagtggtcaaggctttgattgttaatggtattactgagcattcttgttattcagacctggttacgaagttagtggtgaaaaagaggtctgatttgctctgtttatgcattaagcatggtttcgatcttggttcatcagaaatacttaccattttgaggtactttctttctccatccaaagatagttatgacagtatggtaactgtgaagaaggagtgggagtgccaagcactgttggccattgagaaagcaagtgatagcaatcttaagaagaagtacttgcttatagcaaaggaggcttccattttgcttatgatggcatatgatggtttctctgcttctgaaatttgtttgcattatctgttttcatcatccaacatcaatgatgtgatgttatccccttcattcagtaagttgaacagcaaagagttgataaatttgattcgttatttagccaagtggttgaagaaatatgagaggtttcctcaagcaggaccatgtccaaaagcctcatcagtttcagttttgggtttgaatgtttgtgattgggttcctaaactcgaagatgttataaaatgtcttggcttagtgcttgatgagaatttttcttcgttggtgttacatccacagtttcacgaggagctgagatcaattgaaggagtggttagttgtttgactgttgaagccaaattttgccacttgatgactgatgtagtggacaaaataaagatcgaagtaaaaggtgaaaataattaa

SEQ ID NO: 77223 - DNA, 468 bp, Glycine max
  Peptide Sequence Number=SeqID_194001
atggccagtgctagaggtactacaagggttggagtaagaacaagggcacgaactccagttgtggaagagatagtacctaattctggatggacagaggactctgcgggccattaccttctagtggatcttcccgatttcaggaaggaggagatgaagctccaggttaatagctatggccgtattgttgtatcaggagagaggaacttaaatgagtggaaacatgttcattttcggctgacttttccagcaccgctgaactctgatatggataagatagctggaaagtttgatggtggaatcctttatgtcactgtccccaagcaagtaacacaacagaacaaagaaagtgagactgcgaaagttggaaatggaaaagttgaaagagcagaagagaaagatagccatcagcatggaaatggtgaagttgaaagagcagcagaaaatgatagccatgcacccaaatgctga

SEQ ID NO: 77224 - DNA, 708 bp, Glycine max
  Peptide Sequence Number=SeqID_194002
atgttgggaaaagataaaactgccacgtccttggaagaggtggatgcacttccggctatatatgctactgtgttaaaattctcgtcatctgcgccatatgtgtcaattccatcctatcgtataccttttcttcttggtgaaccttacaataaagattctgcatctcaagatgcctccctaagtattgttcctgttgatgttggaaatgattcccaggaagaggaaaaatatagagctattgttgagattgatttggagcccagggaacccacaccaggtatagttgatgttcacattgaaacaaatgcagaaaatagtcaaatcatccaaggtcaacttcaaggaatcacagtaggcatagaagacatgtttctcaaggctattgtcccaacagacatcccagaagatgaaatacctcgatacaactttgacttgttcaatactttatgggaggcatgtggctcatcctccagcactggccgggagacatttcagttgaaaggaggcaaagggattgctgccatcagtggaactcaatcagtcaagcttcttgatgtccctgcaacctctttaatccaggcaactgagcgccatttggcacattttgtcgtaggtgtccactccgtcttacttacaatgatgaagagtatgagaagggggctattagcaatagtagaaaaagaaacctgggttgttttcttgttctaa

SEQ ID NO: 77225 - DNA, 333 bp, Glycine max
  Peptide Sequence Number=SeqID_194003
atggtctccaacttactttatgtggtaactggtaacaaattgaagccttcattgtttagggaaaaaagtgggattacgcacctgagtttgtggaggacatgggattggagatcagagggtgacttaatgatgaatggaaccttctttactgagtctggaaaagaagccgtaattttttcaagacagacatcactgcaaagcctgggacatttgcatcaaggctctctttggctttgttggtactctaaaatgtgtagtaaacaagccatgcaggacaagcaaatacagctcactggacactggaaaagagacagattcaattcggagcagtag

SEQ ID NO: 77226 - DNA, 516 bp, Glycine max
  Peptide Sequence Number=SeqID_194004
atggagagcaaagcatggctgaaaaaggcttgggttggccatttacaaaacttagcaacgttcaacagacttgaggaggagctcatatgggatggcgaggaggagattagaccgaagtacttgggtggcgatatgaaatggagttcagaaatgcacactagctttagactagtctggataatgtgttggtgcattccaatacacgccttggacatggaaagtatcaagaaaattgcagaaagcgtaggagaggtagtcgaggtagacgaagaggtggaagatctacaaagagttgatcgggcaagagtcctcgtcaagacaccttggtctctgctcatcaaccatttggttatgactaatatcaatggtgaagaattcgtagtgaagattgtggaggaaacttgctatagtttccggaagtacacatgcggaaaattgaacttcttggactcgttggagaagatctcttccagggaaagcgagatcgggccagatgcagcatttgtctgttcgtag

SEQ ID NO: 77227 - DNA, 1509 bp, Glycine max
  Peptide Sequence Number=SeqID_194005
atggatcgtcaatggcgtcctcctccaccaccaccaccacccaatgtctgccccgcttgcttccactcccacttccctttttgccctcccccatcccccttcccttacgccaaccccaatttcaagagaccccgaatcgacgacaaccctatcagtttctccgacgacgaacgcaggttaaagctcattcgcgatcacggatcccacacctacgcgccacaccctaatcacaacggcttccctcctccccacaatgcccaattcagatcttcccctcacccctcgcagcgcgttcccgacggtttccatcatattggtgccatgcagccacaaccacctcaccaagggaaccagcacaatttcaatggaagagtagttcactatccttatccctaccctgctcccaatgataataatatggaggctccttggttcttcaaggggcagcctcagcctcctcttccttcttcgccgccgccacctcttcccatggaaccgtctatgaatcaattgaaaacgtacttttcaccacccaagaaacctccttctctttttcccgttcccgaacctcaccccatgcctcagccctattaccccaccgcttttccttccgagcgggaaccatcgaagcagcagtacttgggggattcccaatcttttgcgataaatcaattggctgcagagagacctaaagtgatcgatgcttcgcgcttattccggcatccgcatcgagcttcacgcccagatcattttgtcatcatcttgcgaggccttccaggtagtggtaagagttaccttgcaaagatgttgcgtgatcttgaggttgaaaatggtggcgatgctccacgaattcattctatggatgattattttatgactgaggttgaaaaggttgaggatagtgaggcatcaaaatcttcaagttcaggcaggagcaagaagcttgtgacaaagaaggtcatggagtatttttatgaacctgaaatggaggaggcatatcggtcaagcatgttgaaagctttcaagaaaactgttgaggaaggagttttcacctttattattgtggatgaccgcaatctgcgggtagctgatttttctcagttttgggcaactgcaaagagaggccaatcagtaactggccaaggacataggtctaagatgtggaggagatcggggtatgaagtttacattttagaagctacatacaaggatccggtgggttgtgctgctaggaatgtccatggatttacacaggaagacatagaaaagatgtctaagcaatgggaagaagctccatccttgtatctgcagcttgatgtgaagtcattatttcatggagatgatctaaaggaaagcagaatacaggagagagaaaagagaagaggtacaaccaaggttgacatggatatggaagatgatctgggtgatgcattacttccagttcaaggaaaagaagctgataaagttgttgaccctccatttggagaagatgcaagtaggatgctttaa

SEQ ID NO: 77228 - DNA, 255 bp, Glycine max
  Peptide Sequence Number=SeqID_194006
atgggtctagttcggtgtttccttccagggaaacaggtgcaagggacaagcactaggttcctgaagcataaacaggagcaagatgataataagatgtttggggaacaagcaaatgctttttataccttcagcgtcatcgtgatcctcttatcgacctcctttgtaaaagttactattgttgatagttatcttgtctttgaatttgttgtcttggttattcggatgtatgagtcaaactatggtatgaggaagtaa

SEQ ID NO: 77229 - DNA, 327 bp, Glycine max
  Peptide Sequence Number=SeqID_194007
atgaatgctgaaggttcaagttcaagctcaatatataagagcccgagaagctgtgaagcaatgatggaggctgcaagtacatgggaattggctaaaaacataggaaccagttttgggaacgaagaaaatgaattgttgtccagaatggttgttttagatggaagagataaatctgaatttaagaagctgggaagaaggagattaaaggtgtggaacagggagcaatttggggatattcagcagaagctaaagtgggtaaaggaaaaactcaatgagttggaaaagaaaggggaggataaagacctgactgaggtggaaatcaactga

SEQ ID NO: 77230 - DNA, 464 bp, Glycine max
  Peptide Sequence Number=SeqID_194008
gagagggtcaaaagaagttggcgtgggtgaagtgggagacaatatgtctccctaaggagaaaggtggtctaggggtgcgggattttgcgtcttttaaccaagcattactcgataagtggcgttggaacctgcttcatcatattggcgatttatgggcaaaggttttgatgttgaagtataggggatggaaaaacttagatgaggcaaggaggaatcacaaggagttgatatggtggcgagacttgtgttttgtgtgcggttctgagggaaaaggtgggtggcttaatgaaggtgtgaagtggaaaataggatgtaggtcgcagatgggcttcgaggtgggggaattgtgggaatggaattttgtgtggcggagaatgatgccagaaagggagatggaactagtagctagctttatggaggatattaaggagttgggggttcagcctaatcaacaagacaaataa

SEQ ID NO: 77231 - DNA, 450 bp, Glycine max
  Peptide Sequence Number=SeqID_194009
atggctatcactctgaatgtattgtcttcactttcagtgcaaggtaaatgggcaggatcttcaaattggaatacagttgtggatcctttaaatggagattcatttattaaagttgctgaagttgatgaaacaggcattcagccctttgtggaaagcttgtccagctgtcccaaacatggtgtacacaatccttttaaggcaccagagagaacattaggtgattttcagatgattagtttgctaggtgtgaatggaacggaagtgcttatccttttcggatatctcatgtttggagagatatctgctaaggcagctcacatgttatcacttcctaaggtttcagatttctttacgaggttaatacaaagagtttctccaaagagttaccagcaggcttttggggaagtctatgtgacacaaaaatttctagagaatttttgtggagatcag

SEQ ID NO: 77232 - DNA, 198 bp, Glycine max
  Peptide Sequence Number=SeqID_194010
atggaggaggagcagttgcggcagctggcgaaagaggaagatcaaacggtcaagagcacgaagactgacgaattgttcattcatagtgagcgtgctgaagagagagagagagcggcatactgggaattgaagggcttttttttttcctcatcatggttagaagtagccatatttgataaaaacatgtgcagaaaatag

SEQ ID NO: 77233 - DNA, 186 bp, Glycine max
  Peptide Sequence Number=SeqID_194011
atgaagaagattctgggcaacatgcatgtagggtgggtggctggaagtgtgcatcagggtagtggtggtgcaagagactcacaaaggatgcatggcttgcggagggagttgcacaggtggcacggtggtggctggaccgtggtagaaggggtcacatgcaaatttggtgttgagagcaatgcatag

SEQ ID NO: 77234 - DNA, 150 bp, Glycine max
  Peptide Sequence Number=SeqID_194012
atggtaaaggtgtttgtagatataagacatttttcttgtagtgagaagttgtggggagggggggctgaagccccactactagaaaaaacaggcttctacgacgatcctttgaagccttccatgatggtcttcaaccgtcttcgaaagtga

SEQ ID NO: 77235 - DNA, 966 bp, Glycine max
  Peptide Sequence Number=SeqID_194013
atggcacgtgtgggagagaaagaaaagacgagagttgtggtgaggtttgtggggaggagaagtttctctttcgaggaatggggtggtggagaagattcactgtggatgatgaatttgaggactggggaaacaatggattctggatcttatccggagcgtccaggggagccggattgttcatattacatgagaacaggcctttgtagatttggtgcaacgtgtcgatttaatcatcctcctaacaggaagctgtactatctgaagacaggaacatgcaaatttggagccacatgcaaatttcatcatcctaaagatcaggctggaattgctggaagagttgccttaaatattttaggctatcctctccgccctaatgagcctgaatgcacttattatttgagaaccggacaatgcaaatttgggaacacttgcaaattccaccatcctcaaccaagtaatatgatgctctcattacggggttctcctgtttaccctaccgtccattctccaactacgcctggtcagcagtcatatgctggaggaacatacattcctagtcctcgatggcaaggtccttcaagttatgcgcccttaattctacctcagggagtggtttcagtgcctgggtggagtgcatacagtggtcaaatggggtcaatctctacttcagacagtccacagcaagcaatgagaaacggtcaaacatatggaacttctcgtcaaggtgagcttgcaggatcacaaggggcatattctcaattccgttctggcaccgttcctgtagggttttatacattgcagagggagaacatatttcctgagagacctggtcagcccgaatgccaattctacatgaagacaggagattgtaagtttggcgcagtctgtcggttccaccacccacaagagaggctagttcctgctcctaactgtgtcttgagtcccataggccttcctttacgtcct

SEQ ID NO: 77236 - DNA, 240 bp, Glycine max
  Peptide Sequence Number=SeqID_194014
atgaggggccctacaaggtccaaacccacacaaccccacttaatatggggtcggggtcagggtagttttcaactgaccttgctagggttgcttttagtcgacctcaatgagggctattttcgttcaacctcagccaagattatttttagctggcctcgatcaagattgttttcaaccagcctcgtccatgactattttcaggctacctcgatcaagacctttttggctaaccttggctag

SEQ ID NO: 77237 - DNA, 366 bp, Glycine max
  Peptide Sequence Number=SeqID_194015
atggtgatggagtattggagaccatggttttgggggcacaccgacaagtactacgttgttaagttgagtcaattgaggttagaatttggagcaacgttgggtgctgcaaatgacaagataattgcaattcagattacaggaacagctacgaagaaagggaaagtttcttcttctttttcttcttcaactcgtacccagaaactaggatccattcacaccaccttcccccaaagattcatcaattctaaggcaccaacaatcgtgtgggacgcacgtgacttctgcgggtttcatctcttgctcaaacataggtccctaagtggcacgtgccatatggcacttcatgtcttacatttatctgtttaa

SEQ ID NO: 77238 - DNA, 963 bp, Glycine max
  Peptide Sequence Number=SeqID_194016
atggatacagcagtggacgcagatcagaatgtaatagtggacacagtaattgataaatgcaagaaccagtgcaggcctaatggaagtgaagcattacctgcaggcatagtctccaccacttccagtttggaattgcggcctttatggaatcctcccgtgactaagaagggccatcacaaaatagaacttaaggtaaatgcatcaaccaatttgtttgcaatggcagttggcataaaacagaaagatcttgtgagcaagatggttaaaaagtttatagacagtaatttcgtcgtgatgctcttccactatgatggtattgttgacgaatggaaggatctcgagtggagtagtcttgtcattcatgtgtcggcaattgatcaaagcaaatggtggtttgccaaacgtttcttacaccctgacatagttacagaatatgattatattttcctttgggatgaggacctaggagttgagcatttccatccagataagtatgtttctattatcaaacgtgaagggctggagatatcacaaccagcactggatcctaaaaaatcagaagtgcatcatcagattactgcacgtgggaggaggtcatcagtgcacagaaggacatataaagctagtaatgatggtaaagggtgtgataaaagcagcactgccccaccttgtacagggtggatagaaatgatggctcctgttttctcaagagctgcttggcgttgtgtttggtatatgattcagggtgatagaacaaaaaacgttggtgttgtggatgctgaatacattgtccactacaatcgtcccacccttggaggcatagataatactatggtttcttctcaggaaaaggatcatagagttgatgtgaggagactttcttaccaagaattagatgtctttagaaaacgttgggaaaaggcagttgaggaggataaatgttgggtcgatccatttcaatag

SEQ ID NO: 77239 - DNA, 297 bp, Glycine max
  Peptide Sequence Number=SeqID_194017
atggcattcaaagcaattacaggttttaggggtgaaggaacaaaagccaaaaggtctattgggaatgttgcaattgatggcatagcaacatggagagggcaagcagatccctttggctccaccacagcagccatgagcatgagcatgagcagaagagggcatcttgacaagtgcttcttcttagactctcttgagttgttggaacctgaggaaggacaaggacaagtgtttcctttgaaatcagagtccatgaagagtgacccctcttgtctctactctatgctccctactctctag

SEQ ID NO: 77240 - DNA, 1245 bp, Glycine max
  Peptide Sequence Number=SeqID_194018
atgctactatctcccaacccactttctcttctttgtgcactccttctctgcttacctctagccatagtcttcaccaccaacaccacacatacaacaacaaccaccacccccatcatccttgacattccaatgcctcttcccaaaaacattaccatccacgaaaatctaaacaaaacatcatcattattgtcaccatcactaaatatccaagatgacgagcttcacaaagtaatcactcgtgaaaaaagaagacccattgggcccaacaaaaaatcattactaacatcattgtcagtacctttatcatcaccatcaccgtctatgtggcaagaaaaccgccatgacgccctattcaaagcagccatgcgcgtgaatgcaaagcccacaaggccaaagaaggtagcttttatgtttctaaccaacaaacccctcccatttgcgccactatgggaatcttacttcaaccaaaccacaacatcaaagaatctcttcaacatttacgtccacgcggacccaacatttccctaccacgcgcccttctccggcgtgttcttcaaccgcgttattcgctcacaacccaccaggagattctcccccactctcaccgcggcagcgcgtcgcctacttgcacacgcgctcctcgacgacacttccaattccctgttcgtgctactctctccctcttgcattcctctccactcgctcaacttcacctaccacgcgcttctccgcaggggcaagagcttcgtcgagattcttgccaatgaagcagtggcttacgaccgttgggcggcgcgtggacctcacgtgatgctcccagaagtgaggctcgaggaattccgtgtggggtcgcagttttgggcgctgacacgtcggcacgcgcggcttgtcgtgagtgatcgcgtgctgtggccgaagttcaacgtgccgtgcgtgcggtttgacacgtgctacccagaagagaattactttcctacccttctgagcatgtgggacccgcagggatgcgtgccggccacgctcacgcatgtgaattggacggggcgtgtggacgggcatcctcgcacgtacgaagcgtgggaagtggggcccgagctgattcggaggatgagggaggataggcctaggtacggtgacggtaacggcgacggacggagggatccgtttttgttcgcgaggaagttcgccgcggacgcgttggaaccgttgatgagaatttcgaacggcgtcatcttcagggactaa

SEQ ID NO: 77241 - DNA, 1302 bp, Glycine max
  Peptide Sequence Number=SeqID_194019
gtttcattgagcttattgaaactgagaaattttcatgatgacttgcctagagcatttgtagacaaagtgacatgccttggggagaaaaataatgggaaagttgatgatcaagttgagcaatggagttcttatgaatcggatgagttatctgtgtgtgattcagatgactcatctgatgagtccaccactacaaccacaagcagtagcagcagcagtagcactagcactgcaattcactgtaatgggtcaagtgttacaagatcagagaggtttgtggactcagatacagagacctttttggacacaatgcagaggagttggtccatgttgccatggaatagaagcttcgagggatggactttcaaaagaacctcctcaagtaaacgagagcctttgacctcacattcaactcattccatgggaccatactttgatcacaataaatgcactgcaagtggctgggaaaatagggaactttggagtagagatgggaaaacaaagctcaaaaccaatgtgttctttgcttcctttgatcaaagaagcaaaaaagcatgtggtgagagtgcatgtacagcactagcagtgtgcatagctcactggcttcattccaaccacaacatgccaacaagggctcaatttgatagcctcatcaaaaagggttcctctaaatggagaaagctgagtcatagtgatcactacctaaagcttttccctgataagcattttgatttagagacaatcttggaagccaacattaggccactagttgttatccctcaaaattcctacacaggatttttctcccctgagaagtttaaatgcttagaaggagccatgtcctttgatgatatttgggatgagataactagaaatgatggtgtggttgatcatgagccaagaatttacatagtgagttggaatgaccatttctttgttctgaaagtggaagttgatgcttgttatgtgattgacactttgggggagaggctttttgagggatgcaaaaaggctttcatgttgaagtttgatggttcaagtttgatgcatgcaaagggaagtaagaaaggaagaggtgagatagtttgcaaaggaaaagagtgttgtaaagagttcatcaaacgctttcttgctgccataccacttaggcaactagaagaggaagagcaaaataaagggactgtctataatccttattttcacaggaaattgcagattgacttccattatagtttgttatcatccttgtcttcagtttcttcaattggtgaacctttacaacctaattatatagcaagacattag

SEQ ID NO: 77242 - DNA, 477 bp, Glycine max
  Peptide Sequence Number=SeqID_194020
atgaagaacgagagagaagtaaaggaagaatttccagacgaacaggtcttagaggtagccgaaagaccttggtttgcaaacattgccaattataagacaacttgctgtgaaggacctctaccatcctcatacgggaatgtctacatcctggtggctgttgattatgtgtctaagtgggtggaagttatagccactccgaagaatgatgctagaactaccaatggacaagcagaagtgtcaaatgggaagctgaagagaattttggagaagaccgtggcttcctcaagaaaagattgggcagtgaagctagatgatgctttatgggcttacaggactgcatacaagacttccataggcctctctccctttcagatggtctatgggaaggctttccatttgcgagtggaattagagcacaaagcctattgggccctcagattactagactttgatgaatccttgtctggagagaagtga

SEQ ID NO: 77243 - DNA, 372 bp, Glycine max
  Peptide Sequence Number=SeqID_194021
atgcggttattccttgatcagcaaggcaaccgcttcgcaggcgatgccctcaccgcgcccggtgaagccgagctgctcggtggtggtggccttcacgttgacgtcatccatatggcactgcagatcttccgccaggaaaacgcgcatctgcgggatgtgcggcgccattttcggcgcctgggcgataatggtgatatcgaggttaccgaggcgatatcctttggcgcggatgcgtttccaggcttcgcgcagcagctcgcggctgtcggcgcctttgaacgccggatcggtatcggggaacagtttgccgatatcgcccagcgccgccgcgcccagcagggcgtcggtcgcggcgtgcagcgcgacgtcgcc

SEQ ID NO: 77244 - DNA, 495 bp, Glycine max
  Peptide Sequence Number=SeqID_194022
atggaggaaaacattccacttgaggaagtttttcagactctgaggtgtgattcagatggactcacaacaaaatttgctcaggagaggctggtcatctttggccacaacaaacttgaggagaagaaggagagcaaggttttgaagtttttaggatttatgtggaatcctctttcatgggtcatggaagctgcaacaatcatggccattgctttggccaatggaagaagtatcatctcaggcagctcaaagcacacaattattggagcctccaaaaggtctcttttattggaaataatgttaaaatctgtacaatttcagcgcatatccatcgctaagcgcggcttcagcacgcttagcgtgaagaaggaatttggaagagcacctgaatcgaagcatcacgctaagcgtgagatcagcttgctaagcgagttgtccatctattgccaggctcagtgcaacattggcaccaagcccaaatccacttactcgcgctaa

SEQ ID NO: 77245 - DNA, 327 bp, Glycine max
  Peptide Sequence Number=SeqID_194023
atgaccttgttagtgtctgcgacaggaatcactggggttctgacttctgagtctgactctcctgccccatatcaatcaccacctcaggggatattggacattcattttctgcatcctccatcgacctgtgttcaaaatacaaaaggaaaacaaggggggaagcatgcagtaacaacagaagacaatctgcattatatacacataaatagcatgcttggggtggcagtcagaaaattaagaagtgctataaaaatgaagcatagtgagtgtgaaagagatgggaacttggaagctgaggagaatcggaagaactctaggaatttttaa

SEQ ID NO: 77246 - DNA, 2154 bp, Glycine max
  Peptide Sequence Number=SeqID_194024
atgggggactcaacttgtctcatgcaacaaccattctgttatgcttcagggatttccaatgaagccagtgagaacaacccaattcatgcacttgagcagtcaatttcgtttgggagattcatgtcagagtccctggcatgggagaagtggtccagcttctcccacaaccgctatgtcgaagaggcagagaggtactcaagacctggttcagtggcacagaagaaggctttctttgaagctcactacaagaaacttgctgctcagaaggcagctgcattgcttgaacaagcaaacaatgaggcacaaaacaattccactggacaagaagatgagggagtgattgacaatgacaatgacactcataatttacaaataagtccaaattctgaaatggttgtcaaggaagaacaagatgcaaaggtattgagtgttacctctgatgagcatgatgtcttggtcagactcacagccagtgagcatgattcaaactcaagtgtagaggcaagtgttacacctgaaagtaacaaggtagagggagctgaggcagtaatggaagaagtagcagttgtgggaagttcaatgaaggttgaattgcaaagccaccttgaagatgttggtgcacagaaggaggaaagtgaaaagcttagtgcaattgtaacacctccaattttgacaccaatagtgaaggtctccaaatctgatcaggaagttttggctagtgtgggcaagaagaaaccaccagtttcttcctttaagttgtcaaaggctaatggaacctcctacttaacctctacacctgttaagtccactgctgctatttctttcaaaagagataacattgctacaccaatgagcaataaacctgctaatgaaacctccaagttcactactacacctgttaagtccacagctgctatttctttcaaaagggataatattgttacaccaatgagcaatacccctgctaatggaacctccgtgttcaccactacacctgttaagtccacagctgctattactttcaaaagggataatattgttacaccaatgagcaataaacctgctaatggaacctccaagttcaccactacacctgttaagtccacagctgctatttctttcaaaagggataatattgttacaccaatgagcaataaacctgctaatggaacctccaagttcaccactacacctgttaagtccacagctgctatttctttcaaaagggataatattgttacaccaatgagcaataaacctgctaatggaacctccaagttcaccactacacctgttaagtccacagctgctatttctttcaaaaggaataatattgttacaccaatgagcaataagcctgctacattaagcactgcagataaaaagagatctactcctagatcagttaattttacacccattagagaacttaacagattgactgcttcagtcatgaggaaatttgaaagtacaagagctggtgctggttcttccaaggcttcaaaggataactcgactacactaagaactccaactatggcttccaaggagatgcaaaaccaatcttcattgaccccattaactgaaaagaaaaggaacaaaacacctcttgatttgtcatcagcaccagggaaccatacgggtggttctaaatggcgcttgctttctggagacattgaggctggaaagaaggcctcactaagagcacaaatccagaaactcgaagaaaagttcaatgctaatgaagcgcaaaaagagcagctgcatacgaaactcaaggtgggtgaccaagagaaaacagagactgagattattagaaaactacgccaaagcttttgcttcaaagccaggccactacctgatttttacaaggaaaggaaaacgtcaacgaatgagacaaaaaaggatccactgacacattttggaacaccgaaagatggaaggaaatccaccccaagtatggcagagagcaagacttcttttcctcccaacagacctgtactgaaaaacagtggcaccaagcatttcctaggaaagagtggtcgcaccttgtctcaccctctaacttcaacttccatgattattccaactcatgagaatacatcaccaaatattcagaatggataccagactggtagaaacttaaaatattaa

SEQ ID NO: 77247 - DNA, 2122 bp, Glycine max
  Peptide Sequence Number=SeqID_194025
atggcgtttcgaacacaccatgggcactacgaatacctcattatgccctttgggttgtgtaatgcgccctccacattccaggcaattccaggcagcaatgaatcgcctccttgctctgttcttacgactgagttctacttgaaacgaactaagtgtttatttgcccagagagaattagagtatctcggtcacgttgtttctattaagggagtcaccccggaaccctccaagatcaaagctatcgcgcaatggcccaccccggccacagctaaagaacttcgagcgttccttgggttaactgggttctataggaaattcatgtgccaatatgcaactatcgcgtctccattaacgagcctactatgcaagaatgtgtttgaatggtccctcgagtcacaagaagctttcgataagcttaaatctgccatgatcaacaccccaattctggccctccccaacttccatgaaccattcctcattgaaatggatgtttcaggtactgccatgggggttgtgctctcgcagcaagggcacccattagcgttcttcagcaagaacttcaaccctcgcctacttaacgcctccacctacgtgagggaactccacgctatcacatccacagtgattcaaacacctgaacaacattattatctttccaagttacttggctttgattatacgattcaatataaaacgggcgctaccaatattgtggcggatgcactctcttgcagaccaccggaaccaggccagttgcttgtgttgttagtgcctcaattcgacttcctgcgcgacatccaacaagcacttgtcagtgatcctgactttcaggcattactgacccacgttcaagagaacccttcagcctatcctcaatatcgggtccataacgggttcctgctattcaataatcgcatatggttgaataaaaccaacccgtacatcacgtcccttttgtcgaaatttcacgctacaccgttagggggccatttcgaggtagctaagactttgcaccgcattgaagcaagcttcttctggcaagggctgaagcaagatgttcagaagtatctccgagagtgcaaggtttgccaacagaacaagacgagcacccgacgtccggagggcctgctacaaccactgccagctccggtaagggtgtgggaggacatctctatggacttcatcactcatttaccaccatcaaacagcttcacggttatcatggttgtcgtcgatagatattccaaaggggtgcatctcggagccctacctataggattttcagccttcaaggtcgccatgctcttcgtggaaatcgtctgcaaacaccatggatttctgaagagtattgtctccgacagggaccccgtgttcttaagcgctttttggagagaattattcaggctcagtggcacccacctccggttaagcacggcgtatcatccacagacggatggccaaaccgaggtggtgaaccgcgtccttgagcagtatctccggtgtttcgtcaactcacaaccttcatcgtggttccgatatctgtcactcactgagtggtgctacaacacctcgctgcattcaagtttcggtatgaccccgttcgaggttatctatgggaaacccccacccacgatacctcagtatatcccaggcttgacaaggaatgaagttgttgagactctagtccagtcacggcaagacatacacacccaactacaaaagcggctgaagaaagttcaagactccatgaagaaatatgctgatgctggacgtgacgatgttacctttatcgtggaccaatgggtaggagaagttgcatatcggctagacctctcagctgaggcacgcatccaccctgtcttccacttctcactgttgcgccatcatcatggacctccaccctcttccactgaaccgtggaccttagagatcattggtcagaaacccatgcaacgccccctttgcattttggatacgaagcttgacacttccacttcccctccaatgcaactcgttctggtccaatgggttggccaacctcccgaggacacttcctgggaaccatggctagagttacgagatgcttaccaccttgaggacaaggtggttttcgaggacagag

SEQ ID NO: 77248 - DNA, 411 bp, Glycine max
  Peptide Sequence Number=SeqID_194026
atggaagcttcttcctctccacaatctacaactcctccccttatcttagaggaaccagtagtctttattcatcctcccatctttgaggagcctcaaacggtgaaaaaagagccacctagagtgacacttggagactattcgagctccacaatgcctcaattcactagtattaagaggccaaatgatgaggttgaagagaaattcctcaagaattacttcccgggatctaagacaaccaaggggaagacagatatttcgtcatttcaccaatttcttgatgagtttcttagtgaggccttggactgtttccatggtttgctccgcaaaactcctacacatgggtttagtgaaccagttcaagtcaacatgtttgttgatcgtcccatgaaatatagtttccatgttctatga

SEQ ID NO: 77249 - DNA, 658 bp, Glycine max
  Peptide Sequence Number=SeqID_194027
atggcttatgatatgtccataagcttttttcaaaacttgaacctttttttccctcatgaatatttttacatcaggactcaactttcttttcctgcaaaggtcttcttttgccaggcaaaatctggcatagatggatcattgaatttggaagtggtgtctccaactctgttagcagcagaaaaggaagaagccaaggctgtattaaccttgtttttgaagaaacaaggtttgagcaattcggtcgctgctagaaccatcaacaagtcagatcttttcattgatcaccttgtctcaaagcttcattctaaacacaaatcttggtatctcgcaggtagagagcttacaactctggagatcagggactctctaatcccatatcttgagtctctttttgaagagcatggagaccttctagtggatgtagtggaaaactatccaaatccacctgttaaggataaatcagatgtgccagttcctccttctagtccagtattagactctaagaagcttaaagccgtgtctcgagtgagcgcgatggacccagatggtggcaatctccgccctcatattgtctatctcatggaacttggtatggatattgagcagataaggagtatcacacgacgattcccatcttttgcctactatagcttggagg

SEQ ID NO: 77250 - DNA, 271 bp, Glycine max
  Peptide Sequence Number=SeqID_194028
atgtggaagatgaccacttttactggtgacacgcaaaccgccagtggaactggcgagtttggtgttttagaaggaactgccaacactattggcgatatcggtatccatgggaaccgccagtcaaactgggaagttgcaactgccattggcgagttaagggcaagttgcaactcccactggcgagttagggcagaaggaatagtcattccagatggcgatttaggacctttatatacgcgaaaattgtttcagtgttattgtgtgttcacaa

SEQ ID NO: 77251 - DNA, 460 bp, Glycine max
  Peptide Sequence Number=SeqID_194029
atggggaaagggagcttacgacggcggcttccggaagatccattaagggttctttcggaacttccagaagaagttgttccggaaaaattccggaagaagtgttcttccgaaagaaaccaaaggtcttccggaagaacccttcttccggaacacctcttccataaagtttccggaagaagtagttcttccggaagaattccggaagaagggttcttccggatgacctttgagattttcggaagtagaattataggcagagatagacaggatgaccatgatgatgttcccgagaggcgtaggcctactgcattagcccgtaggcaacaggttcatcagatgactcaggatattcctgacatgactgaggatgtccctgatatggctgaggatgcacctgagatgactgcggacgtacagggtcatgatggtgctgaggggtcacatgctgatggattcccag

SEQ ID NO: 77252 - DNA, 247 bp, Glycine max
  Peptide Sequence Number=SeqID_194030
gtgtttcgtgagagttgctcgttcattattgtatcctcttggtggaggtgcattgtttatggtggttcctcggcaaatgacggttgtgacagtggttggtttgaccattaacagcggagtacttgatgcaatcctccctaggaagggaccagtcactagagccatgagcaagaggcttcaagaggattgggctagagctgctgaagaaggccctagggttctcatgaacctcaaggtagatttctga

SEQ ID NO: 77253 - DNA, 285 bp, Glycine max
  Peptide Sequence Number=SeqID_194031
atgagggtgatgagtttggcttgtttctttgtcctattgttggttctattgctgttacaattgcaaagcttctctactgctgctactactaatgagtcagcaaaatttcaaaactttgaaagtgggtccatgccaaagcctagctcttttcaagaagccaaacaaggttttagacagaattcaggtgaaggtggtagtgaagcagttcttggtgaagagaaaaggaaaatctacacaggttcttctggtgctgtacataagaatgtagcctttagttacaagtaa

SEQ ID NO: 77254 - DNA, 537 bp, Glycine max
  Peptide Sequence Number=SeqID_194032
atggaaagcatagattttctccatgaatttggcctctcagaagagagtattggtaagattttaactcgttgccccaatatcgttagttatagtgtagaggacaatctccgaccaacggctaattacttctgttctttgggggttgatgttgggattcttctattcagatgtccacagaattttggtcttagcattgaggccaacctaaagcctataacaacatttttcttggagaggggatacactttggaagaaattgggaccatgatttcaagatatggagccttgtatactttcagcttgactgagaatctgattccaaaatgggatttctttttgacctcaggttaccaaaaatctgatctggttaagttccctcaatattttggatacagtttagaggaaaggattaagcctagatttgtaattatgaaaaaatctggagtgaagttactccttaatcaggttctttcactgtcaagcagcaacttcgaagaggcattgaaaaagaaaatgaagaaaatgcaaaatggttag

SEQ ID NO: 77255 - DNA, 213 bp, Glycine max
  Peptide Sequence Number=SeqID_194033
atgcgtgcagctgcggtggcatgggaagcagggaagccactgtcaatagaaaccatagaagtggcaccaccccagaaaggtgaagtgcgtttgaggatcctcttcaactccctttgccgtagtgatgtttattggtgggatgctaaggaccagactcctctgtttcctcgtatcttaggccacgaagcttcagggtatgttacttttggataa

SEQ ID NO: 77256 - DNA, 456 bp, Glycine max
  Peptide Sequence Number=SeqID_194034
atggtttcttggaactcatttccattagaagtgatctaccaaatgattcctgtagccgctaatgatgttgctttctccattcattcagtcatattaaatttaattatactgtcccaaatttcaatgtttgaacgaggaaatcagaagttctccaactatgccattgcaatagttgttgtagtgtggtttagtgttgctgtttgttttttcatagcattgcatagccaatcttggctttggctaatctccatcttcaaccttatctctatagtgtctttctctatgaatcacatgtcattgaggtttcctaacttattccaaagggatgagatgctaataatgtgtggtaaacaattatactgcagcacaattcaagcagttatgatcctcatcaaatattttccgcagcatgtttggtacggtgtcctagacatgctttttcacgtttactcgtaa

SEQ ID NO: 77257 - DNA, 249 bp, Glycine max
  Peptide Sequence Number=SeqID_194035
atgtctaatccaagttgtactaccttcaactttggatttgcattttcccctgaattacaatttcttggaaagggaaatagcagtgggtattctcatggagcatgcaatggaatgaaacaaaggcatcaagaagattgttattattgtgaatggaggatgagtgagaatgagggtggagctttgcagttgcaggataacaaagaagaaacttgggaagggaaagagaacagcgtaaccttaacaccgtga

SEQ ID NO: 77258 - DNA, 363 bp, Glycine max
  Peptide Sequence Number=SeqID_194036
atggacttccatgtttctgccatggacactcaacaggcactgcttgatccaaaggttgtagctagcatagttggtgctacattcacatcaccagcagttggagtggagccttctcatccaattttggtggcacttgcgcctatagtttcatttttgctgccaacatatcaatgtaattctgcatataaaaaggggttgccagtttctcgagatccagacgctctaattgctaaatattcagatccattagtatgcacaggatctcttagagtacgtaccggctatgagattcttcgaactacgagctacttgcaacaaaatctcagaaaactgagagtttccatttcaagttctccatgctga

SEQ ID NO: 77259 - DNA, 1167 bp, Glycine max
  Peptide Sequence Number=SeqID_194037
atggttccctggaactcatttccattagaagtgatctaccaagtattgggatggttagctttcctttcatggtcagttgctggctatccacaactcatcttgaattttcgtagaaaaagtgttgtgggattaagcttggattatgagattctgaacttaaccaagcacttctcatatctgatatacaatgcttccctcttctttgtccctgctgttcagaagcagtattttgagaagtatggtcatggccagatgattcctgtagctgctaacgatgttgcattctccactcattcagtcatagtacatctaattatattgtcccaaattgcaatgtttgaacgtggaagtcagaagttctccaagtatgccattgcaatagttgtagtggtgtggtttagtgctgctatttgttttttcatagcattgcctagccaatcttggctttggctaatctccatcttcaagaaatctcttatcacctgccttaactcttggggtgaagtttatatatctgttagacaacttcacttagtgttaattggtttaaagctgaaatctaacatgaaatcagagcctatagcccatcttattctcgcatattctagtaggctcccctattctgctttttcactttttatgattcacattagatgtatgagtgttggggtaagcaagatgacaccggacttagaaaacttaattaatggtcaagctcaaagcctcaaactaggcttaaagagactttgcagaactatgaagttgaggctaggcataattcaagtagttatgaccctcatcaaatattttccccaggcattcatgaacttcttgagaaagagtacagatggatttagcattggcactattcttcttgatttttctggagggatctttaactattcacaaatggttgtgcagtccatagatcaaggttcctgggtgaacttctatggaaacattgggaaagtgcttatatccttggtaaccatattctatgattctattttaatgtgccaacattatgtactataccctgagaacaagaaagggcttacttctaaaaattccgaagaaatcaagcagccactaatcagtgcaagtccaatagatcaacaaatcaaaggttcacttaaatcttcacatcagtctccggcagaattatga

SEQ ID NO: 77260 - DNA, 1740 bp, Glycine max
  Peptide Sequence Number=SeqID_194038
atgcatgtgcctgaaaagaaaattaatgatatccaacacatgataattcatcctgcacgtgaaccacccgtgactaataccgaaagttccatactggaggctccgcctagcacatccccaaacaaaaaagaagaggttgttaatcagcttgagactgccaaagctgaaatgggtgtagcgagagaagaaaatcaactgctaaagacgtgtttgaacaaaataatgaatgaatatcggacactagagatgcaatttcaggatatactaaagcaacaagggacaaaaaagaacgctgataaaggaaatgatgataagcatgaagaaatattagaggaagcggatcttgtttccctctgccttggaagagttccaagaagtgatgagaaaatcaaagtttctaataagccattgaaggatgatgaagggttgactcttggactagagtgcaaatttgaaacatcaaagtcaggaagcacaaatgaagctttacctaataatccaagcccagaaaatagttgtgaagtagtaccaaaggaagaaggtggggaaagtaaggaggcactaaagacaatgagatcagacacagaggatgaagttgctcagcaaaatcctacaaagaaacctcgagtttgtgttagagcaagatgtgacactccaacaatgaacgacggatgccaatggaggaaatatggacaaaagatttcaaagggaaatccttgccctcgagcttactatcgttgcacaattgcaccatcatgcccagttagaaaacaggtgcaaagatgtgttgacgacatgtccattttattcaccacttacgagggaacccacaaccacactcttccaccatcagctactgctatggcatccacaacttccgcagctgcatccatgttattgtctggttcatcaacctctaactctgcctcaataccttcaacagcaaccacaaatctccaaggcctcaacttttatctctcagacggttcaaaaccaaggcaactatacctctccaaccctgcactatcatcttcactttcacatccaaccatcactctcgacctcactacttcacacccttcagcctcttcctcatcatcatcaccctttgtcagattcaattcaaactacaacaacaatcaccaacccagatacccctcttcctcatcaagcctaagcttcagtactagtaattcctccgaaattgctaatgctatatcttggagcaacggcttcctcaacaataataggaacatccttagcagtgtgaactttggaagacaacaaatggaaaacatgaaccagtcctacatgcaaaagaacaacaacaacacaagccttcttcctcaagctgatactatatctgcagcaacgaaagtgatcacagcggaccccgcttttcagtcagctttggcagcagcacttacttcgtttattggcggtggtggtgttggaaacacgcgaggaagtcaaggtggtaatgttgttggagaaagtttgagtttgggtcagaaaatgaaatggggtgaggtgtttccagcgtctaataattctaattcttcaatttcgaacaataaagtcaatggttgtgcatccagcttcttgaacaaaacgccggcagcgaatacacagacgaaaaatttgatgtttctgccgccgtcgtcattgccgttttcttctactcccaaaagtgcatctgcatctcctgctgctgataatagcgacaccaccaccaattga

SEQ ID NO: 77261 - DNA, 531 bp, Glycine max
  Peptide Sequence Number=SeqID_194039
atggttcaatcgaagggtgaggaaaaaggaagtgggtgtgatttaaaaggggttgtttctgggggagtcccagtgcagttacttcaaaaccaagtgtttccagtttctttaatctttattccgaagcataccgaaaagacgcttacgcgttcacgcgcgaaatcgcgtttggggaagttgagccgttggtggaatgagatggacggcggagatggaagcgcgtggcgagaggtatgggagccacgctggcaggatagtgtggtcgattgcgtcgagtgtgcgacaaagagaaacatggaggatgtaggcgacggtagtgtagtgcagttactgaccccaccttattactctcccgtatttgtgccgcaaacccttgaggattggcaagtttctaagccaaaacgaggcacgattgttgctcagttaactgatgttgttgtggttaagtggaaggctcctcaagatggaatcgctaaatgcagcatagatgttgcatttcataaacatattatgtgtgtttgtggcttctga

SEQ ID NO: 77262 - DNA, 144 bp, Glycine max
  Peptide Sequence Number=SeqID_194040
atgggaattgaactgtcattgctttgtgatcccaacccaaattctcctgcaaactcagaagcagctcgaatgtttagtgagaacaagcgtgagtacaatcgaagagtgagagaaattgtggagcaaagttggacagctgactaa

SEQ ID NO: 77263 - DNA, 582 bp, Glycine max
  Peptide Sequence Number=SeqID_194041
atggtcaagattcaaaccgcatcaagtcattgcatcagacggaatggtagatttgaggtgaagacgttccacattggtcagaactcaacgggtaggagtaggagtcggaggagttcgagagatcgaacgaaagctatttattctgagactaacagtatcctcatggaagaaaaagctgttgttcggtttcacataaaagtattgcctaaaggaaaaaaaagtcccgatctcacgatggggaagtcaccaggaaaatggatcaaaactgtactgttcgggaaaaagtcatctaaatcaaatatttcaaaaggcagagagaagcttgttaatcaaaaaggagtagtagttacctccaaggtgccagaaactggtttggctttagaaccaacctccgatactattgccagacatgaggaagatccagagctggaaaataaagaagcagaaaatgttttacccgggaatcaagaaatagacacagtgggatcaattaatgaagatgctgcactagatccagagaaaatgaggctggaggaagcagctacaaaggcacaagctgctttcaggggttatttgttttaa

SEQ ID NO: 77264 - DNA, 1038 bp, Glycine max
  Peptide Sequence Number=SeqID_194042
atggaagaacccgtgaaggaacagcagcccctctctgctgggaactctgcgagacccaagcttcagagatacgcgcttcgttcctcctctaaatccaaggaaaacaagccagacgcacctgatcgctccatttcttctgaatctaaacgggggttaagtactccccgtctaagcagaagtgtatgtggtcttgatttctctggcaacaaggacaagtctactagtgctaaaccaccaagaaggctctccaatcctgtgaaagcatctcccactccaaacctaaagttggttggtaacattaccccaatctcagagagcagaacaatgaggtctggtaatgtccaagggtctcaaagcagaagccagacacccgcttctgaaatttcaagaacatcaagccgaatgaagttcaatctcttatcttcctcttcatattggctaaaccagatcaagctctctgagtctgctgacaagcactcagtttcacttggattcttcaaacttgcctcggaggcaagatgtgagccgtttcagaagatgaaagatgagctaaagtcttatgtgcaacgacatcagcttgctgaacttggagaagtgaaagaactgcttcaaagctatgacattgcagaaaatatagagcagccacaagtgtctgaaagcattacacaggtgccagaggaaggaactggatcctccgatgatgaagaagtgcactgcagttcttcgtccaccatggacactgcaaaactgaagcctgaacccttggacactgaatccactgaacctgctcctgttaaaatagagtcaaccaagaaggaaactagccaaaagaataaccaccccggatccaggttgagagaaaatctcaagaactctgcaaattcaagacctgcttctgacagtgggagttctagattggttaaaaaatcagaaaagccaactacgcaacaaactaataaggaaaaaagcgaggtcaagaaacaaggaaagaaatctgatgttataaaaggcaagaatgcagcaaattttcaattttga

SEQ ID NO: 77265 - DNA, 1359 bp, Glycine max
  Peptide Sequence Number=SeqID_194043
atggagttgtatcctgggtttgctttatatcgcgggttatatgagttagcacaattttcctttgaagggagtagttcagagacaggtggtatgaagtggcagaatctgagtgaaagcaccaatggcatgaaagaggtcttaattatcatgtttgttgagtggataatgatgctttttgctgccttctacgttgaccaagtattgtcgtcaggaagtagaaaaggtccgctttttttcttgaaaggatttcagaaaaggcctcctttccagaagcttgatgcccaaatgccggtgtcaaaagtattctctcaaatggagaaacctgatgtcatccaagagaaggagaaggtggagcaactgctacttgaaccgactattaatcatgcaattgtatgtgatgacctgaaaaaggtctatccagggagggatggaaatccagataaatatgcagttagagggttgtttctttctgtgcctcaaggggaatgctttggtatgcttggtcccaatggagctgggaagacctcttttatcaatatgatgattggtctcacaaagccaacctctggtatggcgtttgttcaaggcttggacataagaactcaaatggatggaatatatactaccatgggtgtatgcccacagcatgacttgctgtgggaaagcttgacaggtagagaacacctatttttttacggcagacttaaaaatcttaaaggctcagtcttgacacaagaagtagaagaatctttggagagtttaaacctttttcatggaggagttgctgataagcaagttggaaaatacagtggagggatgaagaggaggcttagtgttgcaatttcattgattggggatcccagagttgtttacatggatgagccaagttccgggttagaccctgcctcaagaaaaaacttatggaatgttgtcaagcatgcgaaacagaaccgtgcaatcattctcaccacacattccatggaagaggcagaggccttatgtgatcgattgggaatatttgtaaatggtaacttgcaatgtgtaggaaatgcaaaggagctgaaagcaagatatggaggaacttacgtgttcacaatgacaacatcttcagaccatgaaaaagatgtggagaacatggtgcagaaactcaccccaaatgccaacaagatataccatctctctggtactcagaagtttgagctgccaaaaggggatgttagaataacagatgtattccaagctgttgatgctgcaaagagaaacttcaccgtttctgcatggggcttagttgacaccacattggaagatgtcttcattaaggtagcacgcgaggctcaggcatttgacaccttgtcataa

SEQ ID NO: 77266 - DNA, 861 bp, Glycine max
  Peptide Sequence Number=SeqID_194044
atgcctaaatctggaactgttgtagctgtgaagaagcttaagcctgaaggttttcaagggcataaggagtggctggcaatcaactatcttggacaacttcgccatccaaatcttgtcaaacttattggatactgtctagaaggagataaccgacttctagtatatgagtacatgcccaacagaagcttggaagatcatatatttcgaaaaggcacacaaccacttccttgggcaacaagagtcaagattgctattggtgctgctcaaggtctttccttcctacatgactctaagcaacaaattatctaccgtgatttcaaggcttctaatatattgttagattcggaatttaatgcaaaactctcagactttggattggccaaagcaggccccactggtgatcgttcttatgtttccactcaagtcctgggaactcatggctatgctgctcctgaatatattgctacaggtcggttgacttcaaggtgtgatgtctatagctttggggttgtgctattggaactactatcagggcgccatgctattgataacacaaaatctggagtggaacataatttggtagagtggtcaagaccctatttgggtgataggaggaagttgttccggatcatggacaccaagttagaagggcaatacccacagaaggcagcttatacaattgcaattattgccttacaatgtattagtgaggccaagactagaccgcagatgtttgaggttttggctgccttggaacacctgcgagccattagacattcagctagcccatctggagaagagaagtccatgccaagccctatgttaaaatcccctttgggacataaccatccagagttgtga

SEQ ID NO: 77267 - DNA, 981 bp, Glycine max
  Peptide Sequence Number=SeqID_194045
atgagtctcataattagggcacatgaacatcataggaaaattgagttttatgaactgaagagaggatatctcaggctcaatttgacaaattacggtgctacaattatctcagtcataacccctgataaacatgggaatttaggcgatattgttcttggctatgggccattgattcttatacgaatgatacagtttacttcggtgcccttattggacgtgtggcaagtaggatcggaggagctaaattcactttggaaggcaaaacctacaaattgcccgctaatgatcacgggaacacacttcacggtggcgcaagaggcttcagtgatgtcatatggtcagtggaatcccacaagaaacacagtcatgctttcatggaaaactaaggtctcagtgacttacatgctcattggaacacacgaatttggtgtgaaaatgatagcaaagcaagtggacaaagccacaccagtgaatctagcgcagcatacttactggaaccttaggggccacaacagtggtgacattctttctcacactgttcagatctttggctcacacatcacaccagtggacaagcttctcatccccactggcgaaatcatatctgttaagggcaccccatatgatttccttgaaccaaaaaaagttggaagccagattcaggaaggtctatatgacatgaactatgtgctagacaaaagtttccaaaagcacttaagtaaggctgctgtggtgatagaccctgtctctgggaggaaattggagctgtggtcaaaccaacttggtctgcagttctatactagtggccagttgaatgctaccaaaggcaaggatgaagccctatacggcaagcatgccggcattgccttggagacaaagggtttcccagattctgtgaattacccttactttccatcacagattgtgaagcctggggagatttacgagcacaccatgctttacaaattcacagctaactaa

SEQ ID NO: 77268 - DNA, 940 bp, Glycine max
  Peptide Sequence Number=SeqID_194046
gccgctatcggccctcgggccgtctgatgacaaatccccgctcgcgatcgccgtcgaaacccgccttgagataaagctggtgcgcgccggtgcgttgctgccccgacagcagcatcaccttgtaacagcccttgcgccaggccagctgcagcgcgtattcgatcatcgcgagcgccacgccgtggccgcgatagggctccgccgtcaccacgtgttcgatgacgccgaacggctgcgcctgatgcgccagccccgggatcagcgccagcatgcaggtggctatcggctgttcctcttgcgccgctaccaccagacggatcgccggatcgtccagcaggcgctgcagggcacggcgcgcgtcgtcgctgcgcagcggcgcatcctgtgggcgcagctcgcgatacagagccaacaggccgttgagatcgtccggctgcgccaggcgatgaatgatgctcatggttgctcctttcgccgcttcaagggtaatccgctatcctccattaataccacaacgattaccgaaggggatgttatgagtcaggtttcgacctttgtcatgttccagggggaggcgcaacaggcgatcgacctctacagccaggtgtttgcgcgttttcggctcatgcaggtgcagcattacgacccgacgccggacggccggcggttaatcaagcatgccaccatcgatttcgaccggcagaacctggtgtttatcgacagcccgatcagccatgatttcagctttaccccggcggtgtcgctgttcatcaacctgcctaacgaagaagcgttggagagggcgttccaccgcctggcggagggcggtaaggtgctgatgccgctcgacgactacggcttcagcgctcgcttcggctggctcaacgatcgctttgggctttcctggcagctcaatgtgccggcgggggatctgccctga

SEQ ID NO: 77269 - DNA, 634 bp, Glycine max
  Peptide Sequence Number=SeqID_194047
ccggggggaaattcaggctgaccgcccgagattgcccaaaccatcgcccaccgctgagcgcattggccacaaaaggccattgccgcacctgggcaaaacgggccgccgccgccagatcgcgggccatcccggaaaatggccccagctcgggtgccagcaggatcaggctgtccgcctgctgttcacaaggatagcgggtcaggtagttgagcaacatcccggcgccgctggaatggccaagcaggatgacatcgacatcgcgccaaatacgctcaggccgctcaaccgtcccccgctctcccgtggaatcgccatgcccgcgaatatcgaccaggcacaccgcgagcgttggctcggcggccagctggcgcgcaagaatgtcatacccggcggcgctgttaaccccgccgccgtgataaaccacgatcacgtcttcgctctcggcagtttgtcgatacaggcggtagctcaatccctcaacgcaaccggacaacgtgcccacctgtgcccccggccactcaccgtaagacttcgcttgctcaacatagcggtcaaaatcaatcaaatcgcacctttccatgatgttgtcggtattccccacggcagagttcctgccccggcgataagcatatga

SEQ ID NO: 77270 - DNA, 430 bp, Glycine max
  Peptide Sequence Number=SeqID_194048
atgaggcggatcctgccacccactcttcatactcatgttgttgtctctgaccaatcctcggtccccattgaggaccttaatcacggtgtagttgacatggttctcgaggccaaggaggaggtcgaggttatggaaaccaacatcggcatcaatggcgatgacagagaagtcaacgcgagtgaaggagaggtcgatgttggcatgagtggtggttctgcctacgctacccttgccggaggtgatgacagtgacatggggggtggagccgaaaagctcaggcttgcggttccattggaagatggagaggtgtttggatttgggttttttaagggagaaggtggagagagggcattgggaaggggagaaaaggagagggaggagaagaaaaagaagaagatgaatgatgaagaagaagaagcacaatggtcga

SEQ ID NO: 77271 - DNA, 2730 bp, Glycine max
  Peptide Sequence Number=SeqID_194049
atggcagaaatcgcagtgtcatccgcactagacaaattacttccactaatagcagatgaagcaaatctgctacggggcatctccaaagaattcgcagacataaaaaaagaactagaatacattcaagctttcctcaaggatgcagatagaaaggcagcagcagaaggagacaacacagacgatagaatcaaaatatgggtgaaagagttgagggaagcatctttttccatagaagatgtcatcgatgaatacatgatccttgtggaacaacagcctcgtgatcctggatgtgcaacttcactctgtaaggtcattcactttattaaaacattgatgcctcgtcgtcaaatagcatcaaagattaagcaggccaagtcatcagttcatggaatcaagcaaagaggtgtggattatcacttcctaatccattcttctcttcaactaggaccaagcagatacagaggtagccataataatgtccaatggcatgaccctcgaatgcattcccgttaccttgacgaagctgaagttgttggccttgaagacacaagagatgaattgattggttggttagtggagggaccggcagagcgaactgtcatctctgtggtaggaatgggaggactcggaaaaaccactcttgctggcagagttttcaacaaccagaaggtgatttcacactttgattaccacgcatggatcacggtgtctcaatcctacactgtggaagggttgatgaggaacttgctgaagaacttatgcaaagaaaaaatgggggatcttcttgaaggtatttctgaaatggatcgagattcattgattgatgaagtgagaaaccatttgaaacaaaagaggtacgttgtcatttttgatgatgtatggagtgtagaactttggggtcaaattgaaaatgccatgtttgataataacaatggaagtagaatattagtcacaactaggatggaaggtgttgtaaactcttgtaagaaatctccttctgatcaggtgcataagctggaacctttgactaaacaagaatccatggaactcttttgcaaaatggcatttcgatgtcacaataatggacgttgtccagaagaactcaagaaaatttctacagactttgttgaaaaatgtaagggcttaccattggcaattgtagctattgccagtcttttatctggcaaagaaaagactccatttgaatgggaaaagattaggcgaagcctgagttcagagatggacaaaaatccacatttaattggtatagcaaagattttaggttttagttatgatgatttgccacactacctaaaatcatgcttattgtattttggagtatatcctgagaactatgaagttaaatcgaaaagattatttcgacaatggatagctgaaggatttgtaaaagatgaagaaggaaaaactttagaggacgttgcagaacaatatttaacagagttaattggtacaaatttagtgcaagtctcttcattcaccacagatggcaaagctaagagttgtcgtgttcatgacttaatacatgatatgatccttagaaaattcaaggatttaagtttttgccagcatatcagtaaaaaagatgagtcgatgtcaagtgggatggttaggcgcttgtcaatagaaacaatttccaatgatttaatggggagctctaaaagcttacatgccaggtcattgctcatttttgcagatgaaaatgaagcatggaataccaactttgtgcaaagaattcctacaaaatacaagctactgaaggtatttgattttgaagatggtccatcgcattatatctctattcatgaaaattggggaaatctcgcacacttgaagtatttaaacttaagaaattcaaatatgccaagtctgaaattcattggcaaactccagaacctcgagaccttggacataaggaatacatctatcaagaaattgccaaaggagattcgcaagctaagaaagctacgacatcttttgggtgatgatatgaaattgtttcaattgaagaattgtctcggaggcctgacatccctacaaacgttgcgtcatgtaaagctaactatggagaatgatgatggagtagagttaataagagaattgggaaagctgaagcagttaagaaacttttgcttgactggtgtcagagaagaacagggaagcgctctatgttcctcaataagtgagatgacaaacttggagaaactacgtatcgagtcatacggagttcaagtcattgatttgccttttatttcatctttgcctatgcttcggaagcttagcctatttgggaagctaaaaaagcttccagagtgggttccacaactccaaaatctcgtaaaattatctttggaatactcagagttaaccaatgatccattgaaatcactacaaaatatgccatatttgttgttcctcggcatgtacaaggcttataaaggagaaagtttgtattttgaagatggaggatttcaacaactaagggaactgtctcttggaggattgcgtaacttggaatccatcattatcgataaaggagcactccattctctgaaaaagctcaaattttggggaatacgcaaactcaagaaagtacctcctggcattcaacacttgaaaaaactggaagttcttgatatccgtaatatgccatatgaattcaatgagtgcattgctcccgatgggggaccagagcacccaatcatccagcat

SEQ ID NO: 77272 - DNA, 258 bp, Glycine max
  Peptide Sequence Number=SeqID_194050
atgggcagagaattccttgctatgtttcgcggtggtcacgaagatgaagtaattaggcatcaatgtggggctttatttttgtcgggaatgatttttctgtctcttttggttatatcaatgatcatattttcttgtggggttgacgattcccacaggcatcgacgaaaaagaaatcgtggtctaactggacttggtggtaatgacggtgggggtggttctaatgacagtggaggtggcggtggaggtggtggtggctaa

SEQ ID NO: 77273 - DNA, 1362 bp, Glycine max
  Peptide Sequence Number=SeqID_194051
atgggaagttctgtttcagatgatggagatgaggcctatgaagatgctcgtgacctgctctccaggactgaatcattcttcatgagctgtagtgtccaaccatttggaagtttctcgagtgaccatcaacaaggacgctatttcatgattgataggttcttgcttgcagcgaaggcaatgacatctgaagcatctcaatatgcttccaagaaagcacgtattggacaagaacatcaaaagcagaaaaagaatgaagtgaatacagaaatttcatgtcccattaaccagcttaggccaaaagcttcgccacattacactcacgatatcaaaagggaagaaagtgaagatgaaagtgatggttacagtgaatatgaaaactacacaactacaacttgtggcctatttcctcggttctgtcttttgaatccaatgcctggattaagaatggtggataaggttcaaagacatgcagctcatggaatgcaagctaaatctgctgcttctcacattgcttcttcaaaagagcaaggcagaactccttatgggaaaaatttaatagattcccagtctggctttaaagaagaaaaagagattttggatattcttgtaaaatctaaacatggcattgatccacatcaacgaggttgcattcaacatggttctagttatgaaagccatgtacatgagaaaactctatatgttgattcagtacacaaggttaactctcaaaccaatgacatagggggagattttgagacttttagaagagatagtggcatttataataatccttcaacagattcaagtcttaaagtaattggatgtaagaagataaattcagaaagtcaagtgtatagcagggacaaacactcgactatcctaactcagaattcagaacttgatttgaagagacaactagctgccaaatgggttgatgaagaatgcactttggctagctcaaaggtgagatataatgggaagattgacttagaaagccaatgtcttacaaagttaggccatcaagaaataactggtgcaagctgttttggacttcctattgttcttccttctctaaaagctccatcagagtcttggcttaagcgcactttacctacaatttgcaaaaggaacatgacttcacagtctaaccatactgcaaacatttatgcaagaagtaaaactcccaagacaacatcatcattgcgtcctatgtgggaaacaatggttaaatcttctaatgcatatcatggacatctgcagctccctgaggaaataagaaagcataaagtccttcaatatttcaggatctacaagcacctcccatttcagaggcttgagctttatggagagaagtgcctttga

SEQ ID NO: 77274 - DNA, 189 bp, Glycine max
  Peptide Sequence Number=SeqID_194052
atgtcattgaggcatttcaccgagcacttggtgggcgcatgtttaggcatgaatagcaagggaatgggggcaatatggatactaggctgccacccagcagcgctttccgtttgtctagagctgggcaagggacgacgatctatcggtcgtgactctagcctctacttgtgtccgtccctaagtacctga

SEQ ID NO: 77275 - DNA, 498 bp, Glycine max
  Peptide Sequence Number=SeqID_194053
atggctagggtgtcacacagggtaaggaaattgctcgcagattctcgaattggcaagctcatcatagggacacataaaacatctttcttcctctgcatgctttcttattatatatccaacatagtttatcaatatcatgcatgctctgagagccaacgtggggaccctaatttagaagccaacgtggggaatcagtttgctgacttgatggtcatttctggaattgcagggactgtgtcacagcttcttcttatgcctattttggctcctattttgggcaagacaagactactctcagttggactattcttccattgtgtacatatgttcctttacagcatggcatggtcctccttggattcgatttcacctttatcaatgttggataatgagaatcaaagcgaaatcatcatttcacttgatcatattcatgattatgggcacatgcatgccaagcttggagtcatttgtgacttccagatactgtccatgagataa

SEQ ID NO: 77276 - DNA, 399 bp, Glycine max
  Peptide Sequence Number=SeqID_194054
atggctatccgattgaatgatgctgatgatgagagtgttccaagaaaactttcacagtttggctcagtgatgacaaatggtgctccaattgttggagtgattggtgggagtgcatgcattgtatctctattgtgggctctttttggtcgaatggatgcaaattttgggggcatagcagatagatgggactacttggtgggttatcttggatcagaaaggctggcttatgctttcatatgggatatatgtctttacataattttccagccttggttgattggagacaacctccagaatgtccaagaaaacaagatggacaaggcttcgattattaaggatgttattgattacatccagcacttgcacgagcaagagaagattatccaagttgagagataa

SEQ ID NO: 77277 - DNA, 1446 bp, Glycine max
  Peptide Sequence Number=SeqID_194055
atggaagaagattacggctacagaaggacggcgaagatagcacttgtcgcaatcatggtgctcgcttccgtcgccgtctttgcattgctcgttgtcttcgcttactactgctacatcctcaacaaggtctcgaatcgtcgcaaaagcctcaaaaaaggtcttcagcttacttatatgatgttcaactttttcacttctactcaatgtgggacttcccctcacacttgtattccagcatggattaggctggttccagaccatgtttattgtaaaatggagaatttggttgatgaaagacgggcgtttgtttgtttgatttatgcagcaaccgtgtttgtttgtagtttttactgtttatatgtgctcttttcttgtctaaaatttggtgaagtttgggtgtcaaacaggacatttgaagatgccaaccttaacgagaaaagtgactttgcaaatctgcaagttgttgctgagaaaggacttcaggtgtttactttcaagcagctgcattctgcaacggggggattcagcaagtcaaatgtcattggtcatggtggatttggacttgtttaccggggagtgctcaatgatggtaggaaagttgcaattaaattcatggatcaggcaggaaagcaaggagaagaagaatttaaagtagaggtggaattgctaactcggttgcattctccatatctgctggcattgcttggatactgctctgatagtaatcataaattactggtgtatgaatttatggcaaatggtggactgcaggaacatctttatcctgtcagcaattctattattacgcctgtgaagttggattgggaaacacgattaagaatagcacttgaagctgctaagggtttggaatatcttcatgagcatgtcagccctccagtgattcacagagattttaagagcagcaacatcctcttgggcaagaaatttcatgccaaagtttctgattttggattggcgaagcttggacctgatagagctggtggacatgtttcaactcgggttttgggcacccagggatatgttgcccccgaatatgcactaacagggcatttaacaacaaaatcagatgtgtacagttatggtgttgtacttttggagctgctcactggccgggtgcctgttgatatgaagagacctccaggggaaggtgttcttgtttcttgggctctgccccttttgactgatagagaaaaggttgtaaagattatggatccttcattggagggacaatactctatgaaagaggttgtccaggtggctgcaattgctgcaatgtgtgtgcaaccagaggcagattatcggcctctaatggcagatgttgtgcagtcattggttccactggtgaagactcaaaggtccccctcaaaggtaggcagctgctctagtttcaattcccctaagttgtcccctggcccaacattttaa

SEQ ID NO: 77278 - DNA, 240 bp, Glycine max
  Peptide Sequence Number=SeqID_194056
atggggaaaaaagcgaaacagagcgtggatggaagttgcggagagagaagcggacctgagaaagccatggagaagaagaaggttttggtttggggcgtaggtcgaaggatcaaagtttgggagaagatattgaagatcaaagggcatgaaaaagaaggggcaaaggttatgggtagtggtggcaaaaagagtgaggatgttgaagaacaagatggattggatgaaggggttgttggatag

SEQ ID NO: 77279 - DNA, 504 bp, Glycine max
  Peptide Sequence Number=SeqID_194057
atgccgtattatatacagagactttataggctgtgcaaggcttccttttcaccaaatggacctgtctcagaagaagccgttgcaaaagtttgtgagaagttagataattctatactatgtccagatgtcagaaaactccaagccttctccttatctcctcttttcctctttagggtttgtccttctgaaggagaaaaaatcaagccgtcagatgtaggtcttgaacaggaggcacaagtggttcgtaattggtctggtcaaatgcctgaatgcaacgggaaccatcaacagccaccaccgatcaaatacctgcatttgtatgaagatgacagcttctctataggaattttttgtatgcccccttcatctattattcctctccataatcatcctggaatgacagtcttaagcaagctcttatatggttcagtgtatgttaaatcttatgattggattgatttccctggcccaactgatccatctgaagatttgttggccctttaa

SEQ ID NO: 77280 - DNA, 249 bp, Glycine max
  Peptide Sequence Number=SeqID_194058
atgaaacttcctatgaaagagaaagatgataaacaagaccgtaagcattttgattccactagaacacccaagtcagagaagctatcaagcactgtgagaagtggtgctcccaatagatggctttggtggaaatggtggtgcaaccagaatgtgatttggtggacctttgagaaggtaccgctcaagccagtccaacccaagtatgacttggatcaatcagatttggggatcttgagtgcaagaaaatag

SEQ ID NO: 77281 - DNA, 327 bp, Glycine max
  Peptide Sequence Number=SeqID_194059
atggattttgctttgggcaccagcagatttgctgctacattgtttacaatggttcatcaacaagtggtggttgtgtcggttgttggtttggtcattaatggaagagtttatatgaatgacctaaatgaagatgaaggtggtgtgaatgaagaacatgttgattattctgatgctttcaatatttctcaggtgtttgctacttgtgatgatgttctgagtggtcagtatagggccaagaagaaggattcggtaagaacatgtactggtgttagaaaatatgagtatctctttaagctgcgtgaaaaaccaattatggaaggcaaatga

SEQ ID NO: 77282 - DNA, 822 bp, Glycine max
  Peptide Sequence Number=SeqID_194060
atgggaagacagccttgttgtgataaggttggtttgaagagaggtccatggactattgaggaagatcacaagcttatgaatttcatcctcaataatggtattcactgctggagaacagttcctaagctagcaggcttgctaagatgtggaaagagctgcagattgagatggattaattatctgaggccagacctcaagagaggtggatttactgaaatggaagaggatcaaattatacagctacattcatgtctaggtaacaggtggtctaagattgcttcacattttcctgggaggacagacaatgaaatcaagaaccattggaacacaaaaatcaagaagaggttgaagctcctaggtttggaccctttaaccctgaagccatctgagcaaaaggaaaagtctgttgatgacaaaaaaaatatagaattacaaccaaacacttcaaaagggtctgaacaaggtgtagagaacaagtccttagatatgcatagcacaagagaagtgccaaaaacagaagggaaaatagaagaaaacaaggtgacttgggatgataccactggatttttcaacaattatgaaatgttgtgctcacagttggacttgggatcatggatgagccaagaaaccaaaaccagcactagttcttattgtagttcttctttctcacttgatgattctagcaacctttctgtgggtgaatcctcttaccttcaggaaaattccttacaacaatgggttgatggtttggattccattttgtcatgggatagcttcaatcctcttgagaaagattttctcttcttggataataggcaatga

SEQ ID NO: 77283 - DNA, 159 bp, Glycine max
  Peptide Sequence Number=SeqID_194061
atgggaagtgtaggaggcaatagtgagagtagagcaattacgtcctctcagaatacaacacgatcagaagttgaaaaaaataacaggaagcaactagaaagtgcaagaaacaacttagaggtgcaggaggcaactgcctgtgaaatgatagtgaaatga

SEQ ID NO: 77284 - DNA, 270 bp, Glycine max
  Peptide Sequence Number=SeqID_194062
atgcaatatcgccatagcgaagatcggaaaacaccacatgtccccccatttggtcgtttagctagtaacatccatccaatgctccttgcgacacatcttcttgcttcctccgaaaaccctaacaacataggtgcagacgcaaacacaaagtgtggtccattgacgaagatggtgcagcgtctcacctactgcaagcggcacaactatgccaccaagtccaaccaacacagggtcatcaaaaccttggtaatcaaatccctccctcactga

SEQ ID NO: 77285 - DNA, 759 bp, Glycine max
  Peptide Sequence Number=SeqID_194063
atggcgcgagcactgttagtcggcgcaaccgggctggtggggcgcgagttgttgcagctgttgcaaagcgatccgcagataacggccatcgtggcgccgacgcgcgcgccgctgccgccgcacggcaagctgaccaacccggtcggcgatgcgctgttcgaactgctgagtagcctgcagcagccggtcgatctggtgttctgctgcctgggcaccacccgccgggcggcgggcagcgccgatgccttccgctacgtcgattatcaactggtggtggagagcgcgctgaccggccgccggttgggggcgcagcactgtctggtggtgagcgcgttgggcgccaacgcggattccaccttcctgtataaccgcaccaaaggcgagatggagcaggcgctgcgcgaacagcactggccgcgcctgacgctggtgcggccttccatgctggtgggggatcgccccgcgccgcgcctgatggagcgcctcacgctaccgctgttcaggctgctgcccggcaaatggcgcgccgtttccgccaaagacgtggcgcaaacgctgctgcagcaggcgttcacgccgggcgaaggggctgacgctgaggtggtcgaacgccagctccagcccggcgggcagttcgttgtccagcagccacagatcgagatgatggctgatgctgcaatcgagcaccagcagatccagcgccacgttctgcagatagtcggcggtggccggcggcaggccgacggtgtcggtcagtag

SEQ ID NO: 77286 - DNA, 912 bp, Glycine max
  Peptide Sequence Number=SeqID_194064
atgtccattagtgactttgccaagtcattcataggtcgagcatatgaaatgtcagctcctgtcgcagatggtaatgatgcgctcactggtcacataatctcaaccacaattggaggcaaaaatggtgaacctaaacaaaccatcagttacatggctgaacgtgttgttggcactggatcattcggaattgttttccagatctttaggggactggcgtatatccacactgtaccaggaatttgccatagggatgtgaagcctcaaaatcttttagttgatccactcacacaccaagtcaagctctgtgattttgggagtgcaaaagttctggtggagggtgaatcaaacatttcatacatatgctcacggtactatcgtgccccagaactaatatttggtgcaacagaatacacaacttctgttgatatttggtcagctggttgtgtccttgcagaacttcttctaggccagcctttgttcccaggagaaaatcaggtcgatcaactcgtggaaattatcaagattcttggcactcccacccgagaagaaattcgatgcatgaatcctaattatacagatttcagattcccccatatcaaagctcatccttggcataaggtttttcacaagcgaatgcctcctgaagcaattgaccttgcatcaaggcttctccaatattccccaaaacttcgttacagtgcagtggaagcaatggcacatcctttctttgaggagcttcgcgagcccaatgcccggctacctaatggtcgttcactgcctccccttttcaactttaaaaaggaattagatggagcgccccctgaactgcttcctaagctcatcccagagcacgtcaggcggcaaactggtctcggcttcctgtactcggcagaaacccaaacccaaatgtaa

SEQ ID NO: 77287 - DNA, 270 bp, Glycine max
  Peptide Sequence Number=SeqID_194065
atgggggaagctccattagtgctggccatggagctggttgtcgcagcaccatcgtcgtcacaacatcgacattgcatcgccgatgttgcatcaggtcgcgtagcaacattgtcctcgtggattcgagaagccacagcggttcaccacatcaaggttgagcacggagtcttaagcattagcaacatgtcgcagaagaacgagagcaactctgttgcggaggtctccatggcatgttccatgttgttgcttcgtgcgcgtaggcttttatga

SEQ ID NO: 77288 - DNA, 684 bp, Glycine max
  Peptide Sequence Number=SeqID_194066
atgccttgttcaaatgtattcgtgaacggagtgatgcaattagcaaaccacaagagcttgttgaaggggaactacggccaagttgagtttgggcatgagctagcttctattggagaagcttttgaaggtttcaatgatgcttgccgtgatcgactttatccttcttttttgttggtgagcactggattcaaccccagagtctcatgtgaaggaagtgcttactatagattcaaagctcctgatcagcgttccaacacttcaagtgttttctctgattttccttccccaaattctgtcctcacacctcagaagctgaggccaattctttctgggaaggaagtggaagattttccagaggaagaagaccttgagttcaagaagctaaaagggtttatggatttgggttttgtgttttctgaagaagacaaggattcaagatcggtttctttgataccagggttgcaaaggctaggaaaagaggatgatggaaggaactcagaacaaaacattgatgaaactgtgatttgcagaccttatttgtctgaaacttgggatgttttagaccaaaggaaggttgtgaatccattgttgaatttgagggtaccagttgtaggcaatgagataggcatgaaggacaatcttaggttctgggctcatacagttgcatccattgtaaaacattga

SEQ ID NO: 77289 - DNA, 159 bp, Glycine max
  Peptide Sequence Number=SeqID_194067
atggagaccagtgagatgctcacgggagatgcatcacacgtcgtgtgcatgaacttcatgcgcaagaccctgggagacaagataatgctacatagagaaggggaagatgcaatgaaaggtggtgcaatcttatttgatctctactggttgatgatgtga

SEQ ID NO: 77290 - DNA, 1842 bp, Glycine max
  Peptide Sequence Number=SeqID_194068
gggattcagttgttgtttgatgagatggttggcgattcggctgatggggtttcgttgtttgcggcatgtaatcgggtgattcggtacttggctaaggcggagaagttggaggtgtcgttttgctgctttaagaagatactgaatgctggttgcaaagttgataccgagacgtataattcgctcattactttgtttttgaataagggtttgccttataaggcgtttgagatgtatgagagcatggagaaagccggttgttcgttggatggttccacgtatgaattgatgataccgaacttggcaaagtcagggcgtcttgatgctgctttcaaactcttccaagagatgaaagtgagaggttttcggccgggtttgaacgtgtttgcatcgcttgttgattcaatggggaaggcggggaggttggacagtgcaatgaaagtttacatggagatgcgaggttatgggtacaagcctccccctactatatatgtttctttgattgaatcttatgttaagtctggaaagttagaaactgctctaaggctttgggatgaaatgaggatggcagggttcaggcccaactttggcttgtatactttgatcattgaatcccatgcgaaatcagggaagcttgaaattgctatgtctacatttttagatatggagaaagcgggatttctacccaccccatctacgtatgcttgtctcttggaaatgcatgctgcatctggacaaattgatcctgccatgaaactgtacaattcaatgactaatgcaggtttgaggcctggcctaagtacttatactgtccttttaactcttctggctaataagaagctggttgatgtggctgccaaaattctacttgaaatgaaggccatgggatattctgtggatgtcacagctagtgatattttgatggtttatattaaggaaggttcggttgatctagctttgaggtggctgcgtttcatgggttcatcagggatcagaaccaataattttattatcaggcagttgtttgagtcatgcatgaagagtgggttatttgaatccgccaagcctcttctggaaacatatgttaactctgctgcaaaagttgatttgatactttacacctccattttagctcatcttgttaggtgtcaggaagagaaaaatgagaggcatttgatgtctatccttagtgctacaaagcataaggcacactcttttatgtgtggacttttcacaggcccagaacataggggacagccagtgttaacttttgtccgggaattctttcaaggtattgattatgaattggaggagggagctgctaagtactttgtcaatgttcttctcaattatctagttctaatggggcagataaatcgagctcgatgtgtttggaaggttgcttatgagaataaacttttccctaaggctatagtctttgatcagcatattgcatggtcccttgatgttcgaaacttgtcagttggagcggctcttattgcagtagtgcatactcttcatagattcagaaagcgcatgctatattatggcattgtaccaagacggataaaattggttacaggagcaactctgaagattgtgattgcacagatgttgagctcagtagagtctccatttgaggtgagtaaagtggttcttagggcatcaggagattctgtcatggagtggtttaagaaaccaatcgttcagcagtttcttctgaatgaaattccatctaggtctgatattctgatgcataagctaaacatacttttccccagttctgcacctgaacttagatctctatctcctcctaaacctctcattgcaagcagggcaatgtaa

SEQ ID NO: 77291 - DNA, 1239 bp, Glycine max
  Peptide Sequence Number=SeqID_194069
atggtcgattccctctggtacatcgtggtctacaccggcaccgcgctgtacctgttcgcgcaggccgactggcggctgatggtgccgctgatcctgtggctgctggcctacgtggtgatcatggtctacttcgtgccgcgcgcgaaggagcgggcctggatcgcctcggaagcacgttcgaaggcaatgggccgcatcgtcgatggctacaccaacattcccacgctgaaactgttcgcccatggcgggcgcgagcaggcctacgtggccgagtcgatccaggagctggcagtcaagcaccgcgcgcagacccgggtgaccaccggcatggacctgaccatcgccatcgtcaatggtttcctgattgccggtacctgtggcctggccctgtggctgtggaatggcggccacatcactgtcggcgcgatcacgctcgcgaccggcctggtgatccgcatccacaacatgtccggctggatcatgtggaccatcaacggcatcttcgaggacatcggcacggtgcaggatggcatcaccaccatcgcccagccgctgaccgtgcaggaccgcgaggatgcggtgccgctgcaggtgacccgaggcggcgtgcatttccaggacatccatttccattacggtaaaaagggcggtgtgattgccggcctggacctggtggtgaagccgggcgagaagatcggcctggtcggtccgtccggcgccggcaagtcgaccctggtcaacgtactgctgcgcctgtacgacctggaaagcggccgcatcctgatcgacgatcaggacattgcctacgttacgcaggaaagcctgcgccagcagatcggcgtggttacccaggacacctcgctgctgcatcgctcgatccgcgacaacctgctgtacggtcgcccggatgcgactgatgagcagctgcgtgcagccgtagccaaagcacgtgccgaagccttcatcgatacgctggtggacgggcaggggcgtcgtggctacgacgcacacgtcggcgagcgtggcgtgaagctgtccggtggccagcgccagcgcatcgccattgcccgcgtgctgctgaaggatgcaccgatcctggtgctggacgaagcgacttcggcgctggattcggaagtggaagcagcgatccaggacagcctggaccagttgatgggaggcaagacggtgatcgccatcgcgcaccggctgtcgaccatcgcgcgcatggaccggctggtg

SEQ ID NO: 77292 - DNA, 126 bp, Glycine max
  Peptide Sequence Number=SeqID_194070
atggcgtggacctactgcatgcagggctcagcccgcccgttccacccggttgcgaccgttgcccttggcccggtacagcgccttgtcggcgcgcgccagcatgtcatccacgctatcacctgcctg

SEQ ID NO: 77293 - DNA, 1152 bp, Glycine max
  Peptide Sequence Number=SeqID_194071
atgctgcagaccctggccatcgcccactatcgttcgctgcacgggctggtcctgccgctgcagcagttgaacgtggtgaccggtgacaacggcagtggcaagtccagcctgtaccgcgcgctgcgcctgctggcggagaccgcacagggcggcgttgcggcggtgctggcccgcgaaggggggctgggttcggcgctgtgggccggccccgaatccatcgatcgccgggtcgcggccggcgagatcccgctgcagggtggccctcggcaggcatcggtgggattgaagctcggcttcaccaccgacgaattcggctatgccatcgacctgggctacccgccgcccagccattcggcgtttgcgctggatccgcagatcaaggtggaggcgatctgggccgggccgttcctgcgcagcgccaacctgctggttgatcgccgtggggcaatggtgcggcaacgtcatgcgcgcggctgggatctcgtggatgaccggttgtcgctgttcgacagcctgttcactcaggtcggcgatccgcagcgcatgccggaaaccatcgccttgcgtgagtacatccgtcgctggcgcttctacgaccatttccgcagcgatgccgatgccccggcgcgacaaccggcgatggccacgcgcacgccggtgctgcatcacgacggtcgggatctggcggcagcctgggtgaccattctcgaaatcggagatccggtcgcgttggcacgcagcgtcgacgatgcgttccccggcgccacggtcggcttcgaagagctggacgccggagaccagcctgcatccggacctgctgccggcgctggcgcggctgatcatcgcggccagtgcgcgcagccaggtgtgggtggtgtcacacgccagccggttgatcgcagcactggagcaagcgcccggctgtcattcgctgcacctgcacaaggaacagggccgcacgctgctgagcgggcagggcctgctggatgcgccggcatggcactggccgcagcgttgatacggccatccacgccctgcgtggacgcgctcaatcggcgatgttgcgtgcctcggccgtgccaaggatttccggatgctgcaccggcttgcggcggttcagcagcggatgcaggaacaccgcgccgacgatga

SEQ ID NO: 77294 - DNA, 333 bp, Glycine max
  Peptide Sequence Number=SeqID_194072
atgcctctggagcttgaaatgttagctacacttagaggttgcgctaagcgcacaactgtgctaatcgcttttgtcgtgatttctaagaaaacagaggaactgccttgggcagttacagaactaattttctcaaaaactctgtacctttaccctcctttgcttcattgttttatgctcaagtgctttgacattgcatccttttcttcctcatactctgcattacacatccaatttagaagcccattaggggcaatgtggttgaaaggggtgaaaacccctgtgtgtgtttctggaaactgtgatgaacgcgctaagcatgcctactacgcatag

SEQ ID NO: 77295 - DNA, 315 bp, Glycine max
  Peptide Sequence Number=SeqID_194073
atgacattaccgttgatcctgttgaccttgattccatgcaaggtatggatcatccaagtgccgcctccaaagacccttgaagtcgagcctctcgctcggtgtttcactttcagcgtgggctgcgacggtgccgttttgagggagggggtggaaaaggtgaggatagcgtggaacatggtgttaagagggtggaaaggggttttcatgatgatggagcgcatagggaaggtgggttcgcgcctaacaacaagtggtggttctcacaggagttgccagtgccagggtgttgctttggtgtggtggtggcagatttga

SEQ ID NO: 77296 - DNA, 597 bp, Glycine max
  Peptide Sequence Number=SeqID_194074
atggatagttccaaattgccctctatgcattactataatgttgtgcttgtttacattggggtttctcttcttcatggttgtggagtacatgctattgatggtgttgtcaaagtcaccatccttcgacttgggcttccccgccacacgctcctcgagccatcgccgcacctcaagacactcttggtcgcactcaatatgttttcttcaagaagtagatttgcgaatttgtggtcgcatgcttcgatgaatgttgagcatggtgtagccactgtcgaagagggcgagaataggtatgccaacaagctggttggtgaaagttatgaactagatgtggcttccatttcttctttgccatctagaatgtacaaaataggtttgttgaggagaattgtgattccattgtgttgccaagaaatggaaaataacttctacacaagggagggattcatgaggcaaggagagaagacaaggaaagaggaaaagaaggaaggaagaaaaggaaagaggaaagaaagaaaaaaggaagaaaaggtgggtgggtgccaatattggaggaaaggaagaaagggtatttggatgttttgcatgtgctggtag

SEQ ID NO: 77297 - DNA, 387 bp, Glycine max
  Peptide Sequence Number=SeqID_194075
atgtttgcacattcgattaaaggctgccgtcccttgggacgggcgtgtggggtgctaataccttccccatctcgtcttttccggtttttccgacgttttcctcaaataaacgttggtggcgactccgcgcgtattcctttcgtggaacacgcttcccgcgagtcacgcgtcgccctcccgccgaaggagtccaaagaaggtcaacttggttgctgctctggttcgtggtacctgcttgttaaagatgcatcgatgcagttggaattgacaataaaacgagcagcaaaaactgtatatcaggtagtaacactaggtattttcattgtcacctcattggacaagcttgcaaaatctataattttaattgctttcaaagttcctctgtga

SEQ ID NO: 77298 - DNA, 264 bp, Glycine max
  Peptide Sequence Number=SeqID_194076
atgagtgaaatagaggatgtgcaagagcatatgaatgccgacatagaggtcgtgaaagaccgaatggctgccatgatggaagccatgttgagcatgaagaagataatgaaggtcaacacgactgcagttgccactaccaacgctgccactaaggtagacccaactcacctatcaggcctcaatcaagtaaatcctccagtctcaaatatagtagggcagggaggcgaagcattaggaagtacgggaggcacctattttgtgcaa

SEQ ID NO: 77299 - DNA, 396 bp, Glycine max
  Peptide Sequence Number=SeqID_194077
gggtatttaggtatccggtctagtcgaatgcctgaatacttgaaaaaatcaaaagattgtcacattggagtctctaaacctagagtgttcgggtatttaactaggctgaatacctacgacctagtaccctctaggccacgacccaggactccttcggtggacgagccttgtccttttttggagccaacaagcaataacccaccaagtcaaattagaaggaaaatacaaaaggagattccaaaacggaaccaattagaagatcctgtgaaggttcttctcatcaagggtgaaaaggttcattgcattgtcccagatgcgattgagggaaccatggatgcgacaaaggagcggcatgtcgaggtgtccgacgtgtcttcaacacagacatgggtctga

SEQ ID NO: 77300 - DNA, 384 bp, Glycine max
  Peptide Sequence Number=SeqID_194078
atgcctgatggatgggaaacaatatcaaaaaatcaagaaggaaatgtgtgggagatgtcccagagagaagaagatatacttctccaggaatttgaacgacgtattgcctatagcaaatttcagattgctagttttatcaagactcatatatttagccggaggaggccaattgatgggtggaaatatatgattgagttggtgggaccaaatgctaagagagggaagggtagtgtttctagagtaccaagtctatccgatccctctacccaaccatttaaggaggagaaaaattcagttgataagacttatgtaccccgtgagagaagaggtcgtttgattcaaaaaccctgcatgaaggataaagcaagtgacaatatgacctag

SEQ ID NO: 77301 - DNA, 1470 bp, Glycine max
  Peptide Sequence Number=SeqID_194079
atgatcgagctgttcctgtcggaaccgaattggaacgacgtcgtaaacgacgacgattcaactcgttcgagaatctccattctcaacgacttggaaaccgttatttggtctacggtgggtcgctccgaggcgcggttgtggctctgcaacactgtcgcgggattgaactgcgtaacttccctcgatcagcgtgacctgtttcggaatttgctcagaaccagtggggtgaagcgggatttggcctctcagctcctgcatttgatgttcgacacggcgccgcacaaaccaggttccgttttggcgaggaggagtcacgtgctcaataaattttttcaaggtaatcctaagcgtgtattgcagtggttttcctgctcttcctctggaggtggactagagcaggggaaaggtttcagggcactgtcccaatttgcgtttaaaaatagggatatttgttgggaggagctggagtggaaaggaaagcatggacagtcaccagcagtggttgctacaaagccccactattttcttgatttggacgtcctgcaaactgtggaaaattttctcgaaaatgtgcctgaattttggtcatctgaagagtttgctgagtcagtcaaggatggcgatatttttttcgttgataggtcattctttgtgcgttatttcattaatttaatgtataaagaggaattcagagatgtatgggatgttgtaaacgaattcctcatgcagcaggccttttcctctttgtgtgggcgtcttcttattactcttgaagaccaggacttatgccactttgtggaatcgctttgtaaatctctcggcccaaaattggaacttaaacatttcaatgatgtctctaatttgtttgtgattgtactttttaagtgtggttcttatggatctattgaccagttactgctgtttaatgctgtgatgactcaggggaggcagcttcttcgccttttacgtgatgaagaggcttgggagacacaagaaaaaatcaatgaaattgtgtcaaagatgtctgcaatcccaaacaatcctaatagcttgaccccaatcttcaagagcaaatataagatgaaaattatagaagtgataaagtatttgggacttctgtcatggcttctttactatagactgtcaaaagaatgccagacccctgagtcctgggagtctgtatttatgaataatcaaattggtttccgtaactctaataaacatgcattgtcagatgaggatggtccatcagaagaagattgttcagttagagtaaaaggtaggagaaaaaaaaaggctagaaagaagaggaggacctatgaccgccatgatgatggtgatgacgagctactagattatgattctgcaagccagaagttggtttttccgtcaaatactagaagttggttgctttcaactgatgggtactcttcagcttggagcagtgtaagttccatatctttgaattaa

SEQ ID NO: 77302 - DNA, 1212 bp, Glycine max
  Peptide Sequence Number=SeqID_194080
atggagaaaacaaggtcctcagaccaagttgttgtcttcctcgaccagcataaccctaaaccaccctccatggaatccgaaaaccatcaggacaaacccaaacatcccttaaaagtcagagctcttaaccgtctcagcttctcaaaacccaaatcccgaatcctagaatacaactataatgtcccccgcaacaaagttgctgaagagagtgacattattcaacccacctataagttctcttccaacgatgacgatgacgatgacgacgataacgatttggatttggaatgggatgaggatgagaccgaggaggatggctcggagcatggcccaaagttgcaccaaaagaggaagttcaaaatcaagtggaggctcatgatggagtggattttgttcctcaacatattggcatgcttggtgtgttctttgaccatatcttccataacgaacatgcaccttttgggattggagatttggaggtggtgtgtgatggcaatggtcacgttcagtggccgtttggtttctgggtgggtggtaggtctaacggtgttcatcctggagcgaaacttcatgctccgagagaaggtgctgtacttcatctacggactccgaaacagcataagaaactgcatgtggctaggcctggtgctactctcctactggagcatggtgttcaacgacgtccaaaagaagaaccacaagttcctcaacaaggtcttccaagccctagtagcagtgttagtgggcgctaccatctggctcgtgaagatcgtgctggtgaagatgctcgcgtcctcgttccacgtcaccacctacttcgaccgaatgaaggagagcgtcttccatcactacattctcgagaccctctcgggtcctccgatggaagacgccgaggaggtgctgcggcagcaccacctcgcgggatcgaagtcgatgcccgcgaggtggaatgccaagaacttgtacaagtccaagaggttcggatcgaggaagattgatatggagaagctgaggaagctgagcatggagagcaccgctacagcgtggagcgtgaagaggcttgttaactatgttaggtcttccggcttgtccactatttcgaggactgtggatgattttggcaacgcggagtctgagattagtagtgagtgggaggctaggaactgtgctcagaggattttcaagaacgttgccaaacctggtgccaagtaa

SEQ ID NO: 77303 - DNA, 771 bp, Glycine max
  Peptide Sequence Number=SeqID_194081
atgattcgagcttattatgaacgaaaagctctagcacaatcactgaatgataccaaaacagcagtgcaacagcttcacaaaatagcaagcgcagttgttagtgtgataataatcattgtgatgcttttgctgatggagatggcaacgatcaagataatattattctgtattacacagtttgttttgataggtgttgccttccaaggtacttgcaagactgtgttggaggccatcatctttgtcttcgtcatgcacccttttgatattggagaccgctgcgttattgatggagttcatatgattgtggaagagatgaatatcttgacaacagtatttcttcgatatgacaatgagaaaatatattaccctaatgcagttttactctctaagcctataagcaatttctataggagcccagagatgtgggattcaattgatttcaccattgatgtttcaacttctatggagaccatccttgcactcaagaaatcaatacaaatgtacattgagagcaagccaaagtattggaatccaaaacacagcatgatagcaaaaggaattgagaatatggacaagctaaagctgtgcttatctgtgcaacataccatcaaccatcagaactacggtgagcgaaacattaggataacggaacttctcttggaattgaagaggatctttgagatccatggtgtcaagtaccatcttcttcctcaggagatccagattacccatatgaatattgaacatagcaaagttctgtttcaatcatga

SEQ ID NO: 77304 - DNA, 162 bp, Glycine max
  Peptide Sequence Number=SeqID_194082
atgtgtcacacggctcgtgagttgtatatgacatgtttctctgtgcacccattgttcttgtctcaaagcacacaaccatggctgctctctccaacggccacgacgcttccttcttcaagatgccctccatcaattagttatgcgcctctcttctctccttaa

SEQ ID NO: 77305 - DNA, 165 bp, Glycine max
  Peptide Sequence Number=SeqID_194083
atggtcatcatatgtcctaaggacaatgttgtcatctggttttgttccttgcacaataggtcagacaacaacctgaaaggaattattaacagtgctttgaaaggatttgacgatagtcaacattgtaaatccaaggctgctgctagatggattgttgttaaataa

SEQ ID NO: 77306 - DNA, 1224 bp, Glycine max
  Peptide Sequence Number=SeqID_194084
atgggtactttacagtgcttttcggttgaaggagatgaaaaaccaagaaagttatccaaactttcagatgatcctcaggaggaggaggagggtatgcagattgatatggtttctcttttcccttcccagcaccaaagcaatgatcaaaaccatgcacccatggcaattgaggagcgtgatccaagatggcttattaaccaggatgtctcaatcggtgttgtcctacgcttgtcaaggtctgagtatggttcaattgtctcactgaaccagagtttccggtccctgattcagaccggagaactctatcggctcagaaggaaaatgggaattgtagaatactgggtttacttctctttcaatcttcttgaatgggaggtgtttgatccaatgaatggctattggatgaaattgcctagaatgccttccaatcagtatgactgcttcacgttttcggataaggagtctttggctgttggcacagaacttcttgtgtttggaaaggcaatagaggctcctgttgtttatggatacagcctcttgacccacacttggtcacatggtactcagatgagtgttcctagatgcttgtttgcatctgcgagccgcggagaaatagccatagtggctggtgggtgtaatccactaggcaagatcctgagtgtggctgagatgtataactcagacaccaagacatgggaggctctcccaaacatgaacaaagcaaggaagatgagtgctggtgtgttcatggatgggaaattttatgcccttggtggaatgggagaagatggtaataagctgacatgtggtgaggagtatgatttggagacaaaggaatggcgtgtgatccctaacatgctccctccgcgaacaagcgaaagacaagacactactgaggcaccacctttggttgcagttgtgaacaatgtgttgtacgctgcagattatgctcagagggtgctgaggcggtatgagaaagagaggaacaaatgggtctacattggaagtcttcctgagataacatcctctatgaatggttggggattagcatttcgagcatgtggagatcgaatagttgttattgctggggaaagtgctcatggtggaagggtggttgaaattaattcttggatcccagatggaggtgcaccactgtggaacttgcttgccagaaggcacattggtgggagctttgtgtataattgcgcagtgatgggatgctga

SEQ ID NO: 77307 - DNA, 509 bp, Glycine max
  Peptide Sequence Number=SeqID_194085
atgaagatgtgtgctggtttctctgtctccctgaccacgcttcgcatagttaggacggggaatgttgcctttgaggcggttgttggagaaatcaatgtgagtgaggttggagtggaggtggtcggggagggatccagtgaggttggagttggagatggtgagggttttgagcttggtcatgcgggcgaggatgacgaaggggccggaggccttgacgttgacatcgaagacgacgaggtcggtgaggttctggaggttggagagccagacaccggagagtttgcggaggctattgacgcaggtgaaggaggtgagggagagggcgaggtcggcggggaggcggatgggggcaacagggcagttgaggagggagaggaattggagggtggagagggacttgagggcggtgaaggagagggagaggtaagaggagcagttggccaggcggagggagatgaggtggcggaagggcttgtcgctgtcgcagagggtggcattatggaaggagg

SEQ ID NO: 77308 - DNA, 1293 bp, Glycine max
  Peptide Sequence Number=SeqID_194086
atggaggaagaagggagcgccaggaggatccaggtgcgtttcgtgaccaagttgagtgagccttacaaaattccgaccaccgccattgccatccccgccgacctcaccagattcggcctctcctctctcgtcaacgccctccttgaatccaacgacgcgccggaaccgtttgattttttgattgatggcgagttcattcgaatgtcgcttgagcagtttcttctcgctaagggaatctctgcggaaaggatattggaagttgagtacacaagggctgtggccccacgaaaggaggaagacccttctttacatgatgattgggtcagtgctgttgatggttcttcttctcggttctttttgacgggatgttatgatggtttagggagggtgtggaaaggtgctggattatgtacccatatattggatggacatagtgacgcagtcacttctgttagtatcatcaatccaaaaggtgattcaggtgcggaaactgttacagtagctactgcttcgaaagaccggacattgaggctatggaagctcaatacagaggaccctgtaaaccatcctatgagggttagggcttacaaaatcttgcgtggtcacaagtcttctgtacaaagtgttgcagtgcagacttctggagaaatggtttgttcaggttcttgggattgcaccatcaatctatggcaaacaaatgacttcaatgcagaagatgaccaagtgtccaagaagagaaaagttggaggtcaagttgaggagtctcaactagagggagaggcttttactacccttgtgggccatacacagtgtgtatcttctgtggtttggccacaacgggagttaatctattctgcatcatgggatcattctattaggaagtgggatgttgagataggaaaaaacttgactgatatattctgtgggaaggttctcaactgccttgatattggtggggaaggttctgctctgatagctgctggtggttctgaccctgtccttaggatctgggatcctcgtaagccaggcacttctgctcctgtttttcagtttgcttctcatacttcttgggtttcagcttgcaaatggcatgatcagtcttggtttcatttactttctgcatcctatgatgggaaagttatgttgtgggatctgagaactgcgtggcctctttcagtcattgaatcccacagtgataaggtattgtctgctgactggtggaaaagtgacagtgttatcagtggtggagcagactcgaaactttgcatttcgtcagagatccctgtacagtga

SEQ ID NO: 77309 - DNA, 735 bp, Glycine max
  Peptide Sequence Number=SeqID_194087
atgggcctagtgaaaagcccggccttcccagaactaggtttttgggatctcttaaaagggagaaagaagcatgtgttgaagttcagctgcgaaaacctagtgcaccgtaagggttgtgaagcaggcagagaagagccatggtgcacgtttctttctaccgaaactgtaaatgggaaaacgttcaagaagcctcgtcgtccctacgagaaggagcgtttggacgccgagttgaagctggtcggtgagtacgggcttcgctgcaagagggagttatggagggtccagtacgccctgagccgcatccgtaacaacgccagaaacctattgacccttgatgagaagaaccctcgccgtatcttcgagggtgaagcccttctccgaagaatgttccgttacggactcctcgacgagacacagaacaagctggattatgtgttggctctcaccgtcgagaactttctcgaacgccgcctccaaaccctcgtcttcaagtctggcatggccaagtccatccaccacgccagagtcctcatcaggcagaggcacatcagggttgggagacaggtggtgaacatcccatcgttcatggttagggttgattcgcagaagcacattgacttctcactgaccagtcctcttggtggtggtcgtccaggacgcgtgaagcgaaagaaccaaagggctgctgctaagaaggctgctggtggagacggagatgaggaggatgaagattaa

SEQ ID NO: 77310 - DNA, 669 bp, Glycine max
  Peptide Sequence Number=SeqID_194088
atgggatcagagagtgtggctccaatggttgagacctcgaaaaacaggtcttcttctggtaaaatgaaccaagggaaagtccccaggaaaattcacaaggctgaaagggagaaaatgaagcgtgagcatttgaatgaacgctttgttgatcttgccagtgcacttgatctaaatgagaacaatggaaaggcttctatactgtgtgaaactgccaggttgctgaaagacttgctcagtcagatcgagtccctcaagaaagagaatgtcactctgttgtctgaatctcattatatgaccatggagaaaaatgagctgaaggaggagaattgtagcctagaaactcaaattgagaaacttcaaggtgagatacaggcaagactggctcaatctaaacctgacctgaatgtacctccccatgagccaccggagcagacaaattttccaggacagaatctccaattgcataccatagaacctaacttgcagcaaggatctacggttttggttgtcccctttcatcccaatcttcaagcttcttttccagctcctaatgttaccgaggtcacaccgaaatctatgtctgtagtcagtaaaccacatgctaggtatcccacaccggcagattcatggccatcacaactgcttggagagcaaccaacttcaagctaa

SEQ ID NO: 77311 - DNA, 762 bp, Glycine max
  Peptide Sequence Number=SeqID_194089
atgaagattctagtaagaacatttgacgcccatcgtggggccgaagcgaaatttcctttggtcacaagagtatatggtagcaacctagagttcgatgttaaggtcaactaccatggagaaagttcggtgatgcaacaattcagagagcaatttaaggctcttcaaatgaaaaacatagaggagatgggtctttccaagttccttgaagggacccacactaacatggtggcatcaacttcctcctcagaggttgacttttttgacacacttgttgaatattttgtcagaattcaagatcttgaactcagagtagcccttcattccatgataacaacacccaagtcaggggcgcttgcagaaagtttgtgtaaaaagaggtcagccaacatggataagttgagacaccgtgtggttggctttatccagatagaggagttgtctgagttctgtgataaagaggtattcaatgcagaaaccaggccgaccgcaccaaacaatgcaaatagcatcggaactatggtcatttatattgaagaatgcatagttttgaaggataaaattgaagagttggctcataaaggatgtttaaatgattttgttagaggaaacaactataaccctgacggttgtagaagtggagacaaaggtggtcgtagaggcagtttcaaaggtggatatgttagaggttggggcaacaataaccaacaatctacaagacaaagtgaacaaaggcaacatgaaaatcccctaggtgcagtctga

SEQ ID NO: 77312 - DNA, 402 bp, Glycine max
  Peptide Sequence Number=SeqID_194090
atggatggagaagtatctcaaaactcattgttagctagttgggtatgggaggatgcaacttcgtttggctctgcaaatcttcaggataatgaatgttggtcgatgatagtggcgttcaaaggtggagggtatagggatgaaggattgttggtgtcgaaaatgatggggaaggaacctctagatgattgcaaaaaaggtggtatggaggttacaactcaagaaaagagtgcaactgatttttcagacattggggcaccaaaaagggactttgcgtgtgagatagaggaggagataaggggtgttactctatgtctcaaatcaactggaattccagaagctttacttaacaaagtggtagacaacaactattttgatttgactcagcccaatatgaccttatga

SEQ ID NO: 77313 - DNA, 588 bp, Glycine max
  Peptide Sequence Number=SeqID_194091
atgagagtgaaagtgacgagtttatggagggttgaatgtaaggtatttggttcaaagtttgaatgtgtttggatggaaaatgaagatgataacaatggtgttcaagtaggattaaagaatgaagcccttgccataggtcctccaagtccttctaaaggttccttgcccttattccttgccttgtcctcatcaggatgcaatatgacaaggggttcttatgcacaagtggtgaaggagaatgacaatcatgttaaaaaggtgtggcaaaagaaaaggtcaaaggaaacaggaaaaatcatggacggggagacaattccaagcggaagagacaaacacaagatggttgcacaagtgaatgattggaagattttattgtggagggacattcaattatcactaaggtacttgggggataatgtgggttttctatcaggaaagcaagaagataatctaatggacatatttgaaggggaggaggactggttaaccacttgtttgtatcagttacaccatggttcaccacagagtcttatggaagcaagttggtgtggttgtgttgctttggtttcccttacagttgtggagtga

SEQ ID NO: 77314 - DNA, 975 bp, Glycine max
  Peptide Sequence Number=SeqID_194092
atgagctgtacagaagcactgagcgagtgtcaactcgctaagcgcatgcctgcatcttccaggctgagcgagaagactggcgctaagccaaaagccacttataggtggaggagacattcccactacttgtacttctttagtctttcattttctcttttcattgttgtaaaagaagcttccctgctatggagagctaaatcctcagttggttcttcctatggggtacttgatttttccataaggatgaatattaaggcaattcttcaatttccttattccagtgacattgaaggctttttagagagcattatgaaaggttttaaccttaggaagataaaggcttcaatggccaaatctcaaaatatgagcttacgactagtgctcaccgatctagtgaagcctaagaagagaaaaagagttgctaaggagatcgatcaatttggtgacaaaaccgatcaacctcaatctaaaactatgaaggttgtagtgaatgagcatatttctcctaaaaaagaaaaagaagtttataagaaggagaatctaggaactattgatgaggagaagcctactactgagaataaggatgttaatgtgacacaatcatgtcccttatgcaaggttgatcatgtgactgttactcgtgatcttccctcgttaaggaatgctgacatcaaagggtccgagttcattactaatgataagctacttataaagataaagtccaaggctagtttggaggaaaataggaaattggccaattctctcagtgagaaaaactcattaatgatcaagaaaattgagatcattgatggtattcagcaggaaattgctgatcatgagaagatggtttccatgaaaactgttgaaaatgaaaagcttgttaaggccattgaaagtcttaacaagaattttaacactgcaatcatggaattggcaaagactaagaatgttgttaaggcattgaacaatcaatga

SEQ ID NO: 77315 - DNA, 759 bp, Glycine max
  Peptide Sequence Number=SeqID_194093
atgcagaaagaacaggacaaagagtatttagattcgttgacgtgtccaagcttcaactgctactcgaccgatcaactcgctggtatcgctcaaaacagaactcaaaacgacgaccccgatttcgagttcgccgcttttcgagacgaagccttctccggcgacgacgccatttttcctctcttcaacagcgaagttgcgagggaccgccggaacagagtctccggcggccgcgattccggcgcggcggtgctccggtttccaatcaccggcgaggagcttcgccggagcgagcacgatccgctaccggcgccgtcctcggagtcgtcgtcggaggcggatgaattggagagggttccggcggggacgtactgcgtttggagaccgaattcgccgcaggcttcaccaggaaagtgcaagaagagcaattcgacaggatcgtcgtcgtcgaagaagtggaagcttctggatttgctttaccggagcaacagcgaggggaaggagtcgttcgtgtttctgacgccggcgccggcgccggagaagaaaagggcaaaccagcggtggagcattgaagtcgccgaaaaatcgaaggggaaaggtttctccggcaagaagaaggcgccggtgtcggtgcacgaggctttgtatcttaggaacagagaattgagaatggttgataagaaaaagtcgtttttgccctataagcctggcttggttgggttctgcaccagtcgtttgggcaaggcatttccttcattctga

SEQ ID NO: 77316 - DNA, 219 bp, Glycine max
  Peptide Sequence Number=SeqID_194094
atggcgttaacaccagaggagatttcgagacctttcatcaagttctggaattcttcctcattagaaagaggaagagaagaagtaaattcaaagaatgattatgactcttcccttatgtccaatatctctttctctagtatggatttttggcagacaactgaagatccatccctattagaaccagaagaagacatcttaagagtaaaagagaatgaatga

SEQ ID NO: 77317 - DNA, 285 bp, Glycine max
  Peptide Sequence Number=SeqID_194095
atgggtgaatcaccttactccctacaagttactgagaagcaacaccactgtcttgaacaacgccgtcagcttgtaagaaacgaatcagatgcttatcttccaaatgttcctgccaaatgttacagagcaattttcacaaaacgcaagcatgtaagtaactgtgtaatgacccttcatgaatttctcggcgtaccaccttcgaaaatggaattagggtttaagggaaaacagatgacgaagaagaagaaaatggggaaaagaatgtttaggaaggagacctgttga

SEQ ID NO: 77318 - DNA, 1636 bp, Glycine max
  Peptide Sequence Number=SeqID_194096
gattttgatggaggagatgtcaaccacggttacagtgccattgagagtaggtaattcagtgtgtgataagccaaccatagctacccacatggatgtatcaagaattaaactgatgtcagatgctgggttgttatccaattctataactaaggtttccaatgagacttttataggttcagatgaggatcatgatggtggtcgtcatgaggatgaagttggtattacagcggtcacagctccagaacagcaaagagaaggagaaattccgatgtcggatacaatatcccaaaatataagctctctggttgttggtgatgaagttttaaccccagaaattgaggaggatgatttgatatcactggaaggtgatccaattattgatagctcttcactttcagtagccagtgagaatagtagtttttgtggagatgagttcatcagttctgaggtttcttcagatttagggacaacaagttccatagagatagggaagagtgtctccactgtcaaaattgctgccagggctactgatttgggtgcgtcaaatgtagaggttgatgtagcagtgagccttgaagagacaggggttagatctggccaaacgcctactacaggtgtttttcatcaactaactctggaaagatctgtgagtggaacagctggtagaagtgtttttgaattagattgtaccccgctatggggatttacttctgtgtgtggaaaaagacctgagatggaagacgcagttgcaactgtacctcgatttttgaaaattcctattgaaatgctaactggtgatagattacctgatggaataaacaaatgtttcagtcagcagataatacatttctttggagtctatgatgggcatggtggctctcaggtggcaaaatattgccgggagcgcatgcatttggccttggctgaggaaatagaatctgtcaaggaaggtctattagttgaaaataccaaggttgattgtcgagatctgtggaaaaaagctttcaccaattgttttttgaaggttgattctgaagttggggggggagttaattgtgagcctgttgccccagaaactgttggatccacttctgttgttgctattatctgttcatctcatatcatagtttcaaactgtggtgattcaagagcggttctatgtcgtgccaaagaacccatggcactatctgttgatcataaaccaaatcgagatgatgaatatgcaagaattgaggctgctggaggcaaggtgatacaatggaatggccaccgagtatttggtgttctagcaatgtcaaggtctattgctaatcctgatgacatgtaccgagcaattcaaatgaatagtgtgtttagctatccgattgacctgattgcaagtgataggtatttgaaaccatggattattccggaccccgaggtgacgtttcttcctcgtgcaaaagatgatgagtgcctcattctggccagtgatggcctgtgggatgtcatgaccaacgaagagggaattgatcctgctgctcaagcagctgcagactacctatcgaaccgtgctcttcagaaaggaagcaaagacaacatcactgtaattgtggtggatttgaaagctcaaaggaaatttaagagcaagacatga

SEQ ID NO: 77319 - DNA, 703 bp, Glycine max
  Peptide Sequence Number=SeqID_194097
cgtgggtggtgagaaggaaaaagcgcgtaaaagtaaaagagggaaagcaagagggtacaagggcgatgacgaatacgattacctcttcaagctggttctcatcggcgattccggtgtcggcaagtccaacctgctttcgcgcttcacgaggaacgagttcaatttggagtccaagtccaccataggggttgagttcgccaccaagagcttggacatcgatgctaaggtcatcaaggctcagatttgggacaccgctggccaggaaaggtaccgtgccattactagtgcttactaccgaggagctgttggtgccttacttgtctatgatgtcacacgccgtgctacatttgagaatgctgcaaggtggttgaaagagttgagagatcacacagaccccaacattgtggtcatgcttattggaaataagtcggatcttcgacaccttgttgctgtcccaacagaagatggaaaatcttttgcagagaaggaatctctctacttcatggagacttctgctttagaagcaacaaatgttgaaaatgcatttactgaggttctttctcagatataccgcatagtgagcaagagagcagttgaggccggcaacaatgccagttcttctgctgtcccgtccaaaggacagacaataaatgtgaaagacgattcctcagttttgaagaaaattggatgctgctcaaactag

SEQ ID NO: 77320 - DNA, 225 bp, Glycine max
  Peptide Sequence Number=SeqID_194098
atggtgttaagagggtggaaaggggttttcatgatgatggagcgcatagggaaggtgggttcgcgcctaacaacaagtggtggttctcacaggagttgccagtgccagggtgttgctttgaatgattggaatgttatgaaacaagggtgggatgctcaagttcttggtgaagcctcttataagtttacaaatgctcttgaagctgtcaggaagctgatggcataa

SEQ ID NO: 77321 - DNA, 360 bp, Glycine max
  Peptide Sequence Number=SeqID_194099
atggctggttgtcgcaacgtgcccttcgcaggcgagcgagggcgaggctcacgggtgtgctttccaaaggaggaaagatgcgcggagtcgccaccaacgtttatttgtggaaaacgtcggaaaaaccgaaggaaaccggtcaaaatgaaaattctaagttcgggagttgtatttacgcttgaggaaggtattaacacctctcacgtcgacaaaagcggggcttttgctcctacggaccctcctttggagaggaaatcagacctacgtagttctttcttaggcgtgaatcaagcgattcttttttacttgaaaggtgatcattttaaggcgttggaccttaaaaatgatccattttacttg

SEQ ID NO: 77322 - DNA, 591 bp, Glycine max
  Peptide Sequence Number=SeqID_194100
atggacgtttgccaggggctaaatccctgggaaaaacgcccatcgcaaatcagtttgccagggatttcacccctggcaaaaaaacgaggggctggccctggcaaaatccctgtcaaaatccctgtcttagcccctgtcttctcactgacgcatctgcacacttttctgacgcgctgctgtactgacacaagggctgcaagccatttccgaggggtaacacccctgtcacgtctgggccgcacagctttttgcagtgcatggtcatgtcgtgttgacttatgggaagattccgtcagctttacagaaaacgagggcatacccgatgattttaaacctgtgctacgtgagcttttggcaactcatccagggctggagttcctgcagagcacacctgagcttcaagagagatatggtttgtcttccatcttggatttcttgtcatttgctactaagggaatcaataatcaaattgagcaagctatcctcagggctgataaaattggggttaaagtcatcagccttgctccattgcttaaggaaaaatgcttggatgtttttctggaaaatgctctggaagcatcagatccatag

SEQ ID NO: 77323 - DNA, 249 bp, Glycine max
  Peptide Sequence Number=SeqID_194101
atgtggtgcgaagagtggagcgaaaaccaccacgaagggtggcgcgctgccgatggcaccactggtgcaaggtccaacggcatgaggccaccacaagggcaacgacagtacggagatagaaaaaagaaaaagaaaaggaaaaaaacgaaagggaaaacgggatctaatgccacaggcaaagggcccaagggagaatggtggcagcggcaaagacaaaggaactgcctcgccggaattggcaaaagatag

SEQ ID NO: 77324 - DNA, 315 bp, Glycine max
  Peptide Sequence Number=SeqID_194102
atgtcgacaaaggcactcacaaataacatggccatcatcttctacatggctctgattttgtcaggcattacctggatcgcatgtatgaaggaagacacacactactccaacacttacctcctccatcctcggcaacttcttcaagagtcatcatcagttgcagatccaaagatacctattataccgattattggtatagctatcatagggggtatcattgtgctggctattgtgtattacttagtacgtaggttttgttttccaccatcctcttctaatccttcccagccgaattcccctccaccaagtccatga

SEQ ID NO: 77325 - DNA, 222 bp, Glycine max
  Peptide Sequence Number=SeqID_194103
atgttgcgggacatccaaaatgtttttaaagaacctcggagtggtttggccgggcttgcaaagaaactactgggagctattttaaacaagacaagacgcaacaacaattgggagcaacgacctttaactccaaatcaagtgtcctgcaccgaaaatgccaagaaattcaagaaatgtgtaccaaaggttgtagacactgacatggagaccagcaagcattga

SEQ ID NO: 77326 - DNA, 474 bp, Glycine max
  Peptide Sequence Number=SeqID_194104
atgagtaccataagcaaagcttcttcttccaagaatatgaccagtgagtgtgattcctccgaggagagtggttggactaagtactttgaggatttctttgttgacaaccataatattgatgatgatcagaattattgttctatgtctttctctggtgttgatagttattccacctcctttgtctttgatgctgctataaaaaaaataactgacagcacactagataaggaatatggtaaccaatcgagtttgaagaagagaaagaagatcaaaacagctttggttgatgatgctttggaagatactgcaagctctcctatcaaaggctccaaggaaaaaagaaataccttgggagaaagagatgaaaggaaagaactgagttttaatgagaaggataatgacgaccacacagaactgaagaagaaaggccgttgcttagttcctttttcgatgatagtgaaatatctaggttga

SEQ ID NO: 77327 - DNA, 294 bp, Glycine max
  Peptide Sequence Number=SeqID_194105
atgtccaaacaaagctcaatagctttggaacctcttctaccattggacaatatttggtattctgcttctttattttccgttgaatggctctcctactccttcctccatgatgccaccgcctacctcgcctttgcattaaccgtcctatccttctttctattgctttctacgagagacattgtggcactggttgagcatagctccccttttctcttttgcgatgccaacaactttcttaggaagatgaagacctttctctccaatgatgacatcaatggtgcaattgtttggtga

SEQ ID NO: 77328 - DNA, 261 bp, Glycine max
  Peptide Sequence Number=SeqID_194106
atgggtgaggttgtgttgaggaagtggatgagggacaaagatacactgaggtgtagtgggcggagaggttcgaagaacctaggggaattagcgaatggtgactacccaaaatttggtgcactcatttggcgcagttggaagatgaggggtcggtgcatgatgtacccgtatgtagcgatcactcctgactgtcatccacatgattttgtaagaccatcaagacctgggaggattggtggcagtgattgggcccaatggtga

SEQ ID NO: 77329 - DNA, 345 bp, Glycine max
  Peptide Sequence Number=SeqID_194107
atgaatagagccaaggagaaccttaggggctctgtaccagagagcaacaatctcatgagtgtagctcttgagagggatgctcaaggcgtgaccgaggccgagatcaacgatcttaagaatacccttgtgttggtcaaggaaaacgttatgaggcttaatatctcagtgaaggacatcatggatatggcagtgaacaacaccctttcagttttgggagattttctatggcggcatctacatcgacctcaactgattgcaacaaggagatggagagtgagaaacgagagagcagaaggagagataaaaattaaaaacactaagttccaaggaataaaaaccatttga

SEQ ID NO: 77330 - DNA, 426 bp, Glycine max
  Peptide Sequence Number=SeqID_194108
atgccacaatctggttctccagcaacaaaattcagctcatctgatgagatcgtgagtttccctctggaggatagagaatgtgaatggaaaggagtgaatagacttgtcgtgagcacaagaaagactccactggagaggaggttggctaatgctcaatacaagaaaaacttgaccaataatgacattctcgagattgaggtttctaatgctggggagccaatcaagtcccatgacaatctggatgacatgctaggtcgttcagctggccttcctcaatttgataataagaactttgttgatgaacaaaatgccaatggagacaaccagccttcatttgctagcaatacttcacattttaacaatgtgaaagggagctacactagtactgttcctcccattccattatcaatagttaaacaactttaa

SEQ ID NO: 77331 - DNA, 435 bp, Glycine max
  Peptide Sequence Number=SeqID_194109
atggttcaatatccagccactgtatcatggacattaacgcatagaattgtgtttgatgaaggtatcatccatcaagggttgttcactccgttatggtttgacaatgatgacgtccttgttgctaaggaatatgtcagtgtaggctattttacaaataagtatcatggtacatgggaagcaacaccgacttggggacttctgttatgggaaagacatttgcttctatactcctatgtcaacattacttctccgatgcaataccgacttgggggctattgttatggggattacctcacgttagatatattaggccaaatacatgtaaagtatgctgacatatgtaaagaaacaggcacatatgaagtcaccgatgtaggctatgaaacacaaataatagatgatttgtggcataactatccagcgaaaggcctctaa

SEQ ID NO: 77332 - DNA, 255 bp, Glycine max
  Peptide Sequence Number=SeqID_194110
atggagcttaaagatatgtcaaattcagcttgtgtaatatttcatcatcatcttggtgatattacagatttagtagcaactaatatggtcatttgtttatggcagagaacaattgcaacgaggaaaaaggaaaggcttggtgattatcaatattttgcagaaccagaccttccaacaataatcctttctcaagaatatgttgatggtataaaaaattctttaccagagcttctagaaattaagcagagaagatga

SEQ ID NO: 77333 - DNA, 2523 bp, Glycine max
  Peptide Sequence Number=SeqID_194111
atggcggaaatggcagtgtccttcgcacgagacaaattgcttccactactaagcgacgaagcaaaactgctttggaacatccccaaagaatttgaagacatacaaaatgaactagaatacattcaaggctccctggagaaggcagatagaatggctgcagaagaaggagacaacgcaaacaagggaatcaaaaaatgggtgaaggacttgagggaagcatctttccgaatagaagatgtcattgatgaacacattatctatgtggaacaccagcctcatgatgctcttggttgtgcagctttactctttgagtgcaatatcactcacttcattgaatctttgaggcgtcgtcatcaaatagcatcagagattcagcagattaagtcatttgttcaaggaatcaagcaaagaggtattgattatgactacctaatcaaaccttctcttgagcacggatcaagcagctacagagggagccaaagtgtccaatggcatgaccctcgattggcttcacgttaccttgacgaagccgaagttgttggccttgaagaccctaaagatgaattgataacttggttagtggaaggaccagcagagcgcaccatcatctttgtggtaggaatgggagggctaggaaaaacaactgttgccggaagagtcttcaataaccagaaggtgattgcacactttgattgccatgcatggatcacagtgtctcaatcctacactgtggaagggttgctaagagacttgttgaagaagttatgcaaagaaaagaaggtggatcctcctcatgatatttctgaaatgaatcgagattcactgattgatgaagtgagaagccatttgcaacgaaagaggtatgttgtcatttttgatgatgtatggagtgtagaactttggggtcaaattgaaaatgcgatgcttgatactaaaaatggttgtagaatattaatcacaactaggatggatggtgttgtagactcttgtatgaaatatccttcggataaggtgcataagctgaaacctttgactcaagaagaatctatgcaactcttttgcaagaaggcattccgataccacaataatgggcattgtccagaagatcttaagaaaatttcttctgactttgttgaaaaatctgaaggatttgtaaaagaggaagaaggaaaaacattagaggacactgcacaacaatatttatcagagttgattagcagaggtttagtgcaagtctcttcatttacctttgatggcaaagctaagagttgtcgtgttcatgacttgctacgcgatatgatccttagaaaatccaaggatttaagtttttgcaagcatatcagtaaagaagatgagtcgatgccaagtgggatgattcggcgcttgtcagtagaaactttttccaatggtttaacggggagtactaaaagcttacacacacggtcactgcatgtttttgcacagaaagaagaagagttaaccaacaactttgtgcaagaaatccctacaaaatacaggctattgaagatacttgattttgaaggtgatctaacattgcctggaatttttgttcctgaaaattgggaaaatctagctcacttgaagtatttaaacataagacatttagccatgaaaactgaacaacttccaaaatacatctgtaatctccgcaacctggagaccctggacataagggaaacaaatgtcagcaaattgccaaaggagttttgcaagctaaaaaagctacgacatcttttaggtgataacttggatttgtttcaattgaagaatggtctcggaggtttaacatccctacaaacgctttgcgatgtatcgatccctgtggatgataatgacaatggagtagagttaataagaaaactgggaaagttgaagcaactaaggaacttaagcttgaatggtgttaaggaagaacagggaagcattctatgtttctcattaaatgagatgacaaacctggagaaactaaatatttggtcagaggatgaagatgaaatcattgatttgcctactatttcatctctgcctatgcttcggaagctttgccttgtagggaagttaagaaaaattccagagtgggttccacaactccaaaatcttgtcaaattaacattggaaaattgcaagttaactgatgatccattcaaatcattacaaaatatgccacatttgttgttcctcgacgtgtactatggtgcttatgaaggtgaaagtttgaattttgaagatgggggatttcagcaactaaggaaactatctctccgaggcatgttgaacttgaaatccatcattatcgataaaggagcacttcattctttggaaaatctcctattttggaacataccccaactcaagacagtacctcccggtattcaacacttggaaaaactgcaacttctcgaaatttacaatatggcagatgaattctacgagtgcattgctcccgatggaggaccattgcatccaatcgtccagcatccatccctcgtaaaaattttgtaa

SEQ ID NO: 77334 - DNA, 1116 bp, Glycine max
  Peptide Sequence Number=SeqID_194112
atgcatgacatatgtctgaacatgccaccaatggttcaaaccttcgacccagaggacctgttcaaaaggcgttgcatatgggtgaacggacccgttatagtaggtgctggcccttcaggtcttgcagtggcagcatgcctcaaagagcaaggtgttccattcttaatcctcgagagagcaaactgcattgcctctctttggcaaaaccgcacctacgatcgcttaaagcttcatctcccaaaacagttttgtcaattaccaaacttccctttccctgaggacttccctgaataccccacaaagtttcagttcataagctaccttgaaagctatgcaaagcacttcaacatttccccacagttcaatgaaacagtgcagtctgcaaagtatgatgagacctttggcctctggagggtcaaaaccatcaggaagatcaagaagttaggagaagcctcttcaggttgttgtggtgctgttgagtgtgaagttgagtacatttgcaggtggcttgtcgtcgccaccggcgaaaactcggagaaagtggtgcctgagtttgaagggttgggagagtttggtggccatgttatgcatgcttgtgactataaatctggggagggatatggtgggcaaaaagtgcttgttgttgggtgtggaaattcaggcatggaggtctcactggatctttgtaaccacaatgctaacccatcaatggtggttagaagctcagttcatgtgttgccaagagaagcttttgggaaatctacctttgagcttgctgtgatgttaatgaaacggtttcctctatggatggttgataagatattgctggttctggcacgtttgattttggggaatgttgaaaagtatggtctaaaaaggccttcagtgggtcctttggagctcaagcacactgcagggaagacccctgtgttggacattggggcccttgagaaaattagatctggcaaaatcaaagtggttcctggaatcagaaggttcttcccagggaaagttgaacttgttgatggccaagttcttcagattgattctgtggttcttgcaactgggtatcacagcaatgtaccatcatggttgaaggttcgtctttctttatag

SEQ ID NO: 77335 - DNA, 672 bp, Glycine max
  Peptide Sequence Number=SeqID_194113
atggagaatttagttgcatctctcccttcagaatctcagaagttacctttggaggataaatccgatgttgcgaaaaatacagaaagaccagcaccatcaacaggagggtgtagaattgacggatatgtgcgtgtcaagaaggttcctggaaacttgatcttctcagctagatccaatgctcattcctttgatgcttctcaaatgaacatgtcacatgtcataaaccatttatcttttggaaggaaagtatcacctagggtcatgagtgatgtgaagcgcttgataccttacgttggtagcagccatgacaggctgaatggtcgatcatttatcaatacacatgatttaggagcaaatgttactatggagcattaccttcagatagttaaaacagaggtgataactagaaaggattataaattagttgaggagtatgagtacacagcgcacagcagtgtggcacagagtttacacattcctgttgctaagttccatcttgagctctcccccatgcaggtcttaataacggaaaaccagaagtccttttctcactttatcacaaatgtctgtgctattgttggaggcattttcacggttgctggaattatggacgcgattttgcacaacactataagactaatgaaaaaagttgagcttggcaaaaatttttga

SEQ ID NO: 77336 - DNA, 729 bp, Glycine max
  Peptide Sequence Number=SeqID_194114
atgtgtttacctgtttcttctgtctacagaaaaatccctagagatttaactgaggcatcattatccggagcagggctatccatagtagcagctctcgccatgatatttttatttggaatggagcttaatagttatctgtctgtcaccacctctacacaagtgattgttgacaagagttctgatggggactatttacgtatagattttaatatcagttttcctgccctctcctgtgagtttgcagcagttgatgtgagtgatgtgctgggcacaaacaggctgaatctaacaaaaacagttcgcaagttttctattgattcaaatttaagacctactggtgctgaattccattcagaaccagctgctaacagcattaagcatgataatgaagtaaatgaagaatctgttgaaggttctgttgtactcaaaacacaaaattttgataaatatgctcatcagtttccaattacagttgttaatttttatgctccttggtgttactggagtcaacgcttgaaggtcttctgcttaatgtttgaaggtttttatgtgacacttccatctctttcctttcagaaaccatcatgggagaaggcagctaaaattattaaagagagatatgatccggaaatggatggtcgtattattttggggagggtagattgcactgaagatggagacttgtgccggaggttccccttttttaagaattcagtttcttacttgtag

SEQ ID NO: 77337 - DNA, 240 bp, Glycine max
  Peptide Sequence Number=SeqID_194115
atgacatggcaccagtaccaagacaaagttcacctctataacatcttagcagagaggaacctagagctctctatgggcatgctcgacaaattttacggagagctccaatggagacgatggcaccgagtactcaccaaactcccagagaagaagattgacatcgctctggtcaaggaattctactccaacatctgtggcccaaaggacggagctcccaaatactgcagggtgcgggaatag

SEQ ID NO: 77338 - DNA, 153 bp, Glycine max
  Peptide Sequence Number=SeqID_194116
atggatttgacatatcaacaattgaagccttgtaaatgcggttatgagcaaagagagtattttgctcaatatgggaaggtcttaaaagtgtcaatgtctcgaacagcagcgagtgtcattcaacaacttccgaatgatacttgtagtgtgtaa

SEQ ID NO: 77339 - DNA, 363 bp, Glycine max
  Peptide Sequence Number=SeqID_194117
atggaggtgcagatggagaccttgctggggtgggcgtggctggtgagaggattgaagaaatttgaaaacttaagaaagttggagaatttcagacacaaagtgtttaacatgggttcggctaatggtgaaatttcactttcggaacttgggttgcgagacaggttggtctcaaagtcattcaagatatgggatatctcagcgtgctcattaccatttcaggaaaatatatgtctaatatgtggtgataaaggagatttgaagagcctcatatattgcgaccagtgtaaagcttgtgctgagcataggtatttgtactgtgagttgtcatccttacttttaaatatcgacaatactttgatttag

SEQ ID NO: 77340 - DNA, 312 bp, Glycine max
  Peptide Sequence Number=SeqID_194118
atgactatcggagatgtcgagatccgcggtggtggctttattgtggcggctagatgcacggtgtggttggagatgccaaggccttcgtcggtggagatgacaatgttgtgtggttgcctgtgcagtgcagatacagtggtggtgagattaaaggagagggaagagaaagacgcagagggtgtagtcatcagaggcgaaggcaaagatgtcaacttgaggatgtcgtccttggaaggagttacggcggatggggttgcagtcaacggtgtggacatcgcgagtgtgttcctagaaggagcatatggggtttga

SEQ ID NO: 77341 - DNA, 150 bp, Glycine max
  Peptide Sequence Number=SeqID_194119
atgggattcacttggctgatttcatcatgcctttttttctcttcattgctggaatttctctttccctcgtttataagaggatatctattggatagattgttgcagctttatgcgagatctggcttccagctccgcggcggaaagaattag

SEQ ID NO: 77342 - DNA, 1530 bp, Glycine max
  Peptide Sequence Number=SeqID_194120
atggaggatctcgaggaggaagagaacggagcggaggaggtgttggggtcaagcttgaccatggagaaggtggcggcggcgaagaagttcattgagaatcattatagggctcagatgaagaacatccaagagaggaaggagaggcgttgggttttagaaagaaaattggcgtcatcggatgtgccaaatgaggaacggatcaacctcatcaaagatttagagaggaaggagactgaatatatgcgattgaaaagacacaagatttgtgttaatgattttgaacttttgaccatcattggaaggggggcttttggggaggttagactgtgtcgggagaagaaatctggaaatatttatgctatgaaaaagctgaagaaatctgaaatgcttaggagaggccaggtggaacatgttagagctgagaggaatttgctggctgaagttgccagtcattgcattgtgaaactttactactcatttcaggatgctgagtacttgtatttaattatggagtatctgcctgggggtgatattatgactttgctgatgagggaagacaccttaagtgaaaatgttgctagattttacattgcacaaagtgttctggccatagaatctattcacaaacacaactacattcacagagatattaaacctgataaccttcttctggataaaaatggtcacatgaagctctctgattttggtctctgtaagcctctcgattgtaatgccttgtctacactgcatgaaaatcagaccatagatgatgaaactttggcagaaccaatggatgttgatgatgcggacaatcgaagtagctggagaagtccacgtgaacagcttcaacattggcagatgaacaggaggaagttggcattttcaacagtggggacaccagactacattgctcctgaagtacttttgaaaaaaggatatgggatggaatgtgattggtggtcactgggagcaataatgtatgaaatgctggttggttaccctccatttttctctgatgacccaataaccacatgcagaaagattgttcattggagaaatcatttaagatttccagatgaggcccagttaacacttgaggctaaggatctaatttataggttgctgtgtgatgttgatcataggctaggtactcgaggagccaatgaaataaaggctcatccttggttcaaaggtgtggagtgggataaactgtatgaaatggaggcagcatttaaacctcaagtcaacggggagctggatacccaaaacttcatgaagtttgatgaggtagatccacctacagcagcaagaactgggtctggatcctcacgaaagggtgataatgaacaattgatacaaactatgttgcttgtattaagctttatttgcgctaagctgttagtccaagaattgcttatttgttacttttccttaaactggggaaagaaacaacaatttatatggaaattgacggggcactacccgattggcctccaacaaaagtttactgtagaagagaaagaaggataa

SEQ ID NO: 77343 - DNA, 489 bp, Glycine max
  Peptide Sequence Number=SeqID_194121
atggcggatccctattactcatacggtgctccggcagccgctgacggagctagcattgcaaggagcagctttgctggttatattccctctgagccttcaaattccaccactgaattgaggagcattgggtcagattacctgcagagagatataggcttgttttacagtgctgatgataccttcggctccagagttcattctgagcctgttaagggttattcacctcttgcagatcctgatccgagtaaaaaacgagatacaacgcctttgagcattactcatggtgttcctgatgtaaacagtgaaagaccagcctctaaaagcagttatgatggtctaccaatttcagcagcagactcaaacattctgtttgtgggtggacttccaaatgactgcactagaagggaagtcgggcgtatcctttttagctttattagcttacatgttggctcgtatgtgtttgtgtgttgccttttgttcctggcatga

SEQ ID NO: 77344 - DNA, 210 bp, Glycine max
  Peptide Sequence Number=SeqID_194122
atggttccgcaagagatggcagaccatcatgaatggtcccatgacatcaacgtcgaaggaggtatttttgtcaggagcaaaaatccggataatgacactgacattaatgtcgtgggctctcataaactctttcagctcatcagcaaaaaagtatcgggtgtcatatttccacaccctaacaaaatgtttgcttccattatagtcaaataa

SEQ ID NO: 77345 - DNA, 762 bp, Glycine max
  Peptide Sequence Number=SeqID_194123
atggctattctgattgcttgttttccattcttgggaatctttttcctaacattgagacaaacttatgttaagggtaaggcaagttccatggcagcaccagcccttagccctgaaccaggatgggaggttcttgatgcatgtgcagcaccgggaaacaaaactgttcaccttgctgcccttatgaagagaaagggtaagattatagcatgtgagctgcaaagagaaaggattaagcgtttgaaagacactataaagctatctgacatacaagtcctcaatgatgatttcttgaaccaaaatcccaaggatccttcatattccaaggtgaaagctattcttttggatccttcctgctctggttctgggactgctgcttcaagactagaccatctgctcccatctaaagcagcagttccagctgttgaaagaattgtatatagtacatgttcaatcaaccaaattgagaatgaagatgtcatcaaatctgttctgcccatagccgaatcaaatggatttcaattggcaaaacccttccccgagtggcaatgccgtggtctaccagtgtttgaaggctctgaatgcctggttcggacagatcctgctaaacacggcgagggtttcttcatcgctttgtttactaggaaagatgctaacttttcagggggctcaaataaaaatgaaactagaatttcccacagcactcccgaaattaaaaacgcgcgaagaaagaagaaacgcgtaccggatagaggtggtggttag

SEQ ID NO: 77346 - DNA, 1527 bp, Glycine max
  Peptide Sequence Number=SeqID_194124
atgacagataaaaatccaagaccagcagattcagctgacaattatgtcaccaaccaatggcctttggagctctctgagcacttgaattttgatgatgatcaatggctagacgatgacccggattcatttgtttcggggcatgccttcagccataacaatcaagccaatgaagttggtggctttggaggaagtggcacccactttgaagagtcttctagcagagacgttggcaatgaacgtgagaagaaggaagtcagggatagagttgcattcaaaacaaagtcagaggttgaaatactggacgacggctccaagtggaggaagtacggaaagaaaatggtgaaaaacagccccaatccaaggaactactataggtgctcagtggacggatggcaggtcaaaaagagagttgaaagagataaggatgatccaagtgaaagttccattgggcgtggtttaatggaagggatgaagcagcttgcgtacaacactgcggtgaagctcattctggctgcactcgaacacaacttgctccctgactttgtcaccaggagatatggtcgcttcatggcggctaacatccttcgctctggctacaaatcatcctccgaacttcaactctccgatctccttcactttgcgcattctctacaacagatgcccatagcaatcgacactgatgagacaaattctcaactttatgagttgcctaccgctttcttcaagttggtgctcggaaacaaactcaatttcagctgttgctatttcccttctgcctctatgacactggatgatgctgaagaagcaatgttgaaactgtgctgcgagagatcaaatttgaaagatggtcatacagtacttgatttgggatgcggttggggatcactggttttgtacattgccaagaagtacactaactgcagggttacaggaatcagctattcgacaactcaaaagacttatattgaggagaagtgccgggatcttcagctgcaaaatttgaatattatagttgctgatattggcacatttgaaatggaggcttcttacgacagaatattttccatagaaatgtttgagcatatgaagaactataaagatcttctcaagaagatatccaaatggatgaaagaggatagccttttatttgttcatatcatgtgccacaaagcatttgcctaccactttgaggacaaaaatgaagatgactggattacaagatacttctttgctggagcaactatgccttctgcaaatctacttctttatttccaagatgatgttacagtcatcaaccattggctagtaaatgggaaacactccgcacagaccagtgaagaatggctcaaaagaatggaccagaaaatgacttacatcaagccaattatggaatcaacgtatggcaaggattcagctaccaagtggactgcctattggagagcattcttcatagttggagcagaaacttttgcatataataacggtgaagaatggatgattgcacacttccttttcaaaaagaaataa

SEQ ID NO: 77347 - DNA, 300 bp, Glycine max
  Peptide Sequence Number=SeqID_194125
atgacgctggatgatgctgaagaagcaatgttgaaactgtactgcaagagatcaaacctaaaagatggttatacagtacttgatgtgggatgtgtgaagaatggaccaaagaatgacttacatcaagccaattatgcaatcaagtttttcctgtctcaatccttgactttggcccctaatgcaatgctgcaagctccaaagtccaaagtgcaaacacatgatctccttccttcccttgatacactacaactttatcttgctgttcaaacaatatggtgcatcggaggtgaaaaaagttaa

SEQ ID NO: 77348 - DNA, 651 bp, Glycine max
  Peptide Sequence Number=SeqID_194126
atgagtttgggaaccgcggaggacgaatccggttccgaaatccacatcccagccgaaatcgactggcacatgctggacaaatccaagttcttcttcctcggcgccgccttattctccggcgtgtcgtgcgcactctaccccatggtcgtgttgaagacgcgtcagcaagtttcctcctcacgcttctcctgcctcaacatctcctgcgccattctccgccacgagggcctccgcggcttctacaagggcttcggaacctccctcatgggaaccatccccgcacgtgcgctctacatggcctccctcgagatcaccaaaagcaacgtcgccaccgccttcctccaattcggcttctccgagaccaccgccgtggctgtggccaacgccgccgcgggcgtcacctccgccatggctgcccagctcgtgtggaccccaattgatgtcgtgagtcagcggctcatggttcaggggagtggcgggagtaaaaccacagtgctcgcgaatctcaattcggaaaattacagaaatgggtttgatgcttttaggaaaattatgtgtgctgatggagcgataggcttttatagaggctttgggatttctatattgacttatgcgccttccaatgcggtttggtggacttcttattccatg

SEQ ID NO: 77349 - DNA, 563 bp, Glycine max
  Peptide Sequence Number=SeqID_194127
ggattattctgagtttcaccaacggaacccctgcagaagttaagggtttccttgaagattacattgcgcagaaggataaattagggtacattattgtggaagaagctttttctgcgttttatgaagccctctgcaccaaattagattggattggaaaaccaaatttggaggaagaagaacctgaggctgagcctgagaaaagaaggcataaacgaagtcgcaaagatcagtccgataggataaataatatgacattgaatgatttgagtggcgtgttccacataactatgaaggctgcaaaggatgtattagaaatgtctgttactgtaattaaggcaatttgccgcaagtatcgtttatataaatggccccaaagacagttgcaaccacttgcgaggaggttgaaagtgctcaaaagagcattagaatcttcacaagatccagtgataatacagacaactaacatggaggttcgaagaattaaacaagaaatgactcagttgtgtggtggagttaccccaacgggtatagaaattcctgaagttgaagagaatagtgtttaa

SEQ ID NO: 77350 - DNA, 109 bp, Glycine max
  Peptide Sequence Number=SeqID_194128
atggaggaaaggaatgaggatgcgtggcttcgagatgaaggacaaaaggagcagccttcgcaggagggagacgtcgcgggaggcacccctcgcgggtgggttgaagaag

SEQ ID NO: 77351 - DNA, 1119 bp, Glycine max
  Peptide Sequence Number=SeqID_194129
atgtacacaacaaagagagaacaacaaaggttcaggttccaaaacgactctaaaaccccctccttctcttcaactctactcgataaagtctaccgttccatcgaccagagcaacgacatgaagctctacaacgaaacgatggggaagaaacagagcagagtcgtcgtcgaagaagaagagataacagctgccagcattcgccgcgcttgtttgcttgaaaaatggaatcgaagcgaaaaggttggaactcaatggaaaacacaaacgcgttggcatcatcatcgtcatcacgaacatgaccaggacgttatgttcttcagttcaacttcgagttcctcggattctagttctggtttgttgtcctcctctgacacggaatcattgtacggactgaggtcgaaatcgcgattttcgtgtttcgcgccgccgaggccgaagccagtgatgacgtcagcgagcaatgaggagggtctaagaaagtcaaaatcgagggcgttaaagatttacaacaatctgaagaaggtgaagcaacccatctcaccggggggggggagcgtaaagaaaaccaaaacctacgacgacacgaaagctcccaagtcgggacaagactccacgtgttcctccgcttcctccttctcgcggtcttgtttgagcaaggctacaccttcctcctctaaagacaagttgcgagatggagttaagcgaacggtgcgtttttaccccgtgagtgtgatcctgaacgaggattctcgaccgtgtgggcataagtgtttgtatgaagaggacacgcgcgtaatggcgtggaaaattgggcgcaagaagaatgaagatgaagaattaagggtcgtggataacagtaggcgcgtggaggaggctgctagagagttcttgaaagagtatcgtcgaagccagaagaagagcgatttcattaatttgagggattttactaatttggataatgacgatgatgatgatgatgcagcgagttgttcaagttcggatctgttcgagcttgatcacctagcggtgatgggaaataataggtatcgtgaggatcttcccgtttacgagactacttatgttagtactaatcgcgccattgctaatggcctcatataa

SEQ ID NO: 77352 - DNA, 1080 bp, Glycine max
  Peptide Sequence Number=SeqID_194130
atgtctgccacatccgtcaactccgaacgagcacgcgcccctcccgccattcccttgccccctccccctctctccaacttcaaaattggcctctgtcaactctccgtcagccccgacaaagacagcaacatcgcccacgctcgcaccgccattcaggatgctgcatcaaagggcgcccagcttgttcttttgcccgaaatttggaacagtccttattccaacgatagttttcctgtctacgctgaggatattgacgctggtgcttctccttccactgccatgctatctgaactctctcgtctcttgaaaatcaccatagttggtggttccattccagaacgctctggaggtctcttgtacaacacttgctgcgtctttggcaccgacggaaacctactagccaagcaccgcaagatacatctttttgatattgacatccctgggaagattacttttattgaatcaaaaactcttactgctggggagactccgacaattgtggacacaggtctaaacattttcaagtttcaagctgatgctaatgttggccggctgcagaggtgtatggtgacgaaaggaaatgaaaaggttggacgcattggcataggcatctgttatgacattcgatttccagaactagcaatgatatatgctgctagaggctgtaatccggaaggttcacttgagattaattatccagttctttggcaaacttatggtatcagtcagtttttgacttcaggtgctcacttactctgctaccctggggcatttaacatgacaactggaccattacattgggagttattgcagagggcaagggctacagataatcagttatatgtggctacctgttcacctgcccgggatactggatctggttatgtggcttggggccactccactcttgttggaccatttggagaagttctggctactacagaacatgaggaggcaatcatcatagcagaaattgattattcaatattggagcagagaaggacaaatctgcctgtaactaagcaaaggcgaggtgatctttaccagttggtggattttcagaggctgaattctcagtga

SEQ ID NO: 77353 - DNA, 915 bp, Glycine max
  Peptide Sequence Number=SeqID_194131
atggctacttctgatcaaacacttgtttgtgtgaaacaagtgaagcaagaggtggcggatgagtgggatgagagcatgccattaccaggggatatcattgaaggattttctgagcgcgacgctgatgatgattcctttttaccggtcaaggccagttcagagtttagttctcagcttggaaagattaacccgcgtggggaactcatatggatacaggttagaagaggtgatagcttgatgaaacttcaagtacgcattgtgcagcagaagggttccatacttcaaagtgagtaccgcatcgatactaccacaactaggtgcatggcatggtttagtgcagcaatttcctctggggtccctcttgtttttgtcaatatccaaacagaacaaattccctccacggaggagactcatttcttgaaaagggaaatagctactagcaagcaaaaaatcaacaatgctaaccaaataatgcatggtataaggttatggtttctacctggactagcagaaatttcagttgtgttaatccctcaacctgtcgaagcgcgctttggcatggaaattaaacgaactaaagagagctttgtgtacatatattcagtgatgaggggatcgccggctgatcgtgctggggtgagagaaatgtatgaagagtcaagtgcaaatgggttccttttggtgatatcaaggttgcaatgcaagagcataatgccaacgagtgcttgttctgctggccttgtgcattgctgtgaccaatctgaaatgaaggacattctcacttcagctatagaccaatatgagacgattcagctgcatgtcatggcctggccgaaccaaactcgtccttctccaattcctgatgttggtggttttgcggccctgctacatccaaaaagagattcatcattatga

SEQ ID NO: 77354 - DNA, 168 bp, Glycine max
  Peptide Sequence Number=SeqID_194132
atggttgtggttggaggcccagttgaagaagtgaagggcatggtggggaatgttctggttcttgataacgttgataaccaagtttggggtgtggttacgagggaaaggtttggaattggaggtgtagatgaagaagaaggtttggctatggctttcctgaatggctga

SEQ ID NO: 77355 - DNA, 3942 bp, Glycine max
  Peptide Sequence Number=SeqID_194133
atgccaccgcgtatagcaccaccgccaccggcggatccctctactgatcctactagtccgttctttgttcatcctagcgacggtccctcctccgtcaaggtcacaccactcctcgatggttccaactaccattcttgggcgaggtctctgcgacgcgctctcggagccaaactcaagttcgaatttcttgacggaacaattccgatgccggttgatgccttcgatccgtcgttccgagcttggaatcgctgcaatatgttgattcatagctggattctcaactccgttgaaccttccatttcccgatccatcgttttcatggataacgcttccgatgtgtggctcgatctgaaagagcgtttctcacaaggtgatttggttcgtgtttcagaaattcaacaagagatttacgctctcactcaaggtactcgatctgtaactactttctattctgatctgaaagcgctttgggaagaacttgaaatttacatgccgattccaaattgcacatgtcatcatcgttgttcttgtgatgcgatgcgtcttgctcgtcgtcatcatcatacgcttcatgttatgcgtttcttgactggtttaaacgatgaattcaatgcggttaaatctcagattcttctgattgaacctctaccttctatcaccaagatcttttctatggtgattcaatttgaacgtcaaaattgtgttcctaatcttgatgattcaaaggctcttgttaatgcttcaactagtaagtctcaaggttctgctaatggaagatctaattctggttccaagcgctactgtacctattgtcataagacgaatcactttgttgagaattgctttcaaaagcatggtgttcctcctcacatgatgaaaaatcactctggttctgctcatcattctgcagttgatgggggagaacgtgttgaatcttcaactgcatctcagaacaccacaagtgtcaccatgactccttcacttactcaggaacaattagataagcttctgcagttaattcaacctccttctgttaaccattgtaatgcttctacttctaaacaggtttgctcattcaacactgctggtccttcatcagcagatacgaagggcacagttgtgttttcctcttcttttagtatcaccaatgtcctatatgttcctacctttacagtcaatttgatttctgtctctcaattatgtcaccatacaccttatacactcaatttcactgacactatttgttccatacaggagcagaaatcactgaagatgattggtttgggtgaaagcagagatggcttgtactacttgactcagacaaataaggaatgtgcttcttccaactacaacatttcttccattttttcctcagcaaataatgtccatatacctgaaaatgcaatttggcatttcagatatacttggataaccctaatgaaaaataaatctgaagctagacttcatgttcaaaactttattcattttattaaaacccaatataatcattctgttaaatccattcgtacagacaatggtcctgagttccttatgccagatttctatgcctccaaaggtatattacaccagactagctgtgttgactctccccagcaaaatggcagggttgagagaaaacatcagcaaattctaaacataggtagagctcttcttgttcagtctaatctccccaagtctttttggtgttatgctgtttcccatgctgtatacatcatgaatagagtccctgcaccaaatttacaaaacaaatctccttatactttattgtataatactgcccctgattttgatactctcaaagtgtttggttctctagtttttgcatctactttacaatcacatagaaccaagttagaccttagagctagaaaatgtgtttttctaggatataaatctggtgtgaaaggagttgtactccttgatctattaaataattccatattcttgtctagggatgtgactcaccatgaacacatttttccctatcagtcctcatctcccaagactccttgggagtatcattccatcagtcctactccaaatgacagtgacattaccttagatagtgacatttccttagacattaatgctgagcagtcaccatcaccaccccactcatctttatctcctaatatttcaaatgacactgtcatttctgatacctctacctccacacctccacctaaagatcacaatgattctcctctattacattccaaacccatcagacaaagaagggcaccattacatttgtctgactatgtttgtcacaatacatctccaacttcacacgaatctctcacttcaggtacaaagtctaaatatcccttgtcttcttttcattcacttacacttttgtctccttcacacaaggcatttagtatgtcaatcacacactgcactgagcctcaatcttatgaggaagctagtaagcatgaacactgggtaacagccatgaaggaagaattaaatgctttggctaaaaattgtacctggaaaattgttgaactcccacctcatactaaacccataggatgtaaatgggtttataaagtcaaacacaaagcaaatggccaaatagagagatacaaagccagattagtagccaaaggctacaatcaagtagaagggattgactattttgagaccttctcccctgtggctaagattaccactgttaggactcttttggcagtagctgccataaagaattggcaccttcatcaactggatgtcaataatgcttttcttcatggagatcttcaagaagatgtttacatgaaaataccagatggggtaacttgtgccaagcctaattctgtttgcaagctacaaaagagcttgtatgggttgaagcaagcaagtaggaagtggtatgaaaagctgactaatttgcttctcaaagaaggttacatacaatcaatttcagattactccctatttactctcaccaaaggaaatactttcactgcactgttggtatatgtagatgacatcattcttgcaggtgattcaattgatgaatttgacaggatcaagaatgttcttgatttagctttcaaaattaaaaatctgggtaagttgaaatactttcttgggcttgaagttgctcattctagactgggtattaccatctcacagaggaaatattgtctggatctgcttaaggattcaggattacttgggtgcaaacctgctagcacacctcttgacacatccataaagttgcacagtgctgcaggcactccttatgctgatatttcaggttacaggcgcatagttgggaagttgttgtatttaaacacaactaggccagacattgcttttgcaacacaacaacttagccagttcatgcaagcacccacaaatgttcatttcaatgcagcatgtagagtattgaggtatttgaagaacaacccaggccaaggtattttctttagcagaacttcagaaatgcaacttataggttattcagatgctgattgggcaggctgtatggattctagaaaatccatatctggatattgtttcttcataggcaaatctttagtgtcatggcgtgctaaaaagcaagcaactgtgtccagatcatcttcagaagcagagtacagggctctgtcttcagctgcttatttgagagttcagcttaccagaactccaactctttactgtgacaaccaaagcgcagtccacattgcctcaaatccggtttttcacgaacgcacaaaacacttggaaattgattgccatcttgtgcgagagaagcttttgaagggcactctaaagctactaccagtttcaacaagtgatcaagtggcagattttctcaccaaagcattggcaccacccaaatttcatgattttgtctccaagcttagcatgatcaacatctaccatgataagcttgagggagggtgttga

SEQ ID NO: 77356 - DNA, 1362 bp, Glycine max
  Peptide Sequence Number=SeqID_194134
ccagggaaactcttcaaacactatggactgcgttttgtaacttcatccatagagaaaaagaaattagctgtggcagctgaaaaaaatcagacaacatttgctgctactcagaaggaagaaactaatgaggagaatgggggagaaacaaaagaggaaaagaataatggtggatacatgataagtgcatctgctgcatatgagattgctgcttctgctgcctcttatctccatgctcagacaaggagcatacttccattcaaatcttctgatgctgtggaaggtgaaggttcacatgaagcaagcaatgaaagatttaacggcgagaagatggcaaacacggaggaggcaaatttgaaggcaactacggattcggtaacagcagttgttgctgcaaatgagcaagtaaagcagggctccgagtcgtttgcatcctggcaagcaaacctactatttgaaccagttcaatttgaggggttagatgttcatgtacatagaggtatatacgaggctgcaaaagggacatatcaacagatgttgccagaaattcgtggtcacctaaaatctcatggttcacgtgcaactttccgattcactggtcattctcttggggggagcttggcactacttgtaaatcttatgctactgataaggaaggaagcgccattctcctctctgcttcctgtcataacctttggggcaccatccatcatgtgtggaggtgacactctacttgacatgcttggattgccacggagccatgttcaggcaatcacattgcacagagatatagtaacacgagtattttgttgccagtaccctaaccatcttgcagaactactaaaggctgttaatagtaacttccgcaatcatccttgccttaataaccagaaactattatatgcaccaatgggagaactgctgattctccagccagatgagaatttttcaccaagtcatcatctcctaccctcaggcagtggtctatatcttttgagtggttctttgtcagaatctagtgacacattaaaacaaatccatgcagctcaattggtcttcttgaacactccacacccacttgagatattaagtgaccgatctgcctatggatctggaggaaccattcagagagatcatgacatgaattcctacttaaaatgtgtgagaaccgtgatttgccaagaacttaaccaaattcgcaaggcgaggagagagcaaaggcgaaaggcgtggtggcctctcgtgctgccacatggaaggaacactgacatagttggggggtccatgattcaagaccggccttccttctctggcatcattcagataggtaaagagtcattgaaaaggtttagtagacttgtttga

SEQ ID NO: 77357 - DNA, 965 bp, Glycine max
  Peptide Sequence Number=SeqID_194135
atgaatctgcgtgagagccctcgtactcaacagaaactttctcggcaatcatcgaagtcaaacagaggggtgaagcaagaggcagctgctagccctctctcgagtggatgctgtcgaggcttgagcagcgtaaggactgtgtcatccaccgcaccaacctcgcagcaacacgatcagctccaacagcgttatgaaaaattggaagcgaaggtagcaggtttggaaaaagaagtgcaaaggcagacagaacttcgagtcatgtataggaaaagaatggaaagaacacaagattacttaaaatactgtctccaaatagcacaggaaaatggaatcttggacctcattgtccactccaaagttgaactctcacagtctcccctctctctatataccgccaactccactcctcccatccccactccttcccaccaccccaatctaacggccatcattgatcaagccaaaatcaatggatggtatatcaacccaagtgagattgagttggtagaaaaaatagggcaaggaaccaccgcagacattcacaaagggacatggcgtggatttgatgtggcggtgaagtgtatgtccactgcattcttccgcacaaacgaaaacggtgtcgtattcttcgctcaggagctcgaaaccctctcaaggcagcgccaccggttcgtgctccacctcatgggtgcatgtcttgagcctcctcatcatgcatggatagttactgagtatctcaacaccacgctcaaggagtggctacatgggcctgccaaaaggcccaaaaacagatccgtcccacttcctcccttcaaagacagactcatacgggccttggaaacagcccaagccatgcagtatctccacgaccaaaagcccaaagtggttcaccgtgacttgaagcccagcaacatcttcctggacgatgcattgcatgttagggttgcggattttggacatgcacg

SEQ ID NO: 77358 - DNA, 250 bp, Glycine max
  Peptide Sequence Number=SeqID_194136
cgcccaatacgcaaaccgcctctccccgcgcgttggccgattcattaatgcagctggcacgacaggtttcccgactggaaagcgggcagtcgacggtatcgatgggcttgatgtggatcacgaaatggacacgataagatgcaaggataaggttatcgataatctggaacatgatccacttaagagctgtggcttcaagagggataatgttgcttactcttgtgacattaaggagcaaggactaacttga

SEQ ID NO: 77359 - DNA, 2304 bp, Glycine max
  Peptide Sequence Number=SeqID_194137
atggatgttattaataagcagcaaggtggtctaaaatgcggtgaagtaaccatggctgagaagaagagagaagtgatggtggcgattccaaacgagcagcagcatagcagggtgaattcgccacacagaatattaaacgacaacgaggttgccggagcaaagtcgccacctttaaactgtgcttcccctgagataaggttcatgccaagcccaaacaagcccccaaaagttttcacttccaacgccaacctcactcggcgaaaatcactcacaaggtcagtgtattccaaacccaaatcaaggtttggtgaacaaccttaccccattgatgggacccttttggaagataatgcaaactcaactttgcaagaaaacttgactgttggttcgccatataaagcatcacctaataacaacaacaaagctgggactgttaatagaacattctccatcctgtctgtgatcactcccaagacaccgctgatggcgtctcccgggccggccggggaggatttcgatgaaatcatttacaagaaagttgaattgagtaaaaacaagcgtagtaggagactgactgctaagatgttgtttgaatggtttgtgtttgtgtgcattgcaagtagcttggtggctagtttagctgttggaaaacttaaaaggaccgagatttggggtttggggttttggaggttgtgtgtgcttgtgatggtgaccttttgcggcatgttggttacaagatggtttatgcacattgttgttttcttgattgagaccaactttttgctgaggaaaaaggtgctgtattttgtctatggactgaagaagtgtgtccagttcttcatttggcttggtttggttcttctcacatgggtgctgttgattaaccgcggggtccaccgaactgaactggcctcaaagattttgaatggggtaacatggactcttgtttccctcctcattggagcattcctgtggttcgtgaagacattgttgttaaagatcttggcatcgaatttccatgtcaagtctttctttgatcgaattcaagaatcgctcttccatcagtacattctgcagactctctctggacctccacttgtagaagaggctgagaaggttggggcatcgtacagtgttggtcattttagttttaggagtacagatggtaaaggtggcacaaagaaagagactattgatatcgcaaagcttcaccagatgaaacaagagaaagtttctgcgtggactatgaaggttttggtagatgcaatgacaacttcagggctgtccacaatctctagtgcactagatgaaagtttcgatgaaggagaaaatgaacaaactgataaagagattactaatgagatggaagcaactgctgctgcctattacattttcaggaatgtggctgcccctggttgcacgtacattgatgaggatgaacttcggaggttcatgattaaggaagaagtgcgaatggtatatcccctattggctgaagcagaaacggggcaaattactagaaagtccttaacagactggttgttgaaggtttatcaagaacgcagagcattagcacatgccttaagtgacactaaaacagctgtaaaacaactaaacaaactcgtgaccgtactcctagtagtggtgaacataatcgtgtggcttctactgatggagattgcaacaacaaaagtacttgtattcctctcatcacagctagtacttgcagctttcatgtttggaaacacatgcaagaacatatttgaagctatcatctttgtgtttgtaatgcatccatttgatgttggtgatcggtgtgttattgatggtgttgagctattggttgaagaaatgaatatattgacaacagtcttcttgaagcttaataatgaaaaggtgtactatccaaactctgtcctggccacaaaaccaattagcaattattacagaagcccagatatgggtgaccgcgtagatttctccattgattttatgacaccagcagagaagattggggcactgaaagaaaaaataaaaaggtacgtggagagaaatccacaatactggcactccaatcatggcttagtagtgaaggagattgaagatgtaaacaagattaagatggctctcaatgttacccacacaatgaactttcaagagtttggggagaaaaccaagcgaagaactgaattggtgatggaagtaaagaaaatgtttgaagagctcaatatcagatacaaccttcttcctcaaggcattcatctcagacatattgaaccaaactcgagtgtgctcaatacatga

SEQ ID NO: 77360 - DNA, 132 bp, Glycine max
  Peptide Sequence Number=SeqID_194138
atgccagttgcaacactgatggatagtaaaaaattctctggtggccacacagtcatcaagctcaaccaatcagggcctcacaacttcatcagtggaaacaaaaacagctgtctcaaaaacgagaagcttgtg

SEQ ID NO: 77361 - DNA, 228 bp, Glycine max
  Peptide Sequence Number=SeqID_194139
atgtggagagatccgggagtttcagctgattctttctatgaaatccgccccgaatgcaccgatgttcccgttactcgatttaagatcaaggctggcaaaacactaagtgcaagaaaatggcatgctgcatttactccagaagggtatctagatataggcaagactctaagccgaatctaccgcgggtcagtgcaacagggaactcttgcttgcttgaaaaacataagg

SEQ ID NO: 77362 - DNA, 576 bp, Glycine max
  Peptide Sequence Number=SeqID_194140
aacttgaattctgatattgctgtggagtgtgttattcaagacaacaccccttccccacccattcagggtgttgctgaggaagttgcacgagagtcaaggcttgcaaaacaagatcgttattcagaaatgcggaggttgaaggatgaggagcgtgaggcacaggagcgtaagttggaagaggaagccagagctcagaaggctaaggaggaggaggctgctgcattagagtttgagaagtggaaaggtgaattttcagttgatgatgagggtacccttgaagaagtgcagggtagtactgaagacttgctaggcaattttgttgaatatataaaggaatgtatcaatcgcatcacatctctggaaagtatgggtcggctttcgggtgttatggatgatagagggaaatttatttacatctcccaagaagagatgaaagccgttgctgattatattaagcggcaagggagggttagcatttcccacttagcaagtaaatcgaaccagttcattgatttggagcctaaagcccagtactctgaggacattaacattgcggaggagataactgttaactga

SEQ ID NO: 77363 - DNA, 2001 bp, Glycine max
  Peptide Sequence Number=SeqID_194141
atgaaaactgctttattaaagcaggtaacttcttcgtactcaacaaaaataataacagcttgtttgtttctcttcttgaactgccatgttggctacggccaaaatgactttgaaaaattttcgtccttgtcgtcgccgccaccgcctctaatgacggagctcgacgcctgcaacggtgtgtttctcacgtacgcgctccttgggcgcgtgaaggagtacccgcacgtgaagaacacgtcgaagcaggcgtgggcgttcaaggcggaggcgtccctgacaaacgtcggggacgaggaggtgcaggggtggaagatgtacgtggggttccagcaccgcgagattctggtctccgccgacggcgccgtgctcaccgacgccggggactttccggcggaggtggggaacgggaccacgatgatggggtccaccgcgacggacttgaagaccgccatagataccgccggggatattgaccagatgagtgtgaggattcagatgaaggggacgcagtttgggttgggtgctggggctacgccaatgcctaaaactattcatcttgagaatgatggcttcaaatgccctgcacccagtcgaagagccacgagaatgttcgtatgctgcagaaaggacccaaaagtaaaagccaagcaagctaagaaaacaaagtacccacctcgtcgcaaaggagacataaccatagcatacgacgtgctccaagccttccagaacaactactacgcgcaagtcacaatagacaacaaccacccattaggtcgtctcgatcactggaacctaacatgggaatggcaaaagggagaattcatatactccatgaaaggagcctttgctcgcagaagagacccttctgagtgcttgtacggcctcgcaggaaaattctacaaagacatggatttcacaaacgtcgcaacctgtcaaaagaagccaacaatctctgatcttccatcagagagaaaagaagatgagaaagttggaaaacttccttggtgttgtaggaatggcactgttttgcctcctatcatggacaagaacaaagctaggtcaatgttccagatgcaagtgttcaaaattgcacctgacactgataacagaactgctctcactccaccttcaaagtggaacattgatggtgtcattaaccctaaatacaagtgcagtgccccagttagggttgacccacaagtcttccctgaccctagtgggcttagtgctattagcacagcggttgcaagttggcaaatagtttgcaacatcacaaaacctaagcctcaagaaaaccgttgttgtgtctctttctcagcattctacaacgaatcagccatcccttgcaacacgtgtgcatgtgggtgtgatgacacgaggaagtgcagctctagggcttctccgatgcttcttccaccagatgttcttcttgtgccgtttgctaacaggtccgttaaggcacgtgcatgggccaggctcaagcacttgcacgtaccgagcaagctcccttgtggggacaattgccccgtcagcataaactggcacgtgagttctgatcacagggatggatggacagctaggatcacacttttcaactgggaggactattcctttgacgattggttcactgcagttcagttgaggagaactttcgaggattttgaagatgtgtattccttcaatgggacgaggattcctggtctcaaaactgtgttctttgaagggttaaagggtttgaattacttggctggagaaaccaatggaacacacgctaatgaccccagggttccagggaaacaacaatctgttatttctttcagcaagaagcatataaaagacttcgatgtcacacatgatgggttccccactaaggttttcttcaatggaatggagtgttcacttcctccaattagacctgccaaaagttcagggcgcaaatcatcttccatcagtgtcattgcactcgttttcacagcttttgtgactttcttgatgatctaa

SEQ ID NO: 77364 - DNA, 576 bp, Glycine max
  Peptide Sequence Number=SeqID_194142
atgggatgcaaatcatgtagtaaacccattcttgaaccttcacccatcagcttaaactttttgcgaggcaactttagatgcaccgagagctctgttggtgtggcggctcaactaagtaatctggcttcagtcactcaattctcagttaatgtttgtgaaacagaaagtgctaatgtgctgtctcttaattttggagcacagaacatcttggtggagatgatgtgggctctagaatatgatcctgaattgttcttgatgtatgaaatgcctctatcagcttctgaaaaagctgagggctcaaaagggaaaacaaagtcaatacgtcaatgtggaaagtatgagagagaaattgtgaagagtggagcaaaaaatgcagaagcacctcttcctatgtctattttccttgttgctagtgtattgaaagataaaagtgcaaaactactccaagaagcacggggcttggatgatgttgtcaagattttgaatgacacaactggtaatatagatgcaaaaaaagcttgcagtggggctatgaaacttcacaagaaatatttgaaaaaggccaagaaaccctag

SEQ ID NO: 77365 - DNA, 675 bp, Glycine max
  Peptide Sequence Number=SeqID_194143
atgaacagtgactcctacggacgagtcattgtgtcgcttttatatgaaagggtgaaggacattttcgccctttcacccacgttgctgggtgcccagcaaaaatgccggacgtgcactgctgcttggaattggattgtggtggttgttcgaattagacagtcttatatcaagatgtatgagaaagtcatcggaggacaagtcgcactggatcatgggtccaaacctgcacatagtagccaagttaatgagctccttctccattttcttcttctgcttctcctccagttcctcgctctggttctccattatcttctgcagcgctttgcactggcatttggggcttctcagctcgctcatttatgtgcagcacttctgcatgtgtccttcttcttcttcgtcttcgtcttttccttcgttcctccttatgtagttgattcttccccgcatggtcctgagaatgtgattgtcgtcgtcatcatcatcatcgtcatcgccgcggccttggatcttctccatgatgtgcttctcgcagggcgtgaggttcaccccctggagctgcttgcggcagctatcttgctggtgctgccatttggaggcgctgcaagtgtgggcgatgcagaagagaagagagatgaggaggattgtgaacttggtcattttgctattgatgggtga

SEQ ID NO: 77366 - DNA, 180 bp, Glycine max
  Peptide Sequence Number=SeqID_194144
atggagaaccagagcgaggaactggaggagaagcagaagaagaaaatggagaaggagctcattaacttggctactatgtgcagatcatcactggtgaatggtgatcgtgtacgtaccctacttagtaggcaatggaagcacttagagtgtgctttgtgcatggccttgcctctgttttga

SEQ ID NO: 77367 - DNA, 435 bp, Glycine max
  Peptide Sequence Number=SeqID_194145
atggaggagctattcgtagcagttctatcgatgcttcttgtggcagcgttgatcccactctacctatggaaacgccgtcaagattctcaacctccccctccccaccgcgacgaagctcctcaggctccgcggagagaaaccgtggcgcgcgccgccgccactcgtcgcatgcgtcgccgacctgccgcctctggagctagcacttcggcagatccacctgcgacgcaagaaggctctgtttggttaaatttctcaataagcatctataggagaactggagaaggatctggtggtgagagtgatgatgaagctgccggcggagggtattatgaggctaaagcatcaaagaaaaaggagattaaaaggcaagagagggaagaaaggcgtcagcttgtagccttctatactaatttaccaaagaaccatgctgtttga

SEQ ID NO: 77368 - DNA, 357 bp, Glycine max
  Peptide Sequence Number=SeqID_194146
atggcttttcacagaaagaggtatgtgaacagctcgcacatgtcgcgatcaatgcagaggtatgttaagctaaactcgtcgtgcccaagctcgcggtccaccaggtatcgatcctcaatgttttccttcgacacgtcgacagcaaacgtgattggcgccttctgcttcgcaatgaaggcgttggggaagctcgatttcacatccttgcgggccacgatggccggggatctgcagcagttgcccataggagaggagatcacggctgagaaagagtccgtaggaggagagaagggtagtagagaaatgtgtgttggatcaagtggcctcgaaataaagaagaagaaggggttgaattaa

SEQ ID NO: 77369 - DNA, 444 bp, Glycine max
  Peptide Sequence Number=SeqID_194147
atgggagtgcgggcaaaaaaccaaaggaacgtcttccaaaaaggaaaacgcatgggagttgccaccaacgtttattcgaggaaaatgttagaaaaaccaaaaagaaggtatgcaaatattgaaaagaagggttcgagtgttgtttacgcatggggaagggtgttgcccttgctcctatgtatcctcaggtgcgatgaggcaaagggtcactttggggcagttgcagctcgcccaggcaagctgaaacttaaccctgaagcatggcatctcaaatcacctttcttccttctccattccactgtcattgatcttcaagaatcaaatgacgccattgatgaagaagatccaagccttacaagctccacatggagctacatcaccctctccattcagatattccttcagaggctacgtctaggaggactagacaatccacccagctga

SEQ ID NO: 77370 - DNA, 273 bp, Glycine max
  Peptide Sequence Number=SeqID_194148
atggaagatgttaagcctatgaaaagtcctatgtatgtttccaatcctttgagcaaagacgaatcaggtcatgaagcaattggagtcaaatgggtgttcaagattaagaagaatgtcaaaggagaggtggaaagatacaaaacaaggcttgttgctaaaggctacaaaattttccaactttatgtcaaattggcctttttaaatggctatcttgagaaagatgtctatgctgaacaaataacgggttttgccatcaaaagggaagagaagaag

SEQ ID NO: 77371 - DNA, 330 bp, Glycine max
  Peptide Sequence Number=SeqID_194149
atgtaccggtgtcggacaccgatacatatccaggaagtatcggaattttttttttataaaaataatggatacaacttggatacgactaggacacggcttaggttgggggacatggctcaagccgtagtgagatacggctcgtacactgtggtgctagagttcaatcattacactcctggctcacgatggaggctgaccactgtcagtaggaaagatcatagggaggaggggaacgaggctgatggattttatggcggaataagaaagattaccagcgaggctgagattgccacttggaaatgcctttggccatctgaagtcttggattag

SEQ ID NO: 77372 - DNA, 363 bp, Glycine max
  Peptide Sequence Number=SeqID_194150
atggaggcaattgagcaagaagatgaccttgctgggcggcacctgaagtctatatttctagaagaagatgaattcaagctagttgtgtatccagcaacccctcccattgtcctcccagggctaaggcgagtcatggcccgaactactccaaatgctccacagccctcaccttcgggaatccctcctccaaccacctcttctacagtcggcaagcctttttcctcctcttcccaacagcagcatctagtccagatgatgcagagcctccatcatggccatcgccttgccatccaaaacatgcaccagctatccattcacctttctatggagcctccactggtgacgccaaaggcttttctatag

SEQ ID NO: 77373 - DNA, 492 bp, Glycine max
  Peptide Sequence Number=SeqID_194151
atgattgacacctccgccgctagtcgaagtttctactcttgctgctgcagtcgttttgttgttgtcgctgttactcctactcctccaccttttccagttgtgcctattcaggaggccactcctgctgctgaagttgatgcgctagtcgcttcggcagaatatgggctaaggcaccaagaggcactaagaaaagtggcatccttggaggcaaaggtcgccaaatggaggattactgctcgcacaatctggaaagtgaagtgccctaaggtagccagtgccatcgtcgccttctctgaagctgtgaagtcgaaccaccaactgtcttctaagggagagaaaaaggacttggttggcaaggtgaagggcattgtgacagagaaggatgagcttatcaaggtagtggtagtcctcgaggcccggctaaaggagtcggagtccagactagaggagtttgagctgtggttggctagagagaggaaggccaacaagtag

SEQ ID NO: 77374 - DNA, 384 bp, Glycine max
  Peptide Sequence Number=SeqID_194152
atgacaaaaattgttggcacacttggtctaaagtcacgatcagttgatacaatttcccgttgccttgatgcaggaatgtctgtggcaaggtttgacttctcatggggtgatccagaataccatcaagagacattggaaaatttgagagttgctatcaaaagtaccaagaaactctgtgcggttatgctagatactgtgggtcctgaattacagattgagaataagacagatcacccaatcacccttgaagcagacacattagttgtcttaactccagatcaaaccaaagaagctggttcaaatctcttaccagtaaattttaacggactatcaaagttgttttcctgttgcatctttgtgcttcgtccagcgtgtactcgatag

SEQ ID NO: 77375 - DNA, 426 bp, Glycine max
  Peptide Sequence Number=SeqID_194153
atgacaatatattcaaataataggatattagagataacctgtcgattgagagctcagctactaagggctagacgttcgtgctcttgtgctagggctgacatggagggttgtctagtgtcgaaggagattgtctcatgtcgagggagattgtctcatgtcaggggtagtagcctcgaccggtgtgagaattgtaggtctgtcaagcttgtcaagctccccaacctagacaagtgttgttcgggctgcttctgtcaagttgtccagggtggacatacttttggtttcataagcaaggcatgtgcagtgcatgcacagtactcttgcatacgtgtcactcttggagtgggcacatattggagacgtggtgcgtgggtgagtgggattgtgtcgtggtgcaaaaaattagaccactttagctctcgctag

SEQ ID NO: 77376 - DNA, 315 bp, Glycine max
  Peptide Sequence Number=SeqID_194154
atggcatcgctccatctccgcaatgtagttttggagtttttggagagtatcagtatccgtcatggttctagacgaggattggagccttcgaaaggggtctcgtatctgaggccagaccgtgtgctaaccatgggtgaaaaagaaagagagaaagatttcggggtatgttatactgcggccgtacgggtggatgtggcgaaagtgagctcctggactttgcacgttagactgagagtggcctttgataggaggacaagagaggagacctgcaaaacaaaagactccaatgctcaagtgtgtgttcgtctcaagtga

SEQ ID NO: 77377 - DNA, 447 bp, Glycine max
  Peptide Sequence Number=SeqID_194155
atgggaatgcatgataatactgatgattgggttgcgctttgggccataaccttttactggctttgggggtggcgtaacaagcatgttcatgatgaacattccatgaggcctcacaacccgattgtgtttgattcagaggaaaagtctgataggggtagaaattcaagtggatgcagaagaagctgtttacaagagtattttgggagaaaaggtggtaaatgttggttgaggcttgttcaagctattaaaaacaagctgatggagataggccagtattacattaagcatatttatagagaagcaaatggatgtgctgatgcaattgctaatgcaacacataactctcagggtgatgttgtgatgtttgagcaaagccccaatattttaagcactttgctatttgctgatgttgtaggagtttctactcctcgtttaatttctttgtag

SEQ ID NO: 77378 - DNA, 816 bp, Glycine max
  Peptide Sequence Number=SeqID_194156
atggctttcacactagacaggtttgaggagaacatggtgttcactttagagtctcagaagtcagtgccagcaccctttctgacaaagacataccaacttgttgatgaccctcacactgaccacattgtgtcatggggtgaagatgaaaccacatttgttgtctggaggccccctgagtttgcaagagatcttcttcccaactattttaaacacaacaacttctcaagctttgttaggcaactcaacacctatggtttcaagaaggtagttgctgacagatgggagtttgcaaatgagtacttcagaaaaggagctaagcaccttttatgtgaaattcacaggagaaaagcaccacagcagcatcaccaactctttcatgaccaatcaccatcccaaatttttcagcaagatgaaaatctctgctggcttgacactcctctaccatctccaaaaccaaacacagatattctaacagcactttctgaagacaaccaaagactaaggagaaagaacttcatgctcttatcagaactcagccacatgaagagtttgtacaatgacatcatatacttcatccaaaaccatgtaaaaccaccaccctttgagcaaagaagcagcagtgttattccaaacctggtggagttggactcattgcatgagtctccaaatgacatgggagttcgcagaagtgccaaaagttgtgttgtggataagtctttgattacttctactgaggaatcaaacagttctgtgaagctatttgggttccctctaagtggccgaaagagattgcaccctgataacacaaattgttga

SEQ ID NO: 77379 - DNA, 156 bp, Glycine max
  Peptide Sequence Number=SeqID_194157
atgcggaaattgattaaggaaaggatggaaaataaggtggttaatttcgtgggtcttaataaggtggtttctggcataaaatggatgaatgggatgaaatatagaaatggcaataacggaagctacagggctccaaatgaggtgattccaaaatga

SEQ ID NO: 77380 - DNA, 576 bp, Glycine max
  Peptide Sequence Number=SeqID_194158
atgggttctccacctgcctccactactcctcctcctcctcctcctcctccttcttcttcttctcctcctcctcctcctcctacttcggacgcatcggcttcgacgtctgccgtgaagcggacacgcaaagcctcacgcctacgatcgttgtccactagaccacctggtgttgagagaccagtggtgcatgttgatcctgctacagggaaggccgacggtccccacaagaagaaattaagaacatatttggggattgtggcacgtgataaggtggacatcacctacgagaactggaaggaggtccctactactcagaaggacctgatttgggaggatattcaggcggaatttgatttcccagaggcttctgacagtaggacgaaaaggaagttactacagaccgtgggggagagatggaggcagggtttaaatcagacctcacgaggaaatgggcccttgcagccgatcaggacagtgtcgaggacactgtctgtgacaaatacggcatcagctaggaaaagtgggcccagttttgccagactcgcaaagacccttcttgggaggatgtgcgcatga

SEQ ID NO: 77381 - DNA, 496 bp, Glycine max
  Peptide Sequence Number=SeqID_194159
atggtggaagaacaaaatgacaaaacgaccctcactccgaacgaggatattccagtgaaaggtctttcggagaaaagggatggttgtggcaagaaggaagtatcgctagaggaggcaagcgagttcctccacattattcagcaaagcgagttcaaggtcttgaaaaaagctcatgtggcccaagatatctctgtagaaggctttggaggactcgttaataacatcattgccaacaactatctcgccttcgccgaagaagaatccctatcgaggggagagggcataacagggctttgcatgtatcagtcaaatgcatggaccacgtcgtggccaagccaagttccatggtggtccgtgccttcgacggcacccgccgagagtcgttccctctacactccaccaaaaactgaagttcgtagtagagggacatttggttattatgtctggggaggaagacatcttggtaagttgctcgtcctctatgccatatgtggag

SEQ ID NO: 77382 - DNA, 393 bp, Glycine max
  Peptide Sequence Number=SeqID_194160
atggcgaccaataagaagttgattgctcctagggcttttggcaatggtatcagtatttctatccccgacacggtgaaagaccacggggagctcaagctatctaggtttgttagggggtgtgcgtggaacatctgtgaattcttggcatcgtctacacctttctgtgaagtcgagggttttgggcttaagtgtcagccaatagtagtcggtatgcactatctttgttgccagggagcatccctcggtgtggaggttgcagattccatcatgtgcttggagtgtctcctggatgatggtattgaggtgtccaactttcttagtgcttccaaacttggagagcaagtctacatcttgaagcaatcaaaatcatcaatgagggtttttacggtatga

SEQ ID NO: 77383 - DNA, 342 bp, Glycine max
  Peptide Sequence Number=SeqID_194161
atgcaaacttggaacaattccttcttccctcctatctctacttgcgtttttaatcaggatgagactcccttactatatagcctggtctttggggagggggtagtaaatgatgctacctctgtagttctcttcaaagcaattcaaaattttgacctctttcacattgacttaaccactgccttacaattattagcgaattttttgtatttactcattgtaagcactgtgttgggaatctttgtaaggaaaccatatactatcacaaaacaaagagagaggtggacaaatgaagaacataagaagttccttgaagccttaaagctatatggcaaggcttggtga

SEQ ID NO: 77384 - DNA, 3663 bp, Glycine max
  Peptide Sequence Number=SeqID_194162
atgctgtccattgttgagattggtaacctcgacaagcaaggtctgatgtgtcatgtgggagaggcgagtgcaatgcacatgcaatactcttgcatatatgtcacttgtggagtggacacgtattggagatgcggcacttctcacctccgtgggaaggcccaaccttctggtacttctccggtcggggaacctatctcagtcaccatgattcttcccccttctatttcttggggagcgaggaagagtggtggtggagacattatggcatccccctgtgtgcgatgtagccattatgctaggttgccattgtccctcctacggttgctggctttgaatggtacggaggattcctacaagctagccgtccagccctttgagagtgacgatttccctttcctgagggtggtgttgggcagcccgccattctttttcatgtataagtgtctattcgaggttttgggtctgatgaagttgataggcaagattggttgggtctccttgatcagcgtgtccaagaagctattcgagtttgactggaacgtatttcgccgattcaaggaccgtttcttcaaggtcctggctactaacgttgtggctgatgaattgccattgatgttcaaccgggacggggagccttgtttcctattttactggcagtctgaccttaccaggtttaagtctttcgacgaggatctgttgacccttgtggagagggtcgacaaggtgtcgaccaagactaacacttgtcgtgttgttgttcaatttataggtattatgagtgactttgcttggaggccctttgtgaagcagggtcaacctgccattgaggttggccctactactgatgttgttgagagggatgatggcactgaggttttaggccgtaagaaattgagggccccttttagccttcgtgcactgaggcaagttgtagggttcatgcttggttcaggttgccctgcaggtttgcaggatctaccttcgactccgttggccgtccaggtttatgctcctgctgctgttgttgtttctacttttgctactccacctcctcctaccgtgtctattcaggaggtcattcttgctgctgaagttagtgcaccagtcactttggctgatcttgttgtgcctccttcgtccaccttgttgagtgccaatcatatctacactgctcgggattttgattctctatggggtttggcaatcctagaagaaaatggtcaaaggcaccaaaaggcactaaacaaggtggcatccctggagcctgaggttgccaaatggagggtcactgcttgcacagtatggagagtggggcacactaagatgttgttcactagattggatggtgatgagctgttcaagcgatgcaagggcttgcagagggagagtaatgagttggctaacaaggtggagagcactacgacaaagaagggcgagcttgccaaggaggccagcaaggagcttgaagaggagctgataatgtacaagaaggaggctatggagcagcatgaaaagagctttcacaaggccattaggcagaccaggttcttcaacaaggaccttgacttgggtcttttttatcctttcaaggatgtgaaggatggtgttttgcttgacaagaaagatattgctattgaggaggaggtaggggaggagcaggatgctgaggagcaaggcgatggtcttgttgaccagtcgggtggcagcttgctttgccttgtggaatcagggacttttatgcttgtcgtagttcccaaggaaagagcttaccgagagcagatcttgggtttgatgagctttggaccagggatgcattcgtcctgggctttggagaagcaagactcaccaaggatagaccttgggtttgacgagcctttggagaagcgagacttaccaagggtggaccttgggtttgacgagcctttggagatgcgaaactcaccaagggcggaccttgggtttgacgagcctttggagatgcgagactcactaagggtacaccttgggtttgacgagcctttagaaaaaagtgagactcaccgagggcggaccctggatttgacgagcctggcagacctttggcttgacaagcctttggagaagccagactcaccaagggcggaccttgggtttgacgagcctgagactcaccaaggggtggaccttgggtttaatgaacctttggaactaggatgtgcttgtcctgagttttgtcaagacttagcaaggacgaaccttggtctccttatcggtggttccctgacttcgatggtgatcatggcgtctgtaccatatgtgagttggaaaggagttttgttgggccttaaggataactctgttggctacctttacttaactgttggtctggggatgttcgacagaagttaccagtcgatagcgactagtaagtatttgactgctcctagggcctttggtagtggtcctagtatgtccattccccatatggcgaaggtcgagggcatctgccttgagcgttggccaatagtagccggcgcgcaccactttggttccaagggagcgtccccctgtatgaaggtcgcaaatcccttcatgaagttctttcatgacatagtctacctgttggctgttcaggcatttgagcaaggtgttcatggtgggagtttagagcgtctcctggatgatagtcttgaggtgcttggtctttttggtgttggtcagcttggagagcaagtctactctggtgttgctctccctggcactgcttccttggtctggtatctgttggccctggataatttgcgagtcagtgtagcatttgacattgtcagggccttcgaggatgattcctgccccacttcccttcacattggacacattgtcaatgtagaggctccaccagtcttgggtggtttggtcgtttctagcaaattctgccagaaagtctgccacgaactgtcttcatggggccgcggggttcgtactggagatcaaactttgaaagttctgttggccatgctaccgccttctctacttatgggaagttggtgcttcccttcctcttgtatgagggtggagctaacgacttcgtcaactattgagagatataagaggaagggtactcctggtccaggtcgactcaaaactggtggtatgacaatggtcttcttgaaggctaagaacgcttgtttgcggaatgacttcactttttcaatgagcttggggaggaacttggacatggatgctagggttggcttctattccccgatgtgtgatgataaagcccaggaacttgcctccgccgaccctgaaaatttctctgaatacctcttccaagtctgccacatgttgggctatgctacgggatttgacaaccatgttgttaatgtagacctcgacatttcatccgatatgcttttgaagatacgatccattaatctctggacacaccctgttaaggtcggtgtagttagtgcatattcccatttgcagttggcctttttgaccatgatgatgttggcaaaccagcatgtcagatggctgccaagcaaacaggttcgtgttcctgtttatgacattagctatgcatctctgctcatggctggtgaggtctctgctgagctgcatgcactacccgagtttgggtccgagctgcagcttgacaagttcttcaataggctttag

SEQ ID NO: 77385 - DNA, 492 bp, Glycine max
  Peptide Sequence Number=SeqID_194163
atgggtatgggaggaagtgatttcgaggattctatttggcagccccttgtggattgtgaagttgttccaatcaatgacttctcctcggaggagacacgctgcgaagctttcgatggtgggtcctcttcctttgagaggttggtggacctacactgtgttggtgagggtacctctcatccttgtaggagggtggtgcatactgctgaagagaaagaagatcttgcagcgatagtggctgaatctgctaaggtgattgttgaccttcaggcccgactaagggaatcaatgcttattgtgtccgacctccaatacaggttgaaggagtctgagcttgaggtggaaaaggagaaggaagccaacaaggagttggaggaggagctcttgatgttcaagaacgaggacatgaaggaggataaactacttgatgaagaagaagtggttgttgcagaagaggacgctggcaaagagcaagataatggggccaatgtttag

SEQ ID NO: 77386 - DNA, 1242 bp, Glycine max
  Peptide Sequence Number=SeqID_194164
atgacggatattgatactctcaaacaactccaaaaccaaattacagagatggagcgcctccatgaagaggagcttagaaagctaaaggctaatcacgatcggctacagtctcatcttagatgcccccaggggcggactactcgtcgacaccccttcgtcaaccgaatcatggaagttgacatacccctaggttggaaaccacccaacctagagcagtacaatggaaccactgatccagatgaacatatggacgctttcctcactaaggtgaatttatggaccaatgacgatgcaatcttatgtcgtgtcttcccaacgtccctcaaaggggtggcattaacttggtacgatggacttcctccaaggtccatcgatagcttcaacactcttgtagcattgcattccatgttcctctccctatggcctggtaagtctgggaatagtctgtgcaagaaaatcctagtagaatggacaaattgcaagaacgagccaaaggctacattcaaatggaagaaatgtccaggtccagaaacgaggtccgaaaacccagacaaaagcgcaacaagagaaaagaaggagcaagacctagaggacatcaagaggatcaccactgaaaccatgataccgacagaagaagagacaaaacagaagatcgaggaagacagagacaccaccagcaaagatgcgagcaagaacctctgcaagaacaagaaaatgaaccacgcagcaaataagagtcagtctagcaaacgccacctctatgccatctgggacatcgacatcaactatgtcgacctaccatccccacaaagtctccctcctatcactttcactgatagagacttcaagggtagcaaccctattaaccaagatgaccccatggttgtttccatcataatcgccaactttatgatcaagaccagaggctatgtcgacctaatgacaactttcagtcaaggccagctctccaagatcttttcaatcaggtatttaatcatcgatgcaaataccttttactttgctttgattggcaagaaagagctcaatgagctcagagacatcatctccacattgcatcagaagatgcagttccccaccttaaggggagagattgtgactgtcaagacagatcaaaagcaggcacgacagtgctacgcggaaagcctgaaagtggcaccatatcctcacaccagcgagcttgccaaacctcacccacagcgggtggcaacactcaagtcatga

SEQ ID NO: 77387 - DNA, 434 bp, Glycine max
  Peptide Sequence Number=SeqID_194165
aagaaccacttcttccggaaagttcttccggaattttgaaagttcttccggaagagcgcgtcttccggaattcttccggaagaacacttcttccggaaagtttccggaagaggttttccgggagtcttccggaagaagtgttcttccggaagaacacttcttccgaaaactttccggaaaatgttcttccggaacttccggaagaacccctaacgggtcttccggaagactccgccgtcagccttttgcgccattttttccggcgtactctcgtcttttaccctaaggtaactatcctaaggttccattgctatgctaacaatgctgcatattacaagcaaagggtagggagggagattaacctgttcgcggagaagaagaagaaaaccttgggcgcgcctcgcggagaagaagcaagttcacgaagaagataa

SEQ ID NO: 77388 - DNA, 216 bp, Glycine max
  Peptide Sequence Number=SeqID_194166
atggcgaaagcatctttcaccatgaacaatgatcagtcaaaggatgattattgcgtgcaattgttagagtacttaaatgagtgtaatagtgaagggtcaatagttattctcctaacacatgctagaattaaagaatcacaaggatcatgtaactcattgaaagcatcaaaattactgataaaccaaccaatgcctaagattgaagaattcaagtag

SEQ ID NO: 77389 - DNA, 183 bp, Glycine max
  Peptide Sequence Number=SeqID_194167
atgccagatgatagagaaggtggcattagcactcgtaacttccacccgacgcctcaagccgtatttccagagccaccaggaagcggggtaggcgtcatccttgaagggcccgacagtgttactttggagcagaccatcaaattcaatttcaaggaattaatgaagcattgggcttggacttga

SEQ ID NO: 77390 - DNA, 643 bp, Glycine max
  Peptide Sequence Number=SeqID_194168
ggattttctccatcgaatcttcgaggaggattctgaggattccgctccgattaaagtgttcctcttggtgtgggggtccaacggcaagcaacgacggcttgcgatggccaccggtggacgtatttataacctgcaaatttcgcttaggaagactgtcgcgctaaggcgaagtccacttcttgcgcttagcacacccttgggcgctcaacacaacttcctctcggtcgaaattgggcttagcgcacctctgggcgctcagcgtaacttcctctcggttggaattgggcttagcacacttctaggtgctcagcgcaacttcctctcggttggaattgcaattagcgtgccattcgcgcttagagagagaccaaaagtcgttattgtcaaaatcccaacgatggggatagttgatgctatgttggacattgtaagtagtgggaccacactgatagaaaacaacttgaaggaaatcaaaggtggagatgttactgcaaacatgaggggaagcagtgcagaggaagtggccgagagaatattgagtcaaccatcattaatgggtttgcaggcttcttacgcaaagaacaaaaccaaacaacaacattgtcccgtggacaccgaacaacaagttgctaatgtgccttga

SEQ ID NO: 77391 - DNA, 1059 bp, Glycine max
  Peptide Sequence Number=SeqID_194169
atgaatgttgcatgtggagaagagtccaaggcccgatattccctatgttttgtctcccaggccaatgtcgtggaggttgctagtgatatggatttgaacatacgtggtgcggttgagaagtcaaccttgcgacatgttgaccatttggtgaagaaatttcatccacctttgtgtctactttatgaaacccatgctcctttcgttagggttgctggcaaatgggattcgtggggttataaaccttcgtttattcaggaggttggctatggaatttgcaagcatgttggatggcacaggtcttttggatttccatactttgggaatactgtttacgtggaggaaaatgttgtggatggagggcatgttaggaagaggcttgaccgttgtttagctcatgttgattgggggatggctttcccccatgctatagtagagattcttgcaccccataactttgatcataatctacttctcttgagttgctcaaagtttaaaacaaatagtgttcgttcctttcagtttcgagcacaccctgattttaatgaattaatttcggagtgtggacagggactcatgggaatgctatttcaaagttggcctagggatactaagttctttcttgttcaagtagtgataagaaggtggagaaatagagttatcagtctgcaaattgatgggatctgggtggattatgatgaagtcttcaagaaagaagccaactctttctctaagaaacttttgcagtcaactgtagcatgtactcctcaaagtctcattctatggaggagatggttttcaaacttttttatttcaaaagtatcagatgtcattgctcaagaggtttgggagttggtggcctatgctcatgagacaggtaatatcaaccctgctcttgctgaaacaattattgttcctatccctaaggttgatgggcccactaaccttaaggagtttcagcctattagcttatgtaacgtgcttttcaagcttattttaaaggtcctggttgaaaggatcaggcctcgcctttcttctattattggcccttttcaaaattag

SEQ ID NO: 77392 - DNA, 297 bp, Glycine max
  Peptide Sequence Number=SeqID_194170
atgagtcacacgttttatcttcctattggtgaatgcacaatcaccttggaagatattgctcttcaatggggtttacacattgatggaagaccaattaatggcccaagatcttatgattgggaacaaatgtgcgcaaaatatatagctccaaacattgaaattgaacaatatcctccacaacaaagcccaccagtcgttgccaacatgcatgatgaaggattacaaccacatgctcaatcatatgaattcacgccacaacatcatcatcatcaagaagattatgggtataatccgtag

SEQ ID NO: 77393 - DNA, 180 bp, Glycine max
  Peptide Sequence Number=SeqID_194171
atggagactacaaatgctgaagtcatcaaattaagggaaacaaagctctaccctcaactcattaagcttgtcaaaggaataagggcttatattggttctaaacctgatgttcacttaacttgcaacaacaacaatgttacaccacttgcacataacttacactcaaatattgtcccctaa

SEQ ID NO: 77394 - DNA, 297 bp, Glycine max
  Peptide Sequence Number=SeqID_194172
atgggatcgagtcaggtaccttggcttaaaaagaggttttatcaggttaagatcaagagcctaggagttgctagtctgaaagagttaggacagttaatgggtcaactccagcaacaagccttacgcaaagcctatggtaagatctgggacctaactatggcggaggtctccacggaggccattgcctccctcgctcaatattatgaccagcctttgaggtgcttcacctttggggacttccagttaacacccacgatggaagagtttgaagagatcctgggatgcctccttggctag

SEQ ID NO: 77395 - DNA, 264 bp, Glycine max
  Peptide Sequence Number=SeqID_194173
atggaggccgaggcaaagaacaaatacgtgaagaaggaagaaaacaacaatgataacaacaacaataaaagtaacagcaaaattgggaattcaagtgagggtctgagcaagcccaagtgtcaaatgaagacactgtttcagcttgaaacgctcgagaaagcttatgctgcaattgaaggacaagaaggagttgccggcaaagaagccgcgaaaggcagcagcgttgccggattctccggtggaggagcccaagttggggcctga

SEQ ID NO: 77396 - DNA, 315 bp, Glycine max
  Peptide Sequence Number=SeqID_194174
atggtggaaaaatccatttgggcaggggaagctcacccaagcgagctggagctcgcccaagcgagccaattgcttagctctgaaggtataagctcgcctaggcgagctggttacttaaggttgaagatatttcatggcctaggcgagccagatgctagcctgggcgagctttggtccagaaaattccataaaatgactatttttcccatttccttgtggttttcgttcttggatctggcaatcaatttgagcgatggctcgaccttgcattgcaatcggtgtcaaacgataaaagcattccctggacgaaattag

SEQ ID NO: 77397 - DNA, 809 bp, Glycine max
  Peptide Sequence Number=SeqID_194175
gtccccttcatgatggcgacgaacagatcggccaggcccgggctgcgggtctcgccaagggtggagagctgggtgcgcggcacgccatcgaacagcatcacggtcttgccgaacgccaggctgcgctcgtcgatcggcttcatggcgcgggcggtgtccagctggtcggcattgaccagcagctcggtgtagcgccggccgacgtcgtccatttccgcgtcgagcacgatgcggccgtcgcggatgaacatcacgtcgctgaggatgtgctcgatctcctccacctggtgggtggtgacgatgatggtcttctgttcgtcgaagtagtcttccagcaggcgctggtagaactccttgcggtacaggatgtccaggcccagggtcggttcgtccagcaccaggatgcgggcatcgatggccatcaccagcgccaggtgcagctgcacgatcatgcccttggacagctcgcgcacgcgctgcttcggctgcagcttggtattggccaggaagcgctcgcaacgggcgcggtcgaagcgcgggtgcacgccggcgacgaagtcgatcgcctcgcggaccttcagccagcgcggcagtacggcgacgtcggcgatgaagcagatgtcgttcatcagttcgtcgcggtgcagtcgcgggtcgcggccgagcacgctcagttcaccctccaccgaggtcaggcccagaagggccttcagcgcggtggtcttgccggcgccattgggcccgatcaggccgacgatacgcccgcttggaatgctgaaactggcattgtcgagggcgaccgtggtctt

SEQ ID NO: 77398 - DNA, 225 bp, Glycine max
  Peptide Sequence Number=SeqID_194176
atgaagatgaaagcaaacaaaacaagaaatgaattgaaagtctcggattcaaacacttattggttgaagaacaaagaacggacgaagaacgcaggaaaatcttcacagatttactcatggaaacgtcttggaagcgttacggaagcacttcaactcgattcttcttcacggaaatggaaaagggaggtgcttgacgccaagagacttcttgaggaaaatttctaa

SEQ ID NO: 77399 - DNA, 720 bp, Glycine max
  Peptide Sequence Number=SeqID_194177
atgatggttcctgactatttaatcagtgtgttgctaacggcccacaacagtgaaaaatttctgcctgacacgctggcgagtttagaaaaggcctgtcatggtgttgagcagtatattgaatttattcttatcaatgacgcatccgtcgacaacacagcagcgttactcgatgatttttcccggcggcatccgcaggcgaaagtatttaatattgattaccgcaacattggccgggtgcgtaattttggcgttcagcagtgcagcggtgaatatattacgatgctggatggcgacgatcagttgctggccgacgccctcgccgatattgtccgctacctgaaaagccatcgtccggacgcactgttcacggcgcttaatgaggtatatgaatcccggcctgagcacatcacgtggcagggcctgcaggcggaaacactgtcacggcatcaggccattgaaaaattcctgatccatcgcgatttgcaggcacactttatcggtcagtttattaagcgcaccatgctgctggcacatcccttcccggattatacctgctacgaggacgcctggcttttcccggaaatcctggtcagcagtgatgcaatcgcttatagccgccagagcccttatctctattttaaacgcggcaacagcttatccagccagctggataaacacaaaatttcactcttagtgagcgcaacgcagcatatggatgag

SEQ ID NO: 77400 - DNA, 192 bp, Glycine max
  Peptide Sequence Number=SeqID_194178
atgcacttcaaatatgctccaacaacaatggaagcctcagacggccattgtgaaagaggggccacgcgaagcaaacaacaccggcaacacggtggtggacagcaagcgatgaagcaatggaaagtgggcagtgaagtcgcaacgacacagggaatcgaggcacaggcacatggattcgagagacggttttga

SEQ ID NO: 77401 - DNA, 303 bp, Glycine max
  Peptide Sequence Number=SeqID_194179
atgaagaagagaacggaagatgaagaagacttctcactctttgtgaagaagttcaaaaatttgtcaagaagagaagaattgagaggcatgctacaaatgcgaccaacttggtccatcaaagcaaattgtccctcaaatgaggaatggcctgagaagaatgataagaaaaagtatgaagaaagaaggaccaagaaggtatacattgcatgggatgacaatgactcattcgatggttcggagaaggaaatcaaccttctaacaagggactatgagagtgatgagaacatctctcaagaagattaa

SEQ ID NO: 77402 - DNA, 884 bp, Glycine max
  Peptide Sequence Number=SeqID_194180
atggcaaggttgatacggtcggtctcggccacggcgttcagcacgggggcggaacagattgccgaaatcctcggtgcgaaatcccgcgcagaactcgagtacatctgctccggcatcaaccaccagacatggttcatcgatctgcggctcaatggccgcaagatcggtaaggaggagctggttgccgcgtttgaggcgcatccggtcttctcgcagcaggagaagcttcgcatcgacgtgctgaagcgcttcggcgtctattcgaccgaaagcaacggccatctctccgaatatctgccatggtatcgtaagcggccagaggaaatcgcccgctggatcgacatgtccgactggattcacggggaaaccggcggttatctccgccactccaccgaaacgcgcaactggttcgaaacggaattcccgcagtttctcgcctcggccgacaagccgatcgatccggcaaaacgctccaacgaacatgcaagccatattcttgaggcgctggagaccgggcgtgtctatcgcggccacttcaacgtcaagaacaatggcgtcatcagcaatctgccggcggacgccatcatcgaatcgcctggttttgtcgaccgtttcggcatcaacatggtttccggcatcacgttgccggaagcctgcgcggccacctgcatggcgtccatcaacgtgcagcgcatgtcggtccatgcggcagtcactggcgatatcgatcttttgaaactcgccgtgctgcatgatccgctggtcggcgccgtcgccacgccggaggaggtctggcagatggttgacgagatggttgtcgctcaggcgcgctggctgccgcaatatgccgatgccgttccggcggcgaaggagcgacttgcgaa

SEQ ID NO: 77403 - DNA, 176 bp, Glycine max
  Peptide Sequence Number=SeqID_194181
cgcaagtcttttcgcttagcctaagggttaaaggcggtgtgcttagcaagttcactctcgctcagcgcctctttacagcttatccttcttccagattcttatgcgcccttagccggaggatggtgcgcttagcggatgggtcacccagcgcgtggcatggctcagcgggttcataa

SEQ ID NO: 77404 - DNA, 355 bp, Glycine max
  Peptide Sequence Number=SeqID_194182
atgctgacatctctggaaagggcacagacgaccacattggtctccgcttgtccatcaaacttggggtccccaaatgacaaggtgcagataaccataaggcgtctccgcatgctaccagactcacggtctcggttggaagatgctaacatctccggaaagggtgcagatgaccacattggtctcttcgtgtcaatcgggcttggggatagcaaaatgtgtgcacggataaccatcgggtgtctccgcgtgccacaggactcacaggtcacgatagcaaaaggtggggtggttgacaaaagcggggcttttgctcttatgtatcctcaatttgtgatgaggaactcagacctacgta

SEQ ID NO: 77405 - DNA, 909 bp, Glycine max
  Peptide Sequence Number=SeqID_194183
atggaaatttatgtgagtgatcgactaggaaaaagtgtgtgtgtgtgtttcttgatttcagaagttgtcatcatcaaaaaaggggagattgtagaagcaaagcttcatgatgaatcaagattgattcaaatatgttttgatgataacaaagatgatgacaaaaagctcaaaggtcaatcaaagaatgagttcaagatgttcaagatagaatcaagaacacttcaagatattagaggaaagttgatttcaagaatcaagagaagtcttaatcaagataagtatgaaaagtacagggtacatctacttgggttgttgactgagaacaagagagggtacatctcttgtggatcagttctagtggagggtacatccactaggttcaaagagaacaagggagggtacatcccttgtggatctttgcttgtaaaaggatttttacaagatgaaataatctttagtgcaaccttagaaaaggcgtgcaatgagttttttgagctaatgaaagatgaatttgaaatgagtatgatgagtgagctaaagttcttcctagggcttcaaataattcaaaaagatgatgggatattcatccaccaagagaaattcacaaaagacctactaaagaggttcaaaattgatgaagctagatctatggctacccttctgcatccttccacagttattgataaagacaagaaaggtaattatactccagaaaaggagtatagagggtttgagattgatcttgtgcattattgtgatgctgattttgttggcgataaagtagaatggaaaagcactagtggtgcttgtcaatttcttgaaaaatcactggtgtcttggtcatctaagaaacaaagcacaattgctctcaaatcatttggatcaagcaacaaattctggattgtttaa

SEQ ID NO: 77406 - DNA, 472 bp, Glycine max
  Peptide Sequence Number=SeqID_194184
agaacaggggagggtgcatcttttatggctctttgcttgtaaaggattttacaaggttattggaaatctcaagaaccgtgggttgcttggggactggatgccacttgatccaacaattgccataacagaagccaagaatttgaaaactttgggtatggatgaacttattggttctctgaaagttgatgagaaaaagtcgatgaatgagatgcaaatacctaaaggggagattatagctctcaaggcttatcaaaaaaccaagacaaagcatcaatgcaaagcactaagctcaatagtagtttttgatgttgagaacaattatgatgagttttctgaagaggatgaagaagaactatcattcttaacgaaaagagtgcaaagatttcttagaagaaggaaagggccaagaagaaatttctccaatagagactttcaacaaggagaaagttttagagatatcagatgcttttag

SEQ ID NO: 77407 - DNA, 699 bp, Glycine max
  Peptide Sequence Number=SeqID_194185
atggcaatcaaaaacccttcaaactcatccacctctaatagtgagacttctcactcaccctctcctaaaaaccaagacaaaggcaagggcaaggctatccatatttcatttgggccaaattttgaagcaaccatgaccatcacacccctttgtgccaaagtgattgtcattgggtctcccaaaaggagaagcttagtgaaggatgaaaaatatggaaggaagaggcaaagacctgaactagttaaggtcttcttcttaggagcagaagtggactacaacaacttcattatgaatactaccataaagggaattgagattatgatcttagaacacattttggctgacattctgaaggttcttagagacaactcaagactttatgatgaatgtctcgaggtccagggacatagaagaacaaagaaggttcccctcagcctacctcacctgatcattaatcatttgatcaaggcaaccaaacccatcaaatccacttctaatgttccttatggaatgttaatgactcttgtgttaagacattttggattttctctgcatggtaaacttattgatgacgatgttttatctttgggtgccaagaatgttgctactttgaagctctctcctcaacctgacatggagaaagcttgcattttttatgaagaggaggatcaaaataaggagaaacataaggaaaagtag

SEQ ID NO: 77408 - DNA, 216 bp, Glycine max
  Peptide Sequence Number=SeqID_194186
atgccgacggtggctttggtggttgtggtggacatggtggtgggtgtggcagtgggcgtcaatgctggtgagaggcagagcaagagactgaggggtgaaaacgcgaacggcgacgagaacggcgagtccaagaaagatcttgatagagatagagagagataccatgaccgcgaacagtcctctggccgttacaggagtgagagggagagaaactaa

SEQ ID NO: 77409 - DNA, 327 bp, Glycine max
  Peptide Sequence Number=SeqID_194187
atggggagtgatgctgatttgggtgcgggactaggtggcttgggtgcggggcatggaatcaaggttggcagaggaaggggagtcagcattggggcatctgtcggtggtggctgcaccgaagaagaaaatggggagcgttggctggatatcatgagttcgaaatccatgggagcttgggttgcagcgaagttagtcatggcgacctcgaggcggtccagtttggcggcagaaggtttggcatctgccattgaagagcggcagagaaggggcaggtcggaccaaattgttacgaacagagtctacactaccaaactaaactacaagtaa

SEQ ID NO: 77410 - DNA, 324 bp, Glycine max
  Peptide Sequence Number=SeqID_194188
atgactaaagcacgtcaaaagggggtaccgaaaggaaaagagggagaagcttgccacccagctcgcccaggcgagctaggttgcttcctccagaaagcaccgccttctggaggaacttcctggaaggcccaagtgggcctagttgctatttgcaccccttcatgttacggaacttcacggatcgtgcaacaatgctctcttttgacttctggcacgttatggaacattacgtattgtgcaacaatgggtgccaagtacctcgaagcagtcaagcaaaggttgcatgccatcaaacaatggtccccggacgaaattagcgtatga

SEQ ID NO: 77411 - DNA, 243 bp, Glycine max
  Peptide Sequence Number=SeqID_194189
atgtttaggtttagaataggtagcaaaatacctttggcaattttacactttgggtgtggtagcaagatactaggatgtattagaaataccagaatgtgcacgtatgcaatttttgatagccaaagtgctttgagtatgcatgtatgtaaatttagcaaaggaaatgcgtgtgatgtaggaaatggcctcgaggaagcttgcctcaaagaggtccaggaaggacaaggcagccgaaggaactag

SEQ ID NO: 77412 - DNA, 210 bp, Glycine max
  Peptide Sequence Number=SeqID_194190
atgttagagaatggtggaaaaataaaggttgaaggcatagggagcatgaggatgaagctttataatggtgctattcaaactttctcaaatatgacatcacaagggtacaagtacgttggttcaaaatgggcatgcaaggtgtacagggggagacacttggtattgcgaggaaagaaaaataaaggcaacctttgttgtttagatgaataa

SEQ ID NO: 77413 - DNA, 564 bp, Glycine max
  Peptide Sequence Number=SeqID_194191
atgacatttttaggagaaactaacagtcagacgattgtcaactcaaggttgggtttcatttttccaaatggatcgattattcacaatgatagtggggtttacttccaaacttccactccggtgcccattcgagtaccaaacagctgtgattttgcaacgctgaaaactagaatacacatcacccttaatctaacctacgaagtatttttggatgaaattcactaccggcagccagtcaaagagacatgtaactattttctctttcaatgtatgcaattgaaaaatgatgacgatgtcaacaccatgttaatgtgtaacgatcaattttcgtgtgttggtccgattgaattgttatgcactattggtagaacactagatgaaatattaaacttacttgaatgcactatgacccatactcatgacgcgctcttgtattacaacgggaggtggaacatgccacgccagaacaactttttaggttacgcattcacaggaaaaaatccaaagaaatttgaaattctttcaggatgtaccatcgatgaactgaaggatttgataaagcaa

SEQ ID NO: 77414 - DNA, 117 bp, Glycine max
  Peptide Sequence Number=SeqID_194192
catgcggaaacaccttctggttatccgcacctcgtcattcggagaccccaagttcgattgacaagcagaggccgatgtggtcatctgcaccctttccggatatgtcagcatctcccg

SEQ ID NO: 77415 - DNA, 255 bp, Glycine max
  Peptide Sequence Number=SeqID_194193
atggcaagtcaaggggattgggtcccgtttatggatgtgttagcgttgctaatttttggggtcgtcctctttccaaacatagatggtttggtggacctagcagcaatcgacgctttccttgcataccaccatagcaaggaaagtccggtggtagctgtcttggtagatttatttgacacgtttgaccgaagcaagacacgaggcatccatgtccgctccagagccatcgctcgtgtactgaaaaaagaagaatag

SEQ ID NO: 77416 - DNA, 216 bp, Glycine max
  Peptide Sequence Number=SeqID_194194
atggttgcctcctttggttaccacaaagagcatgatggcatgatggctcttgggtttgatagacttcaaacctatgttggtgagaggtttgactctttggaacgtcaagtggacacacgattcgaggagatggactcaaggattacaaaggttgaaggagatgtcacctttattcgtgattgctttgacttaccaccaccgccaccatcagtttag

SEQ ID NO: 77417 - DNA, 1389 bp, Glycine max
  Peptide Sequence Number=SeqID_194195
atgcctaatctcaacacttctcatagcttcctccaaatgattgccaagctaccaaaacttagagaactgagtttaagtgaatgtagccttcccgatcagtttatccttccattgaggccctctaaattcaatttttctagttccctttccgtccttgatctttccttcaacagcctcacgtcatcaatgatactccagtggctgtccaacgtcacttccaaccttgttgagcttgaccttagttataacctcttggagggttccacatcaaaccattttggccgtgtaatgaattctcttgagcacctcgacctctcatataatatattcaaggctgacgatttcaaatccttcgcgaatatatgcaccttacattctttatacatgccagcaaaccatttgactgaagaccttccatcaatccttcataatttgtctagtggttgtgttaaacactcattacaagatttggatttgtcagataatcaaatcactggctctttacccgacctttcagtattctcatctctaaaatcattgtttcttgatcaaaatcaattaaggggaaagatacctgaaggcatccgcttaccgtttcatttggaatctctgtcaatccaatcaaactctttagaaggtggaattcccaaatcatttgggaactcatgtgctttgagatcactggatatgtctggtaacaatttgaataaagagctttcggtgataattcatcaattgtctgggtgtgccagattctcgctgcaagaattgaacataagaggaaatcaaatcaatggtacgctttctgacctttcaatattctctgccttgaaaacattggatctttcacgaaatcaattaaatggaaaaattccagagagtaccaaattgccatctctgttggagtctttgtcaattggatcaaactctttagaaggtggaattcccaaatcatttgggaatgcatgtgctttgcgctcattggacatgtctaataatagcttgagtgaagagtttccaatgataatccatcacttgtctggatgtgctagatattcattggaaaaattagatctaggcatgaatcaaatcaatggcacactaccagacctctcaatattctcatctttaaaaaaattatatcttgacggaaacaagttaaatggagagattcctaaagattataaatttccacctcaactggagcaactagatatgcaatcaaattccttaaagggtgtgctcactgactatcatttcgctaatatgtcaaagttaaactacttggagttatctgacaactctttagtgaccttggcatttagccaaaattgggtcccaccatttcagttgacgtacataggattgcgatcgtgcaagctaggtcca

SEQ ID NO: 77418 - DNA, 186 bp, Glycine max
  Peptide Sequence Number=SeqID_194196
atgtcaatgaaaaacctcatcgggcgcgtaggagtacatgacaagacagaccacacactgggataccagtcagggtcactctgttttgagagaacactccaaccatatgggagtgtatttacccccaaggcctacactccgaagagtccatcagggcttctccctcctaattcaggtccaacctag

SEQ ID NO: 77419 - DNA, 252 bp, Glycine max
  Peptide Sequence Number=SeqID_194197
atgttcggtgttgcctctacgatgttcagcgatgaacaaccctggctccagagaggtgacatccctggctccatgattatcgatgatgaacggtattggtgtgagagaaaaggttttggagaaaaattgagaaaagaaaacaaggcaatggggagaaaggatctcaaacatttgaagaaaggaaagagagaatggcttggggggagggggggaggttctagagatattaccgttgcctgtggaccattgtga

SEQ ID NO: 77420 - DNA, 279 bp, Glycine max
  Peptide Sequence Number=SeqID_194198
atgtctctgaaaccgtcgaattcgtcggagaatctgatgctcccggtgtctgatcctcccaagagccacgacgctgacgacaagctcttcaaaggctccgccatgaccaaacgcggagccttcgccgccgtctcctacatgtcctgcgccgttttgttggtgatgttcaataaagcagcgctttcgtcttataactttccgtccgctaacgtcatcacacttcttcagtttttcatttgttatatatcgaccattgttctccaaattattggactgtaa

SEQ ID NO: 77421 - DNA, 357 bp, Glycine max
  Peptide Sequence Number=SeqID_194199
atgtcgatctccccctgcggaaggattgcacccacaaagacacccaatgaactcggtgaagtccaacagggccctggggtttccagctctggtgacgggcccctgttagtcctacagggtgcccgttccccccagcaagggatcgtgcccgcaagacacccagtggacccgaagaagtccaatagggtcttggagttgctagctctgattacgggcctctctttcatcaagaagtattgcgccctcaggcaggcgcagggcgaaacaccacaacagtctggggatggccgacagcgggcaacagacgcaccgccaccacctctagagttcacctcagctcatccacaaaaaggttag

SEQ ID NO: 77422 - DNA, 396 bp, Glycine max
  Peptide Sequence Number=SeqID_194200
atgagctcacaggagctctatgcagcaaaagagaattttctcctcacggttgattacatggggatatctaataccatgttgagaaacatgggagagcccaaattagagagaaagaggagactaactaatataaccatcatcttaactatttcaaccaatccaactatccctaataatgacatgaatatcaaaaacataaaatcagaatatataaaagcgataaaggagtgcacattagactccatggcattaagtggaaaaggtaaaacaacaagcaaggcatacataccttcagattaccacaaattgtctgtgtcacagctgaatttagtgttgtgttcagaaaaatacagtaattcaagaagaatgccagcacgcaggaaaaaagcaaaataa

SEQ ID NO: 77423 - DNA, 378 bp, Glycine max
  Peptide Sequence Number=SeqID_194201
atgatggtgacatgtcgacttaacggagctgacacgtatgacttgatggatggagtagtggacgtggagtatagcattagcacactgaacttcaatttcaacaccctgccctttcttttgtcttctattattcaaccaatcgttacttgcgtccatggagtggcaatctttgtggctgcggcagcatccaagatttcagctgcaaacacacaaccagatgaaaaccttaaacaaaaattctccaaccagcttctcaaacgaggttgtcatgtcgatgaggacgccaccggggtagacggcggagagggtgccgaagaaggggtggaggacgtcggaggggtagccgacgaccgagaaaatgacatcagagcaggttga

SEQ ID NO: 77424 - DNA, 378 bp, Glycine max
  Peptide Sequence Number=SeqID_194202
atggaccacttactcaattggtccattgtggacaagcatttaaagccattggatgcaactaagggaaggaccaccgaaggtgttggtggcagttcgctatgtcagaggtggcacgacgggcgtcgcgaactcacagagttggcgcacaacagagaaggacatcacaaaccagtacttgttgagtttgtttcatcaacaaaaatagtgattgcgatgatgatgacgagaggaaatcagggctggtggtggtggtggtcaccggagagttgcagcacttgggggaatggacttggggaggaagagagggggaaaagaaaacagagctccaccatcaacagcttgtggcaattgacggcgcaaatccagaaaggaacatag

SEQ ID NO: 77425 - DNA, 121 bp, Glycine max
  Peptide Sequence Number=SeqID_194203
gtcaagtatctttgatgccaaggctggcattgcactaagtgcttcctttggtaagctactttcgtgcaaccgagtattggaccttatagagcacatggcattggtgggagctcaaaattga

SEQ ID NO: 77426 - DNA, 260 bp, Glycine max
  Peptide Sequence Number=SeqID_194204
ctctagttacgagcctctatcagtcctacagggtgctcgtaccccccggcaaggtcatgccatcgcgacatagggatcacacccgtaggacacctagtggacccaaagaagtccaacagggtcctggggtttccagctctgattacgggcctctatcagcaacaggcaaaaaatgcatcgccgccacctccagagcccctcagctcatccacaaaaggcgaccaagtccaaagccaaaggacgcacctagttgctcatga

SEQ ID NO: 77427 - DNA, 308 bp, Glycine max
  Peptide Sequence Number=SeqID_194205
atgcctgtgatctatatccttcaatccttataccaccaactgcttgccactgaagggcaagcagttggtggtataccccttgaaaacacttcggaaggccctcagtatcacccacaactacacctcttgcattccacaacaagtaaaaaccctcatgctatggcagaaatgggaaagttggaccatctagaggaaaggctcagggccattgaaggaggtgaagattatgcctttgctaacctagaagagttgttcctagtacccaatatcatcacccctctcaagttcaaggtgctggactttgacaa

SEQ ID NO: 77428 - DNA, 288 bp, Glycine max
  Peptide Sequence Number=SeqID_194206
atggatacctcgtctactggaagcaggaatgattccattgaaggaggtaatcttgttgtcatacatgatgtggagggcactgcacgcagtggcattgagggtgaatgggtaatcatgtttgttcagaagggttccaattgggaaagattggaaaacgaaatgatgatgacaaatttgattgtggaaggaaaggaagttgagaagggattagatgcaaaatttttggcctttgagcatttgaatatcattattgtcgttaacttcaaactaagggaaggaccattttga

SEQ ID NO: 77429 - DNA, 279 bp, Glycine max
  Peptide Sequence Number=SeqID_194207
atgtcaaagcagcgcgtggaggtctggttggcatgggatccatttggcatccacgatggtggtgtgacgtcgtggtggaccgctctgtcgggaatgacaaatcgagttcgtacatggttcgaggatggtgttggagatgacattgtgggaaggattaagaggtgggggaagggaggcaagaacaatgacagagttgaaggaaaagatgccgaaagaagagtgcatttgtggggtcggagagttggagtttggcatcaaaagaggaagagacagtcttga

SEQ ID NO: 77430 - DNA, 1296 bp, Glycine max
  misc_feature (1268)..(1268): n is a, c, g, or t
  Peptide Sequence Number=SeqID_194208
aacagcgaagctctggaacacttcagcgagaagctggaagtggaaggacgcagcctgtggcaagacgcgcgccggcgctttatgcacaaccgcgcggcggtcagcagcctgttcattctggtgttgatcacgctgtttgtggtgctggcgccgatgctgtcgcaatttgcctacgacgataccgattgggcgatgatgtccgccgcgccaagcgtggaatcggggcactatttcggcaccgactcctccgggcgcgatctgctggtgcgcgtggcgatcggcgggcgcatctcgctgatggtcggcgtggcggcggcgctggtggcggtgatcgtcggcaccctgtacggcgcgatgtccggctatctgggcggcaaggtcgactcggtgatgatgcgcctgctggagatcctcaactccttcccgttcatgttcttcgtgatcctgctggtgacctttttcggccagaacatcctgcttatcttcgtggcgatcggcatggtgtcgtggctggatatggcgcgtatcgtgcgcggccaaaccctcggtctcaagccggcgctggtgtgcggcgtctccacgcgcaatatcgtgctgcggcatatcgtgccgaacgtgctcggcgtggtggtggtgtatgcctcgctgctggtgccgagcatgatcctgttcgaatccttcctcagcttcctggggctgggcacgcaggagccgctcagcagctggggcgcattgctcagcgacggcgccaactcaatggaagtttcaccgtggttgctgctgttcccggcgggagtgcaatcatgagcaccattgaacatcctcaactgcaaaccggcgccggcgtcaaaacgtcgccgctgctggacgtgaaagacctgcgcgtcacgttctccaccccggacggcgacgtgacggcggtgaacgatctgaacttcgacctgcgcgccggcgaaacgctgggcatcgtcggtgaatccggttccggcaaatcgcagaccgcgttcgccctgatggggttgctggccagcaatggccgcatcggcggttcggccaaattcaacggccgtgaaattctcaacctgccggaaaatcagctcaacaagctgcgggccgaagagatctcgatgatcttccaggacccgatgacctcgctcaacccttatatgcgcgttggcgaacagctgatggaagtgctgatgctgcataagaaaatgagcaaaagcgaagccttcgaagagtcggtacgcatgctcgacgcggtgaantgccggaagcgcgcaagcgcatgcgcat

SEQ ID NO: 77431 - DNA, 132 bp, Glycine max
  Peptide Sequence Number=SeqID_194209
atgaagttcctctactatgatgatgtgacgccagctaattatgaccctcctttcttcaagggatgcactaatgaagaagcaactatgacgtgtctacatgttgggttctccactccattggatcagatttaa

SEQ ID NO: 77432 - DNA, 255 bp, Glycine max
  Peptide Sequence Number=SeqID_194210
atgaggttcaagcggttcatggactcgtccaaatcagcgacctctcatgactcgggggctctgaaatcctctacagagctctccatggagaaactgcaaagagaagaaagggatttgtggaggcaccgctactctgactgccgcgattgctcctacgactacaaggctgctaggagagaggccatagcgagagaaaaccctgtcgtgaaggccgcaaagatcgtcaaggagatcccttccaaggacatgccctag

SEQ ID NO: 77433 - DNA, 420 bp, Glycine max
  Peptide Sequence Number=SeqID_194211
atgaaggaagtgagtggtattagaataataccgaatggagaaatagcattgaggaaaatgtcgatgataatcagctcaataatacaacaaatgagtggcctgacaacggtttgggaaaacaaggatggagaaaactctcgtctgcaagattctcatgaagtgtggcaagaagatggtggcttccaagaggccgtggaaaattggttgggaggaccttctgatcatgaaagtgctccagttggtagaatttgtggattttattttcctgaagatgacaacgtgtacagtgttgaactcagggaacttcttaataggcaaggtcatgctaacattaactgggaattgcaagaaacaactctttcttctgcctcagtagagcaggaccttgagcaacatagtagggatcaaattgttggttag

SEQ ID NO: 77434 - DNA, 216 bp, Glycine max
  Peptide Sequence Number=SeqID_194212
atgaaaagtcctcctggagaggagaaagccaagacgattgcagcaaatgaagagaaaagtaccttgtccagtgatacaagtgatgctgtgctgctgaatgtggttcttccttcagataagccaagtgaagaagtgtctcatgtgaatggtgacatagcagttgaagagaatcctcagctctccttggcaaaagaacctatcatggcagcgcattga

SEQ ID NO: 77435 - DNA, 204 bp, Glycine max
  Peptide Sequence Number=SeqID_194213
atggcaagaatccaagacacatcactccattcaccaactataaatacccttccagagttaagccaacagaacctcccttgccaagagtaccgttgtactaactcctccaaatgcaaaataaatgtcacctctagtaattttgagatagatgagctttccaatcaatgttggatatctcaagatctaaataaggctcttgattag

SEQ ID NO: 77436 - DNA, 453 bp, Glycine max
  Peptide Sequence Number=SeqID_194214
atgaaatttcaaagattacccggacctgtcggccaaggctatagactcgttgaatacatcagtgtagcgcgcgtgcggcccagaacatctaagggcatcacagacctgctgaggtctcgttcgttaacggaattaaccagacaaatcgctccaccaactaagaacggccatgcaccaccacccatagaatcaagaaagagctctcagtctgtcaatccttactatgtctggacctgcacggaggcacgacccggccagttaaggacaggagcgcatcgccggcagaagggacgagccgacccgtgcacaccggaggcggaccgatcgacccaacccaaggattgggtaatttgcgcgcctgctgccttccttggatgtggtagcccgtttctcaggctcccctctcccggaatcgaacccctaattctccgtcacccgtcaccaccatggtag

SEQ ID NO: 77437 - DNA, 181 bp, Glycine max
  Peptide Sequence Number=SeqID_194215
gttaattaggcaagtttgtgaagtgctgattttcaccttctcgctaagtcaagatgttggcttagcgagccatccgctgagcgcaacactcctcggcttagggcgaggaagaatctggaagaaggatgagctgtgcatttgtgttaagcgaggggtcatccagcgaagcgcaccgctttaa

SEQ ID NO: 77438 - DNA, 495 bp, Glycine max
  Peptide Sequence Number=SeqID_194216
atgggatcgagtcaaaagccttcgcttaaaaagaggttctatcaagtcaaaatcaagagcttagaggtcactagtttacgagagttagggcgattgatgggtcagcttcagcggcaagctttccgcaaagcctatgggttagtggacctagcagtgattgacgctttcctcgcctttcagcatggcaaggaaagcccggtcgtcgccattttggccatgtatgacacgttcgaccggggatgtgaaaagagcggcgcaagaattgtttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctaacatggaggggcgtctgttaattggttccctcgctagaaggaaggaagaatcaggattctatcttcatgcgaaggatgtccaaatgttcccttga

SEQ ID NO: 77439 - DNA, 546 bp, Glycine max
  Peptide Sequence Number=SeqID_194217
atgtctaagcataagatgataaatgataagtgtttagtatgggctttctccaatgtagttcccaggaggattatagaagcaaatggtcaagctagcctgttccttcacacacgtcgctcgagcgcacccgagctcaagcgactttctccacacaacctgcgtgtagacgccgcaccggtggttggggacgcaagagttgtcggcgtggttgtagaactgcttctgcttcacccactcctcaaccgccatgcgcggcgtcaccgccgtgccccatgccaagagctggttcgcgccgtacttgccggtgctcaggttcgcgaactcgcaccccagtttgtcccgctggtaccgcgccagcttgctcgtcacgttcgccagctgctcgctccaccgcagcggttccacccccaccgccgccctcgcttggttgtgcgcctccagaactctctagcctccgcggagagctccggtgccaggggcggagcttccgcctccgatgacacgtggaacgtggccactgcagccagcaaaaacaatgcaccatga

SEQ ID NO: 77440 - DNA, 324 bp, Glycine max
  Peptide Sequence Number=SeqID_194218
atgtctcctccacctctagaaacctcacaatcactcaaaatttcatccaaagctctacaaaatggcttcctcgtcaagctcagctatctctcagtctttccacagcgcgagatggctcgcttagcgcgcataagtggcttttggcttagcgctcatcttctcgctcagctggaggatgcaggcggtgcgctcagcgagttggcactcgctcagagcgcctgtacagctcatccttcttccagagtcttccatgtgctcagccagcagatgtcgcgcttagcgaattggtcgttcagtgcgagaaacgactttgcggatcaatga

SEQ ID NO: 77441 - DNA, 918 bp, Glycine max
  Peptide Sequence Number=SeqID_194219
atggcggaatcatcctttctgcaaccctctattcccaaatttgatggtcattatgatcattggtccatgttgatggaaaatctccttcgttctaaggagtattggagcattattgaagatggaatcgtggtagctcctgccaattccactgccgagcaaagtaaagcagctgatgatagcaaactcaaagatcttaaagccaagaactatcttttccaagccattgatcgcacaatcttggagactatcttgaacaaagaaactgctcgtgatatttggacttcaatgcgccagaaatttcaaggctccaccaaggtaaaacgtgctcaacttcaagctttgagaagagaatttgaaattctttctatgaaagataatgagactgttaatgagtatttttcaagaactttagcaattgcaaataagatgactgcgcatggtgagtcaatgggtcaaactaaggtggtagagaaggttcttaggtccatgacatcaaaattcaattatgttgtatgttcaattgaagagtctaatgatgtcactgctctcaccatcgatgaattgcaaagtagcctcttagtgcatgaacaaagaatgcagtatactcttgagaaagatgaagaacaggccttgaaagtctcttctgcaggaaggggtggtaatcgaggaagagggaggaatggtggtagaggaaggggtaggggaagacagagtaaagaacttgttgaatgctatagatgtcacaagcttgggcattatcaaaatgaatgtccaacttgggaagaaggagccaattatgctgaattcaatgagaaagaagaggtgttgcttatggcacaagaaagctcgaaagaagaggtgtatgatgagtcaaatgtggaaatgtggtttcttgactctgggtgcagtaaccatatg

SEQ ID NO: 77442 - DNA, 339 bp, Glycine max
  Peptide Sequence Number=SeqID_194220
atggcacctgctctaggaatgatcctaagaaagagcacgaaagtgttagcaatcagttgggcaacaaggcaagtccttctggaaaacagggtccttgagcttagtgagtctcatccgctaagcgagacatcagcccgcttagcgtgtaagaggaatttggaagggaatctaccatgcaagctcatgctcagtgtgtcatctgctcgctcaacgagtcatctatctcttttggagctgagcgtgcctagcttgctaagccaaagttcacttactcgtgctaagcgtgaaaatggcgctaagcgagccttcgaggacagaaagccctttttaaagcctgaa

SEQ ID NO: 77443 - DNA, 881 bp, Glycine max
  Peptide Sequence Number=SeqID_194221
atggatttgactttatggagggtcaaagattttcgggaggtatcattattgcttggaaaaagaataatgttaaccttggaagttgctcaaacgcattttcaattcttgcatgttaagattatcttgcaaggaggtgctacttccatgaatgatagttggatgattggaggtgacttcaatgatatagtgtgtaatgctaagaagaaaggaggagcattagtgtttcttaggaaatgtcagatatttagagacagaatcaacagagccaagcttattgacctaaactctgtagggcctgcttacacttggagaggaccaaagttcaatggtcttcaaagagtgtttgagtggtcggaaagagctttgagcaatgattcgtggagattgatggacatttatcttagacctttcaagtttgaatgtgccaggaccactcaccattcgcttgaagatgtgcatgatgtctttggggaaattaaggttaaaaagagaatgttgatgactcgtattgctagcattcaaaagaatactcgttactactatcaccgcaggaggaaaaatagaatccacatgcttagaaaccatgttggaattttggttaaggatgagcaagaagttaaagtgaaggtgggtcttcctcagaatctcatctcactccttatgagttgcattactacggtggaaaccaatgtcaagttgaatggtaaaagttcttatatgtttgctccacatagaggtttgaggcaaggtaacccgctttctccatatccgtttgtcatgggtatggacaaactttcactccttatctctaaagcggtggatgatggtctttggaagtcatttcatatgggaaggcatagccctttaatctctcacttgat

SEQ ID NO: 77444 - DNA, 597 bp, Glycine max
  Peptide Sequence Number=SeqID_194222
atgatgaaatgggcagacctaattgatcaacacgtagaagaaattgcagcattggatgccattgatgctggaaagttgtaccatctgcttaaggctatcgaagttcctgcaacagcaaatactatacattactatgcaggtgctgctgataaaattcatggagaggttagcccttccttggctgctggttgcacaatggtcctcaagcctgctgaacaaacacctctctcagctttgttttatgctcatctagctaaactggctggaattccagatggagtgctcaatgtagtgcccggatttggcgcaactgcaggtgctgcaatatgctcacacatggacattgataaggtcagttttataggttcaacagaagtagggcgtgaagtaatgcgtgctgcagctaatagtaatttgaaaccagtttcacttgaactaggaggcaagtcacccttcataattttttatgatgcagatctagataaagcggttgagcttgctctcgtggctgtagtatataacaaggttgacaaaaaacaatttaaaaaaattctttcctatatcgagcatgaaaaagagaaggggccacccttttga

SEQ ID NO: 77445 - DNA, 411 bp, Glycine max
  Peptide Sequence Number=SeqID_194223
atggaaggggcgagacagggtgaggtggagacagtctcgccaatgggaggggcgagacaggctgatgtgatggtgccgccagtgcttgtggcaatacatggagaaggaagaaaatattatcgatattttcaccgaatttccggcgaccggccacccaccactccgccggttcagcagcccaacggcaacgtcactgccgctgtcaaccaacggccaccggccgatgacgtcagaggaaccgacacgccaccggaaaaggtgccgcggcgcgttttaccggcaaatttcgcgccaaacgagaaagaatctggtccctccctgtttgaaagcatcatgcacaaatttgtcaaggtcgacgacaacgaaagagttactcagaggtacgcttcgctattttccttctccgactag

SEQ ID NO: 77446 - DNA, 384 bp, Glycine max
  Peptide Sequence Number=SeqID_194224
atggggacgagaggttgtattaactataatcccatgttggccataagacagttaggctaccctatgagaggtgcaccatcggagaaagtcatcacacctttcatcacgggaggcttcaatgaagctaatgcaaagatacttcagaaaatctctaaagcatggaatagagtgggaagaaaagataaggagcttagaggaagtagcaatgacgtcatcaacggctatcacaagtggttgaagtctagaacacaagggataacttggctcccaaagctaaaaagtttaagtaggaaagaggctgaaattcctgaggaaagtgaaaaagtgcaggctttgaaggcagagctcgaaggtgaaagagaagttgaagacggcagtcactag

SEQ ID NO: 77447 - DNA, 597 bp, Glycine max
  Peptide Sequence Number=SeqID_194225
atggggtcgtatgtgaaagatgaaaagttgctaatgcatttcttccaggaaagcctggatggggcaactattatctggtatactaacctgaaaccctctcgggtctgctcttggaaggatctaatggatgccttcattaggcaatatcaatacaactttgagatggctccagataaagtgcagctacaaaacatgtgtaagagagacaatgaatcattcaaagaatacactcaaaggtggaaagacctggctgctcaagtagtaccccctatggtagagagagagatgacaactatgataatggacacatggccagtgttctattacgagaagatggtaggttacatgtcttcgagttttgcaaatctactgtttgttggtgagagaattgaagtaggtctaagaaaaggaaaatttaattatgttacttctatgaatcctagtaataggggacctgggatgagtggcgagaggaaaaaggagggagaatctcatgttgtggctgttgttcccacatggccaaaaattccacaagccctttatagtcccatataccgatatcctcctgatatgccattattttctcctatttcttaa

SEQ ID NO: 77448 - DNA, 228 bp, Glycine max
  Peptide Sequence Number=SeqID_194226
atggtcaagatccttgcggaaattgatgacattgacgacaatgacgacgcaacaaaggttcttcatgatgttgatgactatgcaatgaatgagacgttcattgagtggaagacacaacacgggaactcaagcttgaatgactcaaccttgtcaaccatcgtgcagacttgctttttcccgtcgccatctccgtcgcaccaatcagttattaagtcactgaaaaaatga

SEQ ID NO: 77449 - DNA, 561 bp, Glycine max
  Peptide Sequence Number=SeqID_194227
atgaatgcgaatggaaacgtcacgttactggcatgtggtagagctggactattactgagagagaagcacatacacactgttgttaaagattataagatagtgatgaagaggaaattcatttcggtggttgttttgggagtatgtttggtgctgggaatatcccaatatgttgatgcaagaaacttggaggaaaaatcaaaggaagaggtcaagaagccagaaaattgcttagatggagggtccattggtggtgttggaggaattggagatgtgggtggaggtggtggtggtttaggaggtggctatggaggaggagctggaggtgatagtggtttaggtggtggatatggaggaggagctggaagtggtggagtgggaggacttggaggtggtagtggtctaggtggtggaattgggggaggcatttacaaaggaattggaattggaggaggcatttacaaaggaattggatttggaggggttggaggtggtgtaggtgctattggtggtattggtggtgtcattggtggtttcaagcatgttgaagccaacaagccttga

SEQ ID NO: 77450 - DNA, 432 bp, Glycine max
  Peptide Sequence Number=SeqID_194228
atgtcatcaaaccgcatcaactatttcaactttgtgatttttgccatggttgatgagcttcatgagaagatgttggagtactcaaggagggaaaatgctgagagggaatcaaggagtacggaagaaacccttaagcttgcaatggagctgttgtcagatatgtacttgcagtcattgagacaaataaccgagagttcgggatttaggacattctggtcaggcatattgagaaggaaggacacatgcatgaaggctgatttgggacagtatggtccatcaactttgggtgaaataatccctgatttgttgagaaagatcataacacaaatgaaggaagagggaattttggaaccaagatatgtgggagattacatatacttagatacagtggatatatgccctcatctcaaggatgagttatttcccttatag

SEQ ID NO: 77451 - DNA, 267 bp, Glycine max
  Peptide Sequence Number=SeqID_194229
atgggggttcaaatagcaaccagacccacttgggccttccaggatgttcctccagaaggcggttgcttctggaggaagcaacctagctcgcctgggcgagctgggtggcaagcatctccttccttttcctataaaaaggggaaggagggaagaataaaaaggttcaaccctcgtgaaaatcgaagtcgaggcacttccgtaacgtttccgtgggtgatttcgcgaagattttcaaccgttcttcgttcgttcttcgatcttcaaccg

SEQ ID NO: 77452 - DNA, 399 bp, Glycine max
  Peptide Sequence Number=SeqID_194230
atgcagcggcgacttcttgttccatttttgtacatcggcgtgactaacggcgacatatgttgcaatgaagcccagaaagcccgacttggaggagctcccggggcaaatccgcaactaacgttaaccctttcctcctaccacgtgaataacctcgagaaggttttagtttgttcagacttggttcgcgacgcaaatggcaagcggctcagggttaaggcacctgtgaggatttatctaatctgcaatccttctagacgtttggtgactcatgtaatctacacatcactaccaagaagtccctttgtggtgaaggtagtgggttcgttaaggaaaaccacaggagccgtagtgcaagcgagtcttcacagggcaatcgtgtatggacccgaacctgggtga

SEQ ID NO: 77453 - DNA, 264 bp, Glycine max
  Peptide Sequence Number=SeqID_194231
atgggagaagggttgggtcaacatgctattggcaattccggcaagaatggaaaaaggcttgtggtggatggcgtggagagggtgcagagtgaagcaggtgaactgactttgggtatgggcgaaaggaaaacatggtgggttcggcatgctagagtacagacaattatgggtcatggaaaatggaggttccataacagaagattttgcaatggtagttgcatggttaccctagcggtggccggtgggggatgcttggataattga

SEQ ID NO: 77454 - DNA, 558 bp, Glycine max
  Peptide Sequence Number=SeqID_194232
atgttgagatcgaggacatggcactgcgtctcggcgtcgatctctccactctcaatctcgacgtcattcgcgtcgctcccggcgaagattgcagcatcgttctggtcactgaaacggaaccttagggttgcggtggtttaccaggaagagaatcttgagtttgagtctagatttggtaacatcattgtcgtggataacctcctcgtggttccgagggagaagttcgagaagctcgaaggagtggttcgaaaaatttatagtcaaattggtgttatcaaggaggatggcctctggatgccggaagttgagcttgctaaagagaagactcatgggtacaaattggaccgggcacacatatttgttgtgagcatgtttgatgactttgacagattcatgaaggtgcctaatgagtgggctccccctgaaactaagccatatgctccagggctcactaatgcaaaggccggggaccaatttgtgattcgtgctggttcagatactaaggttttgtggaatgatgccagacatttaaagccagatgttgttagtgccagttaa

SEQ ID NO: 77455 - DNA, 213 bp, Glycine max
  Peptide Sequence Number=SeqID_194233
atgagtgataaacgcacagagacaaattatgcgccctttatcattcaggagcagcgagtcgagtggaacaacaagttgggtggtaaacgcgtagagacagattctgtgccctttatcattcaagagcagcaagctgagtggatgaacgcgcatagacaaattctatgccctttatcattcaggagcagcgagtcgagtggtaaacgcgcatag

SEQ ID NO: 77456 - DNA, 1153 bp, Glycine max
  Peptide Sequence Number=SeqID_194234
gggattacacgtcctagcctttagaggactacacatcctcgccttcagagggctacaaaccctcacttttagaggacaacacgtcgttgccttcaggggactacacgtcctcgccttcaggggactacacgtcctcccctccaggggactacaggtcctgaccttcagaggactacacgtcctcgcctttagagggctacacgccctcacctttaggggactacacgtcctcgcctttaggggactatacgtcctcaccttcaaaggactacacgtcctcccctccaggggactacacgtcctgtctttcagaggactacatgtcctcgcctttagagggctacacgccctcacctttagaggactacacgtcctcgcctttaggggactatacatcctcaccttcaaaggactacacgtcctcgccttcagaggactacaagtcctcacctttagagggctacatgccctcacctttagaggactacacgtcctcgccttcgggggactacatgtcctcgccttcaggggactacacgtcctcaccttcagaggactacacgtcctcgccttcaaagggctacacaccctgaccttcagagggctacacgttcacgccttcagaggtctacacgccctcaccttgagaggactacacgtcctcgccatcaggggactacgcgtcctcgccttcaaagggctccaagccctcaccttcaaagggctaaatttcctcgccttcagagggctacacgccctcgccttcaaaggactacacatcctcaccttcagaggactacacgacctcgctttcagaggactacacgtcctcgccttcagagggctacacgccctcaccttgagaggactacacgccctcaacttcagagaactacacgtcctcgcctttaggggattacacgtcctagcctttagaggactacacatcctcgccttcagagggctacaaaccctcacttttagaggacaacacgtcgttgccttcaggggactacacgtcctcgccttcaggggactacacgtcctcccctccaggggactacaggtcctgaccttcagaggactacacgtcctcgcctttagagggctacacgccctcacctttagagggactacacgtcctcgcctttag

SEQ ID NO: 77457 - DNA, 147 bp, Glycine max
  Peptide Sequence Number=SeqID_194235
atgactaacggtgtaaggttggagcaagtgctgggtggagctctaaaagaaatcacatatttggagttaagcgacaaaggtgagagcctcaacaaaagtgtgttgtgtgtggagcctatggttgaggaaggagagtgcgaagggtga

SEQ ID NO: 77458 - DNA, 726 bp, Glycine max
  Peptide Sequence Number=SeqID_194236
atgcacgtcctcacctttagagggatgcacgccctcgccttcagaggactacacgtcctcgccatcagacggctgcacaccctcaccattggaggactacacgtcttcgccatcagagggatgcatgccctcaccttcagaggactacacgtccttgcctgtagagggctgcatgccctcaccttcagaggactacatgtcgtcgccttcagagtgctgcatgccctcaccttcagaggactacacgtccatgccttcagagggctgcacgccctcactttcagaggactacacgtcctcgccttcagagggctgcatgccctcaccttcagaggactacacgtcctcaccatcacagcgctgcacgccctcaccttcagaggactacacgtcctcgccttcagaggcctgcacaccctcaccttcagaggactacatgtcctcgccttcagagggatgcatgccctcaacttcagaggactacacgtcctcgccttcagagggctgcacgccctcaccttcagaggactacacgtcctcaccatcacagcgctgcacgccctcaccttcagaggactacacgtccttgcctgtagagggctgcatgccctcaccttcagaggactacatgtcgtcgccttcagagtgctgcatgccctcaccttcagaggactacacgtccttgccttcagagggctgcatgccctcagctttcgaggactacac

SEQ ID NO: 77459 - DNA, 1008 bp, Glycine max
  Peptide Sequence Number=SeqID_194237
atggctcccgatcggactcagctgcagaacatggttaaaaaggaaagcgagtcctttaaaaagtacgctcagcgttggagggacctggcagcgcaagtagcctctccaatggtcgaaagggaaatgattaccatgatggtagacaccttgtcggtgttttacaatgggaaattagtgggctacatgccctccagcttcgcagacatggtattcgtcggggaaataatcgaagtgggcttgaagacagggaagttcgattacgtctcctccacatgtaccaacgctaggaggatcggagcaactggggcaaagaggaaggaaggagatacccatgccatcacttcagcgcccgcatggatcaagccgccgcggatctcccacggtacccatcagtatgcgcaacatcacccgagcttctcagctcgcgccggggacttctccaactcagcacctgtacaaactagggcacctgtgcccatccagagggaggccccccaagctctggctccaatcccgactcacctggccggcaatgcccactttggcgccggttccaacgcgataaggaactttccctcgaggccaacattcaccctgatcccaatggcgtacgaagacctcttgccatccctcgtcgccaaccaaatggctatgatatctcccggaaggatctaccagcctcctttcccaaagtggtataaccctgaagaggaaatccctaccgaggggagagggcataatagggctttgcatgtgtcagtcaaatgcatagaccacgttgtggcccaagtggatccactcggtgggagtcgttccctctacactcccccaaaaatagaagttcgtagtggaggggcatttggtcattgtatcgggggaggaagacgtcttgccttgcctgtccgatacggcaatgatggtggcccgggtgatgttggggtacggctacgagccaggaatgggtttaggcaagaacaacggcagcagaaccagcttggtaagcattag

SEQ ID NO: 77460 - DNA, 345 bp, Glycine max
  Peptide Sequence Number=SeqID_194238
atgcgggggtccggggaatttgtccccttcttagatacgacgtctaggggtagcaaaatgccccaacgcacgtttttaagaaggcgacacggaccctccgttggtttgtttacagtagggatcaagacagaaccctccccagtggagtcgccaactgtcgcaacctacccttcggtgggagggcgacgcgtgactcgcgggatgcgtgttccacgaaaggaatacgcgcggagtcgccaccaacgtttatttgaggaaaacgtcggaaaaaccggaaaggacgcgatctacgatcttttaagtgaaaggttcgggagtcgtatttacgcacggggaaggtattag

SEQ ID NO: 77461 - DNA, 528 bp, Glycine max
  Peptide Sequence Number=SeqID_194239
atggcctgcacgaagaaaattggtcaaatgacatttgaagctacaaaggaaattgcaaacatgattggactcgcactccctcttgaggttgaggttggtctttttgctactcttatcagcacaaaggaaagttgcgttgatcatttggggcaggacccagaaacaagagacttaaacaaatgtggcttgtatgttgatgacaatcctccccaactagttactgttaaaagagtttatgaggggtccacaactgtacgcaacattcctttgggcaatgatcaactcaaggataagaaaatagttgagggaccgatgaaacctgtagatatgccagatcttgacgtcgatttgatgtacctgatgacattgatcattctgcaacttttcttgaggccgttgcagatgtcgtgggatgctagcgtgtttggggtgtataatgataacttcccattgtacataaagcatgaagatctttctaaaatagcttacagtggccaatgtttgagcatctttgttatacaattgtga

SEQ ID NO: 77462 - DNA, 591 bp, Glycine max
  Peptide Sequence Number=SeqID_194240
atggaggagaagaaaaagaaacatctggaggaagctgttatatctggaagcactgacactgtcattgatcctccatctcccatcaaacgacaagtgaagtggaagatggcccgcaccaacaaaattgggcaaatgacttctggggcagctaaggaaattgatgacaagatcgattctttggaggagcaggcctcacagggttcctttgtcgcccatggatgtaaggatgtactgactattgccattggacgaccagaataccctggtcgtgtgcgtgctgctggagtcggtgtcacgatcaaacaatactttggaccggctctaaggacctctcgcacgtctttgtccatggctcccaaagacctggagcaacttacacaaaaaataaggccccagctggaggagtctatcacagaaaaaatgcaatcacatggactcacactgcctcctgagcttgaggttggtccttcagctgctcatgtcagtacaaaggagagttgtgttgatcattcagggaacgatccaggtacgggtgactcagagaaatgcgagttgtacgtcgaagaaaatcctccttgcctggttgcctag

SEQ ID NO: 77463 - DNA, 153 bp, Glycine max
  Peptide Sequence Number=SeqID_194241
atggcatgggaccaagtcatggattcatgggcaagtgttatgaattgtcctacaaagtttgactatgaagaccgtgtgacaaattttaaagttgtaagtggaccacgacttgttgagtatgtcaatgggttgagtcggctcattggagcttga

SEQ ID NO: 77464 - DNA, 188 bp, Glycine max
  Peptide Sequence Number=SeqID_194242
atggaagggttagggatattgagaaagttgggaagcgcagggagcagccatgggcgtgcagaaagtaagggccttcagtacaatgggggtgccaacatcatgggaaagaaacacttggggattgagattatggagatctaccttgggaggggattgctgaatggggagctttatgatcacttttcaaa

SEQ ID NO: 77465 - DNA, 285 bp, Glycine max
  Peptide Sequence Number=SeqID_194243
atcgtgattgcagcgcagttgatccatgatcgcgtggtgatggagtgcctagaggttgagccggttcaagtgatagaggtgtcatcctctgaagaggatcttgaagaagacccagaggagttacctcctgaatctgatatggacgcccttgacttacctgaggatgatgaagacccactccctgatgttgattctccagaggatatcatgtcagcatctgaggcagactctacacaggagagtggccctggagggacaacgaatagtgacgactcttcatcgtag

SEQ ID NO: 77466 - DNA, 324 bp, Glycine max
  Peptide Sequence Number=SeqID_194244
atgacagcgatggatcttagccttagggatcccctgtatcaaaagtcttcctggtatgtggtgtcaagttcccttaagtggtggctcgtggtccatcggtgtttactctcctcgaatctccccaacaactggtatcagagccaggttcgacttggtgaccggctcagacaacgagcgtccgctaagcgcaacactcctgggctaagcgcgaggaagaatccagaagaagatgagttgtacaggttcgcgaagcgcaccgcttcagttcatccgttaagcgagagaaggtgcactaagccaaaaataagcggtccacctatttaa

SEQ ID NO: 77467 - DNA, 417 bp, Glycine max
  Peptide Sequence Number=SeqID_194245
atgacgcctttgattcatttaattgcacttcagaattcctaccatcgtcaagcgttttggctaacactgcttttaagtaaacaagtttctctccttcttcaaagtccactgactcctccatccagcactgttggtcaccactgcaagtggaagagaggatggtggtgttggaggcggaatacggtgcaagggacagatcgagatgacgccagattgggaatcgtggttgtggttcatgtagccgaagttgtcgatgaggtcagactaagagagaaactagaggaggacgtggtagtgaaggatgtcggcgagggcggcctgggagagatggtcgtcaacaacaaggtaggcgttatggacaacaaaaatggagagggaggagcagtccaagagattcgtgacgaggggcgtggctaa

SEQ ID NO: 77468 - DNA, 282 bp, Glycine max
  Peptide Sequence Number=SeqID_194246
atggttctaatgattataaaaggattgtttggaaggtacgaaagatggaaccctgttcatccaactcatggagccttttggggaatgggtgtgggcgttggttgtggtgtcggatggggtcctgggtttggccctgaagtgataggctatgttggagctggttgtggcattggattcaatgtaggcatcacttttgctggtgttggagttggcctacctgctaattttatctttgaaggtccatataatggtaaatggcagtcattaagtgaaagccattga

SEQ ID NO: 77469 - DNA, 447 bp, Glycine max
  Peptide Sequence Number=SeqID_194247
atggaagaacaccaacaagaacagcaccaagcaagcagttctctctccacacaagtattcactctctcggataacaagcaaactcgaaagcaaggatggaggaatgcaggcaaacaattgaaggccataaaccagattataaacgaagaacaacccaaaacgccaatggcatcagcgacttcagcaggcgcaaatcgccaatgggagttgcacaaagtgccaacaacagtggcgtgtccctgggctgaaatcgccagcagtgctggcgcgtccgtccagccttcgacacgtgtccgccatgcacgaagtcaccagcagtattggtgtgtccctccacccttcgacacgtgtccaccatgcacgaagtcgccagcagtactggcgcatcccatgctaggtacgtgcaaaaacagcaccccctgggaaatactttgtaaagagccctaa

SEQ ID NO: 77470 - DNA, 390 bp, Glycine max
  Peptide Sequence Number=SeqID_194248
atgcctaaggttcctgaattgtctatgcccgagttgcctaaagtttctgaattgcctaagtccaaattgtctaaagtacctgagatacctaaggtccctaaattgtctaagcccgagttacctaaagtacccgagttgcctaagttgcctacggtttttgaattttctaagcctaagttgcctaaagtacttaagttgcataaggttccagaattgcctaagctgagttacctaaagtacctgagaggccaaagctacttgagagtgattgtggcggtttacaagcactggcactgtcatgacatctcgtggcatactctccagggcttccctttcccattcccatgcaacaagctaacaagaccacggttaatgttgacacatctataa

SEQ ID NO: 77471 - DNA, 1452 bp, Glycine max
  Peptide Sequence Number=SeqID_194249
atgggggggtttcaacatggaaatgagagcattctgacttgtccaccaacttctggtctcagtggtccaaatgttaatgtttcagaaatggctattagttctgtgtctatggccaagccttcaaatgttgtagctaacccttttctcgcttcttccacttgggatccacttgtttccttgagccaggctcaaacttttggaggctcttcaatggtttctcataatgagtttgtcaatgccaactcatcttaccctcttgttttggataaccagggggggataagcaacacttcccaccttgttcaatacatgtctgactcaaatcttgggggtatagtccccaaggttcattcctatgcaagtgggggattctcagaaatggttggttctggctctttttgccaacatgggtctggtgatatggctgacacagggtatccaacacattataatccaatcaaggaggctccaattattaatggtgaacaatctcaggttgaggactcaattcctgaagaggaagcaccaggatctgcacctagtgggaatagaagaaagagagggcttgatcataattccaccttcagtccaaataagtatatctcaggacagaacttagatgctattggtgttgttttccaaatcaaattaaagttttgcctcggtaatatgtgcggaacgatttacattaccaaaaatgctgagggtgatgctgtgaaagattctcctgggaaggcctctgatggttcaaaagaacacgaaaagagaccaaaagtggagcagaataatggcgcagatgtgcgtggcaagcaatcagtgaagcaagctaaagacaacaataattctcaaagtggagaagctcccaaagaaaatttcattcacgtgagagctagaagaggtcaagccactaacagccacagccttgcagaaagagtaccatccctatctcaccacgatatttgctatgagaaagtgagaagagaaaagattagtgagcgaatgaggttgcttcaagaacttgttccaggttgcaacaagataactggcaaagctgtaatgcttgatgagataataaactacgtgcaatcacttcagcaacaggttgagtcaacttatcaaagagatattttgcagtttctgtccatgaaacttgccacagtgaacccagaactgaactttgatgtagacaggatcctatccaaggatattctccaatcacgcataggacatggaattggtgcatatggtcctggtatcaattcctctcacaccttccccaatggaagtttccatggaacattggctggcatgtctagtacatcctcacaattccctcctttgccacagaatgttttggaccatgagttccaaagcttctatggaattggatacgattctaatacagcacttgacaacttgggacccaatgggcggttgaaaacagagttatag

SEQ ID NO: 77472 - DNA, 183 bp, Glycine max
  Peptide Sequence Number=SeqID_194250
atggcaccatcgctcgctcccgtcgtgtcaccgacattgctgcgccgccactgcgaacccacacaaggattgtcacccccgtcgtctttcttcactggggctgcaacatcattgattctgggtctctacgcccttcacaagggattgtcgcgcctgccaataatacataacaacacatcctag

SEQ ID NO: 77473 - DNA, 366 bp, Glycine max
  Peptide Sequence Number=SeqID_194251
atgaagcagcagaagcaggcacaaccaatggcaagggtgggggagaaagaaaacgaagaaacagaagaagaagcaccacaagaggaagaagattcattaacctcgaaggcgatcaacaagacgaaaccaccacagcaagacgcactagcaccaacaagaagaaaagccacaactagcaaccacggacaaccaaccaccacgtgcgaaaaagagggacgagtcactggcacttttgccatttcaccacgggtgctgggtgccccagcaaaaatgctgggtgcaccaagtaacacccttttgtctagtagcctcttgattaatgaagcccaaagcagcaccgtttccactcttcaggaagccacatag

SEQ ID NO: 77474 - DNA, 381 bp, Glycine max
  Peptide Sequence Number=SeqID_194252
atggggtcgaaatcgtggctataccttgttccaacctatcaaactatagaaaccttctgggtcacggatgaaaacgcgcccagccctcactgtggccacaccttcaccgttgtcgctaccaccaagactcaaggcccccacgttatcctatttggcggtgccatcgccattgaaggaggatcttcctctgccccgacattcgtaactcctccttcactcactcactctttgtctgccttctttttttgttgcctgaatttcattgcttttactttgcaggagtttccatctcctcaagctgctcatgttgctgctgcaattggtaccatggttgttttgcagctagggtgggataggtccaggggggcattctatcgatga

SEQ ID NO: 77475 - DNA, 117 bp, Glycine max
  Peptide Sequence Number=SeqID_194253
atggcaggaaaaagagttgtatttgatacttgggcttttgatactgctcaaaaaccttatgtgtggcagaagctgaacccaagaaggtcacagaccttctctgcaaaaattgattaa

SEQ ID NO: 77476 - DNA, 631 bp, Glycine max
  Peptide Sequence Number=SeqID_194254
ggtgacgagtttgtcgagcccccaagtatggatgagtgttgtctgatgtcggttgtttctgtcaagctatccatgatggacatgtctttggcttgtcagagtgggcacgtactagagttgcggttcatgcgtgacttggggagcttcgtggtacttctatccatcaaaatgtcttcctttttgtctgattgtgccatcggtctgggtggcagtgactctgggggctcgattgagcaacccatcatggatcgggatgtcatcttgataggcggttcctcatttaaggacacttgtctaggtgcctccgatagtgagtcctcctcttcagagaggataagggcctcacatcaaacaggtgggggcatttctcgccctcgtggaaggggacgaccttctgctgttgtcagggagcctatcttggttactatgatcctccccccttctgcttttgggggtgtgaggagaggtatttgtggtggatatgtgaggatgtctccatgcgtgcgacgcagccagagtgttgggtcattgccatcaaccctggctgttgctagctatgagtgggtgaaggaagacattctgaagtataagtacagtttgacctcggcagcaaatgtcgctacgcttcaat

SEQ ID NO: 77477 - DNA, 908 bp, Glycine max
  Peptide Sequence Number=SeqID_194255
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgccctgccgccaacgcgtcgaggtcaagccactcctcggcgcaggctagcagagcctcatcgctgacatcgggccagggatcaccaaacacccgatgggccagggcaagacggcgtcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 77478 - DNA, 357 bp, Glycine max
  Peptide Sequence Number=SeqID_194256
atgaccaaaggcaagggcaaggatccacttgaaggacttggagggcctatgacaagggctagtgcaaggaaagccaaggaagctcttcaacaagtgttgtccatactatttgaacacaagcccaagtttcaaggagaaaagtccaagggcccaattggcaacctaggcatcaaccttttgggagaccaaatggtggctgacttgttggctgttggggggcccaaatgggccctcttagcagcacccgggttaatggaggaggaggaggaacctggccatctccaatgtggccctgttgctttcccttggccttgtcggcctaaaccttctcaaccttctcggtttgagccttcttga

SEQ ID NO: 77479 - DNA, 381 bp, Glycine max
  Peptide Sequence Number=SeqID_194257
atgccacatctttctgagaaaagaaagcaacaagaggaggacttttcctctcaacctcttgccaaagcttccaaatctcagcggcttcagatgcaacataaatatgccaatgacacttataaatttttcaaaaaatatatcgaaagtagatattatgcaagcctcaagagggaggtatatgttgagaggaaagtgaatctcaaggaaggtgaattcactgtgattcaagagatctttgaggataaagggtggactaaattgatggaaatagttatctataatgaaccccttgtcagagagttttatgctaatgtcatctttctagatggtttcaaggaaaggaagtcttgggtcagaggcataattgttaaatatgactaa

SEQ ID NO: 77480 - DNA, 324 bp, Glycine max
  Peptide Sequence Number=SeqID_194258
atgggggtaggatgttgttgctggaggttcgccttattgatgagagttcaaatgatgatccttccaactttcacaatggtttctgatgacatcaatgatcaggaatctagtattccccttggtagtgttattcctttagttgatggcgttggtcctctagtcactaatcttgccacccttgctagtggcactgttgttgttaaaggagggcctcacttaaacattgaggttccctccttccctaagaaagacgaggtcgagtcccctctacccattccttcttataatgttattgacctagactcagaggctactatcctttag

SEQ ID NO: 77481 - DNA, 414 bp, Glycine max
  Peptide Sequence Number=SeqID_194259
atgcaaaaactggacaaaattaaaggccttgaagaaaaaattgaaagaattggaaagtccgttagcgcgcaagatgagcccagcgcccactctcgctcagcgcacgacacacgcttagtgcaaaaaaggcccacgaagaagcccaaaggtgcttttagcgcaaaaagcccaaaggcgcgaggtcgcttaaaaattaagctaaagaagagaagatgcgaaatgttgttgaagaactcgcttagtgagacaccttggctaagcgagcctcattcgcttagcgaggcaacaagctcgttgagcaaatgcaaaaccctagaagatgatcagccagagagcagcgcgcttagcacgcacctagcctgcccagtgaggacgttgtctctactcgtgcttagcgcgtccagactcgcttag

SEQ ID NO: 77482 - DNA, 2238 bp, Glycine max
  Peptide Sequence Number=SeqID_194260
atgacatcacactctgaaggatgcaaaagcaataaaattgaggtttcctaccaggaagctgttgctctaaagagacaagaagagctcattcgtgaagaagaagcagcatggctggctgaatgtgagcagaaagcaaaacgtggaaatgagagggaaaagaagtcaaagaagaaacaggccaaacagaaacggaacaatcggaaaggaaaggataaaggtagagaggagagacctattgtggctgtatatgacaagcagcaacacaatcctgctgatgagaaaaaggattctaacatggaagaagttcaagctcttgatgaaaagcttgatgccctggaagttgtttctgatgtgtctgattctgtggacggggttggtgaagcgcttcagcttgattctgaagacagagatgtgagtcttgtaaattgggatactgatgcatcagaagttcatcctcccactgaggctagtagcaatggtattggtagtctttcatctgtacaaaatggaatggctgagaaaaggagcagttcggcaatggatgacagttcttcaacatgttctactgattcattaccatcaatggtgatgaatgaccactacaaggggaactcttttttaaattacaaagtccaaaagtcacctaacagaggtaagaaccaagtaaaagcatcatgtaatgtgggcagttggacaacagaaatggatagtcagccatccggttctgctgcagatgctgtagatgttaatgagtctggaagtagcaagttaggtggatctgagcctgagggtgctgttctctgcttgcaggatcgattaaagtggctcgatcaccaggaagaggatttaccttcgctacaaaagaaacaaagcatcaaagaccaagttagcatagaaagaactgttgataatgaaagccttccaaaagagaataaatcagcagtgccatcctcatctagtagtcctccaagaaacttacctgttcaaatgaagtcagaaaaccaaactagagttactggagatcctgttcatgccaggaaaacatcttttggtacctcacaatcaactgataaagaggtgtcttcatcttcaacttctgtatcacaagtaacagttggtccaaaaacagagatccagaaagcttcaaccccaagactaactgaaagatccatggcacaagtggctatgttgtcaaggccttctagtgctccactagttcctggtgttcccaggcccactgccgctgttgtctccatggttcaaactgctcctctacttgcacgttctgtgagtgcaactgctcggttgggtcctgatccctcacctgctactcatagttatgttccccaatcctatagaaatgcaataatggggaatcctgtggtgtcaactgctgccagtctccctcattccagctctagttcaggagtaaacccatctcctggctattcacaaccacccatggtatcatcgccactatttatctcccggagctccgacaaaatggattcaaatacttccctgtctgatgttccttttggtatgattacacgggatgttttacagaacggacctaattggattgatagttctcaaagggaagccggcagaagcatgccctatgaacctccttcccgactaaatgatgctcaaaacctagacttgttcaggccaatagacagtagatctttgggcaacataacgagtgagttcccagcttgcacatccaagcatcagaaccaaggggggttggtggatgagttcccacaccttgatataattaatgacctgcttgatgaaccaagggagcatggtattgggaaggcatccagggcaagttcagtgttctactccctcaatgatggaccacagttgctaaatcgtcagttcacttttcctggagacttgggtaccgatgatgatttgggatcttccaccagttcttgtaggtttgagagatcgcgaagttaccatgatgctgggtttcaacaagggtatagcacatctggtcggcattatgattcactacaggattatgttcctcaggcgagtacactatcgtatggaaatggcaaggtagatgggatgattccaaaccaatggcaggttgctggttctgatctatcttatctaggcatgagaaacactgagaatagttactcttactatcaagattactcaaatatggcatgtggtgtcaatggttatactgtattcaggccttcgaatggtccgtag

SEQ ID NO: 77483 - DNA, 435 bp, Glycine max
  Peptide Sequence Number=SeqID_194261
atgcatggtgggataaagcaacatttattcgccattaaaaagctatcaggtgtgaacatggtaagtattcccgcctgtcacgcgggtgacccgggttcgatccccggcaacggcgttttatattttttgtgtcgagttgatatatctacatataattcaccatacatctctgtgacccatcctagatcagcaggacatggcttgcctgttttaagtgaagaaagtacccttgtatttcctgataccgacaaagaaatttgggtctctgattcttcagcgtatgaggctaatgaaaattttacaacatgcatgcaaaacactgctactataatcaaaatcagtgagaaacaaatgagagatttagggtgtcaaaacaaaaaagggacttgggattcttggggagattctagcacgagtgctagggaagaggcatga

SEQ ID NO: 77484 - DNA, 183 bp, Glycine max
  Peptide Sequence Number=SeqID_194262
atggagaaagagagagcggaatgggaagaaggttggagggttcgagaaagggaaattcacgacagagaagcgattgtgaaagcgcgtgagcgagatcttgcttctaagagagactcttccattgtttccaacttagagaagataacagttcttcagcaatgggcatcatttttggttcgctga

SEQ ID NO: 77485 - DNA, 1794 bp, Glycine max
  Peptide Sequence Number=SeqID_194263
atggctactcatcttttcagacttcctctcttctcgcaacccaagctctccttcaatcacacgcctaatcatgcactccacttcatttctcctctgccggcaaaacgacatcgcacccgcaaccgccaccgtcgtcgaattctccggccaccgttctctgtttcgaactccttcggcaccgagattggctcgccggaattttctctccttcaaagcaggagagaggccaaagactcgccggttctgctcgacgtcaccggaatgatgtgcggcgcgtgcgtctcccgagtcaaaaacatcctctccgctgacgaccgagttgactcggtcgtggtcaacatgttgaccgagaccgccgccgtcaagctgcggcggatcgaggaggaaccggcgagcgtcgcggagagcctcgctctgagactgagcgattgcggatttccgacgaagaggagggcgtcgagctcgggagtgacggaaaacgtgaggaagtggaaggagttggtgaagaagaaggaggaattggtcgttaagagtcgaagccgcgtcgcgttcgcttggacattggtcgcattgtgctgcggatcgcacgcttcgcatattttccactccttggggattcacattgctcacggtaatgctcgaaatcttgaatcgaacctgcgaagttcgttattctctattcagttgcagattcgtgtaaatgtaattatggaaataaaccaagcgaaaagctcgcttgcttttctatttgtaggaccgcttatggagattcttcatagttcatacttgaaaggtggtttagctttggggtctctattgggaccaggacgagagttactctttgatggcctaaacgcatttaagaaggggtcgcctaatatgaactctctcgtgggatttggttctgtagctgctttcatcattagttcggtcatgcttcttggtttcgtgcttctgggacgttctctggaggaaaaggcaaggattcaggcatctagcgatatgaatgaactgctttcactgatatccactcagtcaagacttgtgattacttcaacagaaggttcaccttctactgacactgtgctttgctctgatgcaatttgtgttgaagtcccaactgatgatattcgagtaggggattctgtgttggtgttgcctggagaaactattcctatagatctaactagaaaaattcatgagcagggaacggtcatttcaggaagaagtgttatagatgaatccatgcttacaggggaatcacttcctgtatttaaggagaaagggctcacagtttcagcaggaactataaattgggatggtcctttaaggattgaagcttcttcaactggctccaacactatgatatcgaagattgtacgcatggttggtatccctttttctgtaatggcttgttggtgtcagatgctgtataatgttgaggatgctcaatcacgtgaagcacctgtacaaaggcttgcagattcaatagcagggccatttgtatacagtgtaatgactttgtcagcagcaacatttgcattttggtattttgtaggatcacacatatttcctgatgttttgctcaacgatattgctggcccagaaggagatcctttgttgttgagtttaaaactatccgtagatgttttggtgagaatgaagcaccccctttttactggctttcagcttctgttgttggttaggacgtgcttgacaaaaccttgcatgtgctttttttctgatgagtcttcaaaattgcaaactgccttcgatttggactcttcacactag

SEQ ID NO: 77486 - DNA, 336 bp, Glycine max
  Peptide Sequence Number=SeqID_194264
atggaatttagaggttgcagaaggggaagcagattttcatcatatgagagattggctgccataggattggcgattctggctgtggcttctcctctctatatagaccgcaaagcagagtgtgagttggaagatgaggagcaacccatcaacgttgatgttttgttaccttttctgctctttctattgactttgggcatagctttatcagcttccatggacaggagctttgcagggtttgatcgttactggattcatagagtcattggttcttctggcggtattcttgccattcttactgttctttttcttattttgaaatttaaatcgtctctgtga

SEQ ID NO: 77487 - DNA, 2682 bp, Glycine max
  Peptide Sequence Number=SeqID_194265
atggacagggtttcgccgaaccggcgtcgttccgacggagagagtagttctgcttccgctggggacactcgccagaagcgcgccagagtttacttcgatttcgatggcactcattgtattgtgaagtgttcaaatgctgggaattccagtgcatctgttgaagaatttgtggattatgataattttcaaggatcctctcttcttcgatccaacgatgatgatgctggcgaagagagtaacttcgacgaaggagatggtaatgacatctcaaaagtggatgatctagaggtcaagatggatcttacggatgacttgttgcatatggttttctcgtttttggatcatcccaatctctgcagagctgctagagtttgtaagcagtggcggactgctagtgctcatgaagacttctggaagagtttgaattttgaagaccggaacatatctgtagagcaatttgaggacatctgtaggcgttatcctaatataacagcaatccgtatgtctggtcctgcctctaaccagcttgtcatgaaggccatctcttcgttaagaaatcttgaggctttaacattgggaaaaactcatataatggataattttttccatgctttggccgattgttctatgttgagaagactaagcatcaatgatgctatacttggcagtggtctgcaggagatatcagtcaaccacgacagactgtgtcatctccaattgacaaagtgccgtgtgatgcgtatgacagtcaggtgcccacaacttgaaattatgtcattgaagcgtagtaacatggcacagactgtgctcaattgtccccttttgcaagagcttgatataggctcttgccacaaacttcctgattctgctattcgttcagctgttacgtcatgcccacaattagtttctttggacatgtctaattgttcgagtgttagtgatgaaacattacgggaaatatcacagaattgtgctaaccttagttttcttgatgcatcgtactgccccaacatatccttggagactgttagactgccaatgttaacagttctgaagcttcacagttgtgaaggcatcacttctgcctctatgactgcaatatctcacagttatatgttggaggttttggagcttgataattgtagcctgttgacatcagtgtctttagatcttccccgcttgcagaatattagattggtacactgtcgcaaatttgctgatttgaacttgatgaccctaatgttgtcttctattttggtgtccaattgccctgtgctccatcgtatcaacatcacttcaaattcacttcaaaaattaacaataccaaagcaggacagcttaaccacattagctctgcaatgccaatctttacaagaagtggatctctctgagtgtgaatctttgaataactctgtatgcaatgtttttaatgatggtggaggttgcccgatgttgaaatcgttagttcttgataattgtgagagtttgacgtcagttcagttcatcagtacctctctaatcagtctttcgcttggtggttgccgtgcaataactaatcttgaactcacatgccctaatctagagaaagttattttggatggctgtgatcatttggaaagagcatcattttgtccagttggtcttttatctctcaatttaggaatatgtccaaaattgaacacactcagcattgaagcaccgtttatggtttcacttgagttgaaaggatgtggtgtactatctgaagcattcattaattgtccactcctaacatctctcgatgcttccttttgcagccaactaacagatggttgcttgtctgcaacaactgtctcatgcccactgatcgaatcattgatattgatgtcatgctcttcaattggttcagatggtcttcgatctctgtattgtcttccaaatttgattgttcttgacttatcatacactttcttggtgaacttgcagcctatctttgattcttgtttgcaactaaaggttttaaagctgcaagcatgcaaatatctcactgacacatcacttgaacctctttacaaaggaggtgctttaccagcacttcaggagttggacttatcttatggaactctttgtcaatcagccatagatgagcttcttgcttactgcacaaacctcactcatgtgagcttgactggctgtgtgaatatgcatgatttgaattggggaagtagttgtgggcaaagtgacaatttccctgctgtaaacaccccatctagggcaagttctaatgagaatatccctgaatcaagtgagcaatccactcgcttactgcaaaacctcaactgtgttggatgtccaaatattaggaaggttgtcattccattgagggcaaattgttttcatttgttatttttaaacctttcactctcggcaaatttgaaagaggttgatgttacttgtctcaacctatgctttcttaatttaagcaattgttcctctttggaaattttgaagctagagtgtccaaaattgaccagtctgttccttcagtcttgcaatattgacgaggaagctgttgaagctgccatatcaaaatgctctatactggagacccttgacgttcgcttttgtccaaagataagctcaatgagcatgggaagattacgcacaatttgttcaagtttgaagcgaatattcagcagttag

SEQ ID NO: 77488 - DNA, 576 bp, Glycine max
  Peptide Sequence Number=SeqID_194266
atggcgtttcggtttggactactccttctggtttctcttctttgtttggattcaattagttccgtgaattcacacgtcggagaaacgttgttggagataaagaagtggttcagggatgtggataacgtcctgtatgactggacagactcaacttcttctgattattgtgtttggagaggtgttacgtgtgataatgtcactttcaacgtggttgcactcaatctttcggggttgaatcttgagggcgaaatttcacctgcaatagggagacttaacagcttgatctctattgatttcaaggaaaaccgtttatctggccagatacctgacgaacttggtgattgttcctctttgaaaagcatagacttgtcatttaatgagattcggggagatataccgttttcggtttcaaagatgaaacagctggaaaatctaattttgaaaaataatcagctaattggaccaatcccttcaacactctctcaggttcctaacttgaagattctgctctatgatgtgttcttgctgtcaatctttgtctgtgtctttccttttcctatgctagtggcttgcgag

SEQ ID NO: 77489 - DNA, 210 bp, Glycine max
  Peptide Sequence Number=SeqID_194267
atggtattcataggattagccaatagctcatgtacagtgagggtggccaaggatgaagtggcaggagcaggcaacatcgtggtgctggcagaagtgaagcgcagagatgagttgtgcgtagtagcggtgggcgagggagagcttgaagatgaggtcgatattggtttacgagtaggactgacaatgggtatcatcacgataaagtcctag

SEQ ID NO: 77490 - DNA, 2898 bp, Glycine max
  Peptide Sequence Number=SeqID_194268
atgccagaaccaaccacgaatatgcgccacggcaccaaggtttgggtccacgacagagattccgcttggattcctgctgaactactcgaatcttccggaaataaagttactgttgctaccgcttcgggcaagaaagttgttgctcttccggagaacgtgtttccccgggacgcagatgaagaagagcatggcggagtcgaagatatgacgagattggcttacttgaatgagccgggggtgttgtacaatctccgaagaagatattcgctgaacgatatttatacgtatacagggagcattttaatagctgttaatccattcacaaagcttcctcatttgtatgatatccatatgatggagcagtataagggagctccatttggtgagcttagtccacatgtatttgctgttgccgatgcatcttatagatcaatgatgaatggaggacaaagccagtctatcttggtcagtggtgaaagtggtgctgggaaaactgagacaacaaaattgattatgcaataccttacctttgttggtgggcgtgctgctggtgatgatagaacagttgaacaacaagttcttgaatcgaatccacttttagaggcatttggaaatgcaaggactgtctggaatgacaattcaagccgttttgggaagtttgttgaaattcaatttgattcaaatggtagaatatctggggccgcaattagaacttacttactagaaagatcacgagtagtgcagataacagatccagaaagaaattatcactgtttttatcaattgtgcgcatctgaaagggatgtagagaagtataagttgggaaagccaagccacttccactatttgaatcaaagtaaagtctatgaattagatggcgtaagcagtgctgaagagtacatgaagacgaggagagcaatggatattgttggcataagtcacgaggatcaggaagccatattttccaccttagctgcaattttacatttgggaaacgttgaattttctcctggaaaagagcatgactcgtcagtaataaaagatgagaaatcaagatttcatttgcagatggctgctaatcttttcaggcagagttttcaactactattgggtattgactttgcaaaggtagtattaagtcttcagaattggcttgttgataagatcaatggttctgtcgggcaagatatcaattcccagaagcaaattggagttttggatatatatggttttgagtgttttaaggataatagttttgagcaattctgcatcaattttgcaaatgaaaagctccagcaacattttaatcagcatgttttcaagatggagcaggaagaatacaacaaagaagaaatcaactggagttacattgaatttattgacaaccaagatgttttagatttgattgaaaagaaacccattggtattattgctctgttagatgaagcttgcatgtttccaaaatcaacgcatgaaacattctcaaccaagttgtttaagcacttcctgtcacaccctaggctagaaaaggagaagttttctgaaacagattttaccctttctcattatgctggaaaggtcacttatcatacaaacaccttcttagagaaaaatcgtgattatgtagtcgtagaacattgcaatctattatcctcttcaaaatgcccctttgtgtcggctctttttcctttgctagcagaggaatcttcaaggtcatcatacaagttttcttctgtggcttccaggtttaagcaacaacttcaatcactcatggaaacgcttaacacaacagagcctcattacattcgatgtgtcaagccgaattctttgaatcgaccacaaaagtttgagaatactagtgtcatacaccaattacgctgtgggggtgtccttgaggctgttagaataagtctggcaggttaccccactcgaaggatttactcagagtttgtggatcgctttggactaatagctcccgaatttatggatggaagttatgacgataaagctgtaactctgaaaatattgcaaaagctaaagcttgagaattttcagttaggtaggaccaaggtatttctcagggctggtcaaatttgcattttagactctagacgtgcggaagttttggacaatgctgcaaagtgtattcagcgtcgactgcggacatttattgcgcgccgggatttcatctcaatccaagctgctgctctttctattcaagcatgctgcaggggatgcattggccgaaagatatatgcttctaaacgggagacagcagcagctatctccattcagaaatatatccgtatgtgtctgatgaggcatgcttatgtgaaattatattattctgctattattgtacaatccaatgttcgtggtttcacaactcggcaaagattcctgcatagaaaagaacacaaagctgccacttctattcaggtctattggaggatgtgcaaggctcggtctgccttcctaaaacatcaaaattcaattgtagcaatacaatgcctttggcggtgtaaacaagcaaaaagagagcttcgcagacttaaacaagaggctaatgaagctggagccttgcgtttagctaagaataaacttgagaaacaattggaagagcttacatggcgtttgcatcttgagaagaaaataagggtttctaatgaagaggctaagcatgttgagattttcaagctacagaagatggtagatgctctgaatcttgaattagatgcagctaaactagcaacaattaatgagtgcaacaaaaatgcagttttgcaaaatcagttgcaattgtcagtaaaggaaaaatccgctttagaaagagagctagttgcaatggatgaagtgcgaaaggaaaattctctattaaaggtgcttgatgttgaatag

SEQ ID NO: 77491 - DNA, 555 bp, Glycine max
  Peptide Sequence Number=SeqID_194269
atgggtggcttcggcgtttggatggaagcatcgccgtcgtttgaggttgaagatgataacgagcactgctcaacttccgctacttcgtccattggaaacgacagtgatgtgttgtcggagacagagtgtggtgagaatgacaatgaggctcacagtacttataaatgtcatcaacctttggacaccatggactctctccaacaggttcttcccatcaggaggggcatctcaaagttctatgatggcaagtccaagtcctttacgagtctggcggatgctggttctaccccatctgtcaaagacattgcaaaaccagagaatgcttacaccaggaggcgtagaaatttgatgtgggaaaagagtcgaaactaccctttgagaagcaacaatggtggcatttccaagagaacaacaataagctcgagccgaagcaccgtgactctcgcgtttgccatcaactatgacagtaacagtagctgtgcgagcgaggattcattttcaagctcaaatccgaggtcacctccacctcttccaccactacatccccaaaattga

SEQ ID NO: 77492 - DNA, 1425 bp, Glycine max
  Peptide Sequence Number=SeqID_194270
atgcttgttaaaggtgattttaattacaaggaggctctgaccaagtcccttatcttcctagaggcacaacgttcagggaagctcccttcaaataatagggtgccttggagaggagactcagcactcgatgatggcaaactcgttaatgtggaccttgctgggggatactatgatgcaggggacaacgtgaaatatgggcttcccatggctttcaccgttactacgctagcatggggagccattttttacaagccagaatttgaagctgcaaatgagttgggtaatgttcacgatgctattcgttggggtaccgattattttctcaaagctagttctcgacacaaaagattatatgtggaggttggggacccggaagatgatcaccactgttgggctccaccagaaaatatgaagacaaagagaagtgttaagatgattactagtgacattcccggaactgagatcgcggctgaaactgcagcagcaatggctgcttcttccattgtttttaggcccaaagatcgtaaatatgctcgtcgtcttctcaacagagctaaattgcttttccaaatggctaactcgaataaaggaacgtatgatggagagtgtcccttctactgctcttattccggctataattgcaaattaacgtatgtgaatggtgttggtgagatgcaggacgagatgatgtgggcagcaacatggctatacatggcaaccaggaagtctgtgtatatgaagtacataacagaagaatgcatgagtgcaagtgtagcagaatttagttgggaccttaaatatgctggagctcaaatccttctcagccagttacatttcgaaggtcaaaagaatttggaaacattcaaaagccatgccgaaagtttcatatgctctgtcctacctgatagtccctaccaccagattaaattgtcccctggtggctttattcatttaagagatggagccaacacacagtatgccaccggcacttctttcttgttcactgtatatagtgatttgcttgctaaacataatcagaaagtcacatgtggagacaaacaatttagctcgtcccatcttcttgcttttgctaagaaacaaatggattacatactagggaacaaccctgaaggaagatcatacatggtaggatttggaaagaacccaccaacgcaagctcaccatagaggtgcttccgtttccatattgaaaaagggtgaagaggtggtttgtgccttgagcttcacgcaatggtttcaaaaagatgaacctaaccccaatgaactcactggtgccattttgggtggacctgacatcaacgacaagttcaacgataaacgttgggattcgcctaagactgaaccatgcacctacatcaattccctagctgctggggctctagctaaacttgcatctttgggttga

SEQ ID NO: 77493 - DNA, 1386 bp, Glycine max
  Peptide Sequence Number=SeqID_194271
atgcttgttaagggtgattttaattacaaggaggctctgaccaagtcccttatcttcctagaggcacaacgttcagggaagctcccttcaaataatagggtgccttggagaggagactcagcactcgatgatggcaaactcgctaatgtggaccttgctgggggatactatgatgcaggggacaacgtgaaatatgggctccccatggctttcaccgttactacgctagcatggggagccattttttacaagtcagaatttaaagctgcaaatgagttagataatattcaagatgccattcgttggggtaccgattattttctcaaagctagttctcgacacaaaagattatatgtggaggttggggacccggaagatgatcaccattgttgggctccaccagaaaatatgaagacaaagagaagtgttaagatgattactagtgacactcccgggactgagatcgcggctgaaactgcagcagcaatggctgcttcttccattgtttttaggcccaaagatcgtaaatatgctcgtcgtcttctcaacagagctaaattgcttttccaaatggccaaatcgcataaaggaacttttgatggagagtgtcccttctactgctcttattccggctataatgacgagatgatgtgggcagcaacatggctatacatggcaaccaggaagtctgtgtatatgaagtacataacagaagaatgcatgagtgcaagtgtagcagaatttagttgggaccttaaatatgctggagctcaaatccttctcagccagttacatttcgaaggtcaaaagaatttggaaacattcaaaagccatgccgaaagtttcatatgctctgtcctacctgacagtccctaccaccagattaaactgtcccctggtggctttattcatttgagagatggagccaacacacagtatgccacgggcacagctttcttgttcactgtatatagtgatttgcttgacaaacataatcagaaagtcacatgtggagacaaacattttagctcctcccatctccttgcttttgctaagaaacaaatggattacatactagggaaaaaccctgaaagaagatcttacatggttggatttggaaagaacccaccaacgcaggctcaccatagaggtgcttcggtgccaaaactgaaaaaggatgaagaggtggtttgcgccacgagcttctccaaatggtttcaaaaagatgcacctaacccccatgaactcactggtgccatcttgggtggacctgacttcaacgacaagttcaacgataaacgttgggactcgcctaagactgaaccatgcacttacatcaattccctagctgctggagctcttgccaagcttgcatctttgagttga

SEQ ID NO: 77494 - DNA, 678 bp, Glycine max
  Peptide Sequence Number=SeqID_194272
atgtcacgctctcgtgcttcgtcatcatgttggactagtgtgaatgaggaactcgaacacatcgttgcgcatatgcccaaattaacaatcgaagagcaagggcaatggaaggaattggcatacaagttgcagcatgttgcggctccaccagagggtttcttccagacgattttcggtgaagttggtaaggtatatgctgccaagtggaaggacatacttggtagtatatggcatttggttgacaaggatggaaattatcacaatgttatgtacaaccaagatgtggatcaaccagccatcgtcgcagggtggacaacactacgcgacttttaccaacggaccggagatcatctcatatcgttgcatcattatggtaaaagtacattttttcttactatatgcaagacccctctcctgcccagagcattcccaagatggcactctttatatcatcaagtgccaggttttgtgatcttcaaggtttatctcactgagcaaaacgttttttgtagcagtctgggcgttccaagtagcatgtattatttcttgaaagacaaaggctggactcatttgcactttggagacgttgcagaatgccagctcgtgttcaatcactggagaaagttactgaaaattggagccgggttgaaagttactggagaaagcggatcaggttga

SEQ ID NO: 77495 - DNA, 159 bp, Glycine max
  Peptide Sequence Number=SeqID_194273
atgcacatcatcgagggtgacggtgacctctcctgcaaagtcaatggcagggttgagtttgcacattggaccttaaagagactactccagaatagccttggagacctatttagtgtttgggatgccatgagcaacatgatcactttgcaacatagttaa

SEQ ID NO: 77496 - DNA, 210 bp, Glycine max
  Peptide Sequence Number=SeqID_194274
atggccaataacatcaaaaatcaagcagccaagaccagaaaacagaggctcgggctgctaggaaaaggatgggtttggccaaaaagcactaaggctgcagcaagacaaaacagggttttgaccctgttcagagctacagctgctataggtgtgatattgtctacaaaacacagacttgaaagatgtcagaatccactttgccctgtatag

SEQ ID NO: 77497 - DNA, 309 bp, Glycine max
  Peptide Sequence Number=SeqID_194275
atggacttgttagttgactttcttgaagtcaattcacaagaaccaagagatgagacattgcaatgttgcacactctttgctaacaagaatgctcacacgtgcatgtgccaaactggaagctacgcatggggagctgctgcattggtccatatgtatgagaatttgaatgatgcatcaaagagaagcaccagacaacttgtaggatatatcacacttttacaatgttggatctatgagcattttcctatttttgcttcttttattgttgctgaagattatcatgagaggaaaccacgtgcttaccattga

SEQ ID NO: 77498 - DNA, 1215 bp, Glycine max
  Peptide Sequence Number=SeqID_194276
cactcagcagcgataacagttgaagacacagaaaacaagcaagagaggcagctgaagatgttgtgggtggacaaatatcgtcccaaaaccctcgaccaggttatggtccacaccgacatcgctcataatctcaagaaattggtaacggaacaggattccccccatttactcttctatggcccatctggctctggcaagaaaaccctaatcatggctcttctccgccaaatgtttggacctggtgctgaaaaggtgaaggtggaaaataggacctggaaaatcgacttgcttgttttttgttttgaagtgcttgagaattggtttcaggctgggagtagatctcttgatttagagctgacaacattatcaagtgccaatcacattgaaatgagtccgagtgatgcagggtttcaggatagatacattgttcaggaagtaatcaaagaaatggctaagaatagacccattgatactaaggggaagaaaggatttaaagtacttgtgctcaatgatgttgacaaactctctagagaagcccaacactctctccgcagaacaatggagaaatacagtgcttattgcagattaattctatgttgcaatagttcttctagagtcacagaagcaatccgctctcgatgtctcaatgtgcgaataaatgcaccaagtgaagaacagttttactttttgttccttgttgctttaaagggtataccaatggcatccaagattgttcaagttttagaattcattggtaagaaagaaggactgcaacttcctcctggttttgctgctcgcattgcagagaaatcaaatcggaatttaaggagggccatattgtcgtttgagacttgtcgtgtcctacagtatcctttcactaacaaacaagcaattcctccaatggactgggaagagtatatttctgagattgcatctgacataatgaaggaacagagcccaaaaaggttgtttcaagttcgaggaaagctctatgagctgctaatcaattgcattcctccggagatcattttaaagaggcttctttatgagctattgaggaaactggatgcagaactaaagcatgaagtatgtcattgggctgcatattatgaatacaggatgcgtctcggacagaaggcgatctttcacattgaagcatttgtggccaagttcatgagcatttataaatccttccttattgcaacattcggctga

SEQ ID NO: 77499 - DNA, 318 bp, Glycine max
  Peptide Sequence Number=SeqID_194277
atgtcacaacatctgattggagaagagcagaacagtggagcaagcatagaattcattgaacatagaacaagacctcctccaaggtacttggaacagatgcagacaaacaccaagtttaaaactttgcaaaagaagatcatggaaaatactgcagagttgcaaaaattcaaatggaatccaaggtttgcagcctcagagataaatgctaaaataacacaaacttcgtaccaacttcacaaaaatattgcaaaagttgacatcaaaggcagatcatatcttgcgagctttcaagtttcaatttcctataaagcatattga

SEQ ID NO: 77500 - DNA, 552 bp, Glycine max
  Peptide Sequence Number=SeqID_194278
atgtcagatctccataagtttctactctttaacttaatggagaatctgccatttgatctccctcaaaccatctacatcaacattctgagaaacctgaaaggcttaggtggtctggacgacatctattatgttgccctcatcagcaagctactttgggatcaaggcgtgcatcacgtcttcaacaaaatggaagatgattctaagcataccctagtagccaaggggattggcgagaaaaagtgggcagtctccttcaccgggaataaggaggttctagccttatccttctcagatagtgagtctactgacgatacttctatctctcttctccacaagagtcaagttccctcaacacaaccgcatccacctccatccccaattaatctcgagaagttcaaaagagctattcaacaaaaggaaccattgacaaatgctcaaagatttcctttagcattcgttattggtaatccaatatctgaatcttccttccatgagtccatatccattgagtctcttcagaaggaaaccatcattgtccaagcctcaacatga

SEQ ID NO: 77501 - DNA, 783 bp, Glycine max
  Peptide Sequence Number=SeqID_194279
atggacactctaaaagcctccacctctggttatgatggaagtgacaacattgtgcaccatgacgtcattcatgtgttacgtctagttaggaagtattactttgatgatgcatgtcagaaaaagaagaaagctgaagaagaagaagaaacattagttgttgttgtcgtgaaagacaaagatgtttttgtccaagttgaagtgtctactaaagttgtggatgataccattgtacatgaggtcattattgatcttatcaaccctattatcatggacaaaacacctaagctatccaatgcgaccataactgataaggttgtacatcacttcctagaacctatgtccaagcagtcaacaacctcaaatgaagttacctcaagagacaagagtgaaccaaatgtcatcattgtttactccactagtttaggacatgctcctctaaaatgcgcacaacctgctgttgtcacaagggatcaagtgcaagacatgattaggatggctatagagtcatttgttgaacgccaacgccaagaaaatgagcaatttaggctcttcatgcagaatgctatcacaacacaattctccaaccttggtgttatccttctccaaaacattcaacaagctcaaatgtcgatgtttggagctgttgttgcacctgtaatcgtacctgcacttgcacctcaacctcttgaaccttcaccacacacctttgcccccaacacctcaacttcctcatcttcacccccacctactcaacctccaccaccatttccaactcaaaagtga

SEQ ID NO: 77502 - DNA, 426 bp, Glycine max
  Peptide Sequence Number=SeqID_194280
atggggaagagcaaggttcttgtggtggggggaactgggtacatagggaggaggatagtgagggcaagcctggcactgggccatgagacctatgtggttcagaggccagagttgagcctccagatagagaagctgcagaggctcctctccttcaagaagcaaggtgctcatctcattgaggcctctttcaatgatcacaagagccttgttgatgctgtgaagcaggttgatgttgtcatcagtgccatctctggtgttcacatcaggagccacagcatcactctgcaactcaaacttgttgaggccatcaaagaagctgggaacgttaagtcactaaaaatatattcatgccatctgaaaaatagacaggcacttatggtagatttcgctttcaagtatacagctgcacttcgattagatcagtga

SEQ ID NO: 77503 - DNA, 376 bp, Glycine max
  Peptide Sequence Number=SeqID_194281
atgcaactcactcaggttttcaaccatttggagattgaaaagaagcaaggagatgacctagaccatgagcataagaagaacattgaaaaacatgttaacaaatccatgattgagcacactagtaatatgcctttttcatcaattataaggcctagtaatggacttggtgcaattgcatgttatgactcttttgagaacaaacttggtgttgggattagtccttcgtcaattcctaacgcccattatctcacttttcgcagggcattgctttgtgctcattcgttgtcgcatctactttggtcgaggtgcattgttacggtggttctttggcaaatggtggttgtggtggtggttggtgtggctgttaacggcaaac

SEQ ID NO: 77504 - DNA, 1725 bp, Glycine max
  Peptide Sequence Number=SeqID_194282
atggtgaatggaaaaatacttgcatctggtgtttccctaatccttgtggtgggtgttgccatcggtgttgtggttgttgttaacagaaagggcacatccaatcctgaagtagaagctcaacagaaatccgtgaaggcaatgtgtgaaggcaccgatgaccctaagctttgtcacgatactcttattaccgtgaacagcacgaattcctcagatccaaaggcatacatagctgctggagtggaagcaacggtgaaaagcgtgatccaagcattgaacatgagtgataggctcaaagtggaacatggagacaaagatcctggcatcaaaatggcccttgatgattgcaaggacttaatcgaattcgccttggacagcatcgagtcctcggctaatttggttaacaatcacaacattcaagcgctgcatgaccaatctcctgacttcaggaactggttgagtgcaattatctcgtaccagcaatcatgcatggacggcttcaacaacgagaccaacggtgagcaggaaattaaggaacaactgcacacaggaagtttggaccaaatggggaagctcactggcatagtcctagacattgtcaccaacttatccaaaatccttcagagttttgacctcaagttggatttgaacccggcttctcgtcgtcttctcgagcttgatgctgaagggtaccctacgtggttctctgctgcagatcgcaggctacttgctaagatgaaccaaggaggtgcacccccacccaatgcagtggttgccctagatggtagtggtcaatttaaatccgttaagcaagctattgactcctaccctaagaatttcaaaggcagattcattatttatgttaaagctgggatttataacgagtatatcactatccctaagaagtcagagaatattttgatttatggtgatggccctacaaaatccattattactggtaacaaaaactttatagatggcgtcaagacaatgcaaactgccacctttgccaatactgcacctggattcattgccaagtcaatagcattcgagaacacagcgggtgcaaagaagcaccaagcagtggcattcagaaaccaaggagacatgtcggccatgttcgactgtgccatgcacggttaccaagacacattgtacacccaagccaaccgtcaattctaccgcaactgcgaaatctcgggcaccatagacttcatcttcggagcagctccaactctgatccagaactcgagaatcatagtaaggaagccagaagctaaccaattcaacacggtgaccgcagatggaaccaagcagaagaacatggccacaggaatcgtgctccagaactgcgagatactgccggagcaagctctgttccctacaaggttccaaacgaaatcctacttggggaggccgtggaaggacttcgcaagaacagtggttatggaatccaacattggcgactttattcagccagaggggtggaccccttggagtgggaacttgtttcttgacacgttgtactatgctgagtatgctaacgttggacctggttccaacgttcaaggaagggttaagtggaagggttaccatcccaatattaataagaacgaagctgagcaattcactgctggccaattcctcagaggtggaccttctggaaatgccgatgattggttgaaggctactggcgttccttataccattggtttcaccaaaccttga

SEQ ID NO: 77505 - DNA, 405 bp, Glycine max
  Peptide Sequence Number=SeqID_194283
atggttagtcattatggcatttctgtgatgattgcagctatttttctggatgaagatgatgttgcaacatatacaatcaaggcaatagatgatccacgaacccttaacaaaacattgtacctaaggcctccagaaaatattatctctcaagcagagcttattggaatttgggagaaacttattggaaaggaactagagaagacatacatacctccagaaggctttcttacaacactgaaagggttggattataaacttcaagtagggattggacacttttatcatatattctacgagggatgtttagcaaattttgaaattggagaggaaggagaagaagcatccaagctttaccctgaagtgaattacacacgcatggacgagtacctaaaaatttatgtgtaa

SEQ ID NO: 77506 - DNA, 498 bp, Glycine max
  Peptide Sequence Number=SeqID_194284
atgcctttgctctcttcgtttctcctccttctcacctcctcctcctctttctctctcttcgcctttctttctctaaaatctcagagctgttgttgttatctgctccttcgattccagaaatgggggaaggaatcaaccctatgtcatgtgattgttttgatggctttcaattggtcaattattgtcattggaattcgttctatattcttctcttcaacgcactgtgcttctgtatcgactttgcctagaattcataacttgtgttataagaggagtgttagtgaaatagtgcttgatcagggaatggctgggatttcgagcgaggaatctggagtgggaaagtctgcggagggaactttcagtgggcagcgttgtcaatctggggaagcattggcagaatggcggtcttccgagcaggtggagaatgaaaccccatcgacttcccccccttattgggacactgacgacgacgacgatggtgaatttgtaatcatataa

SEQ ID NO: 77507 - DNA, 2379 bp, Glycine max
  Peptide Sequence Number=SeqID_194285
atgattggcctctctaaaggaaagattcaaggctctctaataatttttgttctccttcattggagaataagcatttttctgcaattggtatgcaataaatttttgggggatgctgacaggtcagatcagactacagatcaggatctactaactcatattctgaggagtcttgctagtcagaatggtgagcaagggagcaagaacatagctaaccttttgcgagaaccagagaatttgttgagagaagatggttcatcaaggaagtcagaaatgatgtctactttattctccaatggttctcaaggctctccaactgatacaagacaacatgaaactgtatctattgctaaaatgcagcaacaagtgatgcatgcacatgatgctagggctgctgatcagcaaatcacatcttctataaagcccagcatgtcaaacagtcctccagcctactcagaagccagagacagtaccgctggacagatcaagatgaataattttgatttgaatgacatatatattgactcagatgatggtatggaagatttagaaagattgcctgtctctacaaatcttgtgactagctctcttgattacccatgggcacaacaagattcccatcagtcaagtccacctcaaacaagtggaaattctgattctgcatctgcccagtctccttctagtttcagtggagaagctcagagtcgcacagatcgaattgtttttaagctcttcggtaaagagccaaatgattttcctcttgtacttagagcacagattcttgactggttatctcacagtcctactgatatggagagctacatacggcctggttgtattgttttgaccatttatctgcgtcaggctgaggctttgtgggaggaaatgatactttttggagaaacggatgggttcacatcagggtgcagcatcagatggccttcatttttaatggtctcttgccatgtctttgttgtctttgtcattgttgttgttaggggtcaagataacaggagtcaagttgtcatagatacctccttacctttcagaagtaataattatagcaagattttgactgttagtccaattgctgcaccagcatcaaagagagctcaattttctgttaagggtgtcaacctgatacgccctgccactaggttaatgtgtgctttagaagggaaatatctggtctgtgaagatgctcatatgtcaatggatcaaagctccaaagagcctgatgaacttcagtgtgtccagttttcatgctctgtccctgtgatgaatggaagaggatttattgagattgaggaccagggtttgagtagcagcttttttcctttcattgttgtggaggaggatgtttgctcagaaatctgtacacttgagcctcttctagaattaagtgaaactgatccagatattgaagggactggaaaaattaaagccaaaaatcaagccatggattttattcatgaaatgggttggcttcttcacagaagccagttgaaattaaggatggttcaattgaactctagtgaggatctctttccattgaaacggttcaagtggcttattgagttttccatggatcatgattggtgtgcagcagtgagaaaactgttgaacctactgcttgatggaactgtaaatacaggagatcatccttccttgtatctcgcgctttcagagatgggtctccttcacaaagctgtaaggagaaacagcaagcagttagtggagtgtcttttgagatatgttcctgagaatatttctgataaactaggacctgaagacaaggcactggttgatggcgagaatcagaccttcttgtttagacctgatgttgttggtcctgctggtttgacaccactccatatagcagccgggaaagatggttctgaggatgtacttgatgctttgactaatgatccttgcatggtgggaattgaagcatggaaaaatgctcgtgacagcacaggctcgacacctgaggattatgcccgtttacgtggccattatgcttacattcacttagtgcagaaaaaaattaataagagacaaggagcagctcatgtggtggttgagattccaagcaatacgacggagagcaatacaaacgagaagcaaaatgagttatccactacctttgagattggaaaggctgaagtaatacgtggccaagggcactgtaagctttgtgacaagagaatttcttgcagaactgcagtaggcaggtctttggtatacagacctgcaatgctctcaatggtggcaatagccgctgtctgtgtctgtgtggcccttctgtttaaaagctcccccgaagttatatgtatgttccgacccttcaggtgggagaatttggactttggaacaagctaa

SEQ ID NO: 77508 - DNA, 291 bp, Glycine max
  Peptide Sequence Number=SeqID_194286
atggagattgatgtgcccatctctgtagcctacacttgttattctgatcgcgaagccatcccaaactggatgccctttatttcttctgttaagatattgccagacaaacctgacctgtcacggtggtccttgaacccattccaaatcagaaaattcactggcgatctatggaaggtcttccaaacagttcaacatcgtgtgaagatatttgagatgtatgacagcaaagaaaagttcagatatcacattttagagcctgacctgaaacttgtgggcatctatgtaatttaa

SEQ ID NO: 77509 - DNA, 975 bp, Glycine max
  Peptide Sequence Number=SeqID_194287
atggccagatttctacacatgcttataatgctctctagccttgctctaattatctcagttttgccattggcctccgcatctttgaaggtggacttctataaaactacgtgcccatctgcagaggcaatagtgaaaagagccgtaaacaaagccgtttctctcaacccgggcatcgctgctggtttgataagaatgcattttcatgattgttttgtgaggggttgtgatggttctgtgctattagaatccacccaaggcaacccatcagagagagagcaccctgccaacaacccaagtttacgtggctttgaagttatcgatgaagccaaggctgaaatagaggcagagtgtcctcacactgtgtcctgtgcagacattcttgcctttgctgctcgagacagctccaacaaagttggaggcataaactatgtagtgccagctggacgcagagatggtcgtgtctctaacagagacgaagcttcacaacttcctcgtccaacattcaacacacaacaactcattagtaactttgaacaaaaagggttgtctgcagatgaaatggtaacactctctggagcacattctattggtgtctcacattgttcctccttctccgaccgcttgtactctttcaatgccacgtttcctcaagacccttctatggacactaaatttgccacgtcgttgaaaagcaagtgtccaccaaggagtgataacacggtggagcttgatgcttcctcgcctaaccgtttggacaacaactactacacgatgctcaataaccatcgtggtttgttgacctcagatcagactttgttgaccagcccctcaacgaggccaatggtgctaaccaatgctaaacatggttcgacatgggcacgcaagtttgctaaggcaatggtgcatatgggttccattgaagtgctaactggctcacaaggagagatcagaacgcgttgcagcgtcgttaattaa

SEQ ID NO: 77510 - DNA, 396 bp, Glycine max
  Peptide Sequence Number=SeqID_194288
atggaaaaatggaattatgcaccaacaattagaggccactcactaaggttgaataagcaacaccatgaacacggcattggaattagagtggtacgattttgtgtgttttggcattgttggtttggccttcctgggtgccatatgggtgctttggatgcacgaaggggcctcccaaagcaaattgggaaccttggaagagaaccttctggtgggtctacaagacagtactggagtggtcgtgaatgtggttctgagagacagagtcataggtcaggtgaggagcaccccccagttatggaccagttgttggcgaggactgcaccctttgttcctcttgatcacgcgtttcctttcctttgtggtcatggccgttttgctaccattggatgttcgtga

SEQ ID NO: 77511 - DNA, 246 bp, Glycine max
  Peptide Sequence Number=SeqID_194289
atgacgggtgaaaagcgcttgaagccatggaaggttgagaagaggagattggaggagagtggagtagcggggaagcttgtggaggtggaattggcgccaaatgtgcttctacttgtacgtgatgatggcaacaagggtgtcaaagctgctgttgtagaaatagagcctaccacagtagttgaagacatgttccagttttttcagaattcagacacagttcctctctctctctctctctcttcgtga

SEQ ID NO: 77512 - DNA, 774 bp, Glycine max
  Peptide Sequence Number=SeqID_194290
atgtcaggtggtgaagacactgagggctacaagtactggtttcgatggcaagtgcctgtgtgtgctttgatccttattgtctccatcataacagcttccatgcaaattgtaaaggccaaagcacagcccttttaccacaatcacttgtggcttccctgttggagaaaactcagtcctgtgtggcttttcttctctagagctttcgcgttcctttgcttggctcaccttcattttgatatcattgccttggatggagccttttctttctatttttatactcagtggactttcacattagttatgatatattttgcattggggacaataatatctgcacacggatgttggcagtacataaacaaacctccgcttcaaaatggggaaatggctgagtttctgagaagggatttggaagagagtacaaactctattgcctatagagagaaagaaacaaaaagttccatcaggttgcaaagccaatatatccaagaggagtttaaccaaagagtaggattctggggttacctcatgcaaattacttatcagctaaggttaacaaatgaggagttccctatgtctatgcatcttttggggcccttatatacaagcgcaggggctatcatcctaacagacattgtgttttggtgtgttattgtcccattcttatcaatttctcatttcaagctaaacatggtgagtgcaacccttctctataacctgactgttattgttcatgatttccatttctattcctgtggtttcggtgcatactag

SEQ ID NO: 77513 - DNA, 1484 bp, Glycine max
  Peptide Sequence Number=SeqID_194291
atggtctctgccccaaaccccaatttcgacgaagctgcttcgctcgccctcgataatcgcgttcctgccaccgtcataacgggttttcttggctctggaaagactactctccttaatcatattctcacatctcagcatggaaagcggatagcggtcattgaaaatgagtttggtgaggttgatattgatggctcattggttgctagtcattcttctgcgagtgaagagattatcatggttaacaatggctgcctctgctgcactgtacgaggagatctagttaaaatgctgttggagctggttaggaaaaagcgagacaagtttgatcatattgttattgaaaccacaggtcttgcaaagccagctcctgttattgaaacattttgcagtgatgagctggtctctcagcatgtaaaactggatggagttgtaactttggttgattgcaagcatgccatgaaacatttaaatgaagtgaaaccaagatttgtggttaatgaggcagtagaacaagttgcatatgctgatcgtattattttgaacaagcacatcaatggaatggcacaaattaagcaagctaaatttggatctgttgacatggactttgttctgggtgtgggaggatatgatcttgagagtgagaacaagggtctcgaagtcgcaagggagagtgtatgggtggagaggaatgagcgagagcgagtgaggtgtaggtcgagagtgacgagcgagactgagcgtagagaggagaaagggaggatcaagctagtgcgaacgcctatggcttctttgaacaattcgttcagctcctcttccacatttccaaactccattgctgagaagcttgatcattccaattttttgatgtggtggcaacaggtgcaaccagtgttcaaatctcatcatcttcaatggtttgtagaaaatccaataattcctccgaggttcctttctgatgaagattgtgcaatcggatgtgaaaatgctgcgtatgaagactgggagcagcaagatcagggggctgctcacatggttgcagtcacactttcaaagtcgatcctttctcgaactgaactacaatcaccagtgcttgcggacaagcctatgcgtgaatttcttctcaaaatgaaggctatttctgattctctagcctctgttggaggtctgatcttgcctcaggagcacattgatgcgatcctcaaaggtcttcctcaagattatcattctgttatttttgttatcgaaagcaagtttgaaccttttctgattgaagagcatgctttctctgactcactgtcaatcaactacaagcaagctaattctaatttttcgtctgcatatggatctaatggctacaatgtgccaaacaaaacatcacaacctaaatctgagaatttttcgtttggctctcgtggtggttttggttgcagaggtaatttcaatcatggcggtcattgtggtggtggtcgtggctgcggcggaag

SEQ ID NO: 77514 - DNA, 327 bp, Glycine max
  Peptide Sequence Number=SeqID_194292
atgctaccatcaacttatcattcaactccacgattcaacctctttaactccacgaggttcttcttcctcttctacgttcaactccaccagcattttctccatcttgcaatgattcgtttccatgagggaggtaggaaaagcatcgtattctccgatgagatagtccaaggaaagcctattccagaatctaatttgtgttttggaatgaccattttgttgagacaaagaccactgacgaatggtgaaggatgggtagttaaggtgttgtgtaggtttcataatcatgatgttgctgagacattagttggtcatccatatgttggttga

SEQ ID NO: 77515 - DNA, 978 bp, Glycine max
  Peptide Sequence Number=SeqID_194293
atggggatttggtgtgattcagaagagggtggtgaatatggaggacagtgttcatggagtttcttaaccaggaggaaaagggtggattcttcagataagagcaattctcaaggccaacttgccaaggagttaactgtgcctcatctcatggcaattggtgttggtgcaacaattggtgctggtgtgtatgtgctggttggaaccgtggctcgggaacattcaggagctgctttgcccctctcttttctggtggctggatttgccgctgctctttctgcactttgctatgcagagttggctagtcgctgtccttctgctggaagtgcatatcactactcttacatctgtgttggagaaggagttgcttggttgattggttgggccttgatactggaatatacaattggaggagctgcggttgctcgtggcatgacacccaatttggctgcactcattggaggaggagaaaatttgcccagctttttatcgcggcatagcattcctgggattgatgttgttgttgacccatgttcagcaattatgatatttattattactggactcctatgtgttgggatcaaagagagtacaatggtgcaaagtataatcacatcaattaacatatgtgcattgatttttgtcatacttgctggtggttacttggggttcaaatctggatgggttggatatgagcttcccgcagggtactttccctttggggtagatgggatgctagctggttctgctacagtctttttcgcatatattggttttgatgcagttgccagcaccgccgaagaggtgaaaaatcctcagcgtgatttgccactgggtattggtggctcattgtttctatgttgtggattgtacatgttggtgtcaattgttattgtgggtttagtgccttattatgcaatcaatcctgatacccccatatcatctgcatttgctgacaatgggatgcaatgggcagcgtaa

SEQ ID NO: 77516 - DNA, 780 bp, Glycine max
  Peptide Sequence Number=SeqID_194294
atggcttcctcttcaagctcagttctctctcagttgctccataaccgaaaactcccaaaaaactcaactccccctttcagaaatccgccagacacactcgctcagcctaaaggtgaagacggtgcgcttagcgagttggtcttcgctcagcacctctatacagctcaaccttcttccaaaattgtccatgcacttagccatcagattgggcgcttagcgaatgatgcacttagccagaagataagtggcttaacgaggctcgacaaactcgcaacccttctacttgtaaaggctattacccttgacaccagccaatctccctcaacaccagacaatctctttcgccaacaagttggctcaaagcttgtggggcttatgtactgtctaggatccacaaaatggttgttacactaccgtaacaacccctacaaacaaggacccgaagctcctacttcactctataagtatcaggttctatctcaccattttcatatctcattctcatctaactcagaacaagttgacgaacttcgacactggcaaaggccacaatgccatggtggtgacgacattgtagtggtgctcgttgtcattgtcggtgtagctgttgtgggggaatctatgaccctgacgccgtcatgcgtctccaccaccaccatatcaccatctgcgaccccgacatcgtcgtgcccgctgtgctggctggtgcagatagtggcacacggtggaggaggtggtgtaggtggtggcgcgacacaaaggagatgggtaaggtggtga

SEQ ID NO: 77517 - DNA, 1044 bp, Glycine max
  Peptide Sequence Number=SeqID_194295
cgtatccagcttctcttccagcaggagaagcccttcgcggatgacctcctgatcttcagcgctttggcaggcgcgctcgatctgcccgcacagatcatcgatctcgctggcgtaaatgatctgcgccgatccgcccagccggtgcagcgacgaggccagcgccgtccagtcctgcgcatcaaaatgataccagcactgctgcatatcgttgcggctctcctcgctgactttctccagcatcttcgccaccatcgcatcgtcgtgatacaccatggcgcgcagcgattcgagcgacagcagcgcatccagcgccggcacttcggcggccggctcgttgctgctcagcagctcagccagcttgtcaattttcagcggcttaaacaggcaggcgttcatgcccgcttcaagacagcgcacgcgcacgtccgactgcgcattcgccgtcagaccaaaaattttcaccgcgttgccgctgcggcgcagggtctgcgtcagttcgatgccgctcatgcccggcatattgcagtcggtaataatcagatcgaacgcctgatgcgccagcagcgccagcgcctcttcgccgctgctggcttcgctgatctgctggcccagctcgctgagctggcttcgcagcagcaggcggttggccggatgatcgtcgaccaccagaatattcagctgtggcagcgcacggctgcgcgccacgcgggttttctccagcagcttgcgcgcccggcgtgccggcatcattacattaagctgaatcagcgtgccgcgtcccggctggctgttgaggttcatggtgccctgcatcttctccagcagctgggcgctgatcaccaggccaaggccggtgccggtctgcttgcgtccctcttcggtctgggcaaacggctgaaacagtttggcctgatcggcagcgctgatgcccacgccgctgtcttcgatctcaatttccagctccagcgaaccgtcttcccactcatggccgatcacccgcacttccacgccgccttcgtgggtaaacttgatggcgttattgat

SEQ ID NO: 77518 - DNA, 189 bp, Glycine max
  Peptide Sequence Number=SeqID_194296
atgtaccgctattcaatgtttttggcttacatgcctcgcagggaaactgtgttagcaaagcaaagtcattggagatttaaaggacgagcatggatggggggtgaaggagagaatggcatgatgcaaagagaaaaaaagtataagatgaaacaagcaaggcgtccaatcgcatggagccttgaactatga

SEQ ID NO: 77519 - DNA, 291 bp, Glycine max
  Peptide Sequence Number=SeqID_194297
atgtatgctttgttcaacaagtgtttgcctcttgctaccatcatggtgcagccctcaccaaatgctctcattttcatgcactcttgcattcaaaaatgcaagcttgggttcctaggcccaaggcatatttggggcaattatcctaccccctgtgaaactgcctacacacttaaagacgacaatcatatgtataccaactcgtcccatgggttatatcccacaaaatcgtgcgccaatgccattgaggcatttcaccgagcacttggtgggcgcatgtttaggcatgaataa

SEQ ID NO: 77520 - DNA, 123 bp, Glycine max
  Peptide Sequence Number=SeqID_194298
atgggggccgggcccgcgggcacttccggaggtggggacgaagcccaggaggatgaggacatggccgatctgttcgactttcttggagggggcagagccgtacattataacttccatttgtga

SEQ ID NO: 77521 - DNA, 639 bp, Glycine max
  Peptide Sequence Number=SeqID_194299
atggcctcgagaaagttccccgcgaagaggtccatgaaggacaccactggagagggtttcagtgtggccccacaagctgatatggactttgacagacaccggttctggagcatggaacaccagcagtgttttgagaccatcaggggatggcactgggcaccacttgtgacacccatggctaaattcgatccagagatagtcatggagttttatgctaatgcctggcctaccaagggggaagtccaagatatacgccctcagtcagttcctaggccacccgctgatcttggaagagggttagcagtggagacgggtgcggatcatgcacaccagcatgaccacccttatgcagatatggatgactttgtagggacggcacctatgagacaccctgtggacccgaagaagtccaatagggccctagggtttcccgctctgattacgggcctctatcagttctatagagtgcccgtcgcccccagcaaggtcatctgtccacctaataacagggtcttcatcgagaaatactgtacccccaggcaggcgcagggcaaggtaccacaacagccaggggacggccagcagcaggcagcagatgcacctccgccacctccagagtccacctctgatcacctatga

SEQ ID NO: 77522 - DNA, 1971 bp, Glycine max
  Peptide Sequence Number=SeqID_194300
cccgatcagggcctgcagctggccgtgccggctggcgtgatgcagtatcgcggcagcgtcagcactgacctgcgcggtaacgtaacgcagctgaaagcgcgcggcgcgaacctcgggctcgacagcggctggcgctggcagtccggcgcgcatgcgctaacgccggtagccggcgtgaatgcacagtggctcgatatcaatgatttcaccgacagcgacggcgcacaggtcagctaccgtaatccgctgcagtggcagctctccggcggcgtaaaatacgacttccgcctcaacgaaaagctgaagctgggcgcggaaacgcactacgtgcagcgcatcagccagcgcgatcgggtggcgattggtgacggccagcaggcagcgcacttcgccaccggacgcggcggcaacagcttgcagtacagcggttacgccggctggcaggtgctggacaatctggagcttaacacccagcttcagggccagcagcgcctgacgcaggaaggcatcagcgactggaatctgcaggccggtttgcgattctcgctattttcatccatggaagagaatatgaaacttaccccgctgacgctggtgatcagtgcgttctgttatagccttcctgcattcgctgatgagcgctaccctgcattttccacatcacaaaataataacgttaacgctgcgaatattccgcatccaccggggccctttcatggtccatcaacccaggaaatccctgagctgccgctgcttgcgcaggtcagccgccagactggcgaagggattaaacagcttgggaaaattatcgcccgcggctcgtggtttgatgagatcaatccggcaacctcgggcctggtgcgatccaatgtgctggccggcaataacagccatcatctgtggtattaccggttacagaccatggtcctgaccggggagaaagatgaaggattgccgaatattaataatcctggcatcgtggctccgatacccgaccccggtaaaggcgaagctgtcatattgccgccgccaccgccgcctgagccggaaccgccacagctcacacctgcgccacaaatcccgacctacctcgccctgcccaacatgctgtatgccctcaacgacgccatgcaaacccgcttccacttcgctgcccaacagatgagcatggatgatcatcacaacctgtttgtgtatggctatagcggcggcgagcgttatcgcagtgcgcagggcgatagcgatgccaccagccgctatcagggctggatgctgggtgcgcgctggacgcctgaagcggaacagagcccgctggccttcagtgcgggcgtgcacaaaggcgtagcgactatgctttcgaatacggcggccgggcgcagccagctgcgtatgcaaacccagggtattaatgcgctgatcggcattcagccgcctgagggttggcagctggagataccgctggggctgacgcattatcgcggcaccttacgccatgaaacccagggtgaagtggcgcggatcagcgccgttagcggcaatatcggcgcagaagcgggctggcgctggctgcaggatgcgcatagcctgatgccgctggccgcagccggtgtgcagtggctgcatgttgcggatttcaccgagcaacagggggcacaggtgaactatcagctggcgccgcagttcagcctggctggcggggttaagtatgattatcagccgctgtcgtcagtgaagctggggctggaggcgcgttatgtctggcacagcggcaggcagaatacgctggatgccggcgatatgcgtggattgccgattgagcgcgcccgccacagcgcccagctgggcggttacgtcagctggcagctgcatgagaacgtcgagatcggcacgcagttgcaggtgcagcagcggctggatcgccccggcgtgagcgactggaatgtgctgagcggagtgaaagtggcgttttaa

SEQ ID NO: 77523 - DNA, 609 bp, Glycine max
  Peptide Sequence Number=SeqID_194301
atgttattcccaacagtcaggttttctgcgaaacataatcaaaggatctatacatgctctgactattattctatgctgtctcaggtcccagaatattgcttcacttttgagcatgggaagtctaagagaccatttgcacggttgtggtgggacgagaatcttcctactgcactaaccttcccaagttgtcataaccaggttgtactacatccggagcaggatcgagtcctcactatacgagaatttgccaggctgcaaggatttcctgattattatagattctatgggactgtaaaagagaggtactgtcaaattggaaatgcagttgctgttcctgtttcacgggctttaggttatgccctaggacttgcttgtagaaagctcaatggaaatgagccacttgtaaccctcccgtccaagttctctcactccaattatcttcagttatctaaatgcgtgtttggaaacacgtccaacgaggtgaattcacgtcaattcagggctttggacgcggaagttacaccgggtagcattggccaagactcacgtgtggaagattcgacacagctccaaacatgctataataatcagcctggcaacactgactaa

SEQ ID NO: 77524 - DNA, 177 bp, Glycine max
  Peptide Sequence Number=SeqID_194302
atggtactcgtcaagctggaaggtgagggataccaggtattcggccaggccaagttccttatattattagggataccaggtattcggcctggtcaaatacctgatgttacaagggctaccaagtattcgcccaggccgaattcctcatgctatggacgatgcccaatacttgactag

SEQ ID NO: 77525 - DNA, 531 bp, Glycine max
  Peptide Sequence Number=SeqID_194303
atggatgtgtcgtccaacccaaaaataagacccaacttttcactactaataggaaagaatagcatttgccaatggaaagagatatatggtttggtagtagtggatgactacttaagatggacatgggttacattccttgctcacaagaatgagtcctttgaggtcttctttaaattttgtaaaagagttcaaaatgaaaatggagtatgcattacttcaatcaaaagggatcatggtgaagagtttgaaaatgagagctttcatctattctgtgaagaaaatggaatttttcataacttaaccgcttctagaacacctcaacaaaaggacaacttgggaaagtttgattataagagtgataatggaacattacttgggtacttagaaacatccaaggcatatagagtttacaactctagaacctcagctgtggaagaagctattcattggttgtcgattgcggtgtgggttgtggtggttgcggacattcattccaccaacccctttctacaaacattcgataatttttaa

SEQ ID NO: 77526 - DNA, 162 bp, Glycine max
  Peptide Sequence Number=SeqID_194304
atgtggcaattagtcttggtggatgtccacgtctacgcgatggtgaagtattcggaaagtggaccaccggtgaagcaagtgattttacctataatgggaggtaagcttcataaaaagagtgagcaggctctgggagtgttatcagagttaacggtggtttga

SEQ ID NO: 77527 - DNA, 498 bp, Glycine max
  Peptide Sequence Number=SeqID_194305
atggcagcgacggcggtgacggagacggaggcggtgtggtccgttaagtgctattgctgtgggttaacggaggagtgcacgccgcgttacattgacggcgttagggagaggtatcagggtcgttggatttgtggtttgtgtgctgaggcagtgaaggaagagggtttgaaattgaaagatgatgatgttgatgttgatgttgatgttagcaccgatgaagcactgaagcgccacatgaagttcagatcttccacttctagccctccaaacaaacccacccttgacttgattctcgcaatgaagcaccttcttgttcgctctttggattctccgaggaaggagcctttgactttttccccacttacaacatcacgcacgtgcttttcacctggatcctcaaagggggagccgcaagaggctagaaaggtagttaccatgtcaggggaccttggccgatatgatctaactcatgggaaatggggtccttgtgcacaatga

SEQ ID NO: 77528 - DNA, 1497 bp, Glycine max
  Peptide Sequence Number=SeqID_194306
atgagttctaaaaagattacatggaagtctatagtgttgatcttaagttgtaacaagacttcagaaaaacaggttttgaaacaaggttctttccaaaggttatgcctctcggatataagcattcccagctcccctcaggccattgaagatctttccatttccatttccctggttggcccaaaacttcacacattcacactagatgagctaagggaagcaacacataatttctcatggagtaattttctgggtgaaggcgggttcggacccgtgtacaagggttttgttgatgataaacttagacctggtttgaaggctcagcctctggctgtgaaacaactggacttggatggcttgcaaggtcacagggagtggctggcagagattatatttcttggacagctgaggcatccacatcttgttaagttaatagggtactgttgtgaggatgagcacaggcttctggtgtatgaatacatggcaagaggcagcttggagaatcaactgcacagaagatactctgctgccttaccatggtcaaccaggatgaagattgcattgggtgcagccaagggtctcgccttcctacatgaagcagataaacctgtgatatacagagatttcaaaacttcaaatatcttactagactcggattacacagctaaactatcagaccttgggctagcaaaggatggtcctgaaggggaagccacacatgtaacaacaacatgcataatgggaacccgaggctatgctgctcctgagtacatcatgtcaggtcacctttccaccaagagtgatgtgtatagctatggagtggttttgttggaattgcttacgggaagaagggtagtggataaatgcgggtcgaatcgagaacaaagcctggtggaatgggcaaggcctcttttgagggatcaaagaaagctgcaccatataatagacccaagattggaagggcagtttcctatgaaaggagctttgaaggttgctgcattgacttacaaatgcttgagccgccaccccaatccaaggccttctatgagtgatgttgtaaaaatactagaatcacttcaggactttgatgatgtgatcataggaccatttgtttatgtggccggcacaggcacaagaagtatcaacaacaagggaatcttcgccctcgttcctgaagaagaagtaaccaacagcgagacccacgacgatggccacaaacacccctccgttgaaggacatcaccgacaacatcaacaagtacccgaccgcggagctcagcccgaagagaaacgctccggcgaccttcacgcccaccttgacgcggtttccggcgagcttccgccgcagaagaggggcctcgatctccgccgggaagggctttccggagccgatgagcttgaggcggatgcggcgattctcgaggaactggtagaaggcggcgacgacgaggcacgcgagcagagtgaggagatagtccgtccaatcgttggtcttccatga

SEQ ID NO: 77529 - DNA, 522 bp, Glycine max
  Peptide Sequence Number=SeqID_194307
atgagcaatccttcagatgagaaggagcagtgtcaaaagaagaggaaatccaccatatgtgaagcctccaactttaagacatcaaggagaagattcttcagcaacaaaaatgaagaggatatgaacaagggagtttcaacaacactgaagctttacgatgacccttggaagatcaagaagacgctaaccgatagcgatttgggaatcctaagtagactctcgctggctgcagatttggtgaagaagcaaattttgcctatgttgggtgcagatcatgcaagagctgcagaaactgaagaagggaccccagttagagtttgggacatggacaccaaatccatgcaccagctcgttctaaagcgatggtcttcatccaagagctatgttcttattggaaagtggaaccaagatttcgtgagaagaagagatctcaagaaaggggatgagatcggatttcattgggatccgtataattgcgttttcaatttctgtgtccttaaacgagctatgccagagaattaa

SEQ ID NO: 77530 - DNA, 210 bp, Glycine max
  Peptide Sequence Number=SeqID_194308
atggagttcagttcccaaaaggtgagttctccgacaggtcgtcgagtcagagaagaagtcgtcgtccttgtcatcggagaagaagcctccgtcgttgcgttagagaagaagttttcgtctggggtttcaaccctagctagtaaggttggggaaggggcaatggtggtggagaacatgggggacgacgaaggtgtggaggccatggagtag

SEQ ID NO: 77531 - DNA, 1314 bp, Glycine max
  Peptide Sequence Number=SeqID_194309
atgcttccctcatttctaagcccggtgtccgtgtacagcctctacctccgtcgctgcttcacgggatctgggctctcatcgcagacgctgagcgtggacgacgaaaccacgctccacttttgggccccgacaaacccaacggcccagaagccctccgttgttctgatccacgggtttgggcccgagtccatttggcagtggcgcaaacaggtccagttcttagcccctgacttcaacgtgtacgttctggacctaattttcttcggaggatcgagcaccaaatcgagcgaacggagcgaaacgtttcaggcagcgtcgctggggaaacttttggataaattggaggttgagaagtttcacgtggtggggaccagttatgggggcttggtggcttacaatttggccaagatgttgggggaagagagggtgcaaaaagtagttattgcgagctctggtgtgaacatgatgaagagcagcaacgtggcgttggtgcagagggcacaattggaaaagatcgaggatctgatgttgcctcctacgccacaacatttgcgaatattgatgtcgctgtccattcacaagcctccccaactcttgcctgattttttacttcgggacttcttggataaattatatggagaaaataagaaggaaaaaatggagcttctgaaagggttaaccatcggaagggatgatacttcaagaatttcacctcttcaacaacaagtacatccgacgatgttttacgagcgctgggctctggtcgcaggccctgagcgtggacaaggacggcgaaaccacgatgcacttttggggcccgagaaaagtcgaagcggcccagaagccctccctggttctgatccacgggtttgggcccgcggccatgtggcaatggcgtcgccaggtgaagttcctggccccacacttcaacctatacgtccccgacctcgtattcttcggagggtcgcacacgaagtcgggggaaagaagcgaaatgtttcaggcagcgtcggtggggtgcaaaaagtagttattgctagctccggtgtgaatatgacgatgagtagcaacacggcgttggtgcaaagttctgaaatggagagcatcgatgacctcatgttgcctaccaagccccaccaattgcgaaaattgatgtctctttccatctacaaccctcccccgctagtgcccgattttatgctcaaagccttcatagacgaattatacggagaaaataagaaggaaaaattggagcttctaaaagggataaccatcggaaggaatgatacttcaaatgtttcacctcttcaacag

SEQ ID NO: 77532 - DNA, 243 bp, Glycine max
  Peptide Sequence Number=SeqID_194310
atggtagcatctaaacagatcaacaaggtttttttaggtgaaaactctcagttgttaaagtattaccatgctttccaacagttaagggaagaatttgatgaagtccagttccttggaaggtggaggaaaggtgttcataaagggatccttcatgggatagttttatatcaacgactgagtggggatggagttgttgacaccaattggtgttcagttcttgcaagaaaggcagaagacatccat

SEQ ID NO: 77533 - DNA, 675 bp, Glycine max
  Peptide Sequence Number=SeqID_194311
atggaatcacttcagtatttgacctttcaagccctaacttcttttattggccttaaattggcaacgccttttcaaatcagcgttgtatattcagcgcttaaaaaaacgaagacaatctacagcgcgtttttttttttttactctccgtctcgtgctcaatttcctctctgcctcgcgcccaacccttcttccctcgcgaaccctctcgtcttcatcgacctctttgatgggaaacaagagaaggagaagagggaaaagaaacgaaaggaaggaaggagaaggggcgtgaaggttacatctggtggctccgatggcagatttggtggcttcgaggcgcatgcgacaatggtgggttcatcggaggcatatccattcttctttgttcttctctcttctctcgtacttggctttcttttttcttcgcaacacagaaccctagattctgaaacctcgatggatgaagtttatcagaacactggcagtgagcatgaggccaaatggcataacataagtaactgtgctggaatgctcttcagtaccagaacaccggcagtgagcatgaggccaaaaggcaagacaggatactgtttggaaaatggacttgtagaggctgttggtattcttatttccaaaatgcctcacatgtttgaccttttcttgacatatattctataa

SEQ ID NO: 77534 - DNA, 954 bp, Glycine max
  Peptide Sequence Number=SeqID_194312
atgcacttgcgacttcgagcagccacttccactgcgaacccattcatcccacccgctcacctcatccactccatccctcaatggttctccatcctccgccacgccatcgccgcctccgacttacccctcggaaagcgcgcccacgcccgcatcctaacttccggccaccaccccgaccgcttcctcaccaacaacctcatcaccatgtactctaaatgcggctccctctcctccgcccgcaaactgttcgacacaacgcccgacacaagccgtgatcttgttacctggaacgccatcctctccgcccacgccgacaaagcgcgcgacggcttccacctcttccgcctcctccgccgctccttcgtctccgccacgcgccacactctcgcccccgtcttcaaaatgtgcctcctctccgcctccccctccgccgccgagtccctccacggctacgccgtcaagatcggcttacaatgggacgtgtttgtcgccggtgctttggtcaacatttacgccaaattcggacgaatcagagaggcacgcgttctgttcgatggaatgggtttgagggacgttgttctctggaacgtcatgatgaaagcttacgtcgacactggtctcgaatacgaagcgctgcttctcttctctgagtttaaccgaactggactccgtcccgatgacgtcactctctgtactctcgcgcgggttgtgaaaagtaaacaaaatgttttggaatggcagttgaagcagcttaaagcttatggaacgaagttgtttatgtatgatgatgatgatgatggttcggatgttattgcatggaacaagacactgtcttggtttcttcagagaggtgaaacttgggaagctgttgattgttttgtggatatgattaactcgcgtgttgcctgtgatggcttgacttttgttgtgatgctgtctgtggttgccggttga

SEQ ID NO: 77535 - DNA, 1803 bp, Glycine max
  Peptide Sequence Number=SeqID_194313
atgaacttaaccaagaaaggacccctaacggatgcaaagctattaagcccaaacaaggcaactactctgaatccaaatgcagcagagtttgttccttttgccctcagatcatcatcattatctggaactaccagcttggtagatgcaacagcaaggcttactgctgctggaactcttgggaaagcagttttagatagatcagaatcatccatttcaaataattctgatgatgaggtgcaccgatactggcgatgtcagctcccggatgatattacccctgatttcaaggtcttgggagaagatgagtctcgagttcttgatgatatttctttagcaggtttatctatacatgatgacaatgaagcctccaggtttccttcttctaaaggaagtaaatatataataaatgagcaggaggaaatatctcaacagcatgctaatggcaatagcttggcagataaattagggttttccaattcaagctacagggaggacccatcttctggaagctttttgaatgctctggcaaagccttgggagaggccaattgggagtgctgaccagcgtattaacagtggtcaagagggccttacttatgatgacaactctagacatggatacttaaatgatattttggccgaaaatgcaattgtggatgatactgatctgaatcctttggagtttttagcctccctgttccctggttttgcagcagaaagccttgcagaagcttactttgctaatagatgtgatttacatctgaccactgagatgctcaatcagttagagcttcaagttgatggtggtttcaatcagaatctgaattcaaagactttgtctgctcccaatctcagtgcaatggactaccctgcacttacttcaccagatggccagactgcttcagtagaatatgtggttgataatgtgcaacaaagtggcaatccttaccgatcatatgacagtgatgtgctgcttttcaaatctgtctcttcagtttcatctaggggtggtgctattgactttgcttcagctgttaggaagttggcttctcgggattctggtggtatttggaagtatgataaaaatggctctggtgatgctgctatcggctcaagtaggaattcgaatgttctggctagtggttacaatggtggacaggggagagcacactttggtgatcggttacagaaccgtggttcagctcgggcatttcctgtttggcttgaaactggtgatgcagttgcaaatatgtattcagagttgcgggaagaggctcgtgatcatgcatgcttacgtaatgcatattttgagcaggcacagcaagcctatcttattggtaataaagccctagcaaaggaactaagtgctaaagggcaactgcacaacatgcatatgaaggttgctcatggaaaagctcaagaatccatttacctccagaggtttgttgttccccaatgctttgattcctgctctccattcattgcaagtgttgattttttcagaaatccagttgctccagagttgcagggcgatggaagaggaaatgagaggataatagacctacacgggttgcacgcaagtgaagccattcatgtgctgaaacatgagttgagtgtgctgaaaagcactgccatagctgccgagcagcgtctgcaggtttatattcttgtgggcacaggtcatcataccaggggttctcgcactcctgcaagacttccaatagctgtacagcgttttcttcttgaagagggcattgacttcacggaaactcagccaggcctacttcgtgttgtgatatattga

SEQ ID NO: 77536 - DNA, 1680 bp, Glycine max
  Peptide Sequence Number=SeqID_194314
atggaggaggcggaatttctttttgttaaccaagatggatttgatttggcatcttggaatgctatgatgcatggatacattgtgagtggtgattttcctaaggcattgaggctttacattttaatgcaagaaagtggagagagagcgaatcagattactctggcgaatgcggctaaagctgctgggggattagtggggcttaaacaagggaagcaaattcaggctgttgttgtgaaaagggggtttaatttagatttgtttgtcattagtggtgttcttgacatgtatctaaaatgtggagagatggaaagcgcacggagaattttcaatgaaataccttcgcctgatgatgttgcttggactactatgatatcaggatgtgtggagaatggacaagaggagcatgctcttttcacgtaccatcatatgagactttccaaggtgcagcctgatgagtatacctttgctacccttgtcaaggcttgctctcttttaacggcattggaacaagggagacagattcatgcaaatactgtaaagctaaactgtgcatttgatccttttgtaatgacctcacttgttgacatgtatgctaagtgtgggaatatagaagacgcacgtggtttgtttaaaagaacaaacacgagtaggattgcctcatggaatgccatgatagtaggattagctcaacatggaaatgctgaggaagcccttcagtttttcgaagagatgaaatctaggggagtaacaccagatagagttacttttataggggttctttctgcgtgcagtcactctggtttggtatctgaagcctatgagaatttttattccatgcagaaaatctatggtattgaacctgagattgagcactattcttgtcttgttgatgcccttagccgtgcagggcggatacgagaagctgaaaaggtgatatcatcaatgccttttgaagcttctgcttcaatgtatagaacactgcttaatgcttgtagggttcaggtagacagagaaacaggaaagcgtgtagcagaaaagcttttggccttggagccatctgattcagctgcttatgttcttttatccaatgtttatgcggctgctaaccaatgggaaaatgtggcgagtgctagaaatatgatgagaaaagcaaatgtgaagaaggatccagggtttagttgggtagatttgaagaacaaggtgcatttgtttgtagctggtgataggtcacatgaagaaactgatgttatatataataaggtggagtatatcatgaagaggatcagagaagaaggatatctccctgacacagacttcgcacttgttgatgtagaagaagaagataaagagtgttctttgtattatcatagtgagaagctagcaatagcttatgggcttatgaaaactccaccatccactacattaaggatgcaaatcgatttcatcatttcaggagtggggtttgctcttgtggtgattactgactcaaaacctaatgaaattatgttctggctcgacttgatgctattgccactagtttgttcaatctggggggatgactcgggcttggctcttggtacaaggagtgtggccagatggatgcaccctcctcaggggcggttgaaactaaattgcgatgcatctgtgagtttgaaattcttctgctttcattgccaagag

SEQ ID NO: 77537 - DNA, 550 bp, Glycine max
  Peptide Sequence Number=SeqID_194315
gacaacatgccctcaccttcagaggaataacggtgctgaccttcagagggcaacacgccttcaccttaaaaggcctacacgccctcgccttcagagggcaacacacgctcaccttcagaggattactggtcctgaccttcagagggcaacacgccctcagcttaaaatgcctacatgtcctcgctttcaaagcactacacgtcctccccttcagtggagtacacgtcctcaccttccgaggactacacatcctcgccttcagaggcctacacatgctcaccttcagaggactacacctcctcgccttcagagggctagattccctcaccttgagagtactacacgtcctcgccttccgaggactctacgccctcactttcgtagggctacacgccctccccttcagaggactacacgtcatcaacttcagagggctacacgccctaaccttttgaggactacacgccctcgcattcagaggactgcttgtcctccccttcaaaggagaacatttcctcaccttccgaggacaacacgtcctcgcctttag

SEQ ID NO: 77538 - DNA, 955 bp, Glycine max
  Peptide Sequence Number=SeqID_194316
ctatcagatagaggtgtatgaagttgcaaggagaaggaacacaatagctgtgttggatacagggtctggtaagaccttgaatgctgtaatgctcatgaaagagcaattcaagaatatgaaatttctgactgattttcaagttgaggaatactatggagctaaaggagttgatacatggagtttgaagatgtgggagaaagtgattagtaacaatgatttaattagttatatcaactgtaacgcccttgattgtcgtcttcttggcggcttacatattacaacacttcacacggtgacacttcacacggtgacacttcactcaacattcttattggtcagaaccctctgtaggagtaatgactatcttgggaagtttttcgctggatgtgttcttaagactattgctgactgtgttgaagctctgataggagcatactatgtagatggtggactctttgcttcacttaatgtgatgaaatggcttgggattggtgttgaacttgaactatcatcacttgatgaagcaatcactgctgcatctctgagtacatgtgtgccaatagaaagtgatattgcaagccttgaaaagaaaattgagtatgaattttcagtcaagggactcttactggaggcaatcacacatttgtctgagaaagaacttgggattggctgctgttatgagaggcttaaatttcttggtgactcggtattggacctgcttatcacatggcatctttatcagagtcacacagatattgatccaggggtgttggctgacttacgttctgcttctgtcaataatgacaattttgctcaagttgctgttagacataaccttcaccagcaccttctacatagctcaggattattagtgagccagatattagaatatgtgaaggtcatttctgaatcagatcccagatcacttccaagtattagagctcccaaggtttag

SEQ ID NO: 77539 - DNA, 429 bp, Glycine max
  Peptide Sequence Number=SeqID_194317
atgaagaagaatcaagtagtttcaatgatgccaaaaagcactttgatttatgaggtttttgggataaaaatggtcattgaccaatccttattctatgacttgacccaattatctagtgaaggtgtaccatttgaaggtgcactaaatgatgattggaaatttgatttctctatgcatgatgcccaccggttggtttgcaccaaccaagcggatatgaccggaaggctttttgtcggatcattggctcttgaaagccgcatccttcactatcttattgtgcgcattttacttccaagatcttcaaaccttgcacaagtttctaaagaagattttattgtcatgtgggcttttcataccggccgacaaattgattgggcacacttagtcgaatatcacatgcataaggcattgcgattggggatcctctag

SEQ ID NO: 77540 - DNA, 1305 bp, Glycine max
  Peptide Sequence Number=SeqID_194318
atgaagttagggggcaggcggaaatacccaagtggttatccgtacaaacacttttgctatccatcagacccagagcacgatagcatgcagagactaacgtcgtcttctgcaccctttgtcaatcgcagccaagcccgtttacacgcggagatttacgccttcttccgcgctttctgtcacactgaccctaaagtcaggcggaaatacccaagtggttatccgtacaaacacttttgctatccattagacccagagcatgatagcatgcagagactaacgtcgtcttctgcaccctttgtcattcgcatccgaacccgtttagatgcggagatttacgccatcttccgcgctttctgtcacactgaccctaaagtcaggtggaaatacccaagtggttatccgtacaaacacttttgctatccatcagacccagagcacgatagcatgcagagactaacgtcgtcttctgcaccctttgtcaatcgtgacccagagaatgatagcacgcaaagactaacatcatctcctgcaccttttgtcgttctgaccgtgaagtcaggtgacatgcggggttaccttatggtcacccgcacctttcgtcaaacaggggcaaatgagcccgttgacgcgcagagactaacatcatctcctggaccttctttcgtcctgacccgggcaaacgagcccgttaatgcgcagagactaacatcgtctcctgcaccttctgtcctcctgacccgtgaagtcaggtggcaggcggagataccttatggtcatctgcgcctttcgtcaaccgaggggaacgaattcgatggtatcaggatgatgttggtcgttcgggacgatcgaatgtgttggcgaagggaagtgtcgtggttatccaactttgtcattttcaagacactgaagggtgtgcaaatagcaaccaagcccacttgggccttccagggtgttccaacagaaggcggtgccttctggtggaagcaacccagctcgcctgggcgagctgggcggcaaccacctccctacgttatcgtgagcgatttcgtgatgattttccaccattcttcatcgttctttgtcgttcttcggtcttcaaccgacgcacccgtgagtctcgcatcgccctcccgccgaaggggacgtctcgggcttcatcctcctcagtttttgctttaccggggaacactcaagattcagagggccattaattcttcacgaatgcgtgcggccatacccgtgcctacttttacttcccttcttccattgtcggttcctaaatctacgagttctgtctcttcttga

SEQ ID NO: 77541 - DNA, 192 bp, Glycine max
  Peptide Sequence Number=SeqID_194319
gggcagggttccgccccttttgtgtgccctactccggagcagtttggggctgaggttgcatggcctggagactggcccgatgcccaggcaggggaggagcctgcaggatcccccggtgaggcggatgagtcctatatggatgaagatatgattgacctgctcggtttcttggaagggagcgaagccgcgtga

SEQ ID NO: 77542 - DNA, 246 bp, Glycine max
  Peptide Sequence Number=SeqID_194320
atgaggggtgaagaggaagtgagggagtgcaattgggaggccactagatgcaaagaccctgtcatagttgcaatagcaatggtctttggccagagaggagcggaagcagaaaagaggaaagaaaaagaagggtggcaaagccttctggtgatggtgcacagacaagaaaggaaagagagaggcaaagagaaaaagagagggagagaacaacgtgccaaagggcaaaatggacaatttgtaaactaa

SEQ ID NO: 77543 - DNA, 657 bp, Glycine max
  Peptide Sequence Number=SeqID_194321
atgactgggtcaaaatcaaatggcacaacagagaaaagacccttattgtatgatcaccgtccctactttttgtttgaagatgactacctacgtgtttgtcaaattccaaaacgcaagggcgcaaatttccgtgatctgcctggtgtaattgtaggagctgacaatgtggttagacgacatccgacagagaatccattgctaccatctggaaagccattggagagcagccaccaccagcaccgtcttcttcaccagcattggaaaatccagcttctagtaacgcacaagatcttgcagatgctcatctcgtttgacgtccgcttgacgttcctctcatcgatggatgctctccatggcaacattggaatactcaccaattgcgacatgctcatcctcctcggcaattctggctccaccaaggagctcctctgcctggtgccgtacgcaagggcgaagggcaaactcctcgtcgtgctcaccttcgacaaaggcaacatgtttgcggcggcgtgtgacatggctgtgcatttgctgctccaaagagagctctgtccgacagtatccattcaacctcacaccggtcacctccactgccattcagatggtgttcggctttactgtggtggtggtcgtcgaagaggaggaaggagattatga

SEQ ID NO: 77544 - DNA, 1212 bp, Glycine max
  Peptide Sequence Number=SeqID_194322
atgtgggctctaccaaatgggtatgaggtgactgatagtcatgctctggtgagatattggttgagtggattgggtttcacacattttaccaatcatgtgtccgcaacaaaggctggacagttgatgaaaaagattatatctattaagtgtcaatatactgccttaaataatcctgttaagactaatgagttatcaccaccttctgttcttgagagtctctcaacagatgcctctacagtaactgagagtcaaccctgttctgagttgaacaagacagaattagcattactagatctctattctgggtgtggtggcatgtcaactggattgtgcttaggtgccaaaactgcatcagttaaccttgtcacgagatgggctgttgatagtgataggtctgctggtgaaagcttgaaactaaaccattcggacacccatgtgcgaaatgaatctgccgaggactttctggaactattgaaggcgtgggaaaagctatgcaaacggtataatgtcagcagcacagaaagaaaacttccatttcgatccaattcttcaggagcaaagaaacgagggaattctgaagttcacgaaatttctgatggtgaacttgaagtttctaagttagttgatatttgttttggtgatcccaatgaaactggcaaacgtggtctatatttgaaggtgcattggaagggttacagtgcaagtgaagacacatgggaaccaattaaaagcttaagcaagtgtaaggaaagcatgcaggattttgtgaggaaagggatgaaatcaaatatcttgcctcttcctggtgaagttgatgtcatttgtgggggtcctccttgtcaaggaataagtggatataatcgctttcgaaactgtgcatcaccattagatgatgaaaggaatcgtcagattgtgattttcatggacatggtgaaatttttgaagcctaggtatgttttaatggaaaatgtggttgacatattgagatttgacaagggttcgcttggaagatatgcattgagtcgtttggtacatatgaactaccaagcaaggttgggaatcattgctgctgggtgttatggtcttccccaatttcggttgcgtgttttcttgtggggtgctcatccaagtgagattgtctatgttaatccatccatatttatgggaaagcatatgcctctctcgatcgatgtcttcaacagcttgcgttaa

SEQ ID NO: 77545 - DNA, 1875 bp, Glycine max
  Peptide Sequence Number=SeqID_194323
atgactatgttgttgtccacaatcattgttccttccaccaagctcatcatcttcaacaacaacaacacgcaagagcgtgcacttccaacttttcgtcatttctcagattccagcaaacgcttcgagaaagtgtcgtcctttattgcttttgcggtgaacggtggctccgctcatgttaaagctacgcataggagagatggtagtagaaacccgcttatgagtgaggggagagatgaagatgaagctagaggacccatttgccctggttgtggagtcttcatgcaagataaggaccctaattttctcgggtattaccaaccaaggaagatgaaaatggaagagttttcagaagaggaggatgatgatgtggggtttttgaatggaagtgaaagtgagcttggagaagaaagtgaagggttaatagatgagttagattgggattctgatgatttggaagatgagttattgggtgaagatgataatgagaagttggaattggatgggtttacacctgctggagttgggtatggtaacataactgaggagtatttggagagggtgaagaagaagaaggtttccaaagctgagaagaagaggatggctaaggaggctgacaaggagaaagaggaggccaccgtgtgtgcccggtgccattccttgagaaactatggccaggtgaagaaccagacggtggagaatctcatacctgattttgatttcgataggttgatttcgacgcggctgatgaacccttctgggagtggcagtgctactgttgttgtcatggttgtggactgtgttgatttcgatggttcattccctagaactgcggtgaagtcgttgttccaggcgttggaaagaattcaggataactcgaagaggtccaagaagctgccaaaacttgttcttgtggccacaaaggttgatctccttccgtcgcaggtttctcctgcaaggttggatagatgggttagaaaccgtgcaagatccggaggagcgcctaagttaaacggggtttatatggtcagttcgaagaaggatttaggtgtgaggaatttgttgtcatttgtgaaggatttggctggtcctcgtgggaatgtgtgggtgattggagctcaaaatgcagggaagtctactctgatcaatgcgtttgcaaagaaacaaggagctaaagttacgaagctcacggaagctccaattcctggcacaacgcttgggatcttgagaattgcaggagttttgccagctaagactaagatgtttgacactccagggctcttgcacccatatttaatgtcaatgagattgaaccgggatgagcaaaagatggttgagatacggaaggaacttcggcctcggacatacagaattaaggcaaggcaggctatacacattggtggcttgacaagacttgaccttgttgaagcctctgttgaaacaatatatgccacagtttgggcatcactaaatgtttctcttcacatggggaaaatagaaaatgctgacgagcctcccactggtaacgaccgtgccgccgaactaggaacatggcaggaaagggaagtcaaagtgtctggaaccagttgggatgtcaacaccattgacatagcaatagcgggtttaggttggttctcattgtgtctcaaaggtgaagcaaccacaaaactgtgggtcttccatggagtagaagtaaccttgagagaacctttggtgcttgaccgggcgccatcacttgagaagccaggattttggctaccaaaagcaatatctgatgctattggcaaccaaaccaaacttgaagctcaaagaaggaaacaacaacttgaagatgaaggtacggaatacgtgggggcaggggcagagttatctgcatga

SEQ ID NO: 77546 - DNA, 303 bp, Glycine max
  Peptide Sequence Number=SeqID_194324
atggactattacaatgagagtattcttttggctttaattgctacaatggaaaagtctcttaaggttgacatcaagaagattaatacctcaggaagattaataccccaagagagggttgtttgtcatgcaggagacgatgacatagatcaagtccatggagatgctacacatgcaaaccctaatgttaatgaggtaattattggaattaaggacatcagtaaggaaagaatatttgtatggatactagattatggtcacaaaaggaaaacacacgtggaagtcaaatatttgtatggagactag

SEQ ID NO: 77547 - DNA, 1285 bp, Glycine max
  Peptide Sequence Number=SeqID_194325
atggcgccaaaacgaaaaccttcgtctccaatctccattggtaactgcgagattacggtcgaggctaaccgcttcacctgcaactccgattcaaacggcgtcgtaatctctcttccccgaagcgggaagatcaaagtgtcagcagtggctccaaaccgtggaagcgcttctgaggatttgaggtctggcgataaagaacacgagttcgtgctagttaatcctaaagatgttgatgctattagcaaatcttaccttcaggaagtattacagatgtatacgacagagctacctggaatgaattatgccgcgaatacaggaaagcaatcaaagtttcttgagagatgtgtgactaatgggaaatatcgtacactacttatcaaatccacttctgttggaaattcaggaaaggttatagctgcaattacataccaaatcatccctgcagatacagaatatgcagagatcccacttgcagctgtcaatgcaatctatcaacggaagggttttggccatctaatgtttctagagctaaggaagagacttcaaagtgttggtgttcgttctattttatgctggggggacaaagaatcagaaggattttggcttaaacagggttttgtagaaatagcacaggtgggtaccaaaggaagggcccgcaggttacccataaaagctgatattcaaaaatcattatgctttcttggtggttcgactctcatggtttgccacctagggaaagaattattagctgacgatgctaacactgtgaagtatctcccctcacagtttcatcagaattcctttacatctgccattgctgaagatgagcagcttgaattttcgggaaagttacatgtggatttgaaatttccagataaatcttcccatagaacagaatcaagtaaaaatcaacatgaagctttggtgaaagaaggatcttcaacagaatatgacaaactcagtggatttgacagtcacaatgctaaggaatgctgcactggcatttctccttttgccaaagtaaatgatgatagacaggccagtccagaaagttcacaggatggaattgatgctaatgtgaagtattcttctcaatctacaaaaggtgcaaagagggcctgggaagcctctttgtcctcattgaagtcaaaaagggtgaaggggagccagatggttgactatcaaccagattctagctgcggttttatcttcgagactgataaggccaatccttgttttgatgaagtccctcatgatccttcaattacaaaaagttctgaaaaat

SEQ ID NO: 77548 - DNA, 237 bp, Glycine max
  Peptide Sequence Number=SeqID_194326
atggccaaagaatttgtgaatggctctgttcatcaaaacggcgtcattgtcataatcatcgatcgcctcaaagctctcaatgccataaacctagattacaaagctcgaaaacttgctttgcagctctggcttgaagcagtttgttatacacttgatcatactaatgctttaaagttgtttaacatggccccccctcctccctcagaaaacaatcaggatagcagcacgccttcttag

SEQ ID NO: 77549 - DNA, 831 bp, Glycine max
  Peptide Sequence Number=SeqID_194327
atggaaagaattgcttacctaaaggaccaaaatgtagattccaatcttcattcagatgctaagcctatcaaaaattctcacgggaagttctttggtgagaagcacttgaggcagtgcccaggattagatccatcatgtgaggcatatgcagaaaagcttgaggtgaaactgcatggtacattggagcctaggagatctcctagactttcatcgtcaaatgggaatgaaaacacggaaattaatgcttcacaagttaaaagaacatcaaaagtagttcaccaaaagaaaaaaaataccaaagtgatttctacttacattgaattgtctaattcaccagttgagcagcatatgtgtggaattgatgatacaaaatacttgataaggtcttcagaggcaatcacatccccatcctggactgaaaatggcagaacaacttctaattcctttgccttgcctgagtcagatgacaggccaccaagaaagaaatttaatacatctacttcttcaactaaggaatgtatagattcagaaaactttccttccttcattggtgatccaatacctgatgatgaagctcagaaaagatggggatggcgttatgaattaaaggttgttgacctgattctttcagacaaaaaatgtaaagacaacatgtttaaaataaacgagggtgaagaagatgagattattgcaaatgtcaaatgccattatgcccaagctgaaattgggaattgtatttttagtcttggcgattgtgcatttgtaaaacattgcatttccaccatgagcttgtgcaatgtcaatttaatgaaggatatatatgcagcctaa

SEQ ID NO: 77550 - DNA, 1089 bp, Glycine max
  Peptide Sequence Number=SeqID_194328
atgagaagacattgtaggctttggtggccaaagcaacttttatcaaatgaagaatcatcatccagtattttgttggggtggtttgtcacctgctcaccatcatcccttgacattattgtagcctttacttgcagtgaagtcttgctttctagttatagtcctggcattgagggaatcattgatggcacatgtgggagcatgccttcagttcttgaggataagtccaagttctctgtgcttggtctgtgtgtcactggccctactactagtaatggtttgatgaatggggcggaagatgacaaaaagaagttctctgagcatggcaatgctttgcaagagggaggtacagatggaaagaataactctatgagttgtcgatgcttccagttagatggttcattgaggaaaagtagccaatatgttcttggaagaagtaattgggttctgctcatgtttgattctcctgaacagaatgatgtagtaatacacaggcttccaaaattgcatcacattcattggaatggactaactgtgtcacaatatgatgttcacgttataatttatgaaacaccctcttatggtgctcatcatttctcattatgtcattcgggttcaaatgagcaagctaaaacttccattaaaaatcctaaatgggtcgatgagcttcataaaaagcagcaattcattgaattggatacaattattctggcaattaattgcactgctgctgctaaaagaatttttgagacacacctggtcccaagaagatcattgagccagctctccatatttcccatgctttatgttgtcatagggcacctgttttccaaattttgggcttcgatctccaccatgctctatattgttcttcagtttttccaaacacattttagttacgaatcagaatcatgggcatatgtgaaatcaacaaatgtattcatgaagactgcttggattaatatgcgaatccgttgtggtcagatattatattggccaatctttcttcgggaaaatgaccccaggacaagttttggtggggctgttaaagaaaccaaatcaaacccaactaaactggttaaactgaattaa

SEQ ID NO: 77551 - DNA, 456 bp, Glycine max
  Peptide Sequence Number=SeqID_194329
atgaaatcgccgcagcacaaaaacaaaacaccaaaatcccgatcagatcctcaacaacaacaaaaatccaattccctggccgtcaccgttttccgaaatgcacccgattattattcctgcgacccccttattccgttaagcacgtgcctccccgcctcgggcacgtgcgccgccagaatgcgcctactgccgcatgcagatcaggctctcagtctccgccgctccccccgcttcaattctgctccggccgccgtggatggcggcaatgcgggctccagaaagcggaagcggtcgccggaaacggcggcgacggcagcggaggaggagacatctcggagacgctccccgagattctcaacacccgttaagaaagtgcaaattgtcctgcaattgccagcagcttgccagcttgtggctggacaatttttatacgtatatagatatagatatagatga

SEQ ID NO: 77552 - DNA, 822 bp, Glycine max
  Peptide Sequence Number=SeqID_194330
atgggaaaccctgcaggcttcaaattgaatgctgagttggcaggagtacttggcatggcttctttgaatgcagtccagatatggtcaacactctggatctttgtgggttacatcttcaattatattattcaagggctttctgtcttaggaatcctttgtggattcactgttcctgctgctttggtcatagacatgattgcactggcaactttacacatttcaactcttcattggttcatttcacttgtatattcatcacaattacaggcattagcagccttgtggcggcttttcaggggtcggaaatggaatcctctgaggcagcggttggatagctttgactatactgtgaagcaacacattgttggatctcttttatttacaccacttctacttcttttaccaactacttccgttttctatatattctttagtatcatggacacaaccattaaccttgtctgtctactgattgaagtcactatttcagtaattcatgttaccccttataccaagatatttctttggttggtaagacaaggaagattcccttctggaatatggcttgaaattattggttgtcagagtaatagtactgcctctccaagtgctgatattactgatgaaatgacctcatacaaggagtcattgcatctaaaggatttcaatagagaaaaatctagtagtctagtttcagctctccacagcaactacttgagcatagggaaattgaatgtgacatcatgtggtcaatgtgcagctttgttttatgaaaatacttttcctcttgatattttgattgctgtgacctgggagtggtga

SEQ ID NO: 77553 - DNA, 171 bp, Glycine max
  Peptide Sequence Number=SeqID_194331
atggagtgttactcttacaatatccaaggttcttctatctatatgctctctgctgacagaccccaaccagatgatcctctagtgcctgagattgctcacatgtacaagattaagagagccaagtatgaggccactgctcggtcatggacagaaaaatatgtcgtgggctaa

SEQ ID NO: 77554 - DNA, 552 bp, Glycine max
  Peptide Sequence Number=SeqID_194332
atggacgagcacatgaactcaacaaattaccttgcacggcttatcaagtgccaaggccctcaaactaatgaagcaaaagttggcataggagagcacacagacaagaacatattgaccacattgtgtcaaaatcaaattgatggtttagaggcatggacaaatgggagggtgcatacgcctaatcaccgagtgatgatgagtggaaacgagacaaggttcactattggattatttacagttccaaaaccagggttcataataaaggcccctgaggagcttgtgacagaggaacaccctttgctctttaagccctttgtccagagtgagttcatgaagtttcttcactcttctgagagtacaaagaatgctctgaagggaaaccaccaccagtgcgccactaccatcgatcacgctgcaccaccaccatggttgaccgcgtcgtccaaccccttctgcgaagaagagaaaaagggttcagttgtggatggcgtgcgtgcagtgcaagggatgctatgggagggtcgtaagggagaaggggaaggggttggatag

SEQ ID NO: 77555 - DNA, 420 bp, Glycine max
  Peptide Sequence Number=SeqID_194333
gtaccttcttccaaatctattaacaaagtgaagagcaatagcgagggaagaaaaagcatggggtcagaacccgaattgaagctgccaactattgacttctccattgaggacttggagttcaatgttgctaagtgggaattagtgaaatcccaagttcacaaagcacttgtagagtatggttgctttgaggctttgtttgataaagtccctttggaccttcgaaaagccatttttcttcaagtggaagagatgttcgatctccctttacaaaccaagcaacgagttgtgtctagtaggccataccatggttatgttgggcctcttcaactctatgagaacatggtaattgacgatgtagataatcatgacagtggaaagtttaatcaagatcttatggccacaaggaaaaccaagttttag

SEQ ID NO: 77556 - DNA, 648 bp, Glycine max
  Peptide Sequence Number=SeqID_194334
atggccattgacaatccattgaatgataaagattgtcacaagtacacaactaatatgtggccacaagggaatgaccaattcagtgaaagtgtgaattcatatgcaaatgaagtggtagaactggattatcttgttaagagaatggcgtttcagagctatggattggacaataagaaatgtaactctttgcttgaatcaactgattatgttctcagatgctacaaatacagaacacctaagaagggagagaccaacttaggagtgcgtcctcatacagattcaggattcctaactatattgaatcagaagttaaatagcttaaaaattcaattgaaggatggagagtggttcaaggttgatgcctcacccaacatgttagctgtcttggctagtgatgcattcatggtatggagtaatgacaggatacggggatgtgtacaccaagtattcatgaattcaaaggtagacagatactgtttggcgctactttcatatgctggaaaggtgatggaaccagaggaaaaattagaggatgagaaacatcctcttcgttataaaccatttgatcattatggatatcttcgtttcttcctcacagaagaagctgtaaaatctgcttttaggatcaaggtatattgtggtatttga

SEQ ID NO: 77557 - DNA, 138 bp, Glycine max
  Peptide Sequence Number=SeqID_194335
atgggtcctggaattgacgttgaaaacctttattctagtagtggggaaagaatattaggagttttcacaaagactgatcttatggacaagggtactgatgcagttgatgttggacaaatgtggcctcagttgtcttaa

SEQ ID NO: 77558 - DNA, 999 bp, Glycine max
  Peptide Sequence Number=SeqID_194336
atgggatcccaaacacagtctcaagaacttcatgtggtggacttcaccgacgaaaacacgaagaagcccggcaccgatgcatggctctcagcgtgcagtgtagtgaggactgcactcgaggacaacggttttttcatggcacgctatgataaagttggcaaagagctttgtgactcagttgtatctgcggtggaagagctatttgatctccctgtggagacaaaagcgcaaaagactagtgagaaacttttccatggctacttagggcaagtctcgtggcttcctttgtatgaatctgtgggcattgatgatccgttgaccttgctagggtgtcaaaaatttggccacataatgtggccggaggggaatcatcgtttctgctcatggcagaggtttaattttccatatagtgaaagcatcaatgagtattctaagttgttgggagagttggaccatatggcgaagagaatggtgtttgagagctatggtgtggacatgcaacgatgcgattctttcatagaatcaaacgattatctacttcgatgcatgatgtataggacaccccagacgggtgaaattgatttgggactgcaacctcactcggacttgaccatcacttccattgtacatcagctgaataatctgaatggcttggaaatcaaactgaaggatggggaatggaaagggattgatgcttcaccctcttcgtttgtagttatggcaggtgacgcattcaatgtgtggagtaatggcagaatacggccatgtgaacacagagttacaatgaatgcaaagaaaaccagatactctatgggactgttttcttttggtggtaataaggtgatgcgtatacctgaggagctagttaataagcaacatcccttgcgttataaaccactattcgaccattatgaataccttcgtttctatgacaaagagaaaatcaaagagccttactctcgaatccaagcccattgtggaatctctaccctacagtag

SEQ ID NO: 77559 - DNA, 705 bp, Glycine max
  Peptide Sequence Number=SeqID_194337
atggctgatgaagcttctggagatgttgatctaaggttgggagagcccaaggcgcctaaagaggagcccgagacggaggaggggtctgccatacgtgtgatgccggtggcggttcacgtgccggcagggatgtccatgtccatgtccaaggctctggcccaagcccaagctcaggcccaagcccaagcccaaccacaaaaacgggcctccaccaaagaccgtcataccaaagtagagggccgaggtaggaggatccgaatgcccgccacgtgtgcggcacggatcttccagctgacccgagaacttggtcataaatccgacggcgaaaccatccggtggcttctcgaacacgccgaacctgccatcatcgccgccaccggcaccggtaccgtccccgccatcgcgatgtccgtcaacggaaccctaaagattccaaccacttcaccttccgaccaagaacccggagaccagcccgagaggaagaagcgcaaacgacccgcgaatagcgcctacgttgacataaacgacgccgccgtttcgatctccaccgggctcgcaagctctaataataataaccaaaacgcagcaacgacgacgacgatgacaattccgcaacatacagcaattcctttgccgcaaggaatggttcccgtgtgggccataccttcaaacgccgtcgttccggcagcaggcgcgttttttgtg

SEQ ID NO: 77560 - DNA, 204 bp, Glycine max
  Peptide Sequence Number=SeqID_194338
atgtcgagccgacggggtcaaataccagtagtgacaatggcaatgggggagctggacactgctgaaccggaagagattatatactgcaacataggtgggaatttctggctgcttgtcgagtttggttcttttctagattcaggtcacactgttgtccaattcaaatcccatcaaattggcctttctttccaatatgattggtga

SEQ ID NO: 77561 - DNA, 561 bp, Glycine max
  Peptide Sequence Number=SeqID_194339
atgagtgaagtagaggaggtgcaagagcagatgaagaccgacatagatgccatgaaagaacagatgaccacaatgatggaggccatgatgagtatgagaaggatgatggaggtcaatacaactactgttgttgtcgaaagtaccgccacaaaagtggacccgactcacccacctggcttcaatcaagtaaatcgtccagcttcggatatggtaggtcagggaggtgaagcgttgggaagtacaggcggcccctatttggtgcaagttcaaaacaagcattccttcccaccatatgtcttgcctcccaactatacaccacccaatgttgcacacactcccgatgagaatgtcaaaaactccgctcccataccaattgagagccaacaaccccaatttggtcatgcacaggtccctctacccatggggggacacatgaagtatcccgagaccacactttatccgactttgagccttacctcggatatgccactaagggatagacattttgtgtgggaagagtacctcctgctatggtggaaagggaaaaattcgatcatatag

SEQ ID NO: 77562 - DNA, 2532 bp, Glycine max
  Peptide Sequence Number=SeqID_194340
atggatcatattagtaatgaggccagtgttgaccgttttccaattggtccttctggcattcttggtaggacaattgctttcagggttcttttttgcaagtctatctcacattttaggcaccacatatttattgtgttgttagatctcttctataggtttagggggggtttggcatcctttatatcatggttgcatcccaggaaccctcaagggatattggcaatgatgacaattgttgctttcttgttgaaacgatacacaaatgtgaaatcaagggctgaaatggcatataggaggaagttttggagaaacatgatgagaagtgctttgacctatgaggagtgggctcatgcagctaagatgcttgataaagagacaacaaagatgaatgaatcagacctttatgatgtggaattggtgaggaacaagcttcaagagctccgccaccgtcgacaagagggatctctcggagatataatgttttttatgcgtgccgatcttattagaaatttaggtaatatgtgtaaccctgaactacacaagggtaggcttcaggtgcctaaattaatcaaggagtacattgatgaagtaacgactcaattgagaatggtctgtgattctgattcagaggagctatcattggaagaaaagcttgctttcatgcatgaaactaggcatgcatttgggaggactgctttgctgttaagtgggggtgcctctcttggagcttctcatgtgggtgtagttaaaacactggtagaacataaactcatgcctaggataattgctggttcaagtgtgggatccattatgtgtgctgttgttgccactaggacttggcctgagctccagagcttttttgaggattcatggcactcattgcaattttttgatcaaatgggtgggatttttgcagttgttaagagagtcacaacattgggtgctgttcatgagatcagacagttgcaaatgatgttgaggcatctaacaagcaaccttacatttcaagaagcttatgacatgacaggcagaattcttgggattactgtttgttccccaaggaagcatgaaccgcctagatgtcttaactacttgacttcaccccatgtggttatatggagtgcagtaaccgcttcttgtgcctttcctggcctttttgaggctcaagaattgatggcaaaggatagaagtggagagattgttccttaccaccctccttttaacttaggccctgaagagggctccacaccagtgcgccgttggagggatggtagcttggagattgatttacctatgatgcagttgaaagaactattcaatgtcaatcattttatagttagtcaggccaaccctcatattgcaccactattgagattgaaagaatttgtgcggacttatgggggcaactttgctgccaagcttgctcatcttgtggagatggaggtgaaacataggtgtcatcaaatactggaacttggttttccattaggtggacttgctaaattgtttgctcaagactgggaaggtgatgtgactgttgttattcccgcaactcttgctcagtacaccaaaattatacagaacccttcttatggagagcttcaaaaggcagccaaccaagggagaagatgtacctgggagaaactttcagccataaaagcaaattgtggcattgagcttgctcttgatgagtgtgttgtgattctcaatcatatgagaagactaaagagaattgctgagagagctgcttctgcctctcatggtttgtccagcactgtcaggttcagtgcttcaaaaagaattccttcgtggaattgcattgcacgagagaattcgaccggctcccttgaggaccttactgatgttgcctcctcattgcatcaaggcatcggcagttccagcagagccaatggcaaaacttggaagacccaccgtggcatacatgatggaagtgacagtgactctgaaagtgttgatttgcattcttggacaagaactggcgggcctttgatgagaactacttcagcaaatatgttcgttgattttctccaaaacttagaggttgatacggatcctaataaaggcttagtgagtcacactatccataatgattttcagtatcatagccccaggctcacaacactagataggaactctgatagcacagaatctgagccaagggaaactggcaacagggttgtcaatgtgtccagcatacttgtgaccgaaggtgatcttctgcagcctgaaaggatccataatgggattgtgtttaatgttgtcaagaaagaagacttgtcacccttaagtagtagcagtcatggttttgaaaattacaacattgaagttgctgaatgtgtccaagatgagtgtccagggaaggagatagatgctgctagctctgcatctgaacacggagatgatgaagaatccatgccagccaggtccttaactgacatgccagattacaattccattgatcatcattcgggcacagattcgggtatggatcaaagcattgttgacagttag

SEQ ID NO: 77563 - DNA, 3483 bp, Glycine max
  Peptide Sequence Number=SeqID_194341
atgaaggttgaaattgaaggcagccacagtgattatgctgaatctgtttccagacaaccagaaaatagaggaagattggaatccaagaagaaactgaagaaagtgaggtcaataaggcttgtaagattgccaagcaagagatcatccaccagaggagggagacaccgccatgattatctcttcattgacacagaaagtttagaggggccaacaccaattgaaatggtagatgcatcaccaaattacatgaaggctaccagcagttctcatgcaaaagatagtattcagaatacacaaagaatactattcacaaagaagactttgacaagaatgtctactactttgaaactgaagagaagtctgaccagaaagttatctggaaggactgaaccaaagagggaactgaagtcctcaagatcaatcaagtttgcagctgtcaagggccaaaaatcaacaagaaagttttatgaatctaattatggaagtgatgaccagaattggaaaagtgcaagtgatgctggtaacaaactccagagagtcataaccagaagattaagcttgaagcccgtgaggatcttagcaaagatgcctactttcaaatcaaagaattcttccatggagagaggcaatcagatatctcaatccccatacacaagcttgcttagagccacttgtacttctgctctcaaggattcccattttcctgagaaaattgacctccctcaagagggaagtgactctcaaggagtatcagctgtgaaggtttgtccatattcttactgctcacttcacggtcaacgccacaccaatctgcctccactgaagcgctttgtgtcaatgaggaggcgcacgttgaagagccaaaagccaacaaaaatggattgtcaacctgacactagatcaaagcagattggtaatgcaaagaaagccgctcagaaaactcaaactgtccacaaagaagatggaagatctcattttcagaacaagaaaaagctggctaggggcttatggattaggcctcatggcactccagcatccacagtttctgaaggtgtggaatcaacatcaacagatagagtcgagttttctgctcctgatactgagatattggagagagaagtaactaacactggcaacacaagcaaaaatatgaagctggattgtgaagtactgaagatgagttctttacagaaagagtctacacatgctagcactactgatatggcaaggggaatgcaggaaagagataaaaaatttgtcaaaatgtggcagttgatgtataagcatgctgtattgagtaacacaggtgaaaataagcagcaatttgatgggaaggacaaggaaggaagagagcaagatttctttgcaactaatgaagtgaacaactcttgtcgtgatgattgtgatacagatcaggatatggatgaggaaaataaggatgcaattgagctggtgcagaaagcatttgatgaaatccttcttccagagcctgaagacctcttttctgatgatcaattcaaatctgaaggcattgattcagatgtggtacacttagaaaagagtgaagttgagagaaaaaggaatacttcaacatccacagaatctccaacagcacagaggatggggaccaaacctgaccaaagagcaccaagaagctggagcaatctgaagaagttaatcctcttgaaaaggtttgtgaatgcattagagaaggtaagaaacatcaaccccaaaagaccaagacgttttccttctgatgctaacttagaaatagaaaaagtttttctcaagcaccaaacagcggaagagaagaagaatgctgaggaatggatgcttgactatgcacttcaaaaggttgtttctaaacttgcacctgctcaaagacaaaaagtgacacttctagtaaaagcttttgaaacaattctgccatttcaagttgctgaaaatagtccacggttttctccaacaatggaacctcaagcaaatccagttcaaccccttgacaattcctcaaatcacagcgaggaagaaacatcattttctcatgatagcagtatggaactgacagaaaatactagtgatgatccaatgccagaactgcacaatcctactacgctcaaagaaagatgtcttgagtctcttgattttcctggaaccgagacagtcaagaatatgcctgcctttggagctactgaagaagacttgagtggaaagcaaagtttagctggcagttatgataatgaggagaagatatcaagtgacagtgataatatttatcttgtagagatcaaagatactacctcaagttccttaaatgagccagttgaaattataagaagcagtcatgaggaggctccaaccaatgaaacagtcaatgatgttccagaagatttgctatccagtgtgaatacagaaaatccagatatcaaatctgagtcacctggaagagatgttgaaaccaagaatctgaatggtgataatggggaaaaaatttccatgtccaaaagtttagtcctagaaggtttagttagatcactcagatctaatttgattggttcaggagcacctgtaaacgaaccaactgccaacaacagaaaagaaggaattgaaaatgttaaacaggaaactgagactcttgaagagttccctacaaaggaacaatctgaagctcatattagtgctgttgtagaacctgagacccctgtagagaaacagaataacacaggattgtggtacttggtgtataagcacatggtatcaaatatggatgaaaacaattccgagtcactaattgatggggcagatgaaaaagagtcagggtttgatgggagcagaacaagaggagcttccttctctcatgaaagtacacccgtgactgatgaagagatgaaatttaaggaccatgtcgtagctgatccagaagttgcacgccaacagaatgaagccatcaagatggtagaagaagcaattgattcaattcttccagatgatcaggatgacttatcagacaaggaatcactcactgacagcacaatttcagacaactccaaacaatccaacagaactgaaagagtatacagtgaaggcctgaaccaaaaagaagaacagatggaatccgggaacggaatgatccaaaaacaagaagaatcagcaccaaaggagcaaaacaaaacaaaccagaaaatgtctacaagctggagcaatcttaaaaaagtgatcctgcttaggagattcatcaagtcattggaaaaagtaaggaaattcaacccaagagggcctagatatctacctctagagcctgattcagaagctgaaaaagttaacttaaggcatcaagacatggaagaacgaaaaggtacggaagaatggatgcttgattatgcacttcgacaggttgtttccaaattaacccctgctaggaaaagaaaagtggagctgctggtggaagcttttgaaacagtcatgccaactataaaaacttga

SEQ ID NO: 77564 - DNA, 398 bp, Glycine max
  Peptide Sequence Number=SeqID_194342
atggaagtggtggatgtattgtgtggtgtgctttcagaaagaggaaaacttttgggttatattacgggtagagccactgggttgagagtgagaactgagaacttagaagaagggaggaggcacagtcagagagcgaaagagggtgtgaaactgtggcagtgtagggttgggacttggggagagagtagtggacatgattcatggactagtgcgggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaaacagttgcgcagcctgaatggcgaatggcgcctgatgcg

SEQ ID NO: 77565 - DNA, 590 bp, Glycine max
  Peptide Sequence Number=SeqID_194343
tcggcggcgagagccaccgtcatggctccgaccactaccaccgccaccaccactaccacgcagatgctgagggatttctcgttggagatttacgacaagcaggagttgcagttcatgtcgcgcgcgtcttccaagcattgagtgaggaacgagaagatgaacttgaatctggtttctttgcttccgccatgaacaacgacgtcgttgctgcgggaaagaggaagagcacgtgcgcacgtgatgcgggattaaaaatggtggggacctcgtgcgtgtgggtgtgggtcaacacgaaaagtggaaggcatggtggggacccagtgcgggggtgggtgcgggacccaaagggtaggagtgtgagggcaatgggtggaccctacgggaccgtttatgcaccgttctcgagccggcctttccaaagtggtccttctgcgcgcgagagtccagaaggacacgtttcactctctggctcgtcgacaggtggggcaccacttttacccttcgacacgtgggggtttcgcaggggtcccacgttgttggacacgaaccactttgttggttttggtttgcttggcccggagaaaacgtga

SEQ ID NO: 77566 - DNA, 1857 bp, Glycine max
  Peptide Sequence Number=SeqID_194344
atggacaattatggttcttcacaacatccatatgggtatcccaacccttattcataccctcctcatgatccatatgctcaaccaccatatccatatccatatccatatccatatccatatccacatccaacaaaccctcctcataataacaactcaaactacccataccccccacctcctccaccaccacactcctcatccccttattctagccccataaactattcctcataccctcctcctcctcctcctcctcctcctcctccatctacctcatcacatggctcctttgactatcctatgcctcagccacctcacacttatccttaccctcaccgagtccctccagaatggagtgtcacaacaggaggtggagtgtctcactctcacgctagtgatagttataaccctcctcactctgctgcttaccctactttggatgatctcatgagcaatgataggttgtcagataataataacctcccaagtgcacctcccttgacacattccccaccaattctatatcttgataggagggatgagttttatggttattctagctactcctcctcaagtttggatcagggggatccttctaggctctcagataataatgatgactcagtgaatagtgagagtttgcagattgtgccggctcagcacaaaggatctctgagggttttgctcctccatgggaatttagatatttgggttcatggagccaaaaaccttccaaacatggacatgttccacaagacgttggaggacatgattggtagattccccggtactgttgcgagcaacaagattgaaggaacggtaagccggaagattactagtgatccttatgtgacaatttctgtgtcaaatgctgtaattggtaggacttttgtgattagcaatagtgagaatcctgtgtgggagcaacatttctatgttcctgttgcacaccatgctgctgaagttcattttgttgtgaaggacagtgatgtggtgggttcacagctcattggcgttgtggcaattcctgtggaaaaaatatactcagggcaaaaggtacaagggacctaccctatcctgaacagcaatggtaagccttgtaagccaggtgctgttttgatggtatccattcagtacattccaatgcatacacttatcatgtattaccaaggagttggagctggtcctgactacattggggttcctggcacatattttccattgaggaaaggtggaacagttactctataccaagatgctcatgttccagatggttgcctccctaatgttgtgcttgataatggtgtgtattatgctcatggaaagtgttggcttgacatctttgacgccataaatcgagctaagcgtttgatttacattacggggtggtcggtgtggcacaaagttaggctggtaagggatcctggaaatccatcaaagttcaccctgggtgatattctgaggtctaagtcatcggagggagtaagagtgcttctccttatttgggatgaccctacatcaagaagcattctaggttacaaagtggatggtgtgatggcaactcatgatgaggaaactagacgatttttcaagcactcttctgtgcacgtgctgctttgtcctcgcattgctgcaaaacgtcatagctgggccaaacaaaaggaagttggaacaatatatacacatcatcagaaaactgtaattgtggatgctgatgccggaaataaccaaagaaaaatagtagcatttgttggcggacttgatttgtgtgatgggcgatatgatactccccaccatcctctgtttaggacgctgcagacactgcataaggatgactatcacaaccctactttcacg

SEQ ID NO: 77567 - DNA, 597 bp, Glycine max
  Peptide Sequence Number=SeqID_194345
atgatggaggccatgatgagtataagaaggatgatggaggtcaggaaggtgaagcgttgggaagtacgggcggcccccattttgtgcaagttcaaaacaagcattccttcccaccatatggattgcctcccaactatacaccgcccaatgttgcacacactcccgatgagaatgtcaacaacttcgctcccataccaattgagagccaacaaccccaatttggtcatgcacagagtacctcctgctatggtggaaagggaaaaattcgatcatatagaagaaaggccaagggctattgaaggaggcagagattatgcttttgctgacatgacagagctgtgcctaatgtccgacgtcgtcatacctccgaagttcaaggtgccagatttcgttaagtataaagggactacttgccccaagaatcacttgaagatgtactgcaggaaaatgggggcatacacaaaggatgaaaaactcttgatgcatttcttccaagaaagtcttactggggtagccgtcacctggtacaccaatctggaatcttcccgggtccattcctggaaggacctaatggttgccttcattaggcagtattag

SEQ ID NO: 77568 - DNA, 2551 bp, Glycine max
  Peptide Sequence Number=SeqID_194346
gctgaaggttcaaaagtttgagttgctgtctgtcactaatactggtggtgttaaggctgtgagttttttccgattaactcatggtgaaggcaagttgtgggggtttgtcaccggagttcctgatcatgagtttcttctgattacttgtagcaactcctctgtgaagcgaggtgatggaggaggttctaatgcattatcttctaaatgtgctggttccgatgtcatttgtctctctgacccagagatttcccatagtattacatctgtaactgtcagttgtggtacggttttagctgtaggtggtcgtttggattggtttgatgcaatattatcctttttcagcttgtctgcttctaataccaaagatgcaggtgatactagtatgccaaagaaggaacagaatatctcttacacgacttattttgttctctgcttgattgatattgctttgagctatgagccttatatgaagaatcttgtagttcagagtgaacttaattcagagtctggctgttcttctatcaaaaaagatacgagtgaacaatgcgtttcatgtttgttggctgcatccagcttaactctttcaaattcatcttcgaaagatacagttggaagtgttttccaaatcagagtgcatgacctggggcttcttcttcatttaatgtcagaactgaattctttgtctggcatttatagtgttgaacatcttcaaaagactggttactttaaagttgctcaggaggcttttatggaggctattttgaaaacaaactgtgctagtggtcttctttgggaactggaattatctaaatctcacctttctgtggaaacttgctacgatacaactgctactctgattcgtttggctgctcaacttcagcaattatttgcacctgatgtggaggaatctattgtgcatttgcagaataggtgggataatgttcaacaggcacagcaaaggaatgaatttaaaaatgaaaataagaatctcagatttgattcgatgtctgcaacttctaaacagtactccgctcaaacattttcaaccgatggatctagtatagctggcttgatggatgaaatatgtgaagatgcatttcaggtaaataacaataatgcgcaccaatcttatccttttgaatcagggttttgcatgccacttgatggaagcttaattgaggttggtcagatgaatttggatgagcctgaagttctctctcatgaattgactttgactgagtcagtgtctgtgataggaccagaaggtagtcacacttcatatctgcaagaaggttgctttccagagattatagaaagctattgtttgtctgacttacgccctctgtcggagctatctttaggtatacattctgatgagctttctagacacaaactgaggaatgtggaacatagagagattgaaagaggaagtggtggatggtatggaggcacctctctaaaagtattagaaaaccacatttcagaggaaagcaaacaagctggaccattaaaggttgtagatcatcatggcatgctttcatctgatggtagttcatcatatggtgagacttgtggacgtgtaattcttaagaaaattgatataagatggagaatgtatgggggttctgactggcttgactcagagaaaagtggaccgcattctgggagagacacatccgtttgcttggaacttgcattgtctgggatgaaatttcagtatgatgtatttccagttggtgggctacgtgtatctaagatgtctgtctctgttcaagatttttttctgtatgacagaagccaagatgcaccttggaaactggtattaggatattatcactcaaaaggccatcctagggaatcttattcgagagcatttaaattggacttggaggcagtgagaccagatcctcttactccccttgaggagtacaggttaaatgttgctattttacctatgctgttacacctacatcaaagccagcttgattttcttgttaatttctttgggagaaaaaacacattgaaggatcagtttcctaatagttgtcaagatttggagggttcaaaatcattgcctgagacgactcagaaaaataaagatcttgcatttcattcaattgcaccagaggcactgcttccctatttccagaagctagatatatggcctattaatgttcgggtggattacagtcccaatcgtgtagatctagcagcattaagtcatggaaagtatgtagaacttgtaaatcttgtcccttggaaggatcccttccctttatatcttgtagtacctctgggggttgagcttaacctgaaacatgttcatgcttctggcatctatggttgggccagtgtttgtgaaactactgtaggggagtggttggaagatatatctcaaaatcagattcataaaatactgcgggggcttcctacagtacggtcattgattgcagttggggctggtgctgctaagctggtttcatcaccagtacagagctacaaaaaggagcggagagtgctcaagggtgtgcagagaggtaggttagattga

SEQ ID NO: 77569 - DNA, 120 bp, Glycine max
  Peptide Sequence Number=SeqID_194347
atggctagctcatggcttggatcattctttaaccagcacgtacatctcacctggacatgcgtgggagtagagccacatgctgtgaatcagcaaggccaacgtaatatgcagttcaagtaa

SEQ ID NO: 77570 - DNA, 198 bp, Glycine max
  Peptide Sequence Number=SeqID_194348
atggtgatatttcagtgcaccaaggttcttacatctattgcagagggtctgcgaaggacaattgaatcatacacacacttgaaggcggataatgaacctaaaactaaaagagaaggtccctcaaaagcttccaaatatcttggaagtggaagaggtgtgaataatcaactatatctgtctaacttctttgcttggtga

SEQ ID NO: 77571 - DNA, 327 bp, Glycine max
  Peptide Sequence Number=SeqID_194349
atggtcaaaagaaaaagtccctatttgacaaggcttcttactatacctatgaattccattggacccaaaaatgatacattggaagaatcatctgagtcttccaatatcaataggttgattgttccactcctgtatcttccaaaaggaaaaaagatctttgagagctatttcctggatccgaaagagagtactcgggttctcccaataactaaaatgtatatcatgcctgaatctaactgggttcgcggtggtggaggaattgagattctagttgtaagatatctaatgaaaccattgctggaattgagatctcattcaaagagaaag

SEQ ID NO: 77572 - DNA, 216 bp, Glycine max
  Peptide Sequence Number=SeqID_194350
atggatggcaaagatggttgtaagaaaggatttttgccgagatcaagaccatttgtcagggtggatggatgccatctaaagaccccttttggagggcaactgctggttgtagtggatagagatgacaatgatcagtatttccctctagcatggcccgttgttgttgagtctgaggcaaaggacgttacgttggagatggtttttaaccacggctaa

SEQ ID NO: 77573 - DNA, 843 bp, Glycine max
  Peptide Sequence Number=SeqID_194351
atgtcttccattcaactctgcgccgcgcatcaggcgacctatggcttcgacggcgatgcgatcgcccagtacatgcgtaccgactttattacgctgcaggaacatttcagcgtccatgaggcgcgtgaacactttatctcgcagctcgccagcgacgatattcccggccaggtatttgtcgtcgccggtaacaagctgcgcggcagcttatcagtcaaaaaactattgcaggaggtagaggtaggccagtctattcgctacctgatggacagctgtctgtttcgcgtcaaacccgacgatgagcgccctcaggttattgccgaactcaccgagcgcggcctcgatctggtgccggttgtcgataaaggcgagctggtcggctgcctgatggaaaaagaaattgcccatctgctggaggatgacgtcaccgaagacgcccagctgcagggggcgacgctaccgctggaaaaaccgtatctggaaatcagtccgtggacgctgtggaagaaacgctcggtctggctgctactgttatttgttgccgaagcctacaccagcagcgtgctgcagcattttgaagaggcgctggaatcggccatcgcactggccttcttcatcccgttactgatcggcaccggcggcaacagcggaactcagatcacctcaacgctggtgcgttcgatggcgctgggtgaagtccgtttacgtgacatgggacgggttatccgcaaagaggtgtcgacctcgtttctgattgccctgaccctgggtctggcgggctgcctgcgcgcctggatgatggggattggcatggaaatcacgctgatcgtcagcctgacgctg

SEQ ID NO: 77574 - DNA, 405 bp, Glycine max
  Peptide Sequence Number=SeqID_194352
atcgactgggcttacttggttcggtaccgaatgcataaagcattacgggccaatgcacctctcccttaccctcaattggtcactctgtttctccatcattttcaaattccacttgatgatgaaccttttgttcaagtcaagcgttcctttgctattggtgctggggcagtcacttcatttggataccgtaaggatcggaatggtcaatggctgaagaaagatgcacttcctccacaagatgagcgtactccttctcctcctcctcagcgagatgattcagcccttatgactgaagttctttccgagttacggggtcttcgtacttatgttggtgaacgctttgattcttggataatcgctttgccggaatggatatccgtctcacacagcttgaagaagatgtag

SEQ ID NO: 77575 - DNA, 279 bp, Glycine max
  Peptide Sequence Number=SeqID_194353
atgcatctacgtgatgaaggtggccttgttcgtgctcgtgcgcttagcgcacttatggaccgcttagcgcacgttagtgatttttggcttagtgcacctttctcgctgtcgcaacatgcccttcgcgggcgagtgagggcaaggctcatgggtgcgctttccaaaggaggaaagatgcgcggagtcgccaccaatgtttatttgtggaaaacgtcagaaaaaccgaaggaaaccggtcaaaatgaaaattctaagttcgggagttgtatttacgcttga

SEQ ID NO: 77576 - DNA, 111 bp, Glycine max
  Peptide Sequence Number=SeqID_194354
atggagcaagtgcgcgagtatgagaacttggtctatataatatgcacaagaagtttctatgaaatcagagacgtgacatttcattcatacattcagcaacagattgcttag

SEQ ID NO: 77577 - DNA, 474 bp, Glycine max
  Peptide Sequence Number=SeqID_194355
atgagccatagagttaataagaaggtagaatttgcatatagtgctggtcaagtgcaccctacaagagctctgagccctagttcaatctatgacatggataactttgcatatatccatttcttatgccatgagggctataatggttcctctctatcaatgttagttggctctcctgtgaactacacctatttgcttccagggcttggccatgaggctatcaactatcccaccatgcaactaagtgtgcaaaacaacacaagcacaataataggagttttaagagttaccaatgttggtcctactccaaccatcttcaatgccaccatcaaatctctcaaaggagtagaaatcacagtgaagcctactagcctcattttctctcacactccacaaaagaagagcttcaaggtagtggtgaaagcaaaacctatggcaagcatggaaattatgtcagatcacaagtatcttaactag

SEQ ID NO: 77578 - DNA, 3333 bp, Glycine max
  Peptide Sequence Number=SeqID_194356
atgagtataaccttatggtttttcttgttgcccttctgcctcataaacttgagcaccaacatcattttggcaactggtcattgtcttggccatcaacaatctttgttgctccaattgaggaacaacctcatattcaattccaccaagtccaaaaaactgattcactggaaccaaagtgatgattgttgtgaatggaatggagtggcatgcaaccaaggccatgttatagctcttgacttgagccaagaatccatctctggaggtattgaaaatttaagcagtctcttcaagttgcaaagtttgaatttggcctataatggattccattctgggattcctccagagtttcaaaagctaaagaatttgaggtatttgaatttgtcaaatgctggctttgaggggaaaattccaattgagatctcttacctgacaaagttagtaactcttgatttgtctagcacagttacttcacaacatgctttaaaacttgagatgccaaatattgcaatgcttgtgcagaacttcacagaaatcaaagtgctacatctggatggcatagcaatatcagctaaaggaaaggtgtggagccatgctttatcttcacttacaaacttgcaagtcttaagcatgtcatcttgtaatctctctggtcctcttgattcttcattagcaaaactacaatctctttcaatacttcaattggaccagaataatttagcaagtccagtgccagagtctttgggaagtttgtctaatttgaccatcttgcaacttagtggctgtggattgaatggagtttttccaaaaatcatttttcaaataccatcattgcaggtgattgatgtgtctgataatccaagtcttaatggttctctagcaaactttcgaagtcaaggttccctctataacttcaaccttagccacacaaatttttctggacctctgccaatgtctattcacaatttgaaggaattgtctaaattagatctttcgaactgcaagttcatagggacacttccttattcaatgtcaaacctcacccaacttgttcatctagatttgtcattcaataactttactggtcctattccatcatttaataggtccaaggccctcacagttttatcccttaatcataatagattcaagggtacacttccatccacccattttgagggccttacaaatctcatgagcattgatttaggagataactcctttgatggaagaataccctcatctttatttagacttcaatctcttcagcatctcatgctttattacaataaatttgatggtgtgttggacgaatttccaaatgcttctttgtcatcattagagatgcttgatttgagtggcaacaattttgaagggcctattcccatgtctatcttccaactcaaacgacttcgtttgctgcaactttccaaaaacaagttcaatggcaccatacaacttggtatgcttgggaggctgcaaaatttgtcttcactggatctaggacacaataacttgttagttgatgcaggcattgaggatgaccatgacgcatcatcctttcccagtttgaaaactctttggttggcttcatgcaatttgagagaattccctgactttttgagaaataaatcttcactactctacctagacttatctagcaatcagattcaaggaacaatacccaactggatttggaaatttaattctatggttgttttgaatatttcttacaactttttgacagatattgaagggtctttacagaaacttagttcaaatttgttcaaacttgaccttcactcaaaccatctccaagggcctgctcctacttttttgaaaaatgccatttacttggactactcaagcaatagattcagctctattaactcagtagacattggtagtcacattcctttcttgtattttctctccctttcaaacaacagttttcaaggaagaatccatgaatccttttgtaacatttcagatcttcgagcacttgacctttcccataacagattcaatggtcagatccctatgtgtttgacaagtagaagtagcactctcaggctactaaatcttggtggaaatgagctcaatggatatatttcaaatacattatcaacttcatgttctttgaggtttttggatctcagtggaaatcttttaaggggaaccatcccaaaatctttggctaattgccataaactacaagttctaaaccttggaaacaatcaactagttgacagatttccatgcttcttgaagagcatctcctccctcagagtcatgattttaagatcaaacaaattgcatgggcctattggatgttccaatagcattggcagttgggagacacttcaaattgttgatttagcctctaacaatttcagtggtacattaccagcatcactcttactgagttggaaaacattgatgcttgatgaagataagggtggacaatttggtcatctatattttgatctctatgatgactttaatcctatgaattttataactgcaattgtagatctcaaccatgagctacaaatcaagttagccaaaattatagcattagagccacatttaataatagaccacataatctctcatatctttgaggagggtgttggtgttcgagcttatgaggattcggttacaattgtcaacaaaggtagacagttaaatttggttaaaatcctcattgccttcacgtctttggatttctcatccaacaattttgaagggccaataccaaaagagcttatgaatctcacagcactacatgctcttaacttgtcacaaaattctttctcaggtagcatcccttcttccataggaaatctaaaacatcttgagtccttagacttgtcaatcaactctttaggtggagagattcctatggagcttgcaaagttatcatttcttgctgtcatgaacatctcttataatcatttggtggggaaaataccaacaggtacacaaattcagacatttgaggctgattcatttatagggaatgaagggttatgtggacctccattgaccccaaattgtgatggtgaaggagggcaagggttgtcaccaccagcatctgaaacacttgattctcataaagggggttcaattgaatggaatttcttaagtgtagagttggggatgatttttggttttggaattttcatctttccccttattttttggaagagatggaggatatggtattccaagcatgtagatgacatcctttgcaagatcgtccctcagcttgattttgtttatgtgcagcgtgggggacaaaattatagaattatgaggtggaagccttattga

SEQ ID NO: 77579 - DNA, 808 bp, Glycine max
  Peptide Sequence Number=SeqID_194357
caagcttgtgtcttcctacgcttgctgtgcccaattgcacgaagccaatatcctcttttctttcaccattcgccaacccactttcctctttaactctctcatcagagcttattcctctctcaacttgttctcccaatccctctgcatctttcgccaaatgttgcttgctcggaaaccctttgatcgtcacaccttacccgtggtgctcaaatcttgtgccggcttatcggctctgcggctcgggcaacaagtccatggagcagttttggttaatgggtttggcttagatttggcaaattcgaatgctttgataaacatgtatagtaagtgcggacatttggtatatgcacgcaagctgtttgatagaatgtggcaaaggaatgagattacgttttcaactatgatggcgggttatggaatgcatgggaagtgtggggaggtgtttgagctgtttgataaaatggtggaggcgggggagaggccagatggtgtgacttttactgcagttttgagtgcatgcagtcatggggggtttatagataaggggagggaatatcttaagatgatggaggtgaggtttggggttaaacctggattgcatcattatacgtgcatggtggatatgttggggagggttggacaggtggaggaagcagagaagttaattttgagaatggaggttaagcccgatgaagctttgtggggtgccttgttaggagcatgtaaaactcatgggaagcttgaggtgactgagagagtagaagagagggtttatggaagggaattgagttttgcatcgtcggtttga

SEQ ID NO: 77580 - DNA, 333 bp, Glycine max
  Peptide Sequence Number=SeqID_194358
atggcacagcagagggattttatagatcagataagggtatcctcactctcattgcgctgtgagactaatcccttggatccatattttgacctgccactgccgactgtaatgcacagtgaaggacgccttctaattgtccaggaaggtagctatcatgtcacatattctgcatattgtttacatgcaacacttgaggagattctcaacctaccaatgcctctagtaccagatcctatcgcttattacctagaggacgagacattttctatcaaagttatagaagccattaagaattatcaaaaagataaagtgcccttgtggagaaactcatga

SEQ ID NO: 77581 - DNA, 2292 bp, Glycine max
  Peptide Sequence Number=SeqID_194359
atgatcttcaggacactcctattcctcctggcctttatggtgacaaattcagttgctgtgatggacaagaagacatacataatacacatggacaagaccaagatcaaagcctcaatccattcccaagacaacacaaaaccttggttcaaatcagtcgttgatttcatctctgaagcgtcattagaagaagacatagcccctcagcttctttatgtttatgaaaccagcatgtttggttttgctgcccaactttcaaataaacagcttgagtacttgaaccaaatagatggtttcctttcagccatacctgatgaactattaaaccttcacacaacatacagctcccattttcttggcctacagaatggaaaaggactttggagtgcttctaacttggcctcagatgtgatcataggagtccttgatacaggaatatggcctgaacacatcagtttccaagacacaggtttgtccaaagtaccctctcgttggaaaggtgcttgtgaagcaggcaccaacttctcttcctcaagttgtaacaagaagcttgtaggtgcaagagtctttctacaagggtatgaaaaatttgctggaagaatcaatgaaacattggactatcgttccgcgagagatgcgcaaggacatggaacacacacagcctcaactgcagctggtaacatggtgagcaatgccagccttttcggcttggcacgcggttctgccagtggaatgaggtacacctcaagaatagctgcttataaagtatgctggcgtttaggctgtgctaactctgacatattggcagctattgatcaagctgttgctgatggtgttgatgtgttgtcactctctttaggtggcattgctaaaccttactacaatgacagcattgccatagcctcatttggagcaacacaaaaaggagtttttgtttcttgttcagcaggcaattctggtccctctagttcaactgctggaaatgttgccccatggatcatgactgttgctgctagctacactgacagaagctttccaacaaaagtgaagcttgggaatggaaaggttttcaaagggtcatcattatacaaaggcaagcaaacaaacctattgcctcttgtgtatggaaactcctcaaaagcacaaaggacagcacagtattgcaccaaaggttcacttgatccaaagtttgtcaaaggaaaaatagtcgcctgcgaacgtggaataaatagtagaaccggaaagggagaggaagtgaagatggcaggtggggcaggaatgatactactcaactcagaaaaccaaggagaagagctttttgctgatcctcatgttttgccagccacatccttaggttcctcagcaagtaaaacaatcagaagctacattcactcagcaaaagcaccaacagtttcaatttccttcctagggacaacatatggagacccagcaccagttatggctgcattttcttctagaggaccaagtgctgtgggcccagatgtgatcaagccagatgtaactgcacctggtgtgaacatcttggctgcttggccccccacaactagtccaagcatgctcaagagtgacaaaagaagtgtactatttaacatagtctcaggtacgtcaatgtcatgtcctcatgttagtggcatagctacactgattaaatctgtgcacaaggattggtcacctgcagctatcaaatctgctctcatgactactgcttccacatcaaacaacaaaggtgctccaattgccgacaacggttcaaacaattctgcatttgctgacccttttgcatttggttcaggccatgttaaccctgaaagagcttctgatccagggttagtctatgacatcaccaccaaagattacttaaattacttgtgcagtttgaaatacacatcctcccagattgctatactgtcaaaaggtaattttaaatgtgccaaaaaatcagctcttcatgctggtgacttgaactacccttcatttgctgtgctatttggcacgagtgctagaaatgctagtgtggcatacaagagggtagtcacaaatgttgggaagccctcaagttcttatgcagtgaaagtggaagaaccaaagggagtatctgtctcggttgaaccaaggaatattagtttcagaaaaattggtgacaaattgagttataaagtgacctttgtttcatatggaagaacagcaattgctggcagttcatcatttggatcacttacttgggtatcagataaatatactgttaggagtcctatagcagtaacatggcaataa

SEQ ID NO: 77582 - DNA, 2406 bp, Glycine max
  Peptide Sequence Number=SeqID_194360
atggcatcttcaccaaccttaataccctttctcctcatcttcttcctcttccacttccaccgttcctcctccctccccctctccgtggagaaccccgaagatgacgtcatagtctcgtcgccgaagggaaccttcaccgcagggttcagccccgtgggggagaacgcgtactccttcgcgatatggttctctacgcaagcgacgacgaagaccgttgtgtggatggcgaaccgcgatcaaccggttaacgggaaacggtccacgctttcgctcctcaagacggggaacctcgttttaaccgacgcgggacagttcgatgtctggtccaccaacacgctctcctcgaagacgcttgagctgcatttgttcgacaccggcaacctcgtactccgcgagcagagtaatcaaagcgcggttctgtggcagagcttcggttttcccacggataccctccttcctggccagattttcactaggttcacgaagcttgtttcctcaagaagtgagggcaaccattcctctggtttttacaacctctacttcgacaacgacaacgttttccgtattctctacgatggtcctcaagtttcaagcgtttactggccagatccttggcttgtcagcgacaacgttggttttggcaacggaagaagcacatacaacagtagcagagttgcagtgttagacaacttgggcgaattcagtgcttcagatcatttcagtttcaagacaattgattatggtttactcctccaacgaagattgacccttgatcacgatggcaatgttcgtgtctatagcagaaaaaacggtgaagagaattggtccataacagggcaattcaagtcacaaccttgtttcattcatggaatttgtggacccaatagtatatgcagtcatgaacaagtaattggtagaaagtgttcgtgtcttgaagggtatagttggattgatagccaagattggactttaggttgcaagccgaatttccaacctacttgtgacaacaagacagaatatcgctttgtaccctattatgaagtggatttctatggatacgactatggttcatctttttcaaattacacttataaacaatgtgagaaattgtgctcgggattgtgcgagtgcatggggtttcagtactcctttgcgagggaaaatggtctcttttggtgttaccccaagagacagttgctaaacggacatcattcgcccggtttcaccggacaaatcttccttcgtttgccgaagaatgatgttcaagagaatcgggttcaaaacagcgatgacttggcttgttcgagaaatgcagaaaaagtactagaaagaccttacgtgaagggcaaggaaaacgggtcggtgaagttcatgctttggtttgcaattggattgggaggttttgaggttttgtgcatttttatggtgtggtgttttctatttaggagtagtaatcatttggttagtgcagatcaacaagggtatgttcttgcagcagctactgggttcagaagatacacttactctgaactgaaacaagccacaaagggtttcagcgaagagattggaaggggtgctggagggacagtgtacaagggcgtgttatcagataaacgcattgcagcaattaaaaaattgcacgaatttgcagaccaaggagagagtgagtttcttactgaagtgagcatcattggaaggctcaaccacatgaacttaattggcatgtgggggtattgtgtagaaggaaagcataggatgttggtttatgagtacatggaaaatggctctttggcacataatcttccatcaaatgcacttgattggagcaagaggtacaacattgctgtgggaatggcaaagggtttggcctatttacatgaagagtgcttggagtggatcttgcattgtgatataaagcctcaaaacatacttcttgactctgattaccaacccaaggtggctgattttggcttgtccaagccattgaatagaaacaatgtcaacaactcaagcttctctaggataagagggacaaggggttacatggcaccggaatgggttttcaacttgcaaatcacttctaaggtggatgtttatagctatggaattgttgtgttggagatgataactgggaggagtccaatgattggtgtccaagtcactgaattaggagctgatcaatctcataatgagaggttggcaacatgggtgagggagagaaggagaaaggcaagagaaggggaatgttgggtggaacaaattgttgaccctactttgggatcagattatgatgtggagcagatggagatattgacaacagtggctttggaatgtgtggaggaagagaaagatgtgagacctagcatgagtcaagtcgttgagaggctccaaagtcatgattcttga

SEQ ID NO: 77583 - DNA, 579 bp, Glycine max
  Peptide Sequence Number=SeqID_194361
atggaggttatcagagttctagtggcgacaatcacaatggtggttctagcggcagtgcttccaacagacgacaagttcttctacaacaacaacatcagcaacattcagttgtcgtcgtgcgatatgagactctcgctctccaatgcgaactctcaaatctctgtcttcagacccaaggtcgacgagatcttgctcctcatcgttaacttctcctcgttcgtcacgaacaaattggctttggcccactccgtcactcatgaagaaactgtcaaagcttggtttgatcttggtgcagtgcgtggcaactccctgtgcgataaggtgaatctccacatggtgtgggtggaagagaacgacaatgaggtcggggcaattggtattgggattggaattcttgaggtggaagggtttgtgaggttcaagggtgagggtttggaaggagccggcggcaacttgctagttgtttcatcgttgccattgcaatggtttcgctgtgtgcttcctttgatggcgtcgttgtggtggttacggtggtgtcatctcaacgattatgcgcgagctattggtgagtgggattga

SEQ ID NO: 77584 - DNA, 318 bp, Glycine max
  Peptide Sequence Number=SeqID_194362
atggcatcaaagtttatctttaccacggtggttttagttatgcttttgtgcttgcttcttatgagggacccttctggttgtggttctgcatatgaatgctttggtgctaatgcagctggtcttacggacattccaaacaggaaggtgctgcctgttttgaaggataagaaaactagtgctctgaaggctagtctgcgaggatcatcaagcaacaagtatggtgaaaagccactgaattgggagttaaggaaggttccttcaggtccagatccgctgcatcataacggtgtgaaccccaaaaatcctcaaaccccttaa

SEQ ID NO: 77585 - DNA, 220 bp, Glycine max
  Peptide Sequence Number=SeqID_194363
actagcagctggtgtctcgctaagcgaggcctgtgcgcttagcgagagtcatgcgctaagcgaggcactcagctcacttagcgagttgggagaatgtggaggagaatctgagaagcatctacgtgctcaacgcgtcttcagctcgctcagcgaggcatttttctcttcctgcgctaagcgcgcccagctcactcagcggatattcactaactcgcgctaa

SEQ ID NO: 77586 - DNA, 336 bp, Glycine max
  Peptide Sequence Number=SeqID_194364
atgggccctatagatagcccatttgctggaggtgtgtttcttgtgtcaattcacttccctcctgattatcctttcaaaccacccaaggtttcatttcgtacaaaggttttccaccctaacatcaacagtaatggaagtatctgccttgacatcctcaaagagcaatggagcgctgttctaacaatatctaaggttcttctatctatatgctctttgctgacagaccccaacccagatgatcctctagtgcctgagattgctcaaatgtacaagactaacagagccaagtatcaggccactgctcgatcatggactgagaaatatgccatgggctaa

SEQ ID NO: 77587 - DNA, 273 bp, Glycine max
  Peptide Sequence Number=SeqID_194365
atgatggaacaacaggacagtgttttgatgatgttaagcactatgttgatgagaggaccaaacgattatgaagaaatccttacagtcaatggtcaattatatcctacatttagagaagcttgctttgctataggcttcttgcttgatgataaggaatacattcaggctctaagagaagcataccattggggttctggccaatttctaagaagattgtttgtaacatgggagtgtctaattatatctaataacattaagcaaacataccattga

SEQ ID NO: 77588 - DNA, 189 bp, Glycine max
  Peptide Sequence Number=SeqID_194366
atggagagatttgcagcaaatctgacccttccaaatacttgccagcaagaaaagcaacttcaaatacaagcagttctctcagtaagtaaaggaaaaaggttgagttaccaaaacgaagcagatatgcaccaaattggcaaaatcaagggaaaatcttttgagccaaggaagggagctaggaaggcttga

SEQ ID NO: 77589 - DNA, 957 bp, Glycine max
  Peptide Sequence Number=SeqID_194367
atggagttgactaaggaaaattcacgtccacacctgacattcccgatctccgccgaccaaatcaccggagctggacttggacgagacgccgacgggtactttgcggcacagaaccttgagaaccctcgtcctgaacctccacgagccggagcggaaagaggtggcggcgacgacctgaacgtcgaagaggaccgagctggcgttcctctcggcgttgagattgtcgatcagtttgggctcgaggtaggtgccggcggcggtgagggtggcattgagtgtggtctgggacctggtgtcctgcctgaagggagcgagctgagactcggagatgtagttttggcggtagaagatggaagagcggagggcgttgtaggagacggtcatcttcttgttgccgttgcggacgaggaaggagaggtgccacgtggcggagagggattgggaggtgctggagaggttggaaacggagagggagtggagggtgaagtgggggagggaggggcggaggacgagccaggtgatgatgaggacgacgccgaagacgacggcgaggcagatcatggtggcgaagaaagcgcggaagaaggagcgggaggcgtaggagcgaggaggagggtaagtggtgttgtagtattgttgttgggcagcgtaggggtagccggtggcgatggcggcggaggcggcggggggaggaggctggccgccgttttggtggtagaagggaggaggggcggggcgagaagggtcttgcataatagtaaagcggtttgtttgttatgctcagttcgatctgagaagttggacacagaaaatgagctgattgggaacccggttcatgaggtccatgatgacaagccaataatgcttagtgttaaactcagaaaaagagtgtccaattcagaacccgaacaatgtaaattctggaagcagtatttcttacgagttaagcttgcctag

SEQ ID NO: 77590 - DNA, 2628 bp, Glycine max
  Peptide Sequence Number=SeqID_194368
atggtggtaggaactcccaactatatgtgtcctgaactgcttgctgatattccttatggattcaaatctgatatttggtcactaggttgttgtatatatgagatggctgctcatcgcccagcttttaaagcttttgatatggcagggttgataagcaagataaaccgttcctctattggccctttgcctccctgttattccccatctttgaaaacattgataaagggcatgctgagaaaaaatcccgagcatcgtccaacagcatctgaaatcttaaagcacccttatttgctgccttatgttgatcaatatcgttcatctttctgtactccaacagctggttctcctgaaaagccaatttctgctgtccatcatgctctaaaaaataagccaggaagtcaaaacagaagtagttcgagtaccgagaaagatagtttgatgtcaaatgagaaaaacaatgcaaaagcattgcacaaatgtgattgcaaaatcactgaaatagacctgacatcaattgaggatgacagctctgagcaactcctgcctggggaagaaggaaatggttccagcaaagtcaatgccaagacaaatgagaaagagctgacgaagcaatctaataatgaacagcattctaatgttgtatctaagcaaccaaaagcaattaagactgtagtgacagctttaaaagatggaaaacttaaagagacaagttctccaataagaagcaatcgcataaaggttggtggtgtgttgacacataaaataaatacagagacagtatccaatttgcccaaacccaattttggtgcttacgatttgaagcctaatttggaggtgccaactactgcaccttctaaaacaactcctgattccgcaaaaagaatgcaagggtcaaacacttcaaagcatcagttaccaatgatagaatccacaccaaaaactaaacctagacataatgtgattccaccttctggtccagtcaaacaagtagaaggacgtgaagttccttccaagacaaggcaaaagactcctccaagcttacttaaaccaccttcttttacaggacatgtgaggcaggctgggtttgatgttctaaatgcagcaaataatactggaaagacaagtccaaagaaaatggttcgagagcctaagatgagccatcatcagttgaccaacagtcatctaccacatgtttctagagagattactagagagcctttgaagacttttgaaagcagttccaaaggaatgcaaacagacggcagcaattctgtctcatcttcgctctctattcaaggatttgaactttctgattttgcaaccacttttattgacttaagtgaaccaacacttcctgatcatgagaatttaaaccacactgaaaacaaggaatcacgtccagatagcagttcacctgcatcctatttgcattttgacatgtctgaacaattgtctggggaaacccctgtggttacaccacgttttcagaatataacttctagtaatgagaaagtaagtcccggtttaactcttgatcactcaagccaaaatgctgaggtaatgctttcttctgatgatagtttttccataaatcaaaggacttcatctgctggctccaggtgtgatgatagatcagtagatccctctgctgaaatcacagaagaagatatttcaaaggaaatgacttcgaccaagtctctccaacagccgctccccatttttggagaaaagtctgtttgtgaagaatttggtccagcaagcaagccaaataataggtttgataaagttagcccgccaaaactcatgtgcatctcaactggtgatgaccaattcatggtgaggggaagactgtcatcagtggatgaaactgctcctttgattatttctactaatatttcaagccagaaagttttgcaagaagagaaagcaacagttttacagaatccagcaccagaaaggccagctgttgggcatcttcctccagcttttgatgatgtcattcatgtcatacgccatagcagttatcgcgtggggagtgagcagccagtgaaggaatctctggagatgggagttcaaagtgtagatgttggtaagtttatcaacattgtaagggatgatttagaaatgagaaatgtgagcactcctttgactctgaaatcttcaaattgctctgaagctattggcttgaagtcaaatatttctgataatatggaaatcagaaacttaagtaatcctcctaacttaaaatcttcaagttgcaccgacttgatgaacatcaaatcaagtttttctgatcatcctgttgttaggcaacaagatgtggaaaacactgattctcttgtttcaaaatctgattcctccgagtataccaaacataagactcctacagctgcagagggaacacccccaaaggaaattttggatgttaaatcttccaggcagagagctgaagcacttgaaggactgctagaattatctgcagatttgctgcagcaaaatagattggaggaacttgcagttgttctgaagccctttggaaaagataaagtttccccaagggagacggccatttggttagccaagagtctaaaaggattgatgattgaggaaagtgggggacgcagttaa

SEQ ID NO: 77591 - DNA, 447 bp, Glycine max
  Peptide Sequence Number=SeqID_194369
atggatgctaacatagttgacaccacaattacttcaaggaaacgtaaaagagagaaatttaagaagataattaaaattgcttctgcttgtgtcctttatatgattatgagtgtagtagcatggcaattcaataatgccttgagagctgtaatgaaagtgaccaagggctatttaaagtttcatacatataatctagaaggtttagaggcaattaaatggagttggtttgagaattatgttggagcacttgatgggacatattttccggtgttagtttctcctgaagataggcctagatattgtaatagaaaatgtgatgtctctataaatgtgttagcagcttgtaatccagatttaaggttaataggtggtactaactgcaatggagccatccaaaggaaacatcaaagggagaagaaaggtggcacaaaaaaaatgaggaaataa

SEQ ID NO: 77592 - DNA, 225 bp, Glycine max
  Peptide Sequence Number=SeqID_194370
atggatggcaattttgagggtttaagctatgatgaacctgaagaggatgcagatgcagaactaatgagaagatcaaatgaggctgaggagagggttattcttctctcaaagaaactggaacgagatagcttttttcttgatggtggttatgatgtgatgaggacatggcaaggactaagggaaggaacctttaaaaggacttggaggacttatgacaagggctag

SEQ ID NO: 77593 - DNA, 393 bp, Glycine max
  Peptide Sequence Number=SeqID_194371
atgggtgacgttgggttgggatttgtgctgtgggatttaaatgtgtttgtgaagatgaagatgaagatggttgagttattggaggtgttggaaatagggaaaaaaaattcccatcaaacaaaatttttgaaccgtcaacacgaattggatcttgaagccaaatccacccgagcctcctcggattccttatatcctaaccatgaaaaacacttaagaagaagtgttttaaggaaccaaatcatggaagaagatgacattgttcaggaattaaatagcggaattctacaatctgtagcatccaagttgcaggagcaacgtttcaaggtggaaaccctattgctgcatctcgatgacatcgtctcgggttcaatttttgctcccactcagatctga

SEQ ID NO: 77594 - DNA, 555 bp, Glycine max
  Peptide Sequence Number=SeqID_194372
atgaccacccgaaaaagcctcgttctttcgctcctcctccttctgggcctctccccgctctgcgccggcgccgctccgccgcaggagctgtggtgcgtggcgaagaacaacgcggaggacgcggcgctgcaggctgcgctggactgggcctgcggggctggcggcgccgactgcggcccaatccagcgcggtgggccctgctacgaccccaccagcgtgcagaatacggcgtcgttttccttcaacgactattttctgaaacatggcatgaccgacgatagctgcaacttcaacaacaacgctgccgtcacttccttgaaccctagtcatgataattgcaagttcccctccgggtttgaatgtgaggaaaaatgggtttttcactttaatggagaggatcttgagttgagacatgtttttgttgatgcagcaagacggggagcaacgggagtttttctggatcaacacccacttcatctgttggattgggacccagtgaagatttcagtgggtgcacgagagtttcttgggggtggtggtggttttggcctttga

SEQ ID NO: 77595 - DNA, 138 bp, Glycine max
  Peptide Sequence Number=SeqID_194373
atgcagtatctaggaagtgatcctaggtcgtctcccaacaacaaacaaaaggctgaatccgtcgctaaattcgtcagtaaaacagttgctaaacagggaatgcaactgaaatacaaaacagaacgttacacaaaataa

SEQ ID NO: 77596 - DNA, 1776 bp, Glycine max
  Peptide Sequence Number=SeqID_194374
atggcgacgttcacatcgattcagcgtgcgcgaaccactatgctctcttcctccttcaagcttcgaacacaccttctccatggcaaccacttcacccaaaccctcactacgaattctctatccacctctgcactcccacacgagtatcaaagattcccttcccaacaaaaccaacaccaaccaccctctgatccctcacactttcaagctcaacaacaatggcagcaacaacatcaacatcaacaacctcaacatttcaacccacagacccatcacccccccaaccctcctcccccttccaatcaatttcctcatcaccataaccatcaacctcgtcaacacaatgttcctcgtccatttctagaacatggcggaaaccataataatcagtggaaccctcaacccccaccacctcaaaatcacaattttcaaacacccacttctcaaaatccaaactttcgcccacccactaccccaaatcgatggaacaatcaaaaccctgctgcccccaaccaatggaaccctaggtctcaggggttcccaaactctaaccagttccaaaaccctaataatcagttgaacaacaatcaagcttctattcaagcgcaaacccaccctgctcctcctcctcctcctcatccactacctccttcaattactgatttgacacgtttgtgcaaagaggggaaagttaaagaggcaattgaattgatggacaaaggggtcaaagctgatgctggttgctttgaccttctgtttgacttgtgtgggcaatctaagtcccttgaggatgctaagaaggcccatgaccactttctacaatccacttttaggagtgatctcactctgaacaacaaggtgattgaaatgtatgggaattgcaaaagcatgactgatgcacgcagggtgttcgatcatatgcccaacagggatatgggctcttggcatttgatgttgcggggctacgcttataacaccaatggggatgatgccttgcagttgtttgagcagatgaatgagcttggtttggagatcacttcagagactttgcttgcggtgttgtcggcttgtgccagtgcagaggatgtggaggatgctttccttcattttgagtctatgaaaagcaagtatggaattgagcctggggtggagcactacatggggcttttggatgttcttggacaatctgcatacctcaaggaagctgaggagtttattgaccagttgccattcgagcccacggtagcagtatgggagaaactgaagcattatgctcgcgttcatggagatgttgatcttgaagactatactgaagagttgattgttagtcttgacccatcaaaagctgttgccaataagatccccacgccgcctccgaagaagtatactgcaataaacatgcttgatggcaggaacagaattattgaatataagaatcctactctttacaaggatgatgaaaagttgaaggccttgagtgggatgaaagaaacagggtatgttcctgacacaagatatgttcttcatgacattgatcaggaagcaaaagagcaagccttgctttaccacagtgaacgtctagcaattgcctatggtcttattagtactccaccaagaacacctcttagaatcatcaagaaccttcgtgtctgtggtgactgtcacaatgccatcaagatcatgtccaggattgtagggagggaattgattgtcagagataacaaaaggtttcatcatttcaaggatggaaaatgctcttgtggggattactggtga

SEQ ID NO: 77597 - DNA, 723 bp, Glycine max
  Peptide Sequence Number=SeqID_194375
atggcgtgtatgttgaggatcagctcttacttcaccatggcctggccgttgatggagtggccattctcacgcgccgccaccgtgaggctcgacaacgccgaaatccttattggcgactccagtgggactgaattcatcgacgttggcttgaagctcaagcgctttggagaggcttgctatcaaaaactgatgagtgtccttcttcttctactagttgaagtttggcgttacctctctcgcaatctacactctgtgaatactttctacgatgatgacttcaaagacgattttggaaccgtcgtcgaatgggtcctgaaatcgacgttgaaagcctttattcttgtagcggtttctatggttgactctttgagcataagaattttcaactttttggttctcactttcgtgcttcttgatttgtcaattactcaatgggaaaggacgtttggatttttgacaaagattgatcttatgagcaaggttactaatgcagctgagcttttggaatctgtcatcaaggctcgaatcccaagcctacaatcacccattaacaagactatcattgaactagagatagaattgaaccgtatggggaaacctattgttgctgatactggaagcggtcacagtgttgctagggttccaagagtggagtcaagagacggtgagagcaagagagtgagtcgagcatggagtcatgagatggtgagagtgatagagtga

SEQ ID NO: 77598 - DNA, 255 bp, Glycine max
  Peptide Sequence Number=SeqID_194376
atggttgctgtggttaacaagccatcatctcaattacaacaaccaaacacagcacctcagcctcattctctccttgttgttattggcttgttaattatgccttcgattgacagtgattgttataacactcattctgatacagtacttttggggtcagcagctctgcactgttatcagggatctattgataactatggacagaataactttgcccgaagtcacaaatcagatgagatgaatggagcatggctatag

SEQ ID NO: 77599 - DNA, 615 bp, Glycine max
  Peptide Sequence Number=SeqID_194377
atggccttaaaacgaatcaacacggaattgaaggacctacagaaagacccccctgtgtcctgtagtgctgttatggtctggttggggttttgtcgagatgagcactatggtcgcaatgggcccaaaaaccttgctttgttgttgaaatcatggtcacagactgcaccaagctatcacaatatttcattgaagatgtatgaacaatatagtgtgtgggtccttaacacttctactactagcccagtgactaatgacatgttccattggcaagctacaattatgggccctgcaaatagcccatttgctggaggtgtgtttcttgtgtcaattcactttcctcctgattatcctttcaaaccacccaaggtttcattccgcacaaaggttttccatcctaacatcaacagtaatggaagtatctgccttgacatcctcaaagagcaatggagcgctgctctaacaatatccaaggttcttctatctatatgctctctactaacagaccccaacccagatgatcctctggtgcccgagattgctcaaatgtataagactaacagaaccaagtatgaggccactgctcggtcatggactgagaaatatgccatgggctaa

SEQ ID NO: 77600 - DNA, 162 bp, Glycine max
  Peptide Sequence Number=SeqID_194378
atgtatgtatatgagggtactgaggtaatttctccttactctgatgtagtgactgctcgtcctctctatcgtgaactccttcgtcttccgcagtggaggagagatgcatgcaaaggtactctgactcttaagtcagaactctccccaatatggaaaatgtga

SEQ ID NO: 77601 - DNA, 540 bp, Glycine max
  Peptide Sequence Number=SeqID_194379
atgttcgctaccaatgccacgagcaacctcttcttcccctgcagcccttcgtccttccggtgccgcgccgccgccggagacctctccgcgggcccctccttcatccagtccgtcgccggcggtctaagaattggccagttccccgacggcgcaggactcgccgtggaaggacggcgcggcggcggcggaaacgaaccaataagggtgaagaaatggtctcggaagaatgagagttacttggataacgacgccgagcctcttccccttccaatgacgtatcccgattcctcgcccgtttcgcaagaagagattgataagcgcctccaatgcgatccccaaattcaggattgtaaagaggtggtgtatgaatggactgggaagtgccgtagttgccaaggatcgggatatgtgagctactatggcaagagagggaaaccgaaattggatccatctgactctcccaactacacacaatggctggaactttgtgcagtgggccactcttttagtgagacaagaggagcagggggaggattgtag

SEQ ID NO: 77602 - DNA, 345 bp, Glycine max
  Peptide Sequence Number=SeqID_194380
atgaaggaagtgagtgctgaaggtggaggtggtctagggcaagcatcatcatcagttcctgccccccaaaatgggaacagcatgcaacccagttccatgaaaatttccaaaagtggagaggtgtatagttatgattatgaagaaacaggagatgagccttcaagatttgaggtttggggttggtatctctatgagttctgctcctactttgttcaaactgttctcatccctgtggtgcttcctctcatgattagtcagttacagaacctcccaatggaccctgttcgggtctggttcaagagccaccaaggcagggcctgtgcagcaaaggagattaacctgtga

SEQ ID NO: 77603 - DNA, 510 bp, Glycine max
  Peptide Sequence Number=SeqID_194381
gcttctaattttaataacctcatcgctggattcgttgttaaaaatgaggaattgaacgaaacctacaagtatagtgagtgtatgagaaatagttatgaagttgctcaaggggtctgtcctgattccatttatgaaggccttgatgggccttctgattctattaactcttactatcttcctcataatcatggggttctgaattatgatcatttggttttgaaggtattggagcatgtgaatgaatgtacaggtcccttggatgatgaagacaaagaagatcaaggtctgcagatgcaaatgttccatgggaatcaagaacaattcaagactcaagaggaaaagttgaagaacacttcaagattcaagaagaaggatgaattcaagaatcaagattcaaggatcaagcttcaagaatcaagatcaagattcaagattcaagactcaagaatcaagagaagacataatcaagaagatcaagattcaagactcaagaataaagagaagacttaa

SEQ ID NO: 77604 - DNA, 360 bp, Glycine max
  Peptide Sequence Number=SeqID_194382
atgcaagatcatatctgcttaagggaagtgaaagggcattttgttgagcctgcctataaaagaggaaagaaaggttactcaacaaaggaagaagacttggagattgggtggataagggaagcagagagaccatgggtggtagccaccactgacgataaaagacaagcaggaagctttaagggaattctggagaactttagatatgagagaggaggggaaaagggatcgccgccgtgtgcggtggtcagaatctggcaacagagtgccgccctttccaacagtgttggtgacaaccttgatttaggttttcaatttttaataaaggataataaagtcattgtctgtttatataagaaataa

SEQ ID NO: 77605 - DNA, 1343 bp, Glycine max
  Peptide Sequence Number=SeqID_194383
atgactattactatctttcaggagagcctcggaggtgtcaacccttgtggggcagtggcttttgacagtatgagcccctccgtcttcctcctgtggattatcactatttctctcctcgcccactctgccctagcttcaatccctctagggtattttttagactgtgggggcaccaaagaggtaacaatagacaataatctcacatacattcctgatggaagctacatcaaggtgggcaaaaccaccaccatcagcaagccagacttgttgccaatactctccacattgcgttactttcccgacatgtgggctaaaaaatattgctattcattgcccgtcatcaaaggaagcaaataccttgtgaagacaatgtactactatggaggttttgatggaaggaataagcagcctccggtgtttgatcaaatcgttgaagggacaagatggagcgttgtgaacaccacagaggactatgctaaaggtcttagttcttactatgatattgttgtggtgccaccggggaagactttgagcgtgtgcttggcaaggaatgcacacacgggtggtgcaagccccttcatttcggccttggaggtgaagatgttggatgcttctttctataatcctattgactttaacaaatatgcccttctaaccgttgccaggaataccttcggagatgacaaattcaacaggatgtggcaaccatacaaggaccagaatcctgttgtggaaagcaattcaaatgtgacttcttcagacttttggaatcaacctccagtgaaagcattcagttctgcagttacaacaagtagggggaagactcttgagattcagtggccttctatgtcccttcccagcacctactactacatttccctctattttcaggacaacagacatccaagcccttacagctggagagtttttaacgtttctatcaatggccacaccttctattccagcctcaatgccacaactaatggtgtcactgtttatgctacaaaatggccgctctcagggaagaccaaaattacgttgacccctggtagtggaatacctgttggaccactgatcaatgccggggaaatttatcaagttctacctcttggtggtcgaactcatactagagatgtaattgcaatggaagatttggcaagaagcattcagaatccacctgttgattggcatggcgatccttgcctacctaagggaaattcttggactggggttacatgctctaatggtttccatgcacgagtcacaatagtgaatttgacaaatgccggggtgtcagggtcacttcctccaactcttggccatctaagtgcattagagcatct

SEQ ID NO: 77606 - DNA, 216 bp, Glycine max
  Peptide Sequence Number=SeqID_194384
atgcttccccttatagagcttgctggtaaaggttatgggaaaaaagttgttgagggagacatgaagattagagctattatttgggaaggacatggaaggaatggaaatgagatcatgcaggagtcaattgaacgataccgcaggcataccaagcatgttaatccaactacattcagatcagttgaacaaaatatgcaggcttcggcaataacttaa

SEQ ID NO: 77607 - DNA, 1235 bp, Glycine max
  Peptide Sequence Number=SeqID_194385
atgggcacttctccgagccgcgagggcctcgaagtcaccgactcagattccgactacgaacacgaagaagaagaaacagagcactacgaacacgccaaaacccactccaccgagctcgatgacttggatgcgaaactcaaagccttaaaactcaaataccaaacgccctcttcctcctcctcaaaatcacttccccaaaacgctgttaagctctacctccacatcggcgccaccactcccaacgctaagtggatcctctccgacaaacgcacctcctacgcctttctcaaagactcagacgacgaaaacgacgccgtttggttcctcactgtaggttccaaggtccgcgctagggtttcctccgaaatgcaattgaagatgttcggcgaccagcgccgcgttgatttcgtagccgacggcgtctgggccctcaaattcccctccgacgacacctaccgccgattcgtcactgaatttcaaaactgcgtcttcgagaacgtgtatggaatcgaatgcacggaagaaaacaaggtcaaaatcttcggtaaagagttcatcggctgggtgaagccggaagccgccgacgattccgtctgggaggacgccttcgccgcagatccgtcgccttcgcggcggagagacgacctaatggaggaattcgaagaggccgcgaacggtggggtccaaaccctaaccctaggcgcgttggataatagtttcatggtgaacgacgccggcgtccacgtgtaccgcaacttcaaccgcgggatccacggcaagggcgtcgccgtgaagttcgccggcggtgacgccacgccgaacaaggctttgttgatgcgtgcggaaacgaacatgatgctgatgagtcccttaaaagacggaaagccccacgcttcgaagcttcaccagctcgacattgaaacggggaagattgttacggagtggaagtttggaaaagacggagttgacttaacaatgagggatatcaccaatgacaccaaagggtcgcagttggacccttcggagtcaacgtttttggggctggatgataaccggttgtgtcaatgggacatgagggatagaaagggaattgttcagaacattgccacggcgagttcttcgcctgttttgcattggagccagggacatcagttttccgcagggtctaactttcagtcctttgcgaccaccggtgatgggtccattgtcgtggggtctcttgatgggaagataag

SEQ ID NO: 77608 - DNA, 368 bp, Glycine max
  Peptide Sequence Number=SeqID_194386
attccctttcccatttatttgtgaagtctgttagaagagtgtatgacactggattagaaattgcatatcaaggagagaagggttggacgccatcaaaataccctggactattggagaagctcttagcaaagagccaaacagtgtctggctttttcctggtgcaatatggtcacttgtggcaagaacatcttgacagactatttaatctttactcttcgggaaagctaaaggttgctattgatccaaagaaatttataggcctgcattctgctgcagacgctgttgaatatctccattcaggcaaaagtgttgggaaggttgtcgtctccgtggacccaagcttccttcctcaagtggccaaattgtga

SEQ ID NO: 77609 - DNA, 1248 bp, Glycine max
  Peptide Sequence Number=SeqID_194387
ctgaaattcgctcgtttcggttactgggtcggtctccgagctatgcgtggtggtggcttcgccgtcagaggcggtaacatctactgggggagaaaagaggaaactgatttcagaggaatcgttgtaatcttcgcctgggtttctgttccgcagaacctgttacaagaattcgttgatctgtgttcttctttgagtttccatgatgaaagtgccatgccattggcattttgcgttcttgatgaacttattgaggagctaagaactaggtcatgtcctgttgtatttgctgctttttctgctgggtcaaaagcatgtctgttcagggtatttcagcctaactatcaattacttaggaactgtctttctggacacatatatgattctggtccaatagatgttacaagtgattttggcttccgcttcacactacacccctccattgtaaaagtgcctggaccatcaaaacttgtttcttgggtagcaaaatctgttacctctggtttggatgctttgtacctaactagatttgaatcccaagctgctgagcattggcaggctttatattcttctgttaattttggagctccatttctcattttatgttctgagaatgatgaccttgtgcgataccaaagtatctatgaatttgctcaacaactacgcaatctcagtggtgatgtcaaccttgtaaatttcagtagctcctctcaccttggtcattacaaacaccatccaattgaatatagagctgctgtgagccatttattagagaaggcttcttcaatatattcacaaaaaatgttgcttgaacgagaaagaactggtatggatggtacacaggatgagatatctgagttaatctgtgacctgcagaaggtggcaatcaattcaaataagagccttagaagagttgcagttgggccaaccgaccacttctttttgcctagttcagcaggacattacagtgatagagaatctggtgctccgcaagacgaacaaaaagaaaaacctgtttttgtacctagcttcccaagcatcagcgctcatagtgtccttggccaatttcttttcgacgtttgtgttccaaagaatgttgagggttgggatgtgaaatcttctgggaatctaaatgggaggagatactttatgataaacctgtttgaaacatcagcagtttccctagacaatacaggaaggggacatgtaatggctgcaatggttcaacaattaattccttggcacttttga

SEQ ID NO: 77610 - DNA, 804 bp, Glycine max
  Peptide Sequence Number=SeqID_194388
atggcggtcaatggcttcgatgtcgcacctggtcaacttcctcatgcaccagaagatcacccacatccgcctctacgaccccaaccccgacatcctccgcgccctgtcgggtacccacatccacgtcaccatcagcgtccccaacaaccagctcctcgccatcgcctcctccaacaccactgccacctcctggatccgcagaaacgtcgccgccgtctccctcggcgacgaggtcctctccaccctcccctcctcctccccgccctccgctccctccacgccgccctcgtctattccaatatccataacgacgtctttgtttccacccctcactccgcctccgtcatcctcaaccccttccctccctcccaagccttcttcaaccaaaccctagaaaccttcattcgccctcttatccatttcctctctcaaacaaattcccccttaatgctcaacctctacccttactacgtcttcatgcagaacagaaacctcgtccctctcgaaaacaccctcttcaaatggtgccatattattataaaactggtatggaaggatttcaatattgcatatgaagcaggaggagttggaaaggaaattaaaataccatttcctgcttatgtgaataataactctttagagattcgcttttattgggctaggaaagggacaaatgctatcccatataaatcaatatatggtcctcttatattagctatatctgtcactcgtgattctacaggtggcagcacgtctgcaggggttgtagttggagaatttatattaggaaaagaaattcattag

SEQ ID NO: 77611 - DNA, 345 bp, Glycine max
  Peptide Sequence Number=SeqID_194389
atgtcagagcatagatggcattattatgaaattgatctggtggagcaaaacgttcaagtcactgagaatggtaaacaagaacgccacctcgttgcgactgtgggcaagtttagtgtgatatgggattttcagcgggtgaagaacagtgcacatgaatgttacaggaatcaagaagggctgaagagctgttactgttataagatagtgttgaaggatgagtcaattgtagaatcacggtttatgcacgacaaatttgcggttagtgattctccagaagctccgttggtggtggctactcctatgaaagtcagctccatcagcctgtctggaaagcgacatggttaa

SEQ ID NO: 77612 - DNA, 300 bp, Glycine max
  Peptide Sequence Number=SeqID_194390
atgcaccaaatcaaagttgcaactaacaactttgatatttccaacaagattggagaaggaggctttggtcctgtttataagggcattttatcaaatggcacgataatagatgtcaagatgctttcatctaggtcaaagcaaggaaatcgtgagtttataaatgagataggcttgatttcagccttgcagcacgcttgtcttgttaaactctatggttgttgcgttgaaggagatcaattgttgttagtatacaaatatatggaaaacaatagccttgcacaagctttatttggtaaataa

SEQ ID NO: 77613 - DNA, 429 bp, Glycine max
  Peptide Sequence Number=SeqID_194391
atggcaccatttgaagagggtgttttcgagagggacgaggtttctgttctgcatgaagacgtagtaaggggtttggttgaagaaggcttgggagggagggaaggggttgaggatgacggaggcggaggtggagaggacctcgtcgccgagggagacggcggcgacgtttctgcggatccaggaggtggcagtggtgttggaggaggcgatggcgaggagctggttgttggggacgctgatggtgacgtggatgtgggtacccgacagggcgcggaggatgtcggggttggggtcgtagaggcggatgtgggtgatcttctggtgcatgaggaagttgaccaggaagccagagttacaatttgggcagaggagaacgacattgttttgtggaaccctaacaatgtggttgtagcaatagcaccagaatga

SEQ ID NO: 77614 - DNA, 284 bp, Glycine max
  Peptide Sequence Number=SeqID_194392
atgactcgagggcccggtagcatgcagagactaacgtcgtcatctgcacctttgtcatccagagacggcatgtccgatgacatacagagataccttatggttatccacaccttttgtcagctagagggaagcgagctcgttgacacgcagagactaatgtcgtcatctgcacctttgtcatccagagatggcaagtcgaatgacatgcggagataccttatggttatccgcaccttttgtcagctagaggcaaacgagcccgttgacgcgaagagactaacatc

SEQ ID NO: 77615 - DNA, 1263 bp, Glycine max
  Peptide Sequence Number=SeqID_194393
atgttgcttcattactgcacggaaaaactatcgtcagcacaaaaaaaaaaatctcaccaaaaccaagtcaattccaacataccccctggcccatggaagctacctaacataggaaacataccccatcttgttacatctactccacatcgaaaattaagagacctagccaaaaaatatggacccttgatgcatctaaaacttggggacctcaaccatagttgtttcctcagcagagtatgccaaagaggctatgataagaaaaccatagcttttgcaccttatggaaactattggagacagctacgtaaaaattgcacattggagctcttcaccataaaacgtatcaattcattcaggccaataagagaagaagagttcaacatcctcatcaagaggattgcttcagcaaatggatcaacctgcaatctcactatggcagtgctttcattgtcatatggaattatttctagggccgcgtttctgcaaagacctagagagttcatattattgacagaacaagtggtgaagacttctggaggctttaacataggagagttcttcccttctgctccatggattcagattgttgctggtttcaaacctgagcttgagaggttgttcataagaaatgatcagatattgcaagacatcatcaatgaacataaagatcatgcaaagccaaaaggtaaagaaggccaaggtgaggtagcggaagatatggtagatgttcttctaaaatttcaagatatgggtggtgagaatcaggatgctagcttaactgatgacaacatcaaggctgtaattgagaaaatgtttgcttctggaggtgagacatcagcaaatagcataaactggacaatggctgagttgatgaggaatccaagggtgatgaagaaagcacaagctgaggtgagagaggtattcaatatgaaaggaagagttgatgaaacttgcatcaatcaaatgaaatacttgaaagcagttgccaaagagactatgaggttacatcctccagttcctcttttattcccaagagaatgtggagaagcatgtgagattgatgggtatcatcatataccagtcaaaagtaaagtaattgtgagtgcttgggcaattggaagagatccaaagtactggagtgaagcagagaggctttatctagagagattctttgctagctctattgactacaaagggactagttatgagttcatttcatttggtgccggaagaagaatatgcccaggtggctcatttggtctg

SEQ ID NO: 77616 - DNA, 384 bp, Glycine max
  Peptide Sequence Number=SeqID_194394
atgaagttgttgatgaggcatgaggcaaaagtggggaaaatatcatgtttgattcttaaggcagatttccaaaagatgaaatggacttattggatcgaaataggccttgaatttgcatcaatttatgagttggtaaatggaagtccaactggtgagtgtagaagcaaaccttcatggagaatcaaaggtgattcaaagaacaattcaagagttcaagataagaatcaagaagaattcaagactcaagaagaaagtttagagtcaagaatcaagattcaaggttcaagatctcaagaatcaagatcaagattcaaaactcaagattcaagaatcaagagaaggcttaatcaagataagtatgaaaaggtttttctcaaaaattga

SEQ ID NO: 77617 - DNA, 1155 bp, Glycine max
  Peptide Sequence Number=SeqID_194395
atggcggaggccgagatggagaagataacaacaatagacccagagacggaatttctggcgtcgaagcggaagaacgggaacgagtgggagaccttcaaggagaacgtgaggccgctcaagagaggacgcaatgtcaacctcttgaaccacgccctcaactcccacaccgataaccaactcaagaaatccctcgtccaacaacgaagcaaactgattcaagccatccaagaataccagggtgacgatcctcttctcccctggatacagtgtatcaagtgggttcaggaggcctttcctcctggtggagacagttcggggctggtggtgatttatgagcagtgtgtgcgtgccttttggcactcagagcgctataaggatgatcttcgctacctcaaagtgtggctggaatacgcagataattgctttgatgcagacgttatctatgcttttctggatgcaaatggcattggaaaacctcattccattttctacatttcatatgctttgcatttggaatctaagaacaagtttaaagctgccaaccagatgctggagcttggcatatctaggaatgctcaaccgattgagaaattgaaggctgcttatagacaattttttgcacgctcaatggcaaggcctatagctatagatgattcagtagaaaaactggcacccacgcgtagctttggaactgttcttgccaagggagaaaatcgtgcaccgctgtccattttgaactcgaaccgtgatccttctgctaagaatgataggacccgagcagctccactttccatttataaagattcagctgacactggtgatactgatcctcataagcctgacccgtcgcactcttggcacacacttggagctcgagctgacagaaataaggaaaacaatgcaattcctggcaagtggaagtcctataaggttccacagcgacctgggactagagttggaggggctactccaagtgcctttatcccagtgtttgttgatgaagaatgtcaagattcacaaagtaagaaagcagagggttgtaagtcctcaagtttgaagataaggcaagaggacgacaaggaactgaaaagggaaacagagctactgaggaagaatccattacgcaattttcctcaaaacagcctccctagataa

SEQ ID NO: 77618 - DNA, 897 bp, Glycine max
  Peptide Sequence Number=SeqID_194396
atgacatgcaaagaccaagaagaattcatatcggcagtgaaagaaggagtaacagttgcaggaggctttaacttagggaatctgtttccttctgctaaatggcttcaacttgttactggtttgaggcctaagattgagaggctgcatcgacaaatcgatcggatactgttagacatcatcaatgaacacagagaggcaaaggcaaaagccaaagaaggccagcagggtgaagcagaggaagatttggacatatttggtgctggaggtgagacagcagcaactgccataaattgggcaatggcaaagatgattagggatccaagagtattgaagaaagcacaagctgaagtgagagaagtatacaatatgaaaggaaaggttgatgaaatttgcattgatgaactcaaatatttgaaattagttgtcaaagagaccctaaggttacacccaccagctcctcttttacttccaagagcatgtgagattgatgggtatcatatatcagtcaaaagtatggtcatagtgaatgcttgggcaattggaagagatccaaagtactggagtgaagcagagaggttttatccagagagattcattgatagctctattgactacaaagggggtaattttgagtacattccatttggtgctggaagaagaatatgcccaggaagcacatttggtttgaaaaatgttgagttggcacttgcatttttgttgtttcactttgattggaagcttccaaatggaatgaaaaatgaggacctggacatgactgaacaatctggagtgactgttacaagaaaagctgacctattcttgatacatatcacttttcgtcctatcatgctcacgcacactgaagcacaaaggagaggcggggagagaattctatga

SEQ ID NO: 77619 - DNA, 1512 bp, Glycine max
  Peptide Sequence Number=SeqID_194397
atgggggaacggccatgtgatgcacgtggcgaactcagaaatcccgggcctgactccgggcctggcagaaagtctggcgaccctgacggagctgggaaagcaccgcctcagcgcccgcgaggagcacgagcacctgcggctcacgctgcacgacatggcgcaacagattgccgataccgtgcaggacagcgcactgccgctgtcctcgtttcgcgcgtggattgtggcgagccatattgtgcacgcgcagttcggcagccggggcgaggtgatctgggggcgggcgagcggcgcactggcggcacgcctgacggatatcagcctccgcatggagtccgacgacacacagaccggtcgcggcgtgcgcgtcccgaaaatgacgttcagcagctggccgcacttcatgcgcgccgtgcgtcagcagctggaggtacagtcatgagcgtacaaaacaccctgtccccggacgcggcgcagcaaaaggtgacgcaggccgacatcacgcgcgcgctgggcgaattctgctttatccgcctggacaacggcgacgaagccttttattacaacggattctggctcaccggtgcggatggcgagagtaacgaaccgtcggtgcaggggctagcacagcgcaccgcccgggcgggcaacaagcatctgcgctgcgtcgagctgccggtgccggaggacaaagagtggtgctgggatgatgtggtcacagaactggcgcgctgcgccgtcacgcgcgagctgcgcggcgaactgatagtgaccggcagcgaaacccgatacgggcggggtatccacatctgcaacgatccgctgctgagcggcatcaacagcaacctgtggttcccgctcaaccaggcggaggactggtttacgggcatcgagcgcgtgctgatgatgaacggcgtggcggagaacgtggtgcgcattgaatcgctgcgcgactgcgcggcgtaccatgactggaaggtggtctataaccggaagctgactttgggggagcttccgttgttcccgatgaaaactatagcaccggccatatttaagtggcaaaactcctgcagcacattatattcagtgctgcctgaccgcgcggcgtgcgaggagacgatgatgagttttttaatgctgggttccctgctgagcctgggttatgcgctggccttcgggttcgtggtgccgggcgatataagccttacatactggtgcggctacgcgatgtgcttcgtgctggcgcgcctgctggcttcaaagcatccacagcccgcaggtgactgggtagtgatcaaactccttgcactgaccgttccggtgggcggcgtgtttctgtgcgtgtggggcgcaatgaacctgctggctgacccggcggcgggcggaccggcaggcgctgacatgctgtactctgcatcccacgggctgctgctgccgcttttggccatgataatgggggcggccatcgtggcggtttcgctgtaccgcatcaggacgcgcgcgcagggataa

SEQ ID NO: 77620 - DNA, 222 bp, Glycine max
  Peptide Sequence Number=SeqID_194398
atggattgtaggctaagcaggattgtccacgaattccaagtcatatatccaactttggggttaagagcgcttgttgggtgtgaggtggtttcattttcagctatgatatctcacgtggatttgaccttacctcctcgagatcacccttacatcatccatttttcatttggagaatggatgttcataagtgcttgtaatggttgtctccaccaaatcacctaa

SEQ ID NO: 77621 - DNA, 1714 bp, Glycine max
  Peptide Sequence Number=SeqID_194399
atgacggaggagcaggtggtgaatgtgcgcggcgaagtaagcgattccgtcaccgatcaccgcagcgtcaaggccaatggagttgctcacggtgtcggtggcgatttggatcttgccgccgacaacaacggtgctgcgttgtcggagaaaatttgtaaagatgcagtgtctaacggtacggcagaggaagtttccgaaacggcgatggttaatgtcgtttcgcgggatgatgaattaaaatgtgcggatggtcaaaacgacacgggatccgttcaaaacggcgtcgtggagaatgatgataagagtgctaatgctgttgcggaggagttggttacggatcacgatgaatacgttgtcgtcggtgattcggatgttcagaacggtgatgatgtgaatgcgaacgctaacggagttgaggaatgcgaaatgctggatggtgcggagggttcgggagatgaaaacggtgtcgttgtgagtgctgtggagggagatgctgatgtgaatcacagtgatcgcgaattcgaatgtgttgatgttcacaatgatgtcgcggtggaaacagttgaggaagaagtaactgctactactgatcagaacgttggaaatggaaatgacgttcagggaagaagtgagtctgtatctgatgaagatgtggataaaagtggggaaagtgtaaatgtcgttagtgcagatgttttggatgagaaggacattgtaactgatggtgatcatgatgcggaagaagttcttgagaagaatgagattcttgttgatgctgatggtgtctctgccactacagatttgaagcaatgtgaacctgaagatgctcgaaacagttcagagaaggggcaggttgagtctgtctcaggtttggcaaagccggagccaagtgaatgcactgaggagaatgagatagctgttgaaggtgaaccaggcagtaagttggaaaggtccgaggaggaagcaggaagtgaaatagttcctcaaggagaaaatttaacagccttaaacagcacagatgtgactggggatggtgatgttgtgtctgacattgcagtggagagcaaagatgaaccttctgttgatgtttgtgagttgaaaagcattgcagttgaaaatgatgttgatgtgcaagagttgaaaaatggtgcagtgcagagtgaaattgtgtctgagatgaaaaacaatacagaggagagtgtagctgaaccttcaaatggtgcagttgagagtgaagctgaaccttcaaatggtgctgtagaaagtgaagctgacccttctaatggtgcagttgagtgggaaactgaacattcaaatggtgcagttgagagggaaactgaacattcaaatggtgcagttgagagtgtagctgaaccttcaaatggtgctgttgagagtgtagccgaaccttcaaacagtgcagttgatcgtgaagatgaaccttcaaatggtgcagttgataaggaagctgagccttcaaatggtgcagttgataaggaagctgagccttcaaatggtgcagtggatagtgaagctgaaccttcaaatggtacagttgagagggaagctgaaccttcaaatggtgcagtggagagtgaagccgaaccttcaaatggtgcagtgcggtgtgtagctgagccttcaaatggtgcagtggagagtgaagctgaaccttcaaatggtgcagtggcgagagaagctaaaccttcaaatg

SEQ ID NO: 77622 - DNA, 177 bp, Glycine max
  Peptide Sequence Number=SeqID_194400
atgaagttttgtggattttcaatcggtggaagtgaaagaggagtgaaagagaggaagattgggctttacgggacgtgttttggtgaagatttgagtaagatacgaaggagtaataagccttctggtaatcgattacaggatgttgtaatcgattacaggctgcttgttcttgtgtaa

SEQ ID NO: 77623 - DNA, 2654 bp, Glycine max
  Peptide Sequence Number=SeqID_194401
ttgatagtgaagctgaaccttcaaacggtgcagttgatagtgaagctgagccttcaaatggtgctgttgataaggaagctgagccttcaaagggtacagtggagagtgaagctggaccttcaaatggtgcagtggagagtgaagctgaaccttcaaatggtgcagtggagagtgaagccgaaccttcaaatggtgcagtgcggtgtgtagctgaaccttcaaatggtgcagtggagagtgaagctgaaccttcaaatggtgcagtggcgagagaagctaaaccttcaaatggtgcagtggagagtgaagctgaaccttcacaaggtgcagtagatagtgaagctgaaccttcaaatggtgcagtggagagtgaagttaaaccttcacaaggtgcagtggagagcgaagctgagccttcacaagatgcagtggagagtgaagctgaactttcaaatggtgcagtgaaccgtgaagctgaaacagcaagtggtgcagtggagagtgaagctaaaacttcaagtggtgcagtggagactgaagttaaaccttcacatggtgtagttgagagtgaagctaaaccttcaaatggtgtagctgagagtgaaagtgaaccttctgttgatgtgtgtgagacgaaaaacgatgtagtgaatagtgaagctgaaacttcaagtggtgccctgcagagtgaaagagaggcttgtgttgtgtctgagatgaaaaacaatgcagtggagagtgaagctcaaccttccgttgatgtgtctgagaagaaaactaatgcagttgacagtgaagctgaactttcagttaaaggtgggctttctgttgaaagtgaaggtagtaatcaaggagatgaagattcaagacctgcctcagatgctttggatggacagaatgtgggtacagaggtagtgaaaaagccattctactatttgatcagggttcccagatatgatgatgatgaaaacataaaagagaagataaaaaacgctcttcaccaagtagaggagaagactaaaattcgagatgctattcgaatcgaaagccagactataaaggccagttgtaaggatttcgaccaagagtttagggctgcaatagcagcccatagagctgctcgtgacttgctcaaatccaaacgccaggaaatagattcagtccaatccacaatgaacagattaaacaatgcaatttctgttggggatatagatgacaagataagaagcatggaacacatgatccagcatgaaactttgcctctaaataaagaaaagcaattgatacgcgagatcaaacaattgaagcagaaccgtgaggagttgtcttctaatatgaaaaagcaggatcaatcacaacaatctgtagacaacaaggatgacaatattgaagagcactttaagcatttacagcttttgaagaaggaaatggaagtgcttagaaataatgttctgaagtcagatacagaaactaaagccgcaaagaagaaatataatgatgaatgtgataaactgaatgagttgctagctcgatttagggccgctgatgattctcgtcaagaggcatatgctaagttactggctttgaaaaaacaattgcatgagaagagcaaaaatttctgggaatacagagatgctgcaaataaagcacaggaactagcagcgggaggaaaaaaagaggagctgcaatgcttctgtgttgatcaggttgagagaattatggagctatggaacaaaaatgatgggttcagaagggactacgtccgatgcaacactaggagtacgctgaggagactgcaaaccctggatggccgatcacttggtcctgatgaagagccccctgtaattcctaatgtaataactgaaagagcttccaaaaatattcccatggtcttgcagtcaactctggaacaagaaaagaaatcgacaccaacagaatctgttaatgtaaaggatgaacctgtttcgaaggttgtggtacaaagaactgaaacgagtcagacaactaaagctaagaagcctaccaaacctgctcccttagagaagcatgtggctcgttggggtgatgagtctgatgaagatgaagttaaaaaagaagaacctgtgagaacaaaggaggaagaggagttgatactgaaggctgagaaggcaaggatggaggaagaggaggcaaagttgaaggaaaagcggaggctagaggagattgagaaagctaaggaggccctgctgaggaaaaagcgtaatgcagagaaggcccaacaaagggctgccttaaaggcacaaaaagaagccgaactgaaagagaaggaaagggagaagagagcaaagaagaaggaaagaagaaaggcaggttctgctgtcactgcagagaatacagaacaagaatctgctcctatcccagaaactctaacaagaagcgtggaagagtttgaacagactgagaaaacagctgaggtaacaaaaaagccacagaaaacatctcaattcacgaggcagaccaaggtaaaatctgtacccgcagctcttcgcaaccggggtaagaggcgaattcaaccatgggtatgtgttctaattgcgcttgtcgttgctgttgccttgttttatgttggccataactgctctttgagatcttcgctcgaaggctttggttactga

SEQ ID NO: 77624 - DNA, 204 bp, Glycine max
  Peptide Sequence Number=SeqID_194402
tcactcaagtgttatccgttatcaattgtggtgttttttatgctctctaaaattcctcctccggttgctctgttgggattcccaaacgttagagagaagaagaagagattgaagccttcattccatggtcctaggtgcgatgcatctttctccctcgacagacataattttgcaaatcccgatggtaaagacgtgcggaaatga

SEQ ID NO: 77625 - DNA, 3030 bp, Glycine max
  Peptide Sequence Number=SeqID_194403
atggatcaagttgctcctcctccgattctcatgcaccgcaagcgcgatctctcctacgccgtcgtttcgcctgctcccaacccgagctggagctgggactgggacagcgtgcgtttcgccggcaaaccaccgccaccactctcctccccaaacgacgacgtcgtttttgaggagagtgttgcgccgcctctgcagttaaacctcgggggaaggacgaacaacagcaacagcaacaagagagttaggtcagggtcccccggaacgtcgtcgtatccgatgtgccaggtggacaactgcagagaggatctgtcgaaggcgaaggactatcaccggagacacaaggtgtgtgaggctcatagcaaggcctccaaagcgcttctcgcgaatcaaatgcaaagattctgccagcagtgtagcaggtttcatcctctctcggagtttgatgaggggaagcggagctgccgccggagactcgccggacacaaccggcgccggcggaagacgcagcccgaggatgttacctcggcgactcccgcgccagccgccgccgcgaatttggaaatcttcgacttgttgactgccatagctggagcttcgcagggaaaatttgaggaaaaaaggtcacaagtaccggttagagagcagcttgttcagattctcaacaggatacctttgcctgcagatcttgcaaccaagttgctggatgctggcagtggcaatgttaatgggaaaaaagatcaagtgcaattgcagacaccatcctcctatcaacgtcacgagtctcatgaccaactgaaccacaccccggctgccccattaactatggacttgcttgctgttctttccaccactctttctggggggtctgcccctgatgccagtgcgtcgccctctcaaaaccacagctgcaacagtgatggtggcagtgctgaccagacgagacaacagcaattcttttcggttggtggggaaagaagcagtagcagttcccggtctccggttgaagattcagactgtcaggaggatgttcgtgttaatttaccactgcaactctttagctcctcaccggaagatgacagcctgcctaaactagcatcttctagaaagtatttctcgtctgacagtagtaaccctgctgaagagaggtccccatcgtcttctcctgttgtggagatgctgtttgatttgcagggtggggctagaggtctcaagccagagagcatatcctctggaagagaagttattgctaataaggaagctagccaaagtcatagttctaatatctctcttgatttgtttaaagggtcaaataacaggatccaacaacctagttcacttcaaagtgttccatttcaagctgggtatacatcttcgggctctgatcattcacctcccagtttgaattcagatgctcaggatcgcactgggagaataatgtttaaactatttgacaagcatcccagccatttccccggaacactgagagcacagatttacaattggctatctaataggccatcagacatggagagctacatacggcctggttgtgtggtcctatcaatttatgcttcaatgtcttctgctgactgggagaaactagaagaaaacttccttcaacatgttcattctttaattcaaaattcagattccgatttttggagaaatggaaggtttctagttcattctggcagtcagtttgtttcacacaaagatgggaagatacgcatatgcaaaccatggagaacatggaagtcaccagagttgatatctgtgtcgcctttggcaattgttagtggacacgaaacctctatttcattgaagggtagaaacctgtcaactccaggcacaaagattcactgtacaggtaccggctcttacgcatcggcagaagtaataggatctgcatattctggtgtgatgtatgataagataaagttgagtgcttttaaagttcaggatgtatcacatggtgttctgggtcgctgttttattgaggttgaaaatggtttcaagggcaacagttttccagtgataatagctgatgagaccatttgcaaggaattgagaccacttgagtctgaatttgacgaggaggaaaaaatatgtgatgccatttcagaggagcatgaacatcattttggaaggccaagatcaagggaggaggctttgcatttcttgaatgagcttggctggctgttccaaagagaaagattctcatatgtgcatgaggttccatattattcgcttgacaggttcaaatttgtactcacatttgctgtggaaagaaactgttgcatgctagtcaaaacccttctggatgtgctggttggtaaacacttgcaaggggaatggttgtcaacagggtcagtggagatgttgaatgcaatccaactcttaaatagagcagtgaaaggaaagtacgttggcatggttgatttgctcatccactattctataccaagcaaaaatggtacatccaggaaatacgtatttccaccgaatcttgagggtcctggtggtattacacccttgcacttggcagcaggcacatctggttctgagagtgtcgttgactctttaacaagtgacccacaggagattgggttgaagtgttgggaatcccttgtggatgcaaacggacagactccacatgcctatgccatgatgaggaataatgactcatataatgcgctggttgcccataaacttgctgatagacgaaggggtgaaatttcggtaacaattgagaatgcgatagagcaacagtcactgagagtggagcttaaagaaaagcaaagtaacttagtcaaacgtggtcagagttcttgtgccaagtgtgcgaatgcagaatttcgcttcaacagaagagttccaggttcacacggtttgcttcaccgcccctttatttattcaatgctagctgttgcagctgtttgtgtatgtgtttgcgtgttcttccgtggacgcccttttgttggctcagttgctcccttcagttgggaaaatctggattatggcacaatgtaa

SEQ ID NO: 77626 - DNA, 911 bp, Glycine max
  Peptide Sequence Number=SeqID_194404
caccacccaccatgatgaagagcctaaaacaagtgaggaaaacaagaagctacaagcttgagagatcttcatcagcaatggaataccaaatcacatctcctagtgatcaccactactccacaggctatgtgaccaaaaagtcccctcctcctcctccacatgtggagtttcctacctctccacaactcatatttggggaggagattcttcacttcagccaccctcagcaccctctctcaatggtggatcttcctgacttgttcaattgtgtggggtgcaaagagtatggctctggaaagaggtttgtttgccagcaatgtgactttcagcttcatgacttctgtgccttggctcctcctgctctcaaggcacaccccttccactcacaacactctgtcttgttccattccaaaccagtgaagagtgggatggcaaaatcaaaatgcgatgtgtgtggcaaaccaacaaagggctttggcttcctatgcacggcatgtgcctttcagatgcacccatgctgcgccatgctcaacaacgaaatcgagtacccagcccacccccacactctcagaatgctcccaacaaccgtcccggaccccgcctctttcgtctgcggcgagtgcaagaagcagaggtccgggaaggtgtaccgttgcaccgtgtgcgagtatcatctccacgcggtgtgtgccaagaccaagatcaatggcctccaagccaatggcattagaccacctgagaagcccagcgtgcttgctgctgcagcacgcgtggcttctcaggttgtcattgagttcattggaggactcgttgagggcattggagagagtgtgggagatgtgcttgtgcagaatattgccaagggaaacaatgctcctgctaatgctactccaaaaccccgatacaaataa

SEQ ID NO: 77627 - DNA, 147 bp, Glycine max
  Peptide Sequence Number=SeqID_194405
atggcgtgtgatgctactagtactatcctcaatagctttctgctatctcatcatctcaacactatcaacttcttctcttcttcttccgttttcgcggtggcgatggataatgggctaatggcatactccaacttacgtagttattaa

SEQ ID NO: 77628 - DNA, 894 bp, Glycine max
  Peptide Sequence Number=SeqID_194406
atgttgagtttgcatgcatatgtttataagcttggtcatcaggctgctgcgtttgttgggaatgcgcttattgatgcgtatcctgtctgtggaaatgttatcgctgcgtgccaagtttttgatgggatttgttgtaagggcatggtatcttggactgggatgatggcttgctatgctgagaattactgccatgaagattcgttgctacttttctgccagatgagggttatggggtttagaccgaacaattttgaggttgggaaaagtgttcatggatgtgctttgaaagcgtgttatgatagggatctttatgttggcactgtgctgcttgaattgttaaccaagtctggagagattgctgagacgcagcagttttttgaagaaatgccgaaagatgatcttattccttggagtctcatgatagcgcggtatgctcagagtgataaaagtagggaggctttggagttgttttgtcgaatgaggcagtcatctgttgttccaaataattctacgtttgctagtgtgctgcaagcttgtgcatcttcggtttcactgaatttgggaaagcaaattcattctaatttaggggatggggagaaagcattaaatttattttcaaatatgcttggatatgacatacatccaactgaagtgacatactcaagtgttctgcgtgcctctgctagtttagtagcattagagccagggcgtcaaattcattccttaactatcaaaaccatgtataacaaggatagtgtagttgcaaattctttgatagatatgtatgccaaatgtggtagaattgacgattcacgactagcattcgataagatggataaacgagatgaagtttcatggaatgctataatctgtggaggctctaaatttatttga

SEQ ID NO: 77629 - DNA, 494 bp, Glycine max
  Peptide Sequence Number=SeqID_194407
gtggacttctattcaaacctggaggaagtaacctacaacacacaacagctctgtcatttcttttaattgtttatgcacgttacatgcaatctgcgaagaaaacagtaacatgtgggaatgaagttgccgacccagctaggctcataaatcttgcaaaaagtcaggtggattacatattgggaaagaacccactaggaatgtcatacatggtagggtatggagccaagtaccctaagaagatacaccaccgaggttcaactttaccatctgtgaatatgcacccacaacatatccagtgtcgtgagggagaccaatatttcaaatcagaaaaacccaatcctaacattctaacaggggctgtggttggaggacctgctgaagatgattcttttcaggattcgcgctataatgttggtcaatcagagccaacaacatacatcaatgctccttttgttggtcttttggcttacttcaacaagcatactattagttag

SEQ ID NO: 77630 - DNA, 429 bp, Glycine max
  Peptide Sequence Number=SeqID_194408
atgaagatactagggttcttcttgtcacttataagttcagggtttgggttctacttctggaacaatcattggaagtgggggcacttgctggtgtttggggccattcagggcacagcaagtgggttggtgcacacttttggaagggtgttggtgttggatagtgctccatccggtgaagagggtgctttttctgtttggtatagttggctgagaggtgttggcttgtgtggagggttcacagtgggttcagtggtgccagggaaagtgaagacttcttttggagctgcgttttgcagtgccattgttggaattgttgttctgctttttggaaaggagaatgactttggtggcgctgtcagagagggtcatgaaacacgttcccgtgaccaccctggtgccttaaattccaaggaatctttcagcgtctga

SEQ ID NO: 77631 - DNA, 546 bp, Glycine max
  Peptide Sequence Number=SeqID_194409
atggatgctaacatagttgacactgcaattacttcaaggaaacataaaagagaagaatttaagaagataattaaagttgcttctgcttgtgtcctttatatgattatgggtgtagtagcatggtatcataatagtcattttgttaaggaaccaaccccttgtggtccagatttaaggtttatttatgagttgcctaggtgggaagggtctaatggagattctcgagtattacgagatgctttacatcgtcaaaataaacttgaaattccaactgcatgcgaccctcgcttgaccgcttcgagatacttaacacccattgttaggcaatccgtggagttccgcgacatgccggaagtcgaagggaagcattgttgctcaatccgtaaagttccacaacattccagaataaaaagaggtgtgcaaatagcaatcaggcccacttgggccttccaggatgttccaacagaaggcggtgccttctggtggaagcaacccagctcgcctgggcgggctgggcggcaaccacctccctcttttcccctataa

SEQ ID NO: 77632 - DNA, 237 bp, Glycine max
  Peptide Sequence Number=SeqID_194410
atggagatgaaagactccgtacgggggacgccgggatgtatgcggtttataggcgttcagaatctagacgatgtcaaatccagaaaggttgagccgcgaagacaaaaggtcgacgacgacgcagattttgcagcgggcgccgatggtgagggtggagtgaaagtgcagtatccgttgcaaggcggggggcctcctagaagagagggagctccgggaaaggatgaccggcaacaataa

SEQ ID NO: 77633 - DNA, 3158 bp, Glycine max
  Peptide Sequence Number=SeqID_194411
gtagtgcaaacataacaattggtgctctcgttgcctccatgactgactcttctccacagctcactgaggtacttgctcgccttggtgacacgatgcattccatgtccctgaaactcgacgagatcctccatcgtctctcaccttcatcccattcctctgcttcgccaaacccatcaccacagcctcacccccctgtccctacatccacacacaaaatgaaattagaggtcccccgcttcaatggcactgaaccactgggttggatctttaagatcaaccagtacttcgagtatcacaatacactggacaaggaccgcctcaccattgcttccttctacatggaaggacgagcgttggcttggccttacagacgcggtttgtgccgtcgcagtacaacgaccctattggcatgttattcaaactcacacgaccctattggcgaaacggatcattggcttgcctcctccatttctcctcgcatgcttcatttttggtctcgcgcccgatattcggagggaggtgcaggctcaccaacccctcacgctggttcaggctgccggccttgccagtctttaggaggagaagatttcctcgtcccgggcgactccacggccttccccgcctcaattgttgtcggccccctcgcgttccacacctctacctcccttgttgccgtcaccccctcgaccgcctccacctccgggcataggtgcgcctctagggttctcctcatggttgcagaagaggaagacctttcatggtctaatatagacccgggtgacccagccctaaacacagacccactcgacagcccaaacccactccaggcccaaatcagcttgaattcactttcgggccatttggcaccaaaggccctccgtttgttggctttgatctctaaccactatgttaccgtcctcgttgacggtgctagcatccacaatttcgtccaacctcaggtggtcacctccctgagcttaccgtgccggaggatttcgacaccccttcgcgttatggtaggaaatggtcaatacttggagtgcgcgagtgtctgtgaagatgtcttggtctacattcagaaccacaccttcaagattgatctctacatcctaccaatctccggcgccaatgtcatattagaggtgcagtggctcaaaacgctggtcaatgttcgaccataccgctacccccattatcagaagcacgaaattgagcttcaagttgattccatgttgcaacaagggctcattcaacctagtactagccctttctcctcgccggtcttactggtgcgcaaacctgatggcacgtggcgattttgtgtggactatcgagcattggatgccgtcaccgtgaaggacaggttccccattccatcaattgatgagttgctggatgaattggggggcgccacatgctttttgaagctggatttactccagggatatcatcaaattcgtatgaatgaagatgacgttcctaaaaatgccttcagaacacaccatggtcattatgagttccgtgtgatgtcgttcggattgttcaatgctccctcctcattccaggccaccatgaatatgattttcaaaccatatctccgccatttcattatcgtcttcttcgacgatatactcatatatagcacctctttcacgaaccatttgttgcatttacaattcgtttttcaaattctgcttgataatcaatttgctctaaaattgtctaagtgtttctttgcccaacctcaggtagagtatttgggccatcttgtctccgcccgcggtgtggaaccagttgctttgaaggtggtcgccattcaccaatggccaacaccacgctccaccagggcagtaaggagtttcctgggcttagttgggttttatcgcaggttcattcgtgggtatgctacgatcgcaactccattggtagcagccacaacaatcaaacctttcaagtggaccacccaagcccagttggctttcgaacaactcaaacaggaacttgcttcagcaccagtcctcgctttgccgcagttcgagttgcccttcactgtggaaactgatgcctctggggtgggcatgggggcagtcctttcccaacaaggacaccccattgctttctttagcaagccattcagcccgaaactcctcaggtcttccacctatgtcagagaattatgcgccataaccacagtgaagaaatggaggcaatatctcctaggccaccactttattatcctcactgatcatcgcagcctcaaggagctgctcactcagacaattcagacgccggagcaacatatgtacctagcgagattgatgggctacgattatgaaatacactaccgttcaggcaaccataatcaggtcgcggacgctctgtcacgactaccggaggccgaatatggttacccaggggaattccactcattaatactttgctcgttgaatatcacacaacacccacaggggtcagggaagacgtcaagcaatttgtggccaaatgcgtcgatttccaagtcactaagcttacctccatatcagggtaacaccacaatcctggtggttgttgaccagttttccaaggggatacaccttggtatgctcccagctacccatacagcacacatgactgcctcattgttcatcaacatcatggtgaaaatccacggcatccctcggagcttagtctccgatcgttaccccctttttataagaaaattctggcaagacctgttccatgcaagtggtacccttcttcgaatgagctcgtcataccaccctcaaacggatggccagacagaggtcctaaatcgcgtaattgagcaatacttgagagcttttatccatcgccggccaagtctatggggaaaattgttatcgggggtagaatggtcacacaatacctcttggaacgtgggaacaggggctaccccttatgaaataacctttggccgcaaaccttttaatttcgctgaatacatattaggatcttcaaaggtggatgctgtggaagaaatgatgattgacaggaacattgatgtaagctccattggagcttgtaggcctaggatcttcttcatcaatggattcctttgcttcttggaagataaatggaagcggaatggagaaggaagagagagaggagacgccacttaa

SEQ ID NO: 77634 - DNA, 357 bp, Glycine max
  Peptide Sequence Number=SeqID_194412
atggaccgtgcgcttctcctcgcttgcgtgatttgcgggatcctcttcttggtgttgggcttggcatcgttcttcattctttgggctgtgaattggaggccctggcgaatttatagttttaagattcagttgccatgctgcaatgttaatgctgttgatttttttttttttttgtggcgtatggtttttgttgctaaaattagtagttgttttaagataattgataatttgatatttactggcattggctgccgtgtactgtcgctgaatttcataactgattttcagttgccatgctttttcgttttttttgatggtctgctaagtatggcggttttgaaccgtgtgagccggtaa

SEQ ID NO: 77635 - DNA, 240 bp, Glycine max
  Peptide Sequence Number=SeqID_194413
atggccaaatatcttgcaaggtcctcaacttcatttgctctgtggtttcctgaatctttctgcatgggtagttgttatttctccaattctggtacttatcatttggggctcttggttgattgtaatattgggtcgagacctgattggtttggctgtaataatggctggcactgcccttctattggcattttattcaattatgctctggtggagaactcagtggcaaagctcaattattaa

SEQ ID NO: 77636 - DNA, 204 bp, Glycine max
  Peptide Sequence Number=SeqID_194414
atgccagagaaggttccatggaggagagaggtgttgacggaggatgcaatctcagtggtgagcatgaattggttgttcagaggtcatcttgggttcgagcaaagctctcaaagccatgataaagttttactgctgagctgtcttcggttatcaggatatcctgtaggaatgggtacaatcatattacagagagtgagagagtaa

SEQ ID NO: 77637 - DNA, 243 bp, Glycine max
  Peptide Sequence Number=SeqID_194415
atggatgctgatgaagtcatgagcattggggatgctagtgcttctatagatttagaggaattaggctctggttcaaaaataaggggacaatcttcaagttcaactagcgtacaatcccaaaggaggaagattggagaaaaagatggaatagttgctttgatgaaactagtggctgagtcttttgatcgattgacacaagcatatgataaaaaggttgaggaaaatgatattcaagaagtgtag

SEQ ID NO: 77638 - DNA, 153 bp, Glycine max
  Peptide Sequence Number=SeqID_194416
atggcgaaaatgagatggaggggagcggttgatggcgacgtcgattttgcaataggcgccgacggtgagggtgggggtgcaagtgcagtatccgttgcaaggcgggggcctcccggaagagagggagctccgagaaaggacgaccgacaataa

SEQ ID NO: 77639 - DNA, 687 bp, Glycine max
  Peptide Sequence Number=SeqID_194417
atgataaagggggagaatttgttgaatggggaatgcacgagaagcaagttatggctgatggacctagtaggcagtgagcgagtggcaaagacagaagtgcatggtgatggactaaaggagacacaaaatattaataggtctctctctgcacttggtgatgtcatatcagctcttgcaacaaaaagttcacacattcctttcaggaactccaagcttacacacttactacaagactcattaggaggagactcaaaggcactcatgtttgtacagatcagtcctaatgaaaattatttgagtgagacaatttgctctctgaactttgctagtagagtaagaggaatagaattgggaccagcaagaaagcagttagacactgttgaacttttgagacacaaacaaatggttgagaaagtcaaacaagaggtaaggctgaaagatttgcaaatcaagaagctggaggaaacaatccatggattggagtccaagatgaaggaaagagacagtaagaacaaaaatctccaagagaagattgcttttcttcgttattctcagcaatggaaaaagaaagcgatttttgtcttgaataaagttgacatatataagaataatcatgagggtcatgttcattactcaaggacaaatgtgcacttagtccttcaacaaccatccacaaggcttggatag

SEQ ID NO: 77640 - DNA, 1560 bp, Glycine max
  Peptide Sequence Number=SeqID_194418
atgaaaattaatggttccttgaagttcattcccttcattgatcccagcaacttgctatcctctgttaaatcaggattgtataccttcatggaaattgtagaatcgaacaaccctacaagtaaaattgtgatttttgacatccttccttataggagtagctacagcctatgggtactgattgcctttggagagactcttgttttagtgcatgcattcaataacatgatgtctgataaatatggatttattgcttggctactcagcacttgtgttggattgttgctctcctttttaagcaaatcatctgttctccttggtatatccttgactgtgccactattggtggcatgcctttctgttgccattcccatatggatttgtaatggttaccaattttgggttcctcgtgtgaattgtactgggagtgctggaaatgatcgaattcctcgaacaaaggagggtattgttcttcttatcagtatgtcagtatttgttggatctgtactggctttgggtgcaatagtttctgcgaagcctttagacgatttacgatacaagggatggaatggtgatccaaaaattttgggttccccttacacatcatctgtttttcttggctgggcaatggcatctgcaattggtttagttgttacgagcgtgcttccaataatttcatggtttgcaacatatcggttctccctttcctctgctatctttattggactttttgcagttattcttgtggcattttgcggggtgtcctatttagaagttatcaaaactagggacgaccaagttccaacaaacggtgatttcttagctgctttacttcctttagtctgcattccagcagtgctgtcgctttgctgtggattgcttaagtggaaggatgatgattggaaactttctcgtggtgtatatatttttgttataattggtcttttgcttctgcttggtgctatttcagctttgatagttgttgtcaagccttggactataggagtagcatttcttttggttcttctccttatggtattagcaattggtgccattcaccactgggcatcaaacaatttttatttgagccggacacagatggtctttgtttgcttccttgcttttctgttggctttggcagcatttcttgttggatggtttgaaggtaaaccatttgttggagcatcggttggttatttttcatttctttttcttcttgccggacgggcattgacagttctgctttcaaatcccattgttgtatattctcctcgagttttgccagtgtatgtgtatgatgctcatgcagattgtggaaagaatgtcagtgtggcctttctcatgctatatgggattgccctggcaaccgaaggctggggggttgttgcaagtttaaagatctatccaccctttgctggtgcagctgtatcagcaattaccctagttgtttcatttgggtttgctgtatctcgtccttgcctaactcttaagatgatggaagatgctgtgcatttcctgggtaaggaaactgttattcaagcaattgctagatcagcaacaaag

SEQ ID NO: 77641 - DNA, 1782 bp, Glycine max
  Peptide Sequence Number=SeqID_194419
atgatatatagccaggaagcagtgttgtacagattagacatgaaaagggctgttgcaatcctgcttcttttggctgttgctcttctttgtgcatatgaactctgtgcagtatatgttacaactggatcacgagcatctgaccgctattctccttctggtttcttttttggagtctctgcaattgctttagcaatcaacatgctatttatttgcagaatggtgtttaatgggaatggcttggatgtggatgaatacgtgcgaagggcatacaaatttgcttattctgattgtattgaagtaggtccagtagcatgtttaccagaacccccagaccctaatgagttgtatcctcgacaatctagaagggcttcccatcttgtactgctctatcttggctcactatgtgttctgttagtatactccatcttgtatggtctaacagcaaaggaggagaattggcttggagcaattacatcagttgctgttattattcttgactggaatttgggagcttgcctgtatggttttcaacttcttgatagtcgtgttgcagcactgtttattgctggaacatctcgtgtttttcttatctgttttggagtgcactactggtatttagggcactgtatcagctatgctgttatggcatctgtactgctaggagcggctgtttctcgccattggtcagccacaaacccattggctgcgaggagagatgccttacaaagcactgtagttcgtctgagagaaggattccgtagaaaggagcacaacagttcatctagcttttctgaaggttgtggctcaagtatgaaacgaagtagtagtgttgaagccggtaatcttggtaatgtcattgaagctggcagggctatggctgcaggtgatgggagcaattggaataatgtcctgtctcaaactactagtttgccggatggaatcaatagtgataaaagcatagatagtggaaggtcaagtttagcattacatagcagctcctgtcgctcagttgttcatgagccagaagttggaacatcatctgatgatagaaatttggatcacaataattctttggtggtttgttctagtagtggtcttgatagtcaagggaatgactctagtgcatcaaactctgcaaatcaacaaacactggatttgaatttggctcttgcgttccaggaaagtttgaatgaccctaggattgcaactatgctgaaaagtaggacaagacaaggtgatcgagaattgagtagtttattacaggacaaaggattggatccaaattttgctatgatgttaaaagagaaaagtttagaattagatccaactatactggcattgttgcaaaggagtagcatggatgcagatagagatcataatgaaaatactgataacaccagtgttgacaatgccatgcctaatcaaatttcattatctgaagaattgaggctacatgggcttgaaaagtggcttcagttgtgcagacttgtattgcatcacattacgggtactccagagcgagcatgggttctgtttagttttattttcatacttgaaaccatcattgttgccatattccgtccaaaaacgatcaaaattattaatgcaacacaccagcagtttgagtttggtttggcggtgctcctgttatctcctgtgatatgttcaattatggctttccttcgatcacttacagcagaagaaatgtcaatgacatcaaaaccaaggaaggaagtgcttctgttctttataaagtttttggttttgatgcgtctgttttag

SEQ ID NO: 77642 - DNA, 474 bp, Glycine max
  Peptide Sequence Number=SeqID_194420
atggccttagattttgaatctatgaaagatggtgatttaactataatgtcaaatggagctcctaagaagactttcaagtttgatgttgtctttggtccccaagctgagcaagctgatatttttaaagacacaacaccatttgcaacctcggttctagaagggttcaatgtatgtatttttgcatatggtcagactgggacaggaaaaactttcacaatagagggcacaaaagaggctcagggtgttaatttcaggactcttgagaaaatgtttgacataatcaaggagaggcataagctctactgttataatatttctgaaatcatccaggaacaactgcaaaaagggttggttgaggcacatgtgaacaatatgactgaagtttgggaagtcctacaaaccggtagcaatgcgagggcagtaagctcaaccaattccaatgagcatagcatccgatctcagtggtcagcttaa

SEQ ID NO: 77643 - DNA, 972 bp, Glycine max
  Peptide Sequence Number=SeqID_194421
atggcgttgaattttgttttcatctgttggttcctcattaattttcttgtcactggggtcctccattattgtatggtgatgtatttctctttcaatattggcatcctctctgtctttggtcacttggaagacaattatagagaccagcttaaggaaaactactgcatagtggagaaagggtacaattctttccctaacaggattcccggaactgtatactccaaagcactcttggcaaggaggagaatcagggagattataagtgagatcatttgtaaaagaaaggagcagagattgatggagatggatctattaggccacttgctgaactacaaggatgaaaaagaacaaacgctaagtgatgaccaaattgctgataatgtaattggggtactatttgcagctcaggatactacagcaagtgttctaacctggattctcaagtatcttcatgatgaccagaaacttcttgaagcaataaaagcagaccaaatggcagtatatgaagctaatgaaggagggaaaaagccattgacatggggtcagaccagaaatatgccaactactcatagggtgattttggaaagccttagaatgtcaagtatcatatcatttacttttagggaagctgtggttgatgtagtatacaaaggatatcttataccgaagggttggaaagtcatgccactgttcaggaacatccatcataatccagaatttcacccttctcctcacaattttgacccatcaaggtttgaggttgctccaaagcccaatacttttacaccatttggcaacggagtgcactcttgtccaggaaatgagcttgccaaactgaacatgttcattttaattcatcatctagtaaccaaatataggtgggaagtagtgggatatcagaacggaatccaacatagcccattcccagtccctctgcatggtctacctacaagattttggagaaacgaatag

SEQ ID NO: 77644 - DNA, 831 bp, Glycine max
  Peptide Sequence Number=SeqID_194422
atggcattctatatggcggaattttggccttccaccatattccaccatccaccattgataactttggtcattgttgctgttattaggttggccattaggattttgacgaagggtagagctcctttacatattactaaggaaatgcaagtaaagattggaaaatgctcagaatcaatgtggaagctaacatattatgctacagttgaagcattcattcttaaaattacctaccaagaaccctggttcagtaacacgaaattatacttcaatgactggccaaatcatgagttgaagagtcccctagtgttgtactacatgtgccagtgtgggttctacatatatagcattgctgctattcttacatgggagactcgaaggaaggattttgcagtgatgtttactcaccatgtaattactgttttactgattgggatttcatatctaacaagtttttttagggttggctccataattctcgcccttcatgatgcaagtgacgtattcatggaagctgccaaggttttcaagtattctggaagggagtttggtgcaagtgtgtgttttggattctttgcagtttcgtggctcatactgcggctaattttctttcctttttgggttattaaagcaacaagcattgatcttcagcaggtcttaaacctgtcagagggctttcatatgtttctttactatgtttttaatacaatgctcataatgctgctcatcttccatatatactggtggaagctcatttgtgcgatgatcttgaggcaacttaaaaataggggaaaagttggcgaggatataagatcagattctgacgatgattga

SEQ ID NO: 77645 - DNA, 3171 bp, Glycine max
  Peptide Sequence Number=SeqID_194423
accagaaatgcattatctggaacctactcagcaccacagaggtcagctagttctgctgcacttttgattggagaccctaccattatgcgtgatagggcaggaaattttgtgcttccgagagctgatgtgatgaaattaagagaccgcttgagaaatgaagaattagttgcaggttcattctttagtagattaagatatcataggacatttcgccatgagccaaccagcgatgtagatcatagaagagtaatgtgtgctcatgctcgaattctggcactagaagaggccattgatactgagtgggtgtacatgtgggacaagtttggtggttatttgcttttgttgcttggtttgacatcaaaggcagaacgagcacaggatgaggttcgtttgagactctttcttgatagcattggattttctgatttaagtgctaagaaaataaagaagtggatgccagaagatcgcaggcaatttgaaatcattcaggagagttacataagagaaaaggagatggaagaggaagtcttcatgcagaggcgtgaagaggagggcagagggaaagaaaggaggaaggccctacttgaaaaagaggaacgtaaatggaaggagatagaagcttctctgctctcctccattcctaatgctagcagcagagaggctgctgccatggcagcagctgtacgtgcagttggaggtgattctgttctagatgattcctttgctcgagagagggtttcaagcattgcacgtaggattcgtgcttcacagttatctcggcgtgcacttcagacaggagtggcaggtgccatatgtgttcttgatgatgagccaacagccagtggcaggcattgtggtcccattgattccagtctatgtcaaagtcaaaaagttagcttctccattgcattgatgattcaacctgaatctggtcctgtttgtcttttgggcactgagtttcagaagaagatttgctgggaaattcttgtggctggatctgaacaaggtattgaggctggacaagttgggcttagattgattactaaaggtgataggcaaacaacggttgcaaaggagtggagtattagtgcaacaagtattgcagacggaaggtggcatattgtaacaatgtcaattgatgctgatttaggtgaagcaacatgttatttggatggtggatttgatggctatcagaatggattaccattgtgtgtgggtagcagcatttgggagcaggggacagaagtgtgggttggtgttagaccaccaacagatattgatgcatttggtcggtcagatagtgaaggggttgaatctaagatgcatattatggatgcttttctttggggaaggtgcttaactgatgatgaggtttcttctctctatacctcaatggcttcggcagacttcggtgcacttgatttccctgaagataattggcagtgggctgattcaccttcgagggttgatggttgggacagtgatcctgctgatgtagatttatacgacagagatgatgtagattgggatggacagtattctagtgggaggaaaagaaggtcagaacgtgatggcatggtggtggatattgattccttttcaaggaagtatagaaaacctagaatagaaactcaagaagagattaatcaacggatgttatctgtagaattagccatcaaagaagctctctacgccagaggagagacacgctttactgatcaggaatttcctcccaatgatcactcattgtttgtggatcctgcaaacccccctgcaaagttacaggttgtttctgagtggttgaggccaggtgagattggcagacagaaccatcttgactgtcgtccgtgcttattttcaggagctccaaacccttcagatgtttgtcagggccgtttaggtgattgttggttcttgagtgctgttgctgttctagcagaggtttcacgtatatcagaggtaatcatcactccagattacaacgaggagggaatttatacagttcgcttttgtgttcagggcgagtggatccctgttgttgttgatgattggattccttgtgaattaccgggcaaacctgcatttgctactagtaagaaggcctatgaactctgggtctctatattggagaaggcatatgccaagttgcatggctcttatgaagcactagaaggtgggcttgttcaggatgctctggtggatcttacggggggtgctggggaggaaattgacatgaggagtggtgaagcccaaattgaccttgcaagtggtagattgtggtctcaactgttacgcttcaagcaagaaggttttctcctaggtgcaggaagtccttcaggttctgatgtgcacatctcttctagtggcattgtgcaaggacatgcatactcaatactgcaggtaagagatgtggatggtcataaacttgttcagatccgaaatccatgggccaatgaagtggagtggaatggtccatggtctgactcatcgcctgagtggacagataggataaagcacaagctgaagcatgttccgcagtccaaagatggcatattctggatgtcctggcaagattttcagattcattttcgatcaatatatatttgccgtatctacccatcagagatgcgtcattctgttcatggtcaatggcgtggttacagtgccggggggtgtcaggattatgatacatggaatcaaaatccacagttcagactgactgcaactgggcaagatgcatcatttcctattcatgtattcattaccttgactcagggtgtgggattttcaagaacaacagctggttttagaaattatcaatccagccatgattcacagatgttctacattggaatgaggatactcaaaactcgtggcagacgtgctgctttcaatatctacctacatgaatcagttggtgggacagactatgttaattctcgagaaatatcctgtgaaatggttttggaacctgagccaaagggatatactatagttcctactactatacaccccgggatagcttacatgtatcttgtcctcttgataagtttctctgcttgggttctcggtggatcatgtacttgcactgctggagccctgcttagaacaattggcattgagatactattcctgggagaaatgatggcatctgttcgagagatggatgag

SEQ ID NO: 77646 - DNA, 605 bp, Glycine max
  Peptide Sequence Number=SeqID_194424
atggggaagaacaagggtcgtcaatcgcactcagctgcaaagcaaattatggtgaagggtactacctcaggttcaggtaaatcccaaacatctgctacttctggtctggctggttgcttggatgttgtccaagcaaatcagaatgcttatactgcttcacaggataatcttgtaggcaaggtgctcgtaaaaaaggcagggacaagttctgcaaaaactgatgatgtcacacaccaagtgtttgataatttgtcggaatgcagtgctgaatctgaatcttccccagaggtttcttgcaccttaggggacaatgattcaaccactgatgatgattcatctcactcttgtggctctaagtcatcattacagctagacgacaataaggctcccactccttgggtcaatctattcaaagataatagaagcccttccaaaggttttggaatgaagttctcccctccaccctctgatgataaagtgttgttggaagaaattgatttgcaacccctggaagaggcttggggacatagccttattggctatgtggctggtcgattcccacgaaagaaagctctgttggattgttggccaaaatggggagtcaa

SEQ ID NO: 77647 - DNA, 312 bp, Glycine max
  Peptide Sequence Number=SeqID_194425
atggtggttgctgctggggcggacggcgcaggagccgtggcgggggagggagcgggtccaaggtggcgagcaacatgtgcctcaagtgtgccaacacctaacgccccattaggtacgcaatggaatgtactcggagcaatacttgatatgggtgacttattaggtgttgatttgcgtgaccaattttttgctgaggctgatgaagtagaagcggggagacatcggggaataagaaatcatgatcgccaagcgggaagatgggatcgaccatatggcatatcctcacgtcatcacggatatcataatgattga

SEQ ID NO: 77648 - DNA, 370 bp, Glycine max
  Peptide Sequence Number=SeqID_194426
atggaagcgaagtttaagaggctaaaaagagactttgacagtcagagaaagaagctgacggaaacaaggagggagttgggggagatcaagagagagaatcaacagaagagtagagaatgccaagaagcttggaactccttgaaagagcttcaaaatgagctaatgtgcaagtccatgcatgtaggatctttggcatttgccattgaggggcaagtgaaggacaaaagtaagtggttttcatcactaagaaacttcacgaggaaattgaagattatgaaaatggaacacatcaagctattagaggaagcagaggcaagcaaaaaatatcaagcagatatgagagaaatggggcttattattaagtccaaaa

SEQ ID NO: 77649 - DNA, 477 bp, Glycine max
  Peptide Sequence Number=SeqID_194427
atgaaatttccgctttggacgccgagaacacggctggttcgaggttgttggagcttaggaagaagcaatttgcgctgttgtgacatgtttgcaaaaggttttaagtgggaaaggctgcttattcttactgctcaagttggatgcgttttaggaaagggtggtagtgtgataaagagaatgacagctgagagtggtgcacagattcggatccttcctaaagacaaggttccagttgttttctgttctgccttttttgccgagaggggtttcacagagaagttgatagcagatataaatacagcagctactaacaatggttatgatgattctattctgaaaccctttcaggaggccaaaggagtttgtacaaagaaaaacaccaagcttgctgcctcaagtgtttccactgacgtttcatcctcacatgacgatgttggaccaaagttagctaaagaattatccaataaagatggttga

SEQ ID NO: 77650 - DNA, 1122 bp, Glycine max
  Peptide Sequence Number=SeqID_194428
atgggcagggatcagaaaagtgtggtagctatggttggccaggagagaaaaacaaacaagaaaaatgggtctcttgggtttaggtccattttcatgcatgccgatggcaaagatttgtttcttatggttttaggtactattggggcagttggggaaggcttggccactcctctagtgttgtatatcagtagccgcatgatgaataacattggaatttcctctaacatggatggaaacactttcatccataacatcaataagaatgcagtggcttggttatatttggctggtgcctcttttggggtttgcttcctcgagggttattgttggacaagaacaagcgaaagacaagcggcgagaatgagatgcagcacctcagagatcatcactagcgtctccagcgacagcctcgtaattcaagatgttcttagtgaaaagaagaaagaaaatagcaagagaaggaaggatgatcataatttaactaagaaaactaaagataaaaagttgtgtctaaaaacctctgtccaagttatctatgtgcctgctgatgacttgacagtacgtctgtatgtgattagaaaacttaattggttactttctatgattcacattgaatgtatatatgactgttggggtaagcaggatgccattgaacttagaaaacttgacttatgtatgcattttacttcctggtggtgggggctgctatatgggcttcttcatgggcagtatgcattttatctagaggctgtattgaaccaggacattcaattcttcgacaccgaggttcggacatccgacatagtttttgtcatcaacaccgatgctatcatggtccaggatgccattagtgagaagttggggaatttcattcactacatggccacctttgtttctggctttgttgtgggtttcactgctgtgtggcaattggctttggtgactcttgctgttgtccctatgatagctgtgattggaggcattcacactgtcaccttggctaagctctctggcaagagccaggaagctctttctcaagctggcaacattgtggaacaggggagacttcagagtatattaaagttaagaaactttgttaattgcaacttcagagtatattaa

SEQ ID NO: 77651 - DNA, 1434 bp, Glycine max
  Peptide Sequence Number=SeqID_194429
atggaagagagagtgagtggatgtagccacgtcttaatggttccatacccaagtcagggtcacataaacccaatgctccaattcagcaagcgcttgagcaccaaaggagtgagagtcactatggtcacaaccattttcatttccaagtccatgcatcttcaatcttcttccttgttaggaaatgttcaacttgatttcatatcagatggctgtgatcaaggtggttttggtcaagctggtagtgtgtcaacctatttatctcgcatgcaagaaataggttccaataacttgagggaactcataaaaaaatacaactcttcagatcaccctattgattgtgtggtatatgaccctttggttatatgggtattggatgtagccaaagaatttgggttatttggagctgcttttttcactcaaatgtgtgcagtcaattacatatattatcatgtctaccatggacttcttaaggtccccatttcatcacctccaatctctattcaagggcttcctttgcttgatctaagagacacaccagcctttgtttatgatcctggattctatccagcttactttgacttggtcatgaatcaattttctaacatccacaaagcagatatcattcttgtcaattccttctacaagctggaggagcagctagggcttgttggccaacatcaccatgactatttcttctggccggcgctggtggtggattccatgtcaaagctatgtccaatattgatgattgggccaacagttccatcctttcacttggacaaggcagtcccaaatgacacagacaatgttttgaatctctttcaagtagattcatcagccattagttggctgagacaaaagcctgcagggtcagttatttacatatcatttggcagcatggtgtgcttcagctcacagcagatggaggaaatagcattgggcctaatggcaactggcttcaacttcttgtgggtcatccctgatttggaaagaaagaatctcccaaaagagttgggggaggaaattaatgcatgtggaaggggtttgatagttaattggaccccacaattggaagtgctatcaaatcatgctgtcggttgttttttcacacactgtggatggaattcaacacttgaagcattgtgcttaggggtgccaatggttgcactgccacagtggactgaccagcccacaaatgcaaaatttgttgaggatgtatggaaagtgggaatcagagtcaaagagaatgagaatgggattgtaacaagagaagaggttgagaattgcatcagggtagtaatggaaaaggacctaggaagagaaatgagaattaatgctaagaaatggaaggaattggctatagaagcagtgagtcagggtggtacttcagacaacaacatcaatgaatttataaataatctgaaaagatcctaa

SEQ ID NO: 77652 - DNA, 2340 bp, Glycine max
  Peptide Sequence Number=SeqID_194430
atggtgatctgttataaacagctgggagaatatcatttctttcttgttttgcttctcatttcagtccaatgcgttattgccgcaaataacattttgaagcccggagatacactgaatacgagaagccagctatgttcagaaaacaacatatactgcatggatttttccccattaaacacaaatcctattgtaaactacactcacttaagcatcagtgacaacagaaaggacgataattccgcagtgtgggttgctaatagaaatcaacccgttgacaagcattctgcagttctgatgctaaaccactctggtgtactcaaaattgaatcatccaaagatgccaaacccatcatccttttttcttcacctcaaccactgaacaacaacaacaccgaagccaagctgttggatacaggtaactttgtggtgcaacaacttcaccccaatggaacaaacactgtgttgtggcaaagttttgattaccctactgatactcttctccctgggatgaagttaggagttaatcacaaaactggtcataactggtcacttgtttcgtggttggctgtatccgaccccagaatcggggcattcaggttcgagtgggaacccataagaagagaattgatcatcaaggaacgaggaagattgtcctggacaagtggagaactcagaaacaacaatggatccattcacaacaccaagtacacgattgtctcaaacgacgacgaaagctacttcacaattacaacaacaagttcaaatgaacaagagcttataatgtgggaagtattggaaactgggcggttgatagataggaataaagaagctattgcaagggctgatatgtgttatggttacaacacagatggagggtgccaaaagtgggaggagatacccacatgtaggcatagcggtgatgcatttgaaaccagggaagtttacgtcagtatgaacatgctaaacaatctaggtaattcgagttatggcccaagtgattgccgggatatttgctgggaaaattgtgcttgtaatggatacagaaattactatgatggtggaactggttgtactttcttgcattggaattcaaccgaagaagctaattttgcaagtgggggcgaaacgtttcatatattggtcaacaacacccaccacaaaggtacaaaaaagtggatatggataactgtagcagtagttgttccatttgtgatatgtgctttcattctatttctggccttgaagaaaagaaaacatctgtttgaagagaagaaaagaaatagaatggagactgggatgttggattcggcaattaaagatcttgaagatgagttcaagaagagacaaaatctaaaagtatttaagtatacttcagtactgtcggcaaccaatgatttttcaccagaaaacaagttaggacaaggaggctttggaccagtttataagggaatcctaccaactgggcaagaagctgctattaaaagactttcaaaaacatctagacaaggggttgtggaattcaaaaatgagctaatgctcatatgtgaacttcaacacatgaatcttgtacaactacttggatgctgcattcatgaagaagagaggattctaatttatgagtatatgccaaacaaaagcttggatttctatctattcgaagattgcactcgaagcaagttactagattggaagaagcgtttcaacataatagaaggaatttctcaaggattactctatcttcacaagtactcgagactcaaagtcattcacagagacttaaaagctagtaacatacttcttgatgagaatatgaatccaaaaatttctgattttggattggcaagaatgtttgaggaacaagaatctacaacaactacgagtaggatcattgggacatatggttatatgtctcctgagtatgctatggaaggaattgtttctgtaaagtctgatgtttatagctttggagtgttggtccttgaaattattagtgggagaagaaatactagcttcaatgacgaccgcccgatgaatttgataggacatgcatgggagttatggaatcaaggtgtgcctctacaattaatggatccatcgcttaatgatttgtttgatctcaatgaagtgacaagatgcattcacattggtctcatatgcgtagaaaaatatgcaaatgatcgacccacaatgtctcaaataatttcaatgttaacaaatgaaagtgtagtagttcccttgcctcgaaaaccagcattctatgtggaaagagaaattttactcagaaaagcatcttccaaagagttatgtacaaactctactgatgaaattactattacctag

SEQ ID NO: 77653 - DNA, 2262 bp, Glycine max
  Peptide Sequence Number=SeqID_194431
atggcatcgcgagcaattttgagaaggaggagaagtttaatccatcaatacttgaataactgttttgcttcttcttcgccgtctcccagtaatcgctctctggaattcgctatagctacgacgtcacctttgtttccttgtaagcatggaacgacgccgtacagagacggtttgttccatcgtttcggattgggacaacttgttcctagattcggaagcgccgttccgctggacggtttttcgggattgaacgcgccgataggtgttcggtggttgtcgcagtcggcggcggcagcggcgaaacgtcatgaaccggacgagaacgatgagacggtggcgaagaagcggaaagaagcgtcgcctgaggagtgcgatcaagccgtcgaaggcttgaccactgcgaaggccaaagccatggcgaaacgggcgcaagaggagtcgcagaaagacgtgcagagcgtgttgcggagagtgtggactgcgtttttgggaattggtcctgcgttgagagctgtcgcgtctatgagtagaaattgtggtgttgtggctgcaattgctatttgctgttgcagattgaaatatgaaacagtgaaatgtttgttcgttggtgatttggcatttagggaggactgggcgaaaaaactggttcactggaaaggggaatttgtgtcgacgttgcagcattattggttgggttctaagctgctgtgggctgatgtgaggatcagttccaggttgttgttgaagcttgcgggtgggaggagtctctccagaagggagaggcagcaactgacgcggactactgccgatatctttaggctagttccttttgctgttttcattattgttccctttatggagttactcctgcccgtgtttctaaagttattccctaacatgttgccgtcaacatttcaagataagatgaaagaacaggaagcattgaaaaggagactaaaggcaagaatagagtatgcaaggttccttcaggatacagtcaaagaaatggcaaaagaagttcagaactcccgcagtggagaactaaagaaaacagccgaagatcttgatgaatttttaaacacaattagaagaggtgcaactgtctctaatgaggaaattttgggctttgctaagttgtttaacgatgaacttactctagataatataagcaggccacgattagtcaatatgtgcaagtacatgggaatcagcccttttggcactgatgcatacttgcgttatatgctaagaaaacatttacggaggattaaggaagatgataaattgattcaagcagaaggtgtggattctctttcagaagatgaacttcaggaagattgcagagagcgaggcatgcttggaatgctttctgttgaagaaatgcgccaacagcttcgagattggttggacttatctctgaatcactctgttccatcatctcttttgatactttcaaggtcatttactgtgtctgggagattgaaaccagaagaagctgtgcaggctacactttcttctctccctgatgaggttgtagatactatacaggttacatctttaccctctgaggattctgtctcagagaggaggaggaaattggagttccttgaaatgcaagaagaacttattaaggaggaggaagagagagaggaggtggtgcaaaggatggagagtagttctagtcaagatgataaggccctgaaagagatgaatgtttcaacggcaaaagaagctcaccaacttgccagagacagagcatttgaaaacaaagaacaactgtgtgaacttagtcgtgcattagctgttttagcttctgcatcgatagaactctataacagcatggtagaggaagagggcccaaatggtaaaaaagatgcctttaaggcatataaagctgcccgagaggaacatgaacacactaatgagttggatgaaggggataaggtgtcatcagcactcattgggagagttgatgctatgcttcaaaatcttgagaaggaaatagatgacgtcgatgcaaaaattggtgaccgttggaggctgctggacagagattatgatgggaaagtaactcctgaggaggtagcctctgctgcaatgtacttaaaggatacattgggcaaagagggtatccaagaacttgtcagcagtctttccaaagatagagatgggaaaatacttgttgaagacattgttaagttgggcagttggagggaagatggtaatgctcatgaagatgatgagaccagggagaggctatga

SEQ ID NO: 77654 - DNA, 840 bp, Glycine max
  Peptide Sequence Number=SeqID_194432
atggtgacaaggaagaagaagcatgataggacgaaagcacgacttacgctcacagacacactcacactcacactcccggtgccgccgccgccaccaccaccaccattgctttcactctccgaatggcaaccattctatctccaatccaaaccctcaaattccgttctcccaatcccaaacctctcttctctcccaaaccgcctcccatctccacacctctcaccttccgcgccgataaactcactctcttcgtctcctccgccacctcctccgccaccgtctccaccaacggccctccctctcctccctcccctgctcgctcaaagcacgtcttcctattctgttccctttcactcagtcctctgcgtccgggttcggcgacacacgatttccgtgttcgtcggcgatgagagcggaatgataaaccggattgctggcgtgttcgcgaggagaggatacaacatcgagtcgctcgccgttggcctcaatgaggacagggcgctcttcaccatcgtcgtgtcagggactgataaggtgctgcgccaagtcatggagcagcttcagaagctcgtcaatgtcttaaaggtagaggatctttcgagggaaccgcaggtggaacgtgaactgatgctcataaaagtgcatgcggatccgaagcaccatgcggagttgaagtggttggtggacatcttcagagctaagattgtggatatctcgcaacattcggtgacaattgaggtcactggagatccagggaagatggctgcggttcaaagaaatttcagcaagtttggaattaaagagatagccagaactggaaaggttggaaagttcaattga

SEQ ID NO: 77655 - DNA, 201 bp, Glycine max
  Peptide Sequence Number=SeqID_194433
atggcgcgtgacacgttcaacgacgttggccgtgggtgcccgtctttgttggtaacgcgcaggaatcaaatgctgaatgctattaaaggcttctcaagatcacctcaaaatggattgttcataaattcatgttttgctcactgccaatctgagaggcaggatacatggtttgctgacaattctcctgtcattgggaacaag

SEQ ID NO: 77656 - DNA, 252 bp, Glycine max
  Peptide Sequence Number=SeqID_194434
atggtttcattccgcacaaaggttttccaccctaacatcaacagtaatggaagtatctgccttgacatcctaaaagagcaatggagtgctgctctgacaatatccaaggttcttctgtctatatgctctctattgacagaccctaacccagatgatcctctggtgcctgagattgctcaaatgtacaagactaacagagccaagtatgaggccactgctcgatcatggactgagaaatatgccatgggataa

SEQ ID NO: 77657 - DNA, 336 bp, Glycine max
  Peptide Sequence Number=SeqID_194435
atggtttttgttaacaggaatgtagtttttggagaaaatgaattggaaactctatactcagactgcgtcatggtaatccatgatgtgtactatcccctaattgaaaaaggggaaccatcaacctttcaaaaggcaatgaatagttcagttgcttcgctatggatgatagcaatgcctgaagaaatggaagtctttcataggaacaagacttgggaacttgttgaatttccaaaaggtcgaaaagccatagggtgcaaatgggtctataagatcaacgatgacaacaatcaagtagaaaaatatcatgctagattggtggtcaagggttatgcttag

SEQ ID NO: 77658 - DNA, 138 bp, Glycine max
  Peptide Sequence Number=SeqID_194436
atgatattagatcccaacagacagctttttcagacgatgggtatagccagagctactggtgagatcaaggatatagccagtgctactggcgagatcaaagatatagccagtggtgctgacaagatcatgcagctttaa

SEQ ID NO: 77659 - DNA, 570 bp, Glycine max
  Peptide Sequence Number=SeqID_194437
atgggtagagggagagttgagctgaagaggatagagaacaaaatcaaccgccaagtaactttctcaaaaagaaggaacggtttgctcaagaaagcctatgagctctcagttctctgtgatgctgaggttgctctcatcattttctcaagccgtggcaagctctatgaatttggaagtgttgggactaccaaaactattgagcgataccatcgtagctcttttactcctcaagacgaacacgttgaatgtgaaactcagagctggtaccaagaggtatcaaagctaaaggcaaagtatgattctcttcaaaggacccagaggcatttgcttggggaagatcttggaccattgaacataaaggagctgcagaatcttgagaaacagcttgaaggggctttagcacaagcaaggcaaaggaagcttgaagcagagggatttaatcttaaagctatggaaagcttgttgagctctacttcagaagctggaaatagtggctttcactttcagcagcctcctcaaaccaatcctatggattaccagcaggcagaaccctttttgcaaatagggtaa

SEQ ID NO: 77660 - DNA, 1050 bp, Glycine max
  Peptide Sequence Number=SeqID_194438
atggatagcttgaatttagttcagactctcattaatggaggtgtttgtgttcctggccatcgtcaagcttctttgattgtcaaaaccgtgtctgttggtaacccacctttctttcttgggaacttacctggtgcattagttcatggtctacagtcattcttccagtcagcggtactatacaagcgaaagaataaggaagagaggctggaaaactccaagcaagtagaggctttaacgatgacgagaggcaaatcaacaaaatgtggctctagtgggagtcaaaaccatggtagatcaaagtctcaaagaaggaagaacctcaaatgctataattatggcatgaaaagacacttaaagaaggattgttggcataagaagagtggaggagagaactctggagtatcaacctctcaaggttgtgttgctattacctcagataatgcagatgtcttgtgtaatgaagtagcaattggttctagaggtggaagacaactccatgattgttggatattggatttagtattgccaaatttaaaatgtataatggtactgtatgcacaattcaaggggtggaatcttgaaagtagtgaagagggaaatcttgtaatgatgaaagttgagaagatcatagctaatctatacatgcttttgggagatacgttgcaagaagcagatgcatcagttataacaagtcaagaagaagcaacgatgatgtggcattgtagactgggtcacattaagcagcatcggttgaagtttgccaaagcaactgccaaaagcaaaaagatactagacttgatccattttgatgtgtgggaattgcccaaagtatccctaggaagagcaaaaatcaagtgcttgagaacaaataatggaggagaatatgtagatgacaattttttgatattctacaagcaagacgatattgtgagacaattctctgttctacatacacctcaacagaatggtgtggtagagcagatgaacatgactctcatggataaaacaagagttatgctgagaacaatagaattgcccaaatctttctag

SEQ ID NO: 77661 - DNA, 198 bp, Glycine max
  Peptide Sequence Number=SeqID_194439
atggtgaagaagcaaacatcccctactagcggatcaatgagggtcgccaaagagcgaatgagggatttgatgagatgcgtgtctttgaagtcggggaagagtgtgcgagaaataagggtgttagggtttgaatgtgagttgcggtttgggtcatgtgtgaatagaggtaggaagttggtggaaattgttggggtttaa

SEQ ID NO: 77662 - DNA, 569 bp, Glycine max
  Peptide Sequence Number=SeqID_194440
ttctaaacattgttacaggagtttttgctagaagaggctataacattcagagtttagctgtaggacatgcagaagttgaaggactttctcgacttacgactgtggttcctgggacagatgagtcaattagcaagttggtgcagcaactctataagctagtagagctacatgaggttcgtgatatcacccacttgccatttgctgagcgagaattgatgctaataaagattgctgtaaatgctgctgcacggcgtgatgtccttgatattgctagcattttccgggctaaagccgttgatgtatctggtcacacaataactctggagcttactggagatttggacaagatggttgcattgcagagattgttagaaccatatggcatttgtgagcctgtgctggatcaacagtttagtgctgatccggccagttatcaccagttcaaggcttctgcagttctaaacatgttatcggacaactggctggtggcacgaactgggcgaattgctctagtccgtgagtcaggtgtggactccaagtacttgcgtggatactcttatcctttgtaa

SEQ ID NO: 77663 - DNA, 174 bp, Glycine max
  Peptide Sequence Number=SeqID_194441
atggcaacgacaacaaaaatgatgatgaaggtagggagtggtgatggtggtgccaatagtagcagtggaataatggtggtggcggaaaaggcaaggtgcgcttgcagtaggggtggaatggtgaaggcgataatggtggtggttgtgatggagcgatggcggtggaggcgatag

SEQ ID NO: 77664 - DNA, 267 bp, Glycine max
  Peptide Sequence Number=SeqID_194442
ttatatgcagagtctcttgcacgctttcaaggagggtcaccttacatatatcctttgtatggtttaggagagcttccccaggcatttgcacggcttagtgctgtttatggtgggacatatatgttgaataagcctgagtgcaaggtagaatttgatgaggaaggaaaggttgttggtgtcacatctgaaggggaaactgcaaagtgcaaaaaagttgtttgtgatccatcatatttgcccggcaaggtattagaaaccaacctctag

SEQ ID NO: 77665 - DNA, 222 bp, Glycine max
  Peptide Sequence Number=SeqID_194443
atggaatacaaatattatcaaatggcaacttttcacgttggtggcagttcaagtggcatttcatggtgctttgaggataagccaatcataagggacaatgttgaagagtttagtgacaacgaccaagaggatgcagtccctgatgaggtagatacagaaaaagacacaaaagatgttaacatgtcttcattttttcacaactttaacagacaatcatcataa

SEQ ID NO: 77666 - DNA, 264 bp, Glycine max
  Peptide Sequence Number=SeqID_194444
atgtttgctacctattccacaacaccaccgtctgcatacaatccaacatcattaatggattgttatcatcccacattacctactcagatgaggaacactaatgattataaagacgatggagatgaagataataacaacaatgatggtagtagtcttagggccagtaatgacggtgatgatactacaacaaagggagcccaaccaactcaacgtggtcatagaccaagagaacaacaagcagaaccaactcaacaacaacaataa

SEQ ID NO: 77667 - DNA, 600 bp, Glycine max
  Peptide Sequence Number=SeqID_194445
atgaccttggaagacgttgtcgtgcaacttggcctccccattgatggagaagtcattacaagcattagcagtggtgatttggttgcttggtgtgaacctttattgggttatcttcctcccacaggttgtgcatcgggaaatatgatcaagttatcatggctaaacaatgaattccaacaacttcctaatgatgtagacaaagttgcttttgcacaacatacacaagctcatattttatcactcataggaggtttattgatgcagaatacaataagctcttgggttcatttgatgtatttattgttgttgttggacttacatagtgtgcagtttttatggactccttatagcaaagttgaactaagttgtttaataaatgttaaggtttctcccataacttgtgcttttgtacctctcatatgtttcactattgtggaattgcatcaagcaaaccgggtcatgagacaatttggctttcgtcaacatattccacttgacccattaaatactgatatactccacaaagaagacatgagaggaagaatcaatagatattggccccaatatatatcaccaagaatggattgctacatggaatga

SEQ ID NO: 77668 - DNA, 751 bp, Glycine max
  Peptide Sequence Number=SeqID_194446
tgcggggattagtagttctgtaccattccgtgatgatcaaacggatggcacccgaacatggagatacactgttaatgtgaatttcactgctgttattgattccactcgccttgcgattaaaatcatggaagcttccaaaaggcctggtgtgattatcaacttgggttctgcttctggtctttatccaatggtggctgacccaatttacagtggctctaaaggtggtgttgttatgttttctagatcacttcgtctatacaaacgtcaaggaattcgagtcaatgtgctttgccctgagtactataatgccaaaagtttggtgcagtttgttgaaactgagatgggaaataagattgatcccaagatcatcaatttgagtgggggctttgtacctatggaaatggtggtgaaaggccgctattttggtggcaacaacaatgatgttgtttctcgtcttccatttgatgcaggatttgaggctgtagggataattgcagcagttggggattctgtcactgacttgaaagttggtatgccttgtgcattcatgacttttggaggctacgctgaattcttaatgattccttcaaaacatgctcttccggtgcctagaccagatcctgaagttgttgccatgcttacatcgggattgactgcctcaattgctctagaaaaggcaggacagatggaatctggaaaagtggtccttgttactgctgcggcaggaggaacggggcaatttgctgttcag

SEQ ID NO: 77669 - DNA, 336 bp, Glycine max
  Peptide Sequence Number=SeqID_194447
atgcctaggcaagcgcagggtgatgcacatcaggccgcagacgcaccgccaccacctcggcaggccgatcccgctggatcactaggcatggagcattatctacaacacttggtttgccagcaggcggccaatcaccgtgggcaggggcagggttccgctccttttgcatgccctacttcggagcagtttggggctgaggtcgcatggtccggagactggcctgaggcccgggcaggggaggagcctgcaggatcccccggtgaggcagaggaggcccgtatggatgaagatatgactgactttctcggtttcttgggaggaagcggagccatgtga

SEQ ID NO: 77670 - DNA, 171 bp, Glycine max
  Peptide Sequence Number=SeqID_194448
cgtgttagctgctcaacagtgagtgactcttctttcttgggagatcccattgttcctttctccgagggcaaggatgaaaattcacatcctgggtcaaggtttatgcaactcagggataaggggaatgtcccacattatttccatgacacgcatgcaacaatgatgatttag

SEQ ID NO: 77671 - DNA, 258 bp, Glycine max
  Peptide Sequence Number=SeqID_194449
atgggtagttgtggaagagaaggtgtagtgaggcagtatataagatcaaaggttcctcgtttaagatggacccctgagcttcatcgttgctttgtttatgccattgaaacccttggaggtcatcacaaggctactcctaagcttgttcttcaactgatggatgttaaagggctcacaatttcacacgtcaagagccatctgcagatgtacagaagcatgaaaggtgactcgtgcagacaaggtaccgaacgttgttaa

SEQ ID NO: 77672 - DNA, 648 bp, Glycine max
  Peptide Sequence Number=SeqID_194450
atggataggacttctacccaacataggaaacaatcttttcagaagcatgatgaagcgagtgatgttggttttcactcttgcttcaaattcattagaaaagaatctgattccctctccggctacagtaatttctcctcaaaaagaactagaatcgagaagacaagtttactctcaggaatcctacaatgcagccaaagaatatgtgaagcagatccaaatccatacactactttttatgattacctgcagagcatggctaaggagaagggaataaagaagatttgtgttggttcaatatggcagcagactcaacccctttccacaacctttcatatgctaacaaagcaagaatcagatttgctccaggttgccaaattaaatgataagcagcctttgaatgaagtagggaacacttggagaaaaggactaggagcagagaatgaagacataggaggttgtgaattgtcattgtcaatcacattgccacaaccccatccttcctcacagaaaagtaatacttcttcagtcagtgagaccagtgaggcattttcattgtgccctgagtttagcaacaacgttatcatgggctgttctagttcttccaatgtcccaaaaacaattaatttggacctttctttggccatttga

SEQ ID NO: 77673 - DNA, 768 bp, Glycine max
  Peptide Sequence Number=SeqID_194451
atggtaaccaatgactattcactagaaaatattctgaatgaggctgctatgcaagacagaactgttatcttgaccacattaaatgaagcatgggctgcaacaaattcaatcattgatctattccttgagagctttagaattggagatcgtactcgtaggcttctgaatcatttagttattattgctttagaccagaaagcatttatgcgctgtcaggcaatacacacctattgctatttgcttgtcaatgaagccactgattttcataaagaggcatactttatgactcctagttacttgaagatgatgtggagacggattgatttcctacgttctgttctagagatggggtacaattttgtgttcacagatgttgatatcatgtggtttagagacccatttccttggtttcacagagatgcagatttccagatagcatgtgatcatttcacaggcagctttgatgatgtacagaacagacccaatggagggttcaactttgtaaagtccaataataggtcaattgagttttacaaattctggtattcttcacgagaaacctatcctggataccatgatcaggatgtcctcaattttatcaaggttgatcctttcattactgagttaggactgaagatgatattcttggatacagctaattttggagggctttgtgaaccaacctcgattctctcaagcattatcatggttcaccagaaaagagtgttcaagaggattgaagttgtcatggcatatgttaactactaa

SEQ ID NO: 77674 - DNA, 222 bp, Glycine max
  Peptide Sequence Number=SeqID_194452
atgtcacatgcattctggctagacatttacaacttacaagtcccagggaatgcctttcttgtcacagaagaaaataaggtgacatttgagttgtacattattgaagatagcgatttacaggcgtcagaggtaatttcgatttaccaggttcctcaactcccacacccaaaatggaacaataaactccaagaagttactaatccaaaatttatcaaatcgtga

SEQ ID NO: 77675 - DNA, 222 bp, Glycine max
  Peptide Sequence Number=SeqID_194453
atgcatatcctaaaggcatttgaacccagaaaacctaatttggacaacaactacaagggtttaattaaaagtgaccgggataacacactaaaattaagacgaggagcggaagaagaaaatgaggaaggacctgaggaggcttgctccggggtcgatgctgtggggtgtgacggggctgagggacgctgtgcggcgtcagtgacgactgagagaagggagtga

SEQ ID NO: 77676 - DNA, 372 bp, Glycine max
  Peptide Sequence Number=SeqID_194454
atgaaattggtagtcttctaccactttggacatggtctgcaacaatcagaatattacaaaggagatgaaattgacagacttgatgaacctatttgtcctgatgattttatgagagaaagaatgataagtgaaaataatataaattctaccattgttcaaccactcaagaaaggtgcacactcccatgctattattgatgcttgtcatggtggaaaaactattgatcttatgcatctttgccaaaaagaaaatggttctgcgggtaagaagttggctgaaagcatcatcaaagagaagcttgcagtagctaatgcttgtagtagatctgaagctattcctccagagtgggctgaagctgaacaaatttcatag

SEQ ID NO: 77677 - DNA, 474 bp, Glycine max
  Peptide Sequence Number=SeqID_194455
atggaaacatgtgtgtatgcagatccagatgctgaggtgatagcactatctcccaagactctaatggcaacaaacaggtttatatgtgaagtgtgcaataaagggttccaaagagagcaaaacctacagctacacagaagaggacacaacttgccttggaagctaaagcaaaagaccaacaaagagccaaagagaaaggtttatctgtgtcccgagcccacatgtgttcaccatgacccttcaagggctcttggagacctcactggcattaagaaacactactctcgcaaacatggtgagaagaagtggaagtgtgacaagtgctccaagaaatatgctgttcaatcagattggaaggcacactccaaaacctgtggcagagagtatagatgtgactgtggcaccctcttctccagttgctatcatgtaacagagaattggtgtcatgatcacattggaaggaagaagtactag

SEQ ID NO: 77678 - DNA, 186 bp, Glycine max
  Peptide Sequence Number=SeqID_194456
atgcttggtgcatatcaatacatttatgctataaatgctgaaaaggaaaactggatggtcaaagttgaagtaatcaggctttggtctataccaagcttgaatgcatcaaaagctcatttttcattggaaatggctctcatggatgaagagggaggaaaaactcatgcttctgtcaaaaagacttga

SEQ ID NO: 77679 - DNA, 297 bp, Glycine max
  Peptide Sequence Number=SeqID_194457
atgtatcacttcagcaacatgtgtgctagcttcatcattgatcctacctatgatcattttcgtgctcgtcataagagactaccatttatcaccaataacactatatatgatctctataagcttgatgaagatacatttgaagatcgagtaagactgactcatgagtctcaagttattgaagcaattgccttagaaactggagcggtagaagaggttgcactcaagcaagctaaagaagaggtagcactaaagcagctaaattggatgccaactatgccaaaatcaatcaagttctaa

SEQ ID NO: 77680 - DNA, 498 bp, Glycine max
  Peptide Sequence Number=SeqID_194458
atggatccctcctcttcgctccctccctctcttcacctcgccattgccgcgctgctcggcgcttccttcatggccctctctgccttctacatccaccgccacaccgtcgaccacgtcctccaccgcctcgtcgaactccgccgcaaacctctcgccacctccgacgacgaagacgacgacggagaagcggaaacagacgccgatctgagaaactatctcggagccttgtcgaggtccgtcgacgacagctcgaacgtgcttcggagctacaggatttcgtcttccatgccgaacgtggtctccgccacggactggttcggagaggacgctaagacttcgtcgctggaaaatctccaattcgttccgtcggggcttccgtctcttcgaactggttccaagaatggagagagtgctcagatttcttcgtgttcatataagaggataagttctgttggcagaattatgaccctgagatccaccggggcgtaccacgtctga

SEQ ID NO: 77681 - DNA, 207 bp, Glycine max
  Peptide Sequence Number=SeqID_194459
atgagactcatcttctacttgaagtggcatctccattcatctttctccttctccattctgctgcaatcagacctcaagaagcaaaggaatccattgatgaagaagatccaaggcctacaagctccacatagagctacatcaagtggtaatcagagcacaagagcttcaagtgtcgagggaagttgcccaaagtatgaaaaaccttag

SEQ ID NO: 77682 - DNA, 336 bp, Glycine max
  Peptide Sequence Number=SeqID_194460
atgacaacctggaagagtgttgcctcggcctccgagaggccatcctccctctcgctcttgcttggaacccatcgatcgcgaaaagtaactatcattcagacatgtccgttacttttgcgagtgttcactaagattgggagtcaccattccatggaagactttgctgtcagaggcaaagagcccgaggacgaagtccagatttacacttggaaggacgctactctccgagaactcacggatcttgtcaaagaagtggctccggctgcaaggagaagaaacgccaagctctcctttgccttcatattccctgacaaaaacggccgtttcaagaggtaa

SEQ ID NO: 77683 - DNA, 1101 bp, Glycine max
  Peptide Sequence Number=SeqID_194461
atgggttccgaagagagcggcacggaaattcagaatccaacacacacacaaacacaacaacatagtaatcctactaatgtttcttcccccgaaaatcacgctaacggctaccaacacgtcaccgccaacaacaatgacactgaaatcacttcccatcatggcggtgaacacgcccagagtgacaggcaagtaactctagttgtccaccctcattcccttcttcccatgcccgtgccaccgcagagtttcaaagtaagccataacgacgtcgtttccttgaacgactcgaacttctccgtaggaagcttcctccgccagcgcagcagcgacctctccgccgcgatcgtgaaacgcgtctcctctctccgccaatccatggaagaaaacaacgacaacgatatcgacggggaagagaatcgcgaagtgacggagttcaacctctccggcgtcaaggtcaccgtgacgcccaagccggagaaggaaacctccatcaaaggacgcatcagcttcttctcgaaatcaaattgcagagactgcaccgcggtgcggagattcttcaaggagaaaggaataaaatacgtcgagataaacgtcgacgttttcggcgagagagaaagagagctgcgcgagagaaccgggagtggttcggtgccgcagattttcttcaacgagaagctgatcggaggtttggtggcactgaactcgctgcggaacagcggggagtttgaccggagagtggcggagatcgtcgccgggaaggtcgccggcggcgacgcgccggcaccgccggtttttgggtttgattacgtggaggaggagcgcgcagacgagatggttggggtggctagggttttgaggctgagattgccgattcaggaccggttgaggaggatgaagatggtgaagaactgcttcgaagggaacgagttggtggaggcgctgcttcagcacttccactgttcgcgtaacgagtatctgatcaattttaaccgccatgattttgtggtatcactgctaaagaagattgctagtgatatacttaattgcactatgctaaagaagattgctagtgatatacttaattgcactattaaatgctag

SEQ ID NO: 77684 - DNA, 960 bp, Glycine max
  Peptide Sequence Number=SeqID_194462
atgaagttgcagggactaaattcaaatgtctgcaatttgcccgctattccattcagagttgaggatgcaaacaatgaaaaaaatcagatgtatagagaggcttcaaaggaagtgaaagctggtgccgatatgaatggtcatggaataacagattcaacttcagtacatgtagctggggatgaccttgtgtttgtcaataatgtcttgtctgcaagaaatactgtgaatgagacaacaaatatagaagaggaggaagtatacaaaatgattcgagaatgcttagatttgcgtaagaaatatgtttacaaggatgttccatggaagactgaacctgtggaaactaactctgacccgtatcattttgaacctgttgaagcaacagcgcaccactttaggatggaagatggagtcatacatgtttttgcaagtaaaactgacactgatgagctcttccctgttgcaagctcaacgagatttttcaccgatatgcattacattctaaaagttatgtctattgggaataaattccgtcttcatctgttactaaatgcagatagggagtttctggctcagaagggtgcaccacaccgggatttttacaatatcaggaaagttgatactcatattcatcattctgcttgcatgaatcagaagcatcttgttgttatctttagagatggaaagtatatgatgcttaaggaggtttttgagagtttggatttgactggatatgatttgaatgttgatttgttggacgtccatgcagataatagcacattccatagatttgacaaattcaaccttatgtataatccttgtggacagagcagactaagagaaatatttttaaagcaggataatcttatccagggttgcttacagccaccaaaatttacgggaaggtttctggctgaagtaagaaaggaagttttgacagatcttgaagcaagcaaatatcag

SEQ ID NO: 77685 - DNA, 933 bp, Glycine max
  Peptide Sequence Number=SeqID_194463
atgtatgttcattgtattctctattacactccaaagtcttcccaacttttatccctgtttggaaatgattttgaggagggaaatcacttataccgtttcctcgagcatgaaccctttatacccagatgctttaattttcgtggtaccacaaatgatactgaaccaaagactgcagattcaatatgcgcgaggcttaccaagattatgtctgccattcttgaatcttatgcctctgatgataggcaacatgttgattatgaggccattagcagaagcgaagaatttcgtaggtatgtaaatttgactcaggatctgcagcgagtgaatctcttggaactatcagagaacgagaagcttgcgttcttcttaaatttatataatgccatggtcatccatgctgttattagcgtagggtgtcaagaaggcgtaattgataggagatccttcttaagtgatttccagtatctggttggagggcatccttattctcttaatcttattaaaaatggtatcctcagatgcaatcggaggtcaccatattccttagtaaagccctttagcacaagggacaagcggttagaggttgctcttatcaagttgaatccgctattacactttggactttgcaatggtacaaagtccagcccaaacgttaggttcttcacaccacatagagttgtagatgaattaagaggtgctgcgagagagttctttgagaaagatggaattgaagtggacctggagaagagaacggtttatctaactcggattttcaagtggttcagtggggattttggacaagagaaagagatattgttgtggataattaattacttggatccaaacaaagccggccttgtgacacatctcatgggagatagtggaccagttcatatctcttaccagaattatgattggtcaataaattcttga

SEQ ID NO: 77686 - DNA, 138 bp, Glycine max
  Peptide Sequence Number=SeqID_194464
atgtgggacccagggatacgatacgacggtgttattccagctcagagtttgcgagccgttgaagattgccaacgtggaaggttcgcgaatggagaagatgaggcgttgatggaccgacacgtcgcaatcagaaaataa

SEQ ID NO: 77687 - DNA, 210 bp, Glycine max
  Peptide Sequence Number=SeqID_194465
atggccaagatgagtgcttctagtcctagtcaagctaaagaacaagatgatgataccaaacctttatggacctatgttacaagtgtaggtggtggtggaaattatgagataaaatgcaatatttgtgattttatctttaatgggtctttcactagagtgagggcacacttgttgaagatgacaggaaagggagttagagtttgtcaaaag

SEQ ID NO: 77688 - DNA, 2178 bp, Glycine max
  Peptide Sequence Number=SeqID_194466
atggggaaaaataaaaatagggctcttcccaataatcagggcataggaggttttcaaaggtggatgcctgaagaatgggattggggcaccgtgaaaggaaatgtgggatccaatagagatggcaacatcaaggatcaggccaagcaacaaaacacctgtttcaaacaattgtcgctagaagagattcagaagaaaaggatgaaaggattgtgttttgcttatgatgaaaagttatctcctaaccatgtgtgtaaaaacaagaacctcaagatcttgatgctggaggaagttgagcccgtgaaaccaggggaaatggtagtcaatgaagattatatttcagctgttccaagtaaacaggttcttgatgttattgtatccagcacaaatgatttgggccctttcagtcttgacaatttcagaaaaaaattgtctgcttcatggagagttggattaggaacttcaaatgctagacatgagttaaaccaacaaacaacacatgttagactagaaaagccagaggtgaaggaaggcagatcttcaggtgatagtcttcctcagtggactgatagttctgcacagcaaacccgaaggcatttaatagagaaaaggcgggaaaagcgtgctgctgagttggtaaaaaaggataatgaagtaattgtaaaactcgaaaatacagctattgaacgctcaaaatctgttgagtcagccattctaggtaaatacaacatttggaggaaagaaattgagaatgaaaatgtcgattctactgttcggttgatgcgggaccagatcattatggcaagggtatatttaagcattgcaaagatgaagaacaaggtcgaactgtacgaagaactaatttaccggctcaaagagagtcaacatgctttaggtgatgcagtttctgatgcggatctacatcgcagtacacatgggaaaataaaggctatgggtcaagttctatcaaaagcaagagagcaattgtatgactgcaacttggtcactggaaaactaagagcaatgctacagacagctgatgatcaagttaggagtttgaagaaacagagcacattcctcagtcagttggctgccaagaccataccaaatggaattcattgcttatctttgcgccttaccatagattactatctccttcctcctgaaaagagaaagttccctgggagtgagaatttggagaatcccagtctttatcactacgcactgttctcagacaatgtcttggctgcatctgttgttgtcaactcaactattatgaatgcaaaggtgacttggactgtctttttaaccataccagatccttcaaagcatgtttttcaccttgttaccgataaactaaattttggagccatgaacatgtggtttcttttaaaccctcctgaaaaagctacaatccatgttgaaaacgttgatgattttaggtggttgaactcatcctactgccccgtcttgcggcagcttgaatctgctacactgaaagagttttatttcaaggcagggcatccaaactcactttcttccggtgcttccaatctgaagtatagaaatccgaaatatctctcaatgctcaaccatctgagattctatcttccacaggtttatccaaaattggataaaatcctatttcttgatgatgacattgttgttcagaaggatttgactggattatggactgtggatcttaatgggaaagtaaatggtgcagttgaaacttgtggtcccagctttcaccgatttgacaagtaccttaacttttcaaatccgcatattgcaagaaattttgatccacatgcttgtggttgggcatacgggatgaacatgtttgatctgaaggtgtggaaaaagaaggatatcaccggcatatatcacaagtggcagaatatgaatgaagacagggtgctgtggaagctggggacgttacctccagggctaataacgttctatgggttgacacatccgctagataaatcatggcatgtacttggtttgggttataatccaagtttggatcgatcagagattgagaatgcagcagttgtacactacaatggtaatatgaaaccatggttagaaattgccatgacaaaatatcggtcttactggaccaagtatgtcaagtacaatcatccctatcttcgaaactgtaagctaaatgaatag

SEQ ID NO: 77689 - DNA, 150 bp, Glycine max
  Peptide Sequence Number=SeqID_194467
atgcagtatctaggaagcgatcataggtcgtctcccaacgagcaatggtcgtacccgaatgaaataaacattgaaaatgcagtatccgaggaagtgatcctaggtcgtcctcccaacgagcaatgggcaaccaacgttcaaaacagatag

SEQ ID NO: 77690 - DNA, 405 bp, Glycine max
  Peptide Sequence Number=SeqID_194468
atgccactgctaccttgtactgtcgccccgacgcggcattcctctgcggcgcctatgactctaaggttcatgccaccaacaagctcgtgttgcaccacccgcgtgtcgcgctctgcgaggagtgcgagcaggcgcgacgcatgtgacttgcaaggccgacgttgccgctctctgccgctctctgcctcacctgtgactgcgatattcactatgccaaccccctcgccagccgccacgagtgcatccctgtcatgtcgttcttcgagttcgttcactcagtcaaggcctcctcgccgatcaacttccaccaccgcttcttctctgacatcaacgttgacactaacgtcagcaccaaggaggctgaggccgcgtcgtggctactacctaattcgaagacagatctaa

SEQ ID NO: 77691 - DNA, 678 bp, Glycine max
  Peptide Sequence Number=SeqID_194469
atgacctccctacaccatcaccacaccaccgcttcaccatcatcatcagatctttcaaatacgtgcccaaaaccatcacccatcaccggattcgaacaaaactaccctgcgtcacaaccacttccacggctccatccatacccaaaatcctgcaaacaaccctccttgagctcatcagtgtgggcctttcttgaatcctcaaatcctaaaccaccacactcaaaatcccacccacatacttcacaaacgcgtcctcccctggtgttgcgatgcattttgttcaaagttggaccaacgcttttcatggatgagacgaaagtcgccattgaggacctcaatcatgacaagggagaggccaatgttgacggtggtggttgtcttgcccatgctgtccttgctagaggtgttcacggcgacgcggggggtggagtcagagagctccgacttgcggggttagggtttttgaggggaagaggagagaatggggatgaaggaggaatgcgaagttgggggcggtggtggcgctggggagaaggtggagagaggacattgggaaggggagagatggagatggagaagaagaatatgaagaagaagaagaagaagcatagtgcaatcacatgtggcacagaagaagatgaatcgtgccagttagctttttttttccttttaacctaa

SEQ ID NO: 77692 - DNA, 228 bp, Glycine max
  Peptide Sequence Number=SeqID_194470
atgttgctcgacgccggtgtcaacgcgttgcctcctctgaattggactccaccggaggaccgcggcgtcggaactgaattgggttattttgggaagtccccaaatacattggccttggccatatccctagtcatacatctttttgctactaacgagagtggaggaaaccattttgaaggtgacacgacaatttgttgtgctatttttaaggagcttgggagtggatga

SEQ ID NO: 77693 - DNA, 620 bp, Glycine max
  Peptide Sequence Number=SeqID_194471
ttatcacattctctgatgccccacttgctttgaattatgtacgggaaaataaaggttgcgttgatgtgattctaattgaagttcacatgccaaatatggatggctttcaattccttcatcgtgtgggcaaggagattaatgttcctgttatcatgcaatatgcagtgatgtctcatgatgatgctacgagtgctctgatgaaggctgttacacatggggcttctgattattggattaagcctctgcatcaaaaccaattcaggattttgaggaagcttgttgctagaaaactccggattgaaaataatccaccaagaaaagataattctgattttgcttcttttattgttgatgcaacaatgagcgtcccaaaaaagagaagctccaattccaaagaatttgatttttatgaatcggatgattgttatgcacccccagcaaaggagcaccgtgtagtatggtcagaagaactgcatcaagaatttgtcaatgctgtgatgcaaattgggcttgatagtatgattatttcttcatttcatatgattattttctttgttggtattccaatacatgaatatatgtcagacataatcgtatgccacttaaaattttcgccttga

SEQ ID NO: 77694 - DNA, 2283 bp, Glycine max
  Peptide Sequence Number=SeqID_194472
atggttaaagaaggttcaattggctacctgttgattaaaatgccttggagtggtaaaggttgtgaggttgaagtgaatggacttgaaatagtagtttctccatgcacagataaaatgtcaactagtgaaggtgaaacttgtggcttggatgatagtgacaatcaacacctcaaaagctcaatgaggactgagcatgaagtattagatgatgctcagaagtcaacttcaatggatgttcatgaaggtgttaaaactattgcaaagatgataaagtggttgctcacaagcttccatgttacaataacaaatataattgttgcatttgatccatccttagataatgaagaaaataaaacacattgtcgtcattccttagttcttcagatttctgaaatacaatgtggaactagtctgtctgaagatgccaattcaaatgttgatgtccttggtataagccggctaacaaactttgtaaaatttcgtggagcagttattgagcttctcaaaatagataatgaagatgtatactttcaacatgaatcaggagcaggatgtggtgaacctgttttggggtcaaatatagcaacatgtccaatcatgactgggaaccaaggtggatttagtggaaatattaaattaagtattccttggaaaaatggttctttggacgtttgcaaggtggatgctgatgtttgtgttgatcccatagtgttaaagtttcaacctagcactattagatggctattgcagtcatgggaaactcttaagaatctgaataagggtggaaaaggttgcacaaatcacaactcaagaggatctgcccaattgaattctacattgttctgtcattcatcaacttcagtttctattaccaatgctcccagtgagatgatgactgctaatggtagtttgacagctgattacacttctttaacccaacctgaaacccttgctgaagatttacttcctgcggctcatcttatatccaattgggtgccattgtctactcatataaatcctaaagatggtattcaagaacctgattttggggcaagtgtggaccagttttttgaatgttttgatggaatgagaaattctcaatcagctttagggagcagtggaatgtggaattggacatattcagtttatagtgctattactgctgcatccagccttgcttctggatctttgcatattccatctgaacagcaacatatggaaaccaatctcagggctacttttgctggaatatctgttgttttgtccttctgcgttgatgaacagaataatttttctgaccctgaaatcggtcacaaggttggattacaaattgattatcttggtgcagagtgcaatgacattgttattgctttgcaggtatgccctcaaggtatgactcttaatggaaaggtgaagcatgtagaagttgctaatttcttgaacattggaattgatgctaaaaatcaaagtgctttggttcaacacctacaagctaaggtccttgatgctctcccttcatctacctcttacaatgtagattcacattcattaattgggccagttgcaacagattttccatttggaaataatgattgcttgttgaaagttacattgttcagaacttttggtgtcacaaattgcaaatgttcaacgcaatcaagttcatcagatggttgtcagaaagggatgacatcattctcactgaacttgcccccatttattttctgggtaatcttttcagtaataaatgttctcttgaatctcataaaggaagttgaaaaatcacttgaaatgcataataaagtaaaggaaattctgtctgaagtctcagattataagtgtggatcatctcagagtgatatgaaggaaggttctggtccctgtgtgacatctttctccacaacagaatgcttgcatggtgatatatcaatttctaatgcaagagtgatactgtgttttccttttggaagggatagggatcataaaaattcattttcctgggaacagttcattgctcttgattttacttcattgtcacctttgaacaagggttgcactccagattatagtcaaacttcaaatgcaagttcgaagaaaaggtttccttcagtagctgctcaatcttttcaattgagtttctatgatcttgacatctacttgatcacatcaagggggtcaagtgactgtgaaagatatggaagattggaaatctcaaactcaacaagagatgattctaagctcatcatttctcatgcatgtccatctatctcaagttgtgaataa

SEQ ID NO: 77695 - DNA, 309 bp, Glycine max
  Peptide Sequence Number=SeqID_194473
atggcggaactttgcgaaatcagcggaggccacgttctcgcggtgggccctcaagagggtttgcaagttcttcctcaagaagaaactgggccagttcatcctaggcgaaatcgacctcgaccagctcgacgttcaactctcgcagggcactattcagctctccgatctcgcgctcaacgtcgacttcgtcaactcaaaggactaggcattggtggtgttaatattgatgatttgagtgaggggggctcgccagggtcaaggcaggcttcgtggatcaaagagtggtttcctgatagtgctgtcacttga

SEQ ID NO: 77696 - DNA, 585 bp, Glycine max
  Peptide Sequence Number=SeqID_194474
atgaaatccttgagtagtgtaggtcttggtctcagtattatttttggttgcctcttgttggctctggtagctgaggtatactatttgctatggtggaagaagaggataaccaacagagagattgagaataattatggcaaccctgtgaaggaattattctacatgttttgttggaaaaggccatcatcatcttctttgaggcaaacaagtttcactcctcctgagttttgttcttcaatgagaattggtgacacccttgttcatgacccagaacaagttcagtctcaaagtggaaaggaatttgttttcaaaccctttggagaagatggcaccgatgcagaatacatgaggcaacaggacctgttactgttaggccctccaagattcttgttcaccatagtagaagaatcaaaagaagatttagaatctgatgatggcaaatccaagtgtgacaagagtggaaaaggttcaaggggtagaagcttgggtgatttactagttgtggagacaccatatatgacacctacaacttctccacctttcttcactcctcctttcactactcctatcagtcccttaaccaac

SEQ ID NO: 77697 - DNA, 522 bp, Glycine max
  Peptide Sequence Number=SeqID_194475
atgactgccattctcgatagaggttttcttctcttcagttttgatgcttcgaaacgtgcggatggagtatctagtatcttcgatagtgtgctagagggaccacagaaggggtttaaccttctagagtgtaaccatttttccaatctggagcatacgggtggaactggttcctcttggatgaggggctttcctccaacaactgactcgcttgtttggatcggccaaactcagccgagtcggacacggaatagcagcacaatcggaacgctttctggaaaatcgatcaaaaaggataactccttttcaaaaatgaaaatggtttgggggatgccgagagtgtcctctccgaattataaccaaatccaaaaaaacttggatgcagagcaatcgaacggtgacccatggaagacaattgtggcagcagaccctttcaaaagtaggaaactggaaaaggtagtggtggtggtggtggtggaggctttcaaacggaggcttcatggtggacaatcttgggatatttga

SEQ ID NO: 77698 - DNA, 222 bp, Glycine max
  Peptide Sequence Number=SeqID_194476
atgacccgtagaaggcaactatggtggcatatcctttcagacagaggaaaagggagcaattgtggtggtggagactttcaaacagagattccatggagaacaatcttgggatatttgaaacaaggaggtgcagacatattttctaaatgtaacttgtatcgtacaactcatgaacttggtagttacttggctagtgatgcttatgtatcgtacgacccatga

SEQ ID NO: 77699 - DNA, 1101 bp, Glycine max
  Peptide Sequence Number=SeqID_194477
atgagcagcaactccggagcagttaagggaagagaattccctcttcctcgctgcccctgcccctcctcaaattcaaatgccccttcccttgatctctggtcacaaatcgttgccgctgaaacgccccgccccgaacgaatcgacgtcgtttaccggagaagacaccctcgcaatcctcaaaaccacgccaactcgtacctccattttcattccatcatctttcttcttctttatttcattttcattttttttaaaggttttacggaaactgttttccttttcgatcgattttccagaaagcctcccgattctgctataccgcgcccgcctcggcagagtttggccgatccaaacaagcgagtcagttggaaccgttctctttccacccgagggaggacaagtatagccgttggggcttttatggtataccagcctcagttgaagaaggacaaaaggaaaggaaaacccgctcttcccaaaggaaaggttgtgcaacctccaaacgttgacaaggagaggatatactttcaagaggttgatgcttatgagttgttggaggaaagcccctcccccaagaaaagcacatggaccataggaaatatgacacaacaggaaccaattccagctgtatgctccagattagaaaaatggttgcactctagaaggttaaaccccttctgcggtccatctagcacactatcgaagatactggatactccttccacacgtttggaaactattcgtgacattgacttcggtgcttctgacttgaaaacattggaacgaactgaccgaagcaattctcttctgcataccatcaaaactgaggagaaggaaacttctattgagaatggcagtcatttgcaaacaaatgaaaagatgctgtttgctcaaagtggtgaaggatgtgaagatattgaagctggtgttaagaaactttctctggtatcaacgtcatcttcaatagatgatgaccacattaatccattttctgttttattatcgatttgtggacagtctgcaccttcagtgttacaagatattttctctaggtattggattgttccttattttcaagtaacatgctatcttagtttgtga

SEQ ID NO: 77700 - DNA, 483 bp, Glycine max
  Peptide Sequence Number=SeqID_194478
atggtgggttacacaccttcaagttttacagatttggtcttcgccagcaaaaaggtcgaagtggatttgaaaagaggcaaatttaataatcctgcttggatgaatgagaaaactggggcaaataaagagggtgaggatgagggagaaacccatcctgtgactgccattcctgtacggccaagtttccctccaacccaacaatgtctttactcagccaataacaaaccttctccttacccaccgcccagttatccacaaaggccatccctaaatcaaccacaaagcctgtctaccgcactttcaatgacgaagaccacctttagcacaaaccaaaaacaccaacaaaaaggaattttgcagcaaaaaacctgtagggttcaccccaaattccgttgtcatatgctaaacttgatcccatatccactcgataattcaatggtagccataaccccaaccaaggttcctcaacctccatttttctga

SEQ ID NO: 77701 - DNA, 406 bp, Glycine max
  Peptide Sequence Number=SeqID_194479
atgacggaagggtgtggtgaagggttttgccttgcaaaccttcccggtgatgcttttagtctatgggggaacttctttgaggcaaagaaacaaatgatggctgatgccaagtttgcggggctgcttggtttaacattgcttaagtttttccatgtgcccggtggtcgggtcggcggtgctgggttatggccccgtgctaagtttcggattggttggccccctcctcccccccgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 77702 - DNA, 207 bp, Glycine max
  Peptide Sequence Number=SeqID_194480
atgtcaggatttacacgcaattctcctcaaatttcagccagcccgcatcaattagaccttgcaccttacgcttcagagccctacaatgctcaatggaacgccccagggctcccccacgatatgcacatgttgcgttcgagtcatatcctcagaaaaatgggggtggtcttcgtcattggaagtgcggtagacaggctttgtggttga

SEQ ID NO: 77703 - DNA, 295 bp, Glycine max
  Peptide Sequence Number=SeqID_194481
atggcaacacctaatgccccattaggtcagcaatgggatgtacccggagtaatccctgatatgggtgacttattaggtgttgatttgtgtcacgagttttctgcagaggctgaggaacaagggcggagacagcgtgcaagaagaaatccggatcgtcaagcccgaagggttatggggttgtgttatgagttagggttaggtttatggggtaaggttaggggttatgggttaggggttagagtttatgagttagttttaggacttagggtttatgagttaggtttaggtgttatgg

SEQ ID NO: 77704 - DNA, 996 bp, Glycine max
  Peptide Sequence Number=SeqID_194482
tcctcgccttcagagggctacatgctctcaccatcagaggactacacgtcctccccttcagaggactagacatcctcaccatcagaggactacacgtcctcgccttcatagggctacacaacctcaccatcataggactacacaacctccccttcatagggctacacgccctcgccttcagaggactacccatcctcgccttcagagggctacacgctatcgcctttagaggactacacgtcctcaccttcataaagctacacgccctcaccttcagagggctacacgccctcgacttcagagggctacacgctctcgccatcagaggactacacatcctccccttcagaggactagacgtcctcgctacgcgccctggccttcagagggctgcacgccgactacatgacctcacctttagagggctacacgccctcaccttcagagggctacatgtcgtcgccatcagaggactacacgtcctcgcctttagaggactacacgtcctcaccttcagaggactacacgtcctcgccttcagaggcctacaggccttcgccttcaggggactatgcgtcctcacattcagagggctgcacgccctcgcctttagaggaaaacacgtcctcgcctttagagggctggacaccctcgcctttagaggactacacgtcctccccttcatagggctacacgccctcaccttcagaggactacacgtcctcaccttcatagggctacacgccctcaccttcatagggctacacgccctcaccttcattgggctacatgccctcactttcagaggactacacgccctcgcctttagagggctacatgctctcgccttcagagggctacacgccctcgccttaagaggactacacgtcctccccttcagagggctacatgtcatcacctcgccttcgaagggctacacgccctgcctctcaaaggactacacgtcgtcacctttagagggcttcaagcccacgc

SEQ ID NO: 77705 - DNA, 231 bp, Glycine max
  Peptide Sequence Number=SeqID_194483
atggcggagttgattaacaaaacacaactctctccccaaaataatcccaatgtcatcacgttggcttggcggctcctccatataatctcatgcctgcaccctactgctgtcattctgcttccacgaacaagatacttggcaccctttgttgtacactatgtgaagtcccgagacgtgccgaaaatcaaaaggaagcaggcttatgcgatccgtgaaagttccgtaatgtga

SEQ ID NO: 77706 - DNA, 249 bp, Glycine max
  Peptide Sequence Number=SeqID_194484
atgcccttggggggtaggagtgcatcaaacgctctcaagagagagaaagaagaggatcctcgaggtttcacacttgcacatttgagaaggaaacccattcgaccaggagctcgtggaaaatgcccaaagacaattgtgatagtagggatcagcccatgtcatcaagtttcggtgagatcgacagacccttggcatcactctatgaccttaaatcaggaaagtttcacttggtcatataccaaagtgtaa

SEQ ID NO: 77707 - DNA, 184 bp, Glycine max
  Peptide Sequence Number=SeqID_194485
tccttttgctaagcgcaagcttcgtgctaagcacatctttggtcatgcgctaagccgagagtctctagcgcttagctctccacccttgcatcttaggctgatttggtcctctaagctggccaaggctgagctaagcccatttcaattcgatctgaattgggctaagcgatggcctgctcgctaa

SEQ ID NO: 77708 - DNA, 543 bp, Glycine max
  Peptide Sequence Number=SeqID_194486
atgactcaggccctgagcttggttcgtgaagaagattgttgtggattccatcccttaatcctcaatctagattctatcaatgaggaagtcgaagattccatccttgatcagtatgaaaacatggtatctcttattccaatcttcttgaatttttcattgggttttgattttgatgaaagggaatcggaggaagcagcgatgggaatggctaaatatataattggtacagttaatgcattgcagtcaaaaccaggtggaggtgaagagtggctttgctctcttcgtaagatggaacttcgagatgttgtatctacactttctacattacctgatgtaggtcctaaagtggttgcttgcattgctctcttcttgcttgatcaacaccatgttgttcttgttgacacatacgtgtggcggggtcgacaagggggtacccttgctcctacgtatcctcagatttattttaatcgtgagcaaagagttgctaaggcgttggaccttgaaatgacatttaaaaatttgaaaagcggatggagtcgttaa

SEQ ID NO: 77709 - DNA, 135 bp, Glycine max
  Peptide Sequence Number=SeqID_194487
atgtgcaccatcgtggaggcgaagaggaatgccaaggagaaactaccactacggatgcgaacaggactacaagacaatgacgataaacatggagtgcacgactccacctttggctgtgcagagaagacgacctag

SEQ ID NO: 77710 - DNA, 696 bp, Glycine max
  Peptide Sequence Number=SeqID_194488
atgaggccagcttcctttcaaatgcaacgaaaggatatttggaagagaaaaacatacctaattgcttatgtaactcttattatagacatggtggtcatcagaacaaccagaggattgcttgtttatggaagacaaggtcgggaaatatttaggagcaacttagatccaaatgtctgtagagaggcttgtctttactctttggagaataaggttccacttattgcattttgtgaagggcgctgcttaaccctatttcatgatccattagttgattcactgcatacaatataccatgaaccaaaggctgaggtcatgccttctgttgaacatctattagcttctgctgacatacagacactgaccagagggtggaatgttaccttgcggccgtactggtcagatgcaacaaaaggtcgtgcctctgttgttcaagctgtgccatacatgctggaaattgtacctgtgggaacatcgaaagggaatggagtaaaagtgctgctagatcattttggggttactgctaaggagataatggctattggtgatggggaaaatgatatggagatgcttgagctggcttctctaggcattgcacttagtaatggatcagagaagaccaaagccgttgctaatgtaattggtttaagcaatgatgaagatggtgcagcagatgccatctaccggtatgcattctga

SEQ ID NO: 77711 - DNA, 666 bp, Glycine max
  Peptide Sequence Number=SeqID_194489
taatcagctttgtgtttcagcttaaaggcaagcgagtagggattgttggattgggaaaaattggcaaagaagttgctaaaaggcttgagccctttggttgcagaattatgtaccattcgagaaaccagaagccatttatctcgtaccctttttattctaaagttgttgagcttgctggtaatagtgatgtccttgtgctttgttgcccacttaacgagcaatcaaggcacttaatcaacagggaagtgatgttggcattggggaaagatggagctattgtcaacgttggacgtggagctctaattgatgaaaaggaattggtgcggtgtttgatggaagatgagataaggggtgctggcttggatgtgtttgagaatgagcctaatgttcccaacgagctctttccattggataatgtggtcctctccccacatgctgcttcattgacttcagatggtttcactgaagtatgtgaacttgcagctgaggctctagaattgttcttttcaaccttaagcggcactcgctgcttggtatcacaagaccacctcattcttaggttgatgactttacaagacaaccctttccaggatggggcatttgcattgctccctaaattcgtaagagcaagtgtacagcttttcatgttggtcttataccgtggct

SEQ ID NO: 77712 - DNA, 1179 bp, Glycine max
  Peptide Sequence Number=SeqID_194490
atggcgcgtgccgtcacgtgcgccactcagccccctcatttccaccgctcatccggcatcgctacctctcgctgcggcgtttctctgccctccaaatcctcgcttttcggccgcacctttcacgccctcgcgcggtgcgcgggcgaagaagcagcgacgcggcggcggccagtggcgggagtccgcaccgagcagagggagtaccggaaggcgaggagaagagcgccgcccaagagcaaaggcaaggagcttcaactctgcgtcgagatttgcatcgaagaagatttgcctgacgatcctgaaattttgagcattgcagagttgcttcgactaaatgttccaatggcgatgaaactagcgtttgatggtttgaaaggtttggggtataaaacacgagacactgctataagagatgttggtgggtttgatagtgttgagttatcagtacttctttgcaatgatgagtttatacaaaaacttaataaggaatggagaaatgaagatcatgccacggatgttctgtcaatgtcgcaacatgtacctgggctcaagattcctattcttatgttgggtgatattataatttcggttgagacagcggcaagacaagccgaggaaagaggacatactcttcttgatgagatccgaatcctcatgcataagtggaaagtgagctggagtttcatttacttctcagcatgggttcatggcttgttacatcttttgggatttgatcatgaaataagtgaagaggctgaagtagaaatggaaagagaggaggacatccttttaaagagtcttgattggaaaggaaaagggctaataaagagtgcatgtgatgctgaaacaaattcaaatttttacccagacagttcagatgatgaattgtcaaaagacaggaagaaagaaggcagtcttagattttacaaaccaaagttcagctatatcttctgtgatatggatggaacattgctgaacagcaaaagtcaaatttcttctacaactgccaatgctttgagagaggcgacatccaggggtgtgaaaattgtgatagctactggaaaagctcgtccagctgtgatagacatttttaagatggtagatttagctggaaaagatggcattgtttcagaattttctcctggggttttcttacagccaggctgtccttatatgtaa

SEQ ID NO: 77713 - DNA, 321 bp, Glycine max
  Peptide Sequence Number=SeqID_194491
atgaataagcaagtaccaaagaattgttctagacatgggagtgataaatatgtaaagtttgatgttcatattaatgatgatgaagataatttgagtgaaccagatcagacagagtttgtgggaacttttgttaatttgttccatggacaaggccataatatcaaagtaacaagttttaaggtagggatatcgaaagtgctcgattgtttagaagttgaagaagacgatgttgtgctagttactttggtgcctaaggttggaaaaggagatgtcatcataggaggcatcaaagttgagtttatttcaaagtacaaggattag

SEQ ID NO: 77714 - DNA, 156 bp, Glycine max
  Peptide Sequence Number=SeqID_194492
atgttaaggcttggagggattgatgggaacccagtgctgagaggaacgaggagaagaactacgggtcaggagaccttggggacgtcaggttgggtgctattgcccaaaaccaagcttgaccaatcccgacctaacccgggcatagtcagccagtga

SEQ ID NO: 77715 - DNA, 483 bp, Glycine max
  Peptide Sequence Number=SeqID_194493
atggcaaacaaacagcacaaccacaatgataacaacaaggagcttcaaccactccttgtgcttggtcctcctttcatgttcccaacctttgaagctcaaaaccttcacaactaccgtttcctcaatgccttttcctcccaaatccctctccaccaattcctcgccgagcaaaacgttgacccttcatccattcaagccatactctgcagccctcgccagaagatctccgcagacgccatccggctcctcccatcactcagcctcattgtgaccactagtaatggaacccgccacatagacttggctgagtgcagctaccgtggcattcaggttgcctctattccaggagatcaattagccgtggatgttgctgacatgactgtggggttgttgattgatgtcatgtggaacatttctgcagctgatcgacatcttaggaaatggggtccttctaagccctgcaatctttcttctggttccaag

SEQ ID NO: 77716 - DNA, 291 bp, Glycine max
  Peptide Sequence Number=SeqID_194494
atgcttacggatcaagtgatccgtaaacaacccagcaacttcccgatagcggtttctgccatcgccggcaacaatggtgaaagaagcaaaaatgcgaaggagaaacttacctcgaagaagaagcagaaacgcaaagaagaagccttcctcctaatcacggcaacaatggcggcaacgcttgggagcttcacttgggaagaagatgcagaatcgtggcgcggagaagaagaagaacaaagaagatgcagaatctcgaagaagaagcagaagaatgaagaagcagaagcataa

SEQ ID NO: 77717 - DNA, 370 bp, Glycine max
  Peptide Sequence Number=SeqID_194495
gagtaagaggctgaaagccccacctagctcaggaacattggtgattgaagacagtgatgatgcagcggaagatccaacaaggtccatgcgaggccagattgtggaacattgttggcaagaaatatataatgaagccaatggaagtacacttttcagagaaaaactcatggaagaacttaaggcaccttactgtgaggaagagtacaagaggcttttacatgacattactgttcgaaagccagtccagcaccatagagaccttcgtggaggtatcaaaatctatgagaaacctgatcttggaaagtcttttcttggttatcatgttgatcttgctaagaagatagaaacagttcgtgatgatcatcccgga

SEQ ID NO: 77718 - DNA, 243 bp, Glycine max
  Peptide Sequence Number=SeqID_194496
atggtggtgataaaacatagggtttcacacacacgtagagtcaaatctgccgtcattggtgttaagacgaagttgcaaggtttgatgctgccaccactagtggttgaccggcgtagggaaaacaatgagatgacaaagggtggtgaatgtgtttgggttatggatgtgcaaagttatggtgggctaagggaagtgcagaggcgacaaaagagaataatctttgggggagaaagtggtgggtga

SEQ ID NO: 77719 - DNA, 579 bp, Glycine max
  Peptide Sequence Number=SeqID_194497
atgactatcactttggatgatgtgttttgtctgttgcacctgcttgtgagagacaggtccattgatcatgtcccctctacctttgacagagacacagctacagcggcggcaagcgcaagtgctagggtgaagttgacgttgttggcatcgtgtgtttgggttgccatgacttatctgttgcacttgatcagcaataagatatttgtcaacaagtcctcgagtcacattcatgttgcctacctccagtacctcgggagtttggatgcttgccacgagtacatatatggagtagttgcattagtgtaccattatgaccatttctcctatgcaagccagtacgacaacaagcagtcatgggcgtttgtgcatttgtccaatgttggctactacgaggcgaagaagacttacgatcttatggatgttgtcatctggtatccatatgattcgcacggtgtgaggcctttcacaaaacaagctcttttctctggcttcattagatgcaagactgacatgtggccttatcatccaaagaagcgacacattcctttggatgattttgagccacttgggggtccttga

SEQ ID NO: 77720 - DNA, 297 bp, Glycine max
  Peptide Sequence Number=SeqID_194498
atggagagtgaatctgttgttgcgtattgtagtggtgacataacttcatcatctgaagagatgttgtttgaatgtcctagtggttctaaagttgtcacaataagtgaggacatgtcgcttgatgctttaaggaaaacatatatggacgccatcggagaatttagtagcaaaggtccgattgagttgaatgcaaattttggccgttcaccaaatgaaatccttgccctgttgcacaaaccaagtaaaccaagatctattgatgagatcactgtcttgatgcgtgataaatctatgtag

SEQ ID NO: 77721 - DNA, 477 bp, Glycine max
  Peptide Sequence Number=SeqID_194499
atgtatgttcatgttggtacattcacgttctcagaatcctttgccttgcctacatcaaggttgaactgctgttactgccatttgagatatgtaatttctagtgaccaagcttacctcacttatgtatctgagcaagtttttggctgtattttttcatacccatcaagagtcataaagcatacatggggtagctgggaacttttgcccgatgcaacaattgagagtcctgaagatgctgtaatgaagcaacatatgagaaaagacgtacatgatctcctgaaaggcttgaacttaagggaaaggaaaatattaaccctacgctttggccttaatgataaccagcctaggtctcttcaggacatagggacacttttcaaagttagcaaagagaggataaggaagatagaaaaaaaagctctaacaaagttaaagaatgaagcaaccatctcaaagttacattattatttggatctgtag

SEQ ID NO: 77722 - DNA, 1326 bp, Glycine max
  Peptide Sequence Number=SeqID_194500
atggaagaccaaaaccagtgtactacaagggacgaacaattaaaaaaccttaatctccccaaagtcctaattcacggtcccccaggtttttcctctgttctccaaccacccttttcccaaaagtttcatattttaaaccactcttctcttcccctgcacaagttcgcggccacccacgcccaccactgttcctccgtcgccgccgtgctctgcgacggcggctaccccgtcactgccgacgtcctccgcctcctcccttcgctccgccttctcgtcaccgccagcgccggcaccgatcatgtcgacctggaggagtgtcgccgcctgggagtccgcgtcgccggcgccggaaacatgttctctgaggacgttgccgacttagcggtgggtttgttgattgacgtgatgatgaaaatttccgcggcgaatcggtgtctgagagaacggattctggtagtttcacgggattttccacttgcttctatttttaagttttgtacaacaaaagtggaagggcgcgcttggtttggagaacttaatgtccgctcaaaattgacaggaaagaaagttggaattgttggtctgggaaaaattggcttagaagtggcacataggcttgaggcttttggttgcatgatatcatacaactctaggagcaaaaaaacctttgtttcctaccctttctattctagtgttgttgagcttgccactaacaacaatgtacttgttctttgttgtgctcttaatgaccaaacgaggcacatgatcaacagagaagtcatgttggcactgggaaaaggaggaattatcgtgaatgtggcaagaggggctttgatatatgaaaaggaattgttgaggtgtttgatggaaagggaaattggaggtgctggtttggatgtgtttgagaatgaacctcttgtgtgtgaagagttcttttcgttggataatgtagttctatctccacatgcagatgattttgaaaagtttgatctatggaaggtattccaaaggtgggggagagtttgggacatctttatagcttatagaagagacaaagggggtcatagatatgggtttgtctgcttcttggaggtctccaatgtgctttggcttgaaaaacaacttgatactatttggattaggaagttagaggattgtatggtgggtagattgagagaaatagcagattttgatatagcctttataggtggctctgaaggcatcgaaatgtcctaccttggtgatgacttgatactaatcaaaggtttgaatgtaaaagaagttgaagatatgttgcaacaggcagatgatagcttccttcagtag

SEQ ID NO: 77723 - DNA, 2079 bp, Glycine max
  Peptide Sequence Number=SeqID_194501
atgaacggcggtggaggtgacttgccgccgtccaacggcggcgagttcctcctctctctcatccaacagcgcccccaccagccccacccccacccgccgcctcagtctccggcgatagatcccgccgtcgccgccatcggtcctacgatccccgttgcgccgccgctgtggcaaatcctctccgccgatcatccccaccaccaccaccaccaacctcaccctcaccatctcccaccaccctggtcccactctctctcttcatctccgctttaccctccgaacttcttcgggttgccccataatgcgtttccccctcctcggacccacttccccatcacccctaactccgtcgctaacggcgtcaacgctaacattaacctcgcccatgatctgcgaaatctaggttttccaattgaagaaagccacaacaacaataataataacaacaaggtcgatggtttcgttcatcatcatcatcaacagcagcagcagcagcatgaactgaagctgcagttcgggtctttacccacggttgcgtattccgccgccgaagtttcctccaatggtggtgactcgttgctcaatttgaagttcaacagagtggatcaccccacttcaaattcgagtgggaatgtggttgttcaaggtaaccatgatgctgtggagagagaaagaagaggacttgggggttatagggctggtggttcgttaccccctgagacaagtagggttccaccagggtttgggaacaggactagagggaagggtttggagggtaggaatgagaatttgtatgataggagggaaggtgggagaatggtgtctggtgagaggagcaatgttagaggcaatgtgggccataaaatggggcttgttgatcagcttgatcgccccgggccgccggccgggagtcacctccattcgggttcgggaaatgatgctggcattggtgaagttggtggtagggatggtaaacataaggaaattgggaggttgaggatggagggtgttcctgagtctggtggagggggtgctgatgttgatgtccttggggagcagttggctgattccttgttggtaaaggatgagtctgatgacaggactaacttgaggcaacgccgtcgagagaaggatgttagattgtcggattcaagagggcagcagatcatgagccagcggggaagaatgtacagaaggcagatgatgtgtcgaagggacattgatgtttttaatgttcctttccttgcaatatatgggtctctaatacctcctgaagaagaaaaactgaagcaaaagaaattagtggcgttattggagaagttagttagcaaagaatggccaacagctaagctttatctctatggatcatgtgctaattcgtttggtgtttctaaaagtgacattgatgtttgccttgctattgaggaagcagacatggaaaaatctaagattataatgaaattggcggatattttgcaatcagataatctgcagaatgtgcagggtgtctttggctccccggtggaacttggaggtatccccacaagctttggtctttgggctaactatgggactaatgttcaatccagggcattgacgcgtgcacgtgttcccatagtaaagctcatggatccagtgacaggaatatcttgtgacatatgcattaacaatctcctagctgttgtgaataccaagcttcttcgggattatgcacacatagatccaaggttgcgtcagctggctttcattattaaacattgggctaagtcaagaagagtcaatgaaacttaccatgggaccttgtctagctatgcgtatgttttgatgtgcattcattttttacaaatgagaagacctgctatccttccatgcttgcaggagatggagacaacatattctgtaactgtggacgatattcattgtgcttactttgatcaagttgaaaaacttagtgattttggtcgtcataacaaggaatcaattgctcaacttgtgcggggatttttccattattgggcatattgtcatgattatgcaaatactgttatatctgtacgcactggaagcataatcaggtaa

SEQ ID NO: 77724 - DNA, 675 bp, Glycine max
  Peptide Sequence Number=SeqID_194502
atgttttcgcgtagttcggaaagttatgcaaaacatctcttatatcttaaagatcaaatcaaggatattgaaagaagcttgaatttggatggaggacgatatgatcaaatcacacaagaaatagcttatgttaataaaactgtcgaagacctcaactctatgagaaatggaatcatagaagaagaggacctctcatcagtaattgatgcaatttcttcaataacatctatgttgtttaaattacagttagaaaaaagtgagttacataaaatatcaattttggaggataagtatgtcgaaatgcttaataagcgggaaaatgcgctagataaactggaggggttaggttttgaaactttagagcaactcaaaggaagtacaaaagtaagagctatacttgcttatcgtagtgcattaattatcatcgccgttttgaagtacgtcaaagccgtacgtgctgtcaagtatttctgctgtgaagcaggcatatctgtggcctcgaactacaactgggaagctaagtacagtgggatggaagcctctgatatcaaaaagatgaaaggccttgaggatgaaaaccgtcgtctcaaaaggatgtttgccgagcttggtcgtgaatatggggcactgaaagatgtcatcgaaaaaagctttaaaaccaacgataaaacgtga

SEQ ID NO: 77725 - DNA, 852 bp, Glycine max
  Peptide Sequence Number=SeqID_194503
atggaaggcgtactggattcgctggtacgtgaactgctctccggtgtgaatgactatgacctgtgcgtcactgagtttttacgcgtggtcgatcagctgctgccgtatcctgagtggctggcagaaaacgccgcacgcgcggtggagctgggctcgtggggcgttgacctcaactgcggctgcccgtcgaagctggtgaacggcagcggcggcggtgcgacgctgctgaaagatccggagctgatctatcgcggtgccaaagcgatgcgcgaggcggtgcccgctcatctgccggtcacggtgaaagtgcggctcggctgggattcaggcgcgcggcgtttcgagatcgccgatgcggtgcagcaggccggagccagcgagctggtggtgcatggccggaccaaagaggacggctatcgcgcagagagcatcaactggcaggcgattggtgagattcgccagcgtctgacgatcccggtgatcgccaacggcgaaatctggaactggcaggatgcgcaggattgcctgcgcattaccggctgcgacgcggtcatgctcgggcgtggcgcgctcaatgtgcctaacctggggcgcgtggtgaaatacaacgaagccccgatgccgtggtcgcaggtggttgagctgctgctgcgctacacccagctggaaaagcagggtgataccggcaattatcacgtggcgcgcatcaagcagtggctgggctatctgcgcaaagcctaccatgaggccgacggcctgttcagcgagatccgcacgctgcgtgtctccgccgagatcgccagcgccatcgaacgccatgccgcacgcatggcccaggtgtcctgcatctga

SEQ ID NO: 77726 - DNA, 165 bp, Glycine max
  Peptide Sequence Number=SeqID_194504
atggtgtttgaaatgtctaatgaagatggcacgccgcggtcgctaagatccagcacggcgagctggttggaccgggtggaattggacgagctcgattccgcggagattgctacagaaggaggtggtggtggtgatgttggtggagatcctcacctccctccatga

SEQ ID NO: 77727 - DNA, 666 bp, Glycine max
  Peptide Sequence Number=SeqID_194505
atggcctacaatcggcgcatgactgattcactgcgtaatggcgaactggacctggcaatcatcggtggtggtgcggccggcgtgctggtggcgatccaggtactgcgccaggccaaggcgccgctggcgctggccattttcgaaccggcttcgcagctggcgcagggcatcgcctatgccacgccgtggccggagcatctgctgaacgtaccggcggcgaagatgagtgcgtttgccgaccagcccggcgatttcctcgactacctgatggacgccgatgcctacccgggcgaggcgcgcgaggtgctgggcgagcgttacgtgtgccgccactacttcgcggcctacctgcagcagcgcctgcaggacgccgccacagccagcccggcgcagctgcaggtgatcgcgcagccggtgctgggcctgcagccggatgaccacggttaccggctgcagctgggcgaaggccagacgctgcacgccgcacaggcggtgctggctaccggcaacagcatgcgcccgctgccggtggccggtgccgatgcgctgcctgccgacgatgtgatcgaagcctgggactacgacggcgtacgcaccctggccggtgaacaggccgtggccattgtcggctccggcctgagcatggccgacaccgtgctggcgatg

SEQ ID NO: 77728 - DNA, 330 bp, Glycine max
  Peptide Sequence Number=SeqID_194506
atgacaagattcttgagaattttacccatctcttttatctcggattcaactccaaaggtcttcatgatgtatcaaactaacggtaatgtctctcaaaacattatggtgaacaccatgctcggacatatcctcgaaatttccaatggtgggaatgctcagaattgggttacgaacgtggtgctcaaatttcatgacgatccaacggtggatgagtctgagatcgtcatttttctaagacaggttaggtggcatgcgggaaaaggagagggttttgggagaagagagaaaaaacgaaattgtaaggcagaggaggctgaggagttagtctaa

SEQ ID NO: 77729 - DNA, 414 bp, Glycine max
  Peptide Sequence Number=SeqID_194507
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagactacgagatcgccccttcattctgggtga

SEQ ID NO: 77730 - DNA, 186 bp, Glycine max
  Peptide Sequence Number=SeqID_194508
atggctaccattgaattattgagtggatatgggatcaagtggtcttcgtcattggaagtgcgtaatgacattgttgggtttggtgggaaacttggccgtataggaatggcagtcacagcatgggtttctccctctttctcaccctcttcatttgccccagttttctcagtcgtcctagtaggatga

SEQ ID NO: 77731 - DNA, 388 bp, Glycine max
  Peptide Sequence Number=SeqID_194509
tacgcgagctcagttggaggtgggcaacaggggatggtgggtttatgcgtgcattgtggatgtggaaaacttgttgtgcaccatcgcccgaccgccacctagtaccacatgtgatggggtgaaacttcctgcttttattgttgaccacagagtggtacctggagatatgtcgcgggggtcaggagaccttggggacgtcaggcgagctcctggcagtcaacagataaaaggaacaaagaccacaaagcaaggaggcttgtggtggctggccagctgtgaattttgtgtgatatgtggattatggcctctggtaatcgattaccaagggcttgaaaacgaagtcaggaaaataagggagcctctagtaatcgattaccagcctgtgtaa

SEQ ID NO: 77732 - DNA, 960 bp, Glycine max
  Peptide Sequence Number=SeqID_194510
atgtccaaattcgatccctacacgcaccttggcatcactatcaacccggacggcactgtcacgcgcgccgtcaagaccccgaccgtcgacgccaaccccgacccatcaccgggaaccgccaccgtcagcaaagacataaccctagactccaataaagaaacatgggttcgaattttccgaccaacgaggctcccttccaacgacaacacggtggcgcggttgcccatcgtgatctacttccacaacggcggcttcctgttcctcagccccgccgcccccggctgccacaaaaaatgcacgcaaatcgccagcgacttcccctccatcgtcgtctccgcctcctaccgcctcgctccggagaaccgtctcccggcgatgtaccaggacgcgcgcgacgcggttttgtgggtgaaagaacaaatgaacgaccccaacggagagcagtggctgaaagattatggagatgcctctagggtctacatttatggctgtgactccggggcaaacatagccttcaacgtttccatgcaggttgctgacttggatttagatcctttaaggattcgtgggttggtgatcaaccaacccatgtttggaggggaaaagagaacggcgtcggagctcagatatgcgacagaccaaacgttgcctttgccggtgttggatgtgatgtggaatttgactttgcctaaggggacagaccgtgaccataggtattgcaaccctatgatgaagggaccgcaccttgataatgtgaggaaattgaggaagtgcctcgttgttgggtacaatggggacatcatggtggatcgacaacaggagtttgtgaccatgttggtcaagtgtggggtgcaggtggaagctcggtttgaccaagtagggttccataatattgacatggtggacgttgctagggctagttcaattataaatattgccaaggactttattcttggttga

SEQ ID NO: 77733 - DNA, 801 bp, Glycine max
  Peptide Sequence Number=SeqID_194511
atgtccgaaccaccaccaccttcttcctccgccatggacccctacgacttcctcaaaatcaaactcaaccctgacggcaattccctaacccgaaactacgtcgttccaacagtgcccccttcggccaccaccccctcttccgaaccagctctctcaaaagatatccctctcaacccaaccaccaacacctccctccgcctcttcctcccaaacccccctcccccctctgccgccaaactccccctcataatatacttccacggcggcggcttcatcctctaccacccctcctccctcatcttccaccgctcctgcgccgccctcgccgcctccctccccgccatcatcgcctccgttgattaccgcctctgccccgaacaccgcctccccgccgcctaccacgacgccctcgaagccctccattgggcccaggcccaggcccaagcccaagcccaatcagacccgtggctccgcgactatgtagacttctcaaaaaccttcctcatgggaagcagcgccgggggaaacatcgccttcttcacagccctaaattctctctccctctcactctcacctctaaaaatcctcgctccgacttgtcgacgatcgcatccttccgttaccggcgaacgacctcatgtggtccctctcgctgccagagggcgcggatcgcgaccacgtgtactgcaatcccgacggctgtggataacgaacacggcgacgcgatcggacggttgccgccgtgcttcatcaacggatacggtggggatcccttggtggacaagcagaaggagttggtga

SEQ ID NO: 77734 - DNA, 327 bp, Glycine max
  Peptide Sequence Number=SeqID_194512
gatcatggcttctccacctggctcgcctcctcctcctcctcctccttcagacgcatcatcttccccaccacctggtgctgagagaccagtggtccatgttgatcctgctaccagcaaggccgacggtccccacaggaagaaattaagaacatatttggggattgtggcgtgtgataaggtagacgtcacgtacgagaactggaaggaggtccctactactcagaaggacttgatttgggaggatattaaggcggaatttgaaatcccaaaggcttctgacagtaggacgaaaaagaagttacttaagactgtcggcgagagattaag

SEQ ID NO: 77735 - DNA, 609 bp, Glycine max
  Peptide Sequence Number=SeqID_194513
atgtcttcaaggaaaagaaagagtgtcggttcaaggcccactactcaatatgatacatggagattccattcctttgaggcctggaccagatatactgataatgtgttgggaagacacatattagctgagaggaaagtggaaatctatcacacaaagctggatgaattcaagggcgagttagagaggcgtaactttcacaagcgcctcaccaacttagctaatagtagcattagcctcgcgttggtgaaggagttctatgccaacctctatagtcccgaggggccttcacctaaacaagtcaaaatccaaggccacttaataaggattgatgcagacaacctcaatgcctttctagaaacacatatggtacttgctaagggtgaatctttgcctgcctactcaagatattgtaggatgcctactgacattagagaaattgaggttgcattgtgcatacccggccaagggtttattctaaatgttgaaggtcacccagggaagatcctcagaaaagatctaaccacccttgctcaggtctggagtgttctatcctactccaatctggctctgacctcccacacttcagatctgactatggatcgagctagg

SEQ ID NO: 77736 - DNA, 471 bp, Glycine max
  Peptide Sequence Number=SeqID_194514
atgggaggaggaatagccaggattgggggcacgcctagtatgagggggaccgtgtgttacattgctcctgagtatggtggtggagggcaattgtctgagaagtgtgatgtgtacagttttggggttctgcttttggttctggtggccgggaggcggccgctgcaggtgacagcctcacctatttcggagtttgagagggccaatttgatttcctgggccaggcagcttgctcacaatgggaggctcttggatcttgttgacacttctatccattccttggataaggagcaggcactgctctgcgtcactattgccttgttgtgtttgcagaggtcccctgggaagaggccttccatgaaggaggttgtggggatgcttagtggggaagctgagccgccacacttgcctttcgagttctcgccttcaccgccatcgaatttcccgttcaaggcacgaaagaaggctcggtga

SEQ ID NO: 77737 - DNA, 285 bp, Glycine max
  Peptide Sequence Number=SeqID_194515
atgagccctcgcgctgccctcccgtcgaagggtaggttgcaacagatattaatgatgaccccttcaaaattcttctgtctacatacccctttcacccctacaaagtcctctccaaagaaggaagatgacatagagaaagattgtgagttccaaagacatagaagcccccccgaggcacctccagatgctccttgtggagcttataggccatggatcttcttcatcaatggagtccattgctccttgaagttcaatggcagcggaatggagaatgaagaaagatga

SEQ ID NO: 77738 - DNA, 1176 bp, Glycine max
  Peptide Sequence Number=SeqID_194516
atgccatcgcgtccgccgccactctctcctcctgccaccgccgcatctcatcggcgccaaataatcctctgcggcgcaattggcggcgcgctctttctaacggcgctaataatctccgtcacgattttcatctaccgcaagctctcctactcccgaacggcgccgttcgagcacaaccagcgccgtttctcgtactccgttctccgccgcgccaccaactcgttctcgccctccacaaagctcggccacggaggcttcggttcggttcacaaagcaaccctcccttccggccagaccgtggcgcttaaagtgatggactcgcccggttcgcttcagggagagagagagttccacaacgaactaacgctgtgttcgaatcttaaatctccatttgtgattgcgttgctcggtttttcctcggaccggcgtggaaaaaagcttgttttggtttacgagctgatgccgaaccggagtttacaggacgcgcttctggaccgaaggtgtccggagctgatgagctgggggaagaggttcgacatcgcggtttcggtggcgatgggtttggagtatttgcatcatgagtgtgacccgccggtgattcatggtgatattaagccgagcaatgtgttgctggatagggattttagggcgaagattggggattttgggcttgctagggttaagaatgtggaggatctggaaatggtggatgagaagaagaaagatgaggaatttagtgttttggagggagaaagtgtggtggatgttgaccggtcgccggagagttgtccggtgagggttgcggagtattcggatgcttcgccggtggggggtgataagttaagtgttgtgtctgatggtggggggtgttttgagagtgtggatagtgggagtgtgagtgtgaatgtgaataagaagaagtgtggcggtggtggttcggggagggattggtggtggaggcaggagagtgggggaggaggggaatccgggagggtgaaggattatgtgatggagtggattgggagtgagataaagaaggaggaaccgaagagcgaatgggttgattcgtgttcgtcgtcgtctccaaaggtggagaatgggaatgagaatgagaagaataagaagaagaaggagaggaaaaggttggattggtgggcttcgctcgatgaggagaag

SEQ ID NO: 77739 - DNA, 177 bp, Glycine max
  Peptide Sequence Number=SeqID_194517
atgaagttacattttagcccaggcgagctggatactagcttgggaaaatttagggtgaggaaacaaagtgctcttgggattgggaggtgtgaggtgaagggtgtggttcattcatatgggaaggttgaggggattggggtagatagtcggagtaagtggtgggtgctagcttattga

SEQ ID NO: 77740 - DNA, 312 bp, Glycine max
  Peptide Sequence Number=SeqID_194518
atgggtcctcgtcgatccttgatgactccttcgcattgctcacataatcagaaagatcctcctccttattgtcatcatcaatatagtcctccaaaatgggtgcctaatcaatcggatgtttgggcaagagaaaccctgtcttgtaggagtacatacccttatcctggtactatgggtagactactattcaccataaccggctatgctcttggtgattgttgggattgccaagtcggctacggatgcctccttttcatgaacgtttctggtggggttcatagttggtgcagtgacgtggttaccaaagcatag

SEQ ID NO: 77741 - DNA, 183 bp, Glycine max
  Peptide Sequence Number=SeqID_194519
atgatgacaccaccgtactacctatatgctaggcttgtggcaatagaggatttatctttgctagtgggggaagtgacatcgcttgtaatggttttgagtgacttcgaatcagaggaggaggaagaccccaaggaagatctaaaggagacttcatgtggttattcttctggtggttttgcttag

SEQ ID NO: 77742 - DNA, 201 bp, Glycine max
  Peptide Sequence Number=SeqID_194520
atgtctaccacaaattccatcactaaatgcatacttctcttgtcagggcaaatattttgggggtgtggcctcaaacgagaaggtgctctccctttctacaaagttcattactctctggtaatggtggtgtggcctcaaacgagtggaaagatgttcctgatatttggagatcttctgctgagaagtatggtgataaaatag

SEQ ID NO: 77743 - DNA, 370 bp, Glycine max
  Peptide Sequence Number=SeqID_194521
atggattgcgcattaacacttcctttcaactctcgacatgtcgcggaactttacggattgcctaacgatgggtgtccagtgcctcgaagtggtcaagcgaaggcgcagaatgactgtcgcaatgtgcccttttgcgggcgagcgaaggcgtggctcacgggtgtctttccaaaggaggaaagatgcacggagtcaccaccaacgtttatttgtggaaaacgtcgggaaaaccgaaggaaaccggtcaaaatgaaaattctaagttcaggagttgtatttacgtttgaggaaggtattagcacctctcacgtcaacaaaagcggggctcttgctcctacgtaccctccatcaaagaggaaatccgacctac

SEQ ID NO: 77744 - DNA, 507 bp, Glycine max
  Peptide Sequence Number=SeqID_194522
atgctgaaatttacaacagtccaacttgttgacattgaagacatgaaagtagagtcttcctcatcaacccgaccaaatgagtttgagttcacaacaaagctagacttatctaatgaagaactcgatccctttagtgaggacgaagacaaagtttatatggaagtactaaataaggtcatcgaagacacacttagaaaggaaaacactcacaatattcttgagttcaatcgatgtgacacacgattcttggtccaagagacaataaactcaagagaggtttggcccattggagatttcatagttaagctggatgaaatatggtgtaactgtgacaaatttcaaaagttgcacatgccttgttctcatgttgttgctacttgtaagcatgctcatcctgtatatatgttggaaagtgtctccaacgtatacaaaggattgtttgaagaattgtacaatgaagcctattggccactgtgtcacgagccaatgatctcccccgacccataa

SEQ ID NO: 77745 - DNA, 198 bp, Glycine max
  Peptide Sequence Number=SeqID_194523
atgccggaaatcaaaaggaagcaggcttacgcgatccgtgaattccgtaatgtggcggaaaccaaaaggaggtggtgttacgcaatccgcccttcaggaacattttggaagttgggttgcttaaggaggaagcaactgggcggcaagctcctccacgtttttgaaaaatggttttcggggcttccgcggcttccgtaa

SEQ ID NO: 77746 - DNA, 693 bp, Glycine max
  Peptide Sequence Number=SeqID_194524
atggctggttcagaacctgtaagtgcagagggagagagtatggctgtggatgctgccccaaggaagccccggattctacttgctgctagtgggagtgttgctgctgtcaaatttgcaaatctttgtcattgtttctctgaatgggcagatgtaagagcagtttcctcaagtggatctttgcatttcattgatagagcatcaatgcccaaggatgtaattctatacacggatgaggatgaatggtctagttggaagaaattaggtgatagtgtgcttcacattgagcttcgcaaatgggcagatatcatggtcatcgctccattatcggcaaacacccttggcaaggtgagttcagtcaatgatatgtgttcctatccatcttttggtattcagttttcgtatattgctggagggttgtgtgacaatctacttacatgtattgttcgagcctgggactacagcaagccattctttgttgcaccagccatgaacactttgatgtggaacaatcctttcactgagcggcatttcatctccattgatgagcttggcatttctctcatcccgcctgttacaaagaggttagcttgtggggattatggcaatggtgccatggctgaaccctctaccatttactcaactgtaaggctcttctatgagtcaaaggctcagcaaggtaatggtgatatctga

SEQ ID NO: 77747 - DNA, 432 bp, Glycine max
  Peptide Sequence Number=SeqID_194525
atgtcgactctgcgactcatgctgaccccgccacctatgccgactttatcacctatgttgagtttattgtccatgccacctccaccgtccatgccgtctctgccgtccatgccgactacgcctccatgtcctacaaccgtgcagccattccttgcacccttggcgactccacttcccatgcctgctgcctaccttcccaatctctgccacactcatgccactgtttcatgcaacaagttcttcagtactgttgcttcgtatggtcgtgcaacaacaccaaatgacaaagctctcgaagggagaaacatgacgttgtttgagataggaattgaataccatggacctaccatggttgcatgcaagcgccaaccagctgtgtttgcattatggatggctacggacctagaggagtcttgctggaacagaccatag

SEQ ID NO: 77748 - DNA, 141 bp, Glycine max
  Peptide Sequence Number=SeqID_194526
atgttaggtgctatgagtcaagataatctggttttcgaggaacgagtgccttcagagggaaataaggagaagagaaggaaaggatatgctcataacagaatggattctgcactatggaattggcagacaagcaggggataa

SEQ ID NO: 77749 - DNA, 129 bp, Glycine max
  Peptide Sequence Number=SeqID_194527
atggaaatatgtaatatgtgttctgaaactaagacagttgttaaggcgactcagaaacacgctcgtcttcacgatcctgcgattccgctctccaacgagtctgcgcaggatgaaaaatcgggaggctag

SEQ ID NO: 77750 - DNA, 569 bp, Glycine max
  Peptide Sequence Number=SeqID_194528
aaggatactcagaggtgtacgcattagaacataggcaatggaagattaatagctttttggaagagtatatgattaccctccaaggtatggtatcaggttcacttatattgttgttcatggtccattggtgtaaatcttcccggtatttaccccttcaatttcccaacactcctgaagaactacttgagtccaagtttattgttgaagataaccagtatgactcctcctatggagaggaaactgacttacacctccttatagattgtggagtggtgcaacaaatttggaagcctgctcagagacattctgtacttcctagcagatggcatattttgtttggtgctactatttggagtatttggaaagggaggaattcgaaagtttttaagaataatgagaaactacacttggaagaatgtgggttggattgccctactaatggtatgctcaagttaaatgtggacgggtcgattatccaaggaggtagaaagggttgcgcttatgggcatcctgatagggctgagattggcttgggaaaagggtttcaggaatgtttggttggagtgtga

SEQ ID NO: 77751 - DNA, 924 bp, Glycine max
  Peptide Sequence Number=SeqID_194529
atgactgtttggaaggactatgctattcagcttcatgatgctatcaacaaaaaccacatgcttaaggaaccattgattgttatgctaagcctcggtaaaatccaagatgttacagacaagtatcctctcagtgtccaaaacatcaagtatgggtcgagattgtatgtcaacaccgacattacagagatacaagaattttgtgatagtccattcagtttgtgtgtcccattttactctggtagagtaaccgatgataaaggtgtttctcagtggttccagttgttgttcttgccaaaaccaagtgaactacacagttccaaggatgcaacatgtatcaagatgtttggtaagactgctgcagaatgtcgagaagagttgattgtggctggcgacgagatcaagggagaagcaagtataggaaaggaaggagttgttgagcctgaaagttctccaccaagttaccatcctacggacttcagaagagcgttgggtattcaagaaggcctggtggttcattttgctgcactcgatagaaatacaacctttcatttgcatttcatgccaccactggacagacaaacatctggcaggccttacagtactaccatgacttacgtatttaccgtcgatattaccaatcgtatgatctctactccttcacccctggtgttgccaccttatgctattgatgtcattggacgcacatcccaatatcttactgttgaaccaccccgtggtcgtcagatttggaggatgtctgcccatgatgggctgcaaactctgactacaccttggtaccaattcttgacggacaacaacttgatggctatagatgaggttgtcttttattaccagccaaaccaaggtgtatgggaaatcatcctgaggaaggagatcacttgggatgaagacgagtccccctaa

SEQ ID NO: 77752 - DNA, 285 bp, Glycine max
  Peptide Sequence Number=SeqID_194530
atgtctccaaagaaaaatctcatatctcagttgcataccaaaaaaggaacatggaaaatagttgtccgtgtcactgatctttgggaagttaggaagcaaaatagtaaacaagcaattgacatggtgttgatggaccaaatgaatctgaagattgttgataaccagtctgaatacaaagtgagcccaattgcacttttggtttatttcgtcaaaactacgtctgtgaaggagatcaaccatccagaaatccctcctaatgtctacatgattactccattttgctga

SEQ ID NO: 77753 - DNA, 261 bp, Glycine max
  Peptide Sequence Number=SeqID_194531
atgaatagggtgtcacacattccatcaagtgatgaaagtgaggatgacaattcggaagggtcggatgttgaaaatctaaacttgtttgtgagaaggttcaacaaaatccccatgaaaaagaagaactatggaaccagaacctttcagccaaagaagaatctcaagaaaggtgaatcatcttcctccaatggattcacttgcttcgagtgcaaaaagataggacatattaaggtagactgcctcatctatcaaaagaagtaa

SEQ ID NO: 77754 - DNA, 861 bp, Glycine max
  Peptide Sequence Number=SeqID_194532
atgacaccacctgatatactaagatggttcttaaggaactgtcttcgtttcgatttcgtaaaaagtgatttttctagtagtgaaaattatttcttggcaagtatggagtttactgttatttcgacaaatctcaagacaatattccgcaacccaaaagcaatcaaaccatatgctgttccatcccctgagcactgcaatctaccagcggctgctatgcatacatcttcacatatggttgaggttgttggtttgaatgcaccagcagctcaggttgcacagcacaagtggcaacccaacacacctgatggccagggtacaccatttttctttcaacatggaaaagctacatcaggctctgtgggtgggaatcttacacgcacgttcaaaggtcctgctggaactggcgaagagtggcaatatccccaagcattggctttttctgtttctggaattagaagccaagctattgtttctataacatgtgacaaagaaattataactgaattaactttctctagcagcattagttgcatggaaatttctgttgatgggaggagtgctttgattggaattaattctcaagaaaatggtagagcccataataacagtttaaattcacaatcaagtatgtcaggattatcgaaacgactaacccctaaagatgatgtatttcatgtattgaagctgaaagaaggacaagatatcactgctcttgctctatataaggataacacaaatcttttggtttcaacttgggataagcaattgattatctttactgatccggctttgagcttgaaagtgggcgatcaaatgctcaagtttggttgggaatctaacatcctatttttcataaactaa

SEQ ID NO: 77755 - DNA, 594 bp, Glycine max
  Peptide Sequence Number=SeqID_194533
atgccatcgacccaactgggttgtgcttgggtccccagcgcgacccgtcgtgcctgggtccccgacgcgcctgctacaacagcactacttgtcgcgcctgtacgcagggcacgtccatgtgtcatcttcacgggaaacgcacccttcggagaggtgaacattcatcttgaagaatcacatatctcaaagcttccgtacttacaagcaactggaaaggaaacttttcgcttgcacccacctactccattactgccacgcaagtcagatgttgatgttgaaataagtggcttcatggagcctaaaagtgcacaaattatggttaatgtatgggccatggggagagattcaagtatttggaaaaacccaaatcagtttataccagaaagattcttggacagtgagattaattttaaaggccaacatttagagctaataccctttggagctggaagaaggatatgtactggtttgccatttgcttataggacagtgcacattgtattggcctctcttctatacaactatgattggaaagttgcggacgagaaaaagccccaagacattgatatttctgaggcatttgggattacctaa

SEQ ID NO: 77756 - DNA, 246 bp, Glycine max
  Peptide Sequence Number=SeqID_194534
atggacattgagagggacaaacaaacacagagcacaaaacaacctcaacacatggaaattaacaaaaatctaaaaattgaggtgcctggagaagtggattcgatggaatcaagagtggacattgcgattggagattgtaaagaaacaaaggtggcttgggaaggcacaaagaggaagaagaagacgcaaacatggattgaaccattgccacacaaaggagaaaaagaagaaacaaagcggccatga

SEQ ID NO: 77757 - DNA, 1257 bp, Glycine max
  Peptide Sequence Number=SeqID_194535
atggcttcaattttattccttcaaatttttgtgcagggtttgtacaactaccacaatttgaaggatttagtaggtgatgggattttcgctgttgatggcaagaaatggcgagaacaaaggaagttgttaagtcatgaattctccaccaagatgttaagggatttcagcatttcaatattcagaaagaatgcagcaaaacttgcaaacatagtgtctgaagctgcgacttctaataatacgttggaaatacaagaccttttaatgaaatcaacactggattcaattttccatgttgcatttggaacggaacttgacagcatgtgtggatcaaatcaagaagggaagatttttgcggatgcttttgatacttccagtgcactgaccctttatcgttatgttgatgtcttttggaagataaagaaatttctgaatattggatcagaggccagattaaaaaagaacactgaggttgtaatggaatttttttttaagctaatcaacacaagaattcagcaaatgcagacttcaaacgtagatactgatggtaaacgagaagatattctgtcaaggtttctgcaagtgaagggaagtgattcaacatatttacgagatataattctaaactttgttgttgctgggagagacacaacagcaggcacactttcttggttcatgtacatgttatgtaagtatccttctgttcaagaaaaagcagcagaagaagtaaaagaagcaacaaacacagaaacaattactagctatactgagtttgtgtctactgttacggatgaagctcttgaaaagatgaactatctccatgcagcaattactgaaactctcagactttatccagtaattcctgtggatgcaaagatttgtttttctgatgatacattaccagatgggtatagtgtaaataaaggagacatggtatcttaccaaccttatgcaatgggtcggatgaaatttatttggggtaatgatgcagaggattttagaccagaaagatggcttgatgagaatggcatttttaagccagagagccctttcaagtttacagcttttcaggctggtcctcggatttgtctaggaaaggagtatgcttatagacagatgaagatattctcagcagttttgttaggctgtttccactttaaattgaatgatgagaaaaaaaatgtcagttacaagaccatgataactcttcatattgatggaggtctagaaatcaaggcattccacagatacagggattag

SEQ ID NO: 77758 - DNA, 282 bp, Glycine max
  Peptide Sequence Number=SeqID_194536
atggttggagcattctcgcaaaacatcgtgaccctgactggtctccctatgatcttacttagtgagagtgacctgacaaacccattgtgtggtgtgtcttgttatgtactcctaagcgccccagggtggtttttcactgacatgggtgtcacagagggaggctatgaatgcatgaagggagggggacgaggcgggactcgccaatggaattggcgagttggacacgtggcggcacctggtggactcgccagtggagttggcgagttgctgtccacgtggcgg

SEQ ID NO: 77759 - DNA, 243 bp, Glycine max
  Peptide Sequence Number=SeqID_194537
atgacggaaggccgcaaagggggaaggaggaagggggagggggccgcagaggggaaggagaggtcattactgcaaaaaatgggaggggggagccacaaggccagggaagggagaggggagaaaaaggaatcgcatgaagacattataagtggaggtttcaatctcttctccgtctctctgacgtttgggaattctatcggagcagtcggaggaataactgaaagaatttcagggaaccgctag

SEQ ID NO: 77760 - DNA, 2243 bp, Glycine max
  Peptide Sequence Number=SeqID_194538
gatacactacaaaggttgaggatgggatgatgaaggtgtccactggagcctcaatcattgctaagggaagccgaagcaatgggttgtacatcttggaaggatccacagttattggacaagcatctgttgcaagtcaaacaatggaagataagtttaaattgtggcacttgcgactaggccacatcagtgagaaaggcttggtagaacttgaaaaacagcacctgctgatgggtgataaactccacaaattgcagttttgtgaccagtgtgtcatggagaaatctcacatggtgaaatttgggacagctgaaacatttcagaagttcaaggaatggcatactcaaattgaaaatcagcaaggaatcaagttgaaggtcctaaggacagacaatgggcttgaatttgtctcagatcaattcaatactttatgcacacatcatggaatcaagaggcacaaaacagttgctggtacccctaaacaaaatggccttgcagaaaggatgaatagaaccatcctggaaagagtgagatgcatgcttcttggagcaggtttgcccaaggttttctggggagatgctgcaaacacagttgttccagcagactactctaacctaagggtgtttggagccttggcatatgtgcatgtcaagaaggacaagagtcaagggatacaggctgtggaggagaaaactcatattgaggtagagcctcttactgataaggtacatgaaaacactcagataaatccaactactgacctagacagtacaacagaggaaactggacactcagcttcaaatttaaggagattagatcacgccattaatgattaccaactggttcgtgatagggaaaggagaattcctaaaccaaacagaaagcttggtcaagctgatctcatctgctatgctttagcagcagcagaggaaattgaaggatcagtagaactaaggaatttcaaggaggcacatgaaagtgaggagagacaactttggcttcatgcaatggaagaagaacttgaggcacttaggaagaacaatacctggaggcttgtggaactacctaagggacaaaaggtagttggctgcaagtggatcttcaaaaagaaaggtgaaattccaggggttcagaagacaagatacaaagcaaggttggtggctaaaggatttactcaagttgagggtgtggattacaatgagatatttgcacctgtggtagccttcttacatggagacttggaggaaaccatttacatgaggcaaccaaaaggttttgctgtggatgataggatggagttcaagagatgcagctataataactgtgtttatgttctgcaccaggaggattatctatatctcctgttgtatgtagatgacatcttggtggctagctgcaacaaatgtatgatcaatgacctaaagtcaaggttgaactcagaattcgagatgaaggatcttggggaagctaggtttaggatgcatcagtccaaacctgtgaacacacctttggggcaacacatgaagctctcgaaaagccaaggtccaatatcagatgatgataggaagaagatggatgtagttccttacactagtggggttggaagcatcatgtatggaatggtctgtacaagaccagacttggctcatgttgtgagtgttgtcagcaggttcatggtggaacctagtcaagcacactgggaggctttaaagaggatattgagatatataaatggaactctggactcaggcttactgtatcagaaaaactctcaagatggaacaatgattgaagggtttgtggatgcagattttgcagggtgcttggacacaaggaaatcattgtcaggatatgtgtttactttgtttggaactgcagttagctggaaatcaaacctccagtcagttgtagctctatccaccactgaagttgagtataatgccttggctgaaggagtgaaggaaggtatatggctgaaagggatgctgcatgaattggggattgaacaagagattatccagatacattgtgatagccaaagtgctattcatttggccaatcatcagatgtaccatacaaggaccaaacacattgatataaagcttcatttcattcgtgaagtggtggaatcaggagtaatcaaaattgtgaagattgcatctaaagacaatccagctaatatgttaactaaatccctgccaagggataaatttaagaagtgcttaggcttggtaggatttggctga

SEQ ID NO: 77761 - DNA, 480 bp, Glycine max
  Peptide Sequence Number=SeqID_194539
atgactaaacaaatgcaaaggataatgagacaaaataatgaggagctatatggcaagtttgaaggaataaaaaatcaattgaatcgtgatgttggaggtcctaatgtcgataggaggtggcaggctaggaaagggataagatatgaagaaggaggactgagaaaaaatagagttgaaggagtcaaactaattaaggtcaaactggtagcagctgaattctcaaaatatgcagtcatctggtggaataaatatcaaagggaaaggttgagagatgaggaaccagaggttgatacttgggctgaaatgaggagagttatgaggagatatgtgccaaccagctacagtaggactgtgtgtctagaactccaaaagttgtcccaaggcaatatgagtgttgaagagtactataaggggatggaaatgacattgattagagccaacatagatgaagataatgaggcaacaattgttgttttctga

SEQ ID NO: 77762 - DNA, 276 bp, Glycine max
  Peptide Sequence Number=SeqID_194540
atggaggaaagtgtccccaattgcaagaaaatatcgccttacctccaatttatggttctttttgccaaagaagagaaggttcaagtagctgatgactcgctcagcaaggcagatccactcaacgagtggcatccgcttagcgaggcatacaactcgcttagcaggttaggaaaccctaaaaaagaaagagtcaaagatgtgctcgcccagcgcgtagccagccagcccagcgaggatattgtctcttcttgtgctcagtgcacccagtcttactaa

SEQ ID NO: 77763 - DNA, 405 bp, Glycine max
  Peptide Sequence Number=SeqID_194541
atgcatggggaaatcaccagtgaatccttagccagtgaaggagaacaagaggaagagacagaagaggaagcattagagggtgatttactgattatcaggaggttgcttggaagccagatgtgttcaatcaatggaaagttgtggtctttgacaattgatgatggaagctacactaatgtggctagtttcatattggtgtccaaattaaacttggagactaagccacatcctaagccattcaaacttcaatggcttagtgaagatgaagagatgatggagtataaggatgtgcttccaaaggaggttccaaatggattgccacctttaaagggaattgaacatcacattgatctcattcctggaccttcattgcccaaccgacctgtatatacaagtaatccctag

SEQ ID NO: 77764 - DNA, 1329 bp, Glycine max
  Peptide Sequence Number=SeqID_194542
atgacatgtagaagccttagtaaggagaggaggggagatcctgaacctctagcctacttgttagtgtggagattacttaaatatgatgcccttcaaatttttgccatgggcttatacaactaccacaatttgaaggatttactaggtgatgggatcttcactgttgatggcgagaaatggcgggaacaaaggaagatatcaagtcatgaattctccaccaagatgttaagggacttcagcatttcaatatttagaaagaatgtagtaaaacttgtaaacatagtgtctgaagctgcaacttctaacagtacgttggaaatccaagaccttttaatgaaatcaacactggattcaattttccaagttgcatttggaactgaacttgacagcatgtgtggatcaagtcaagaagggaagatttttgctgatgcttttgatacttccagtgcactaaccctttatcgttatgttgatgtcttctggaagataaagaaattcctgaatattggatcggaggccaaattaagaaagaccactgaaattttaaatgaatttgttttcaagctaatcaacactagaattcttcaaatgcagatttcaaagggagattctggtagcaaacgaggagatattctgtcaaggtttctgcaagtgaaggaatatgatccaacatacttacgagatataattctaaactttgttattgcggggaaagacacgacggctgccacactttcttggttcatgtacatgctgtgtaagtatcctgaagttcaagaaaaagcagcagaagaagtgaaagaagcaacaaacacaaaaagaattagtagctataatgagtttgtgtacagtgtcacagatgaagctcttgaaaggatgaactatctccatgcagcaattactgaaactctcagactttatcctgcagttcccgtggatgcaaagatttgtttttctgatgatacactacctgatggatatagtgtaaataaaggagatatggtatcttaccaaccttatgcaatgggtcggatgaaatttatatggggtgatgatgcagaggattttagaccagaaagatggcttgatgagaatggcatttttaagccagagagccctttcaagtttacagcttttcaggctggtcctcggatttgcctaggaaaggagtttgcttatagacagatgaagatatttgcagcagttttgttaggctgtttccgcttcaaattgaaggatgagaagaaaaatgtcacctacaaaacgatgataaatcttcatattgatgaaggtcttgaaatcaaggcctttaatagatacagggattaa

SEQ ID NO: 77765 - DNA, 381 bp, Glycine max
  Peptide Sequence Number=SeqID_194543
atgacaattgaggaatcaatacatgttacttttgatgaaactaatattacctcctcaagaaaggagtttgttgatgatattgcagatactttggaagatactcaaaatgaagaaaaaaatctgaaaagaaagagagatgatgaagacaaggatgatcaagatgacacagcacaagaaaatgataatcttcctaaagaatggaaaacttcaagaaatcatcctcttgacaactgtcataccctaatttcgtccggggacctttgcttgatgatatgcgacctttctttggtccttgtgaggtgcttggcacccatcattaggcaatttgtgaaattccaggacatgccggaaaaccaaaaaatattgatgcacaatccgtaa

SEQ ID NO: 77766 - DNA, 279 bp, Glycine max
  Peptide Sequence Number=SeqID_194544
atggccaaagaatttgtgaatggctttgttcatcaaaatggcatcgctgtcataacccacaatccccccaaagcttggtatctaatgttttttgtttcttccttcatgcaggcgattccggctccatgcccgcaagttgctgaggacgagtttttaccgcaacacattgacctcaggcgattccggctccatgcccgcaacttgctgaggacgagtttttatcacagcacattgacctcaggtgtttccttcttttttcctttttttcttgatatctaa

SEQ ID NO: 77767 - DNA, 285 bp, Glycine max
  Peptide Sequence Number=SeqID_194545
atggctttgttcatcaaaacggcatcgctgtcatatcccgcaatccccccaaaggcgattccggctccatgcccgcaagttgttgaggacgagtttttaccgcagcacatggacctcaggcgattccggctccatgcccgcaagttgctgaggatgagtttttaccgtagcacattgacctcagcttccttttctctgcgagtattttccgctatggccaaagaatttgtgaatggctttgttcatcagaacggcatcgctgtcataacccgcaatcccccctaa

SEQ ID NO: 77768 - DNA, 487 bp, Glycine max
  Peptide Sequence Number=SeqID_194546
gattcctgaacacaagggatgggttgtccctgtgtggttcagactttataatggattttacaaagatagtggaaatctcaagccacaaggtccaacaatagatgctgatgaagtgatgagtagagaaacaaatgaagtagaattcatgggtttaggtgctactgctactatagacgtagaagaaccaagctctaatacaaaaggaaaaagacaaggttcaacttcttctggtacacattctcacaagatcgaagaaaaagaaggaataacaacttctttggataaaatggccaactcttttgaccggatggtagaaaaaatggatggtaaagtcaatgatgaagatattcaagaagtattacgtgagacaactttgataccagatcttaatagacaacaatgggctaaagctattaaatggttagctgaagatccaaagcagttagctattgtgaaagcccttccaattcgcgaaaagacagattat

SEQ ID NO: 77769 - DNA, 366 bp, Glycine max
  Peptide Sequence Number=SeqID_194547
gagaaatatcaacatcatcgagatgaaatcttacaacgttcgatagaggaagacacatctacacaggattcccctaacactactattaatgataatgaaatatatttgaatattgttggaggtccaaattacaaggggaacgtgtacgacctagcttcatctacttctattgctcttgtggaagaccaaatagaggaaatgcgtgagacaattaataaattgaatgctgagcttttggcaaaggcaaataaggagaagacacttgaggaaaagatgttgcaaatgatggagaatcatgaccaccaaagtcaggagatgagacaacagatgcaacaacaaaatgagcaaatgcaacgtatactataa

SEQ ID NO: 77770 - DNA, 417 bp, Glycine max
  Peptide Sequence Number=SeqID_194548
atggatatcaacttagcctatagttacctattagggcatttgatcatagtctcgggggaggaagacattcttgttagttgtccttcttctacaccctatgtggaggtcgcagaggagtccttggagacggcctttcaagcattggaagtagtgagcaatgctcatgtggagtctccccaagtgcaactgccctcatccgatgctgcattgatggtagcccgtgtgatgttggggcatggatacgagcccagcatgggtttgggctggaacgaagatggtgtggcgagcttggtagagttcactggcaaccgcggaaggttcaggctgggatatgaacccacacgcaccgacttgaggaggatttccctagaaagaagaggaagaagcattgggtcggttgcaaggaaccgtaagtga

SEQ ID NO: 77771 - DNA, 255 bp, Glycine max
  Peptide Sequence Number=SeqID_194549
atgatgactcagaaaaatggaaaaagttccccggcaacgacgccaaaatacttgttcgcactctgggatactacttgtttgtgtggatgcgaaatctaccagcaagtgcaccgggtagtcaaatatctaaaggcgttgggtcctcttactgagcaaattgatgtaattaaggatgtttctctaattaaagatgtttatgtgttctatgctgaaggctcaagtactaaacaccgatgtctcgtgagtttagcctaa

SEQ ID NO: 77772 - DNA, 264 bp, Glycine max
  Peptide Sequence Number=SeqID_194550
atggcacctactaggcaccctttggacccggaaaagtccaatagggccctgggatttccagttttgatcacgggcctcttccagttctacggagtgcatgtcacccccagcaaggtaatccggccgccaatcacccgagccttcatcgagaagtactgcacgcctaggcaggtgcagggtgacgcacatcagaccgcgggtgcatcgccaccacctcggcaggccgattcggctggaccactgagtgtggagcagtatctatag

SEQ ID NO: 77773 - DNA, 222 bp, Glycine max
  Peptide Sequence Number=SeqID_194551
atgtggctccgcatgccaccagacccttgggtcacggtaacaaaaagtggggtggtcgacaaaagcaaggcttttgctcctacgtatcctcaatttgtgatgaggaactcaaacctacgtagttcttgccaactcatttcatttctaaacgaccatttagaggaaacactgggtccaacaaagataggagaaaatcactcaaagtgtatcaatctcacacag

SEQ ID NO: 77774 - DNA, 1734 bp, Glycine max
  Peptide Sequence Number=SeqID_194552
atgaagggcgtcgagcgcggcaccggcctgcgcatgagccaggtgagcgagcaggagctgcggtgcgaccccgatcgcatcgcggtggcatcagggccgaacctcgccctggagatcgccagggagcagccgacggccgcggtgatctcctcccgcagccaggagaccgcggagatcgttgcgcgtgcggcgcgcaacggctacttccgcaccttcgtgaacacggacgtcatcgggaccgagttcggcggggtgctcaagaacctcatcgcggtcgccatcggcatcgtcgacggggtcggctacggagagaacaccaaggcctcgatcatcacgcgcggtctggtcgagatgacggacttcgcggtggccaacggcgcgcacccggagacccttcaggggctcgcgggactcggcgacctgatcgccacctgccagtcgcccttgagccgtaacaacacggccgggcgcctgctcggccagggctacagcttccaggacgtcgtgaagcagatgcagcagacggcggagggactggcctccgtggcgccgattctgcagctcgcgcgcgaatcggaggtcgacatgcccatcgtcgagcaggtgaagatggtgctcgacggcaagatggaccctcgggacatcgcaccccacctgacgacggacgacgacaccccgcagggtgagaggaccaaccatggacaagcagacggtggtggtgctcttcggcgggcgctccagcgagcattcgatcagttccgcaacggcggggggcggatcacgcgggagggcgccttcgtcctggaggatgacgaccccgcgaagttcccactggatgcggagcacctcccggaggtggtcgacaacggcacgcgcgtgctgtggccggagccgggcggtgaccgcacgctgcgcgtcgtccgggcggaccgatcggtcgaggatctcggcgcgatcgacgtggttctgccgatcctgcacggccctcacggcgaggacggcaccatccagggctacttcgacacgctcgaggtgccgtatgccggtggtggggtgctcgattccgcgctgtgcatggacaagcacttcatgaagatcgccctccaggccgcgggcatctccgtcgcggcctgggtgaccgtgcgtcgcggcgagtgggacacggaccgggagtcggtgcgcacccgcgccgccgccctcggcctgccgctgttcgtgaagccggcgcgtgcgggttcgagcgtcggcgtctcgaaggtgggtgccctggacgagctcgatgcggcgttggccatcgcgttcgccgaggacgacaaggtgctgatcgaggccggagtgagcggccgggagatcgaggtcgccgtgctggagagcgccgacggtgtgcgcgcgtcgctgccgggtgagatcgtgctgacctctcgcggtttctacgacttcgagggcaagtacctcggaggcgacggcgtcgacgtcgtgtgcccggccgagctcaccgacatcgaggtggcggctgtccaggcggcggggcttcgtgcgttcgcagccgtcgatggccgcggtctcgctcgtgtcgacatgttcttgacaccgtccggggaactcgtcgtcaacgagctgaacaccatgccgggattcacgccgatctcgatgttcccgaagtgctgggtggcgtcgggtctgagctacggcgacctgatcaccgaactcgtcgaggcgggcctgcgccgctga

SEQ ID NO: 77775 - DNA, 354 bp, Glycine max
  Peptide Sequence Number=SeqID_194553
atgacttaccttcctaatctgcacatctctagggcaattgacactaagatggttactaatagagcctatccatgtctaacagtgtgggatgctgccaagaaaaaagacgcttatgatgcgaggaaattttggagtcagatcgtgtggatggactctcaaaaagccttcacctctggctatgatggaagtgataatgttgtgcaccacaagattgttcaggtgttacatcctactaggaagtatcactttgatgatgcttgtgtctgctttactaaagatgatgacgattattcctgcatccaacatcttctcaagcttccaaccattcagtttgaggggaattacaatttatag

SEQ ID NO: 77776 - DNA, 447 bp, Glycine max
  Peptide Sequence Number=SeqID_194554
atggtggaggttgtgaaagtggtggaggtattggagccaaggattatggtggaggttcaagagaggcaggacgacatcgaggttgaagaattgggttgtaatggcattttgcatacagaggcagaattgcttattctcttgtcattgatgttctacaaaggactccattggttggacaatcatatcttgaacttgatcaagagtgacggtggcgggatcttgaaagtgtggttcaacttcatcaaccataattgtgttggacacttcaccagtcttgtctataacagcagtgtttctaaggtcaatgatgaccccacgtacaatggtgtcatccataactttagcagatgctttagcttgggtgatggcaaaaacttctctttaagtaatggtagcagtagcaataacatcttcttcaaatctcttattttgttgagattcatatag

SEQ ID NO: 77777 - DNA, 522 bp, Glycine max
  Peptide Sequence Number=SeqID_194555
atggcattgtttgtagataaaatccttgtcattcagagcttgacacatcgccttatccttctatggagtaaaggagaattggacatagctcaggttgagcaaactagtataaaccaagtgtttctacttctctccataaagattttgagggctggcttagatgactttgacatggtgcaacagctaatggttcataacccagaagaagaagaaaaaggcctcatcatgaaagtgtgggtttctagtggtgggagaaaacaagaagacgaagaagaagaagaagaacaccgtcttagaaagcttactttcgaagacaatgctggcataagcactgacgtagaaaacaagtctttcttagacggtgcttacatcaacaccttcttagaaagctggatttcaaagacgttgctgacattaaattcaagacaatacttcaagattacaagtcacaacatcaagatgatcactagtatattaggaagggaattcctaattgaattagcaaaaggtttggccaagtaa

SEQ ID NO: 77778 - DNA, 750 bp, Glycine max
  Peptide Sequence Number=SeqID_194556
atggttgagcaattgaagagaaagaaaacaaggacgaaatcccaaaaagaagaaaaggaggaagaactacttgtcagggagcatatggtgaagaaaagatataagctatctattgcatccacccttgtgcgtccaacgactacaacctcagtcccacaaaggtggaaagacttaagtgaaactgatgaagaagacgaagaccttctacaagtagtccttcaaaagaggaaagcagttgccttggtttctcctaccccaaaaagggataagaaagtccaaccagcctctaaaccatgggtatatgtcatcccctctaggatacaaagacatatcaagacaagggcaaccaaatccaaccccaggattagtaacaaggagtgggcagtctccttcactagaaataaaaaggacaaagccttatcatcatcaggtaagagattcagaagggtttctccaagggaacctttaaaagatgctcagaggtttcctctagtattcattaacagtaatcctacacctaaaaccccatactttgagtttatatattttgaacctgttgcaagggaaaccatcaatgtccaaccacctacatggacgaagcatgactctaagcacactccatctaaggcctttaaggctctaccaaaaaatgccatagttcatcttcctcttccacaatggactcgtccaatgcagcctaatgttatcaagatgcctcctcactggcttgcatctggtactcatcaatga

SEQ ID NO: 77779 - DNA, 435 bp, Glycine max
  Peptide Sequence Number=SeqID_194557
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaact

SEQ ID NO: 77780 - DNA, 637 bp, Glycine max
  Peptide Sequence Number=SeqID_194558
gctcggtggcatcaggtaaggcagacatcgtcatcctcaattacaacggttgagcgcattggcagcgccggaaagagctgggttgcgatcgggcgcaacaaaccgggcagaaaatccgcaatgcagtgcaggcttgctgcagcatgctcacagaattttgcgcggtggattgacgcgccgacggcaaatcaccatgatcgcgccaggattagtcaccccggagccacaaggtgtcggaactcaggcaaagtggcagattatatcccggcgctggccggcgtggatgccgatcaactgggcatcgccattgccaccgccgatggtcgcagctatcaggccggcgatgcgggcacgcgcttttcaatccagtccatctccaaagtcctgtcgctaaccgtcgcgctgacgctgtacgaggacgccgagatctgggagcgcgtaggcaaagagccatccggccaggcattcaattcactggtgcagcttgaactggaacagggaaagccgcgcaatccattcattaacgccggcgcgctggtgatgtgcgatttgctggaaagccggctcaccgcgccgcgccagcgcatgctggagtttgtgcgtcgtctggcacagcagccggacattcagtatgacc

SEQ ID NO: 77781 - DNA, 903 bp, Glycine max
  Peptide Sequence Number=SeqID_194559
atggattctgaattacttagcatattaccccctatcatgtcctttttcctcttcatgattgtggcactaaaaatagggagcaatctcaagaaaactgagtcatctccaaacatacccccaggaccatggaagctaccaatcataggaaacatacatcatcttgttacatctgcaccacaccgaaaattgcgagacttggccaaaatgtatggacccttgatgcatcttcaacttggggaggtcttcacaatcattgtttcctcaccagaatatgctaaggagataatgaagacccatgatgtcatctttgcatcaaggcctaaaattctagcatcagatatattgtgctatgaatccacaaatattgtcttttcaccgtatggaaattactggagacagctacggaaaatatgcacactggagcttttcacccaaaaacgtgtcaactcattccaaccaacaagagaaaaagagctcaccaatctcgttaaaatggttgattcacataaagggtcgcccatgaacttcactgaagcagtacttttatcaatatataatatcatttcaagagctgcgtttggcatggaatgcaaagaccaagaagaattcatatcagtggtaaaagaagctgtaacaattgggtcaggttttaacataggagatttgtttccttctgcaaaatggcttcaacttgttactggtctgaggcctaagcttgaaaggctgcatagacaaattgaccggatactggaaggcatcatcaatgaacacaaacaggcaaattcaaaaggctacagtgaagcgaaggaagatttggtggatgttctcctaaaattccaggatggtaatgatagtaaccaggacatttgtctatctattaacaatatcaaggctataatcctg

SEQ ID NO: 77782 - DNA, 604 bp, Glycine max
  Peptide Sequence Number=SeqID_194560
ggatcgcgcccataagacgcccagtggacccaaagaagtccaacagggccctagggtttctagctctggttatgggcctctgtcagtcctacagggtgcccatcccccagcgagatcatgccattgtgacatagggatcgcgcccacaagacacccagtggacccgaagaagtccaatagggccctggggtttccagctcttgtttcgagcctctgtcagtcctacagggtgcccgttcccccagcaaggtcatgccatcgtgacataggaatcgcacccacacaaactcccaatggacccagagaagtccaacagggccctgggggatcgcgcccgcaagaaacccagtggacccgaagaagtccaacagggtcttggagttgccaagctctaattacgggactctgtcagttctacggagtgcctgtcgcccccagcaaggtcatcaggccctctactaatcgagctttcatcaagaagtactgcgtccccaggcaagcgcagggcgaaacaccacagcaacctggggatggccggcaatgggcaacagatgcaccgccatcacttctagagttcacctcagctcatccacaaaaaggttag

SEQ ID NO: 77783 - DNA, 1089 bp, Glycine max
  Peptide Sequence Number=SeqID_194561
atgacactagaggaggcatggagcggaagaaaaccaacagtgggccacttcaggatatttggatgcattgcttatgcccatattccaaataagaaaagatcaaggcttgatgataaaggtgaaaaatgtatctttcttggtgttagtgatcagtcaaaagcgtataaattgtataatcctaccactaaaaagatcattattagtcgtgatgtttttgatgaagaaagattttgggaaaataacatagatgaaacaaagcaaattcttgcaaactttgatgaagataatgaagatgaagagttgcagacaagggagctagaagaacaacaaattctagcaatcacagttgaagatgaaagacctcaacgagtaagaagaaggcctgcatggatgtctgattatgaggagttgtgtgatcttccaaatggacataataccataggagtgaaacgggttttcaaaacaaaactgaatgaaaatggtgaagtggataaatataaggcacgctcggtggccaagggttacaagcaacagtatggggttgattacatagaagtgttttcaccagttgcaagacatgatacaatcaggtacatggagaatcctacagaaatgcatttacttgttgctaaaagaatccttcgctacttgcaaggaacaagagaatttgagttgttttataagagaggtgaaaagttcaatctgttgggattcactgatagtgattatgatggagattcagatgacaggaaaaaatttgtagcagtttcagcatgtgcttgtcaaacaatttggctaaggaatcttcttgaagaagtttacttcaagcaacaaggtccaactctcatctattgtgataatagttccaccataaagttgtcaaagaatcctattatgcatggaagaagcaagcacaaagatgtgagatttcattttgcaagggacctatcaaatgaaggaattattgatcttatctactgcaagagtgaagagcagattgctgacatcatgaccaaaccattggagttgtctgcatttcagaagctaaggaatttgcttggagtttgcatgcttaatgaatctcattaa

SEQ ID NO: 77784 - DNA, 276 bp, Glycine max
  Peptide Sequence Number=SeqID_194562
atggctaagcgtaccctatgcgctaagcctaagtgtcattctgatgaggctgagctaagcgcgccatgctgcgagtttgacgagttcaaggaggaactcaagagaagacattgggttgagaagttaactgattttgctgacagtagcataaacattgctattgtgaaggaattttacgccaacctctatgaccccgaggataaatcacctaagcaggtgagggtgagagaccccgataattttggaggagggggagaatttgtgtacttattctag

SEQ ID NO: 77785 - DNA, 633 bp, Glycine max
  Peptide Sequence Number=SeqID_194563
atgccttctcctgcacccaccatgctctccaaatgcaccgtcttcccagaccaaaagtccactctgggaaacctcaaactctccgtttcggacctccccatgttgtcctgccactacatccaaaagggatgcctcttcacccaccccaatctcccactccactctttaatccctctccttaaatccgcactctctcgcactctttctctctttccccctctcgccggccgtttaatcaccgactcccacggttacctctatatatcttgcaacgacgccggggtcgatttcatccacgccaatgccaccggcctccgcatctgtgacttactctccccactcgatgttcctcaatcttttaaggacttcttctccttcgatcggaaagtcagctacactggtcatttctctcctattctcgccgttcaggtcaccgaactcgccgacggcattttcatcggctgcgccgtcaatcacgccgtcaccgacggcacctccttctggaatttcttcaacaccttcgctcagttctccagaggagccagcaattgcatccgcaatacaccggacttccgccgcgactcatttctcatctccgacgccgttctccgcctaccggaggacggtcctcag

SEQ ID NO: 77786 - DNA, 594 bp, Glycine max
  Peptide Sequence Number=SeqID_194564
ctgtggatggccaaaatcccgagagtcctctggacttagctccacttccagctactcacaactttagtggagatgcgggacaatttgctaagctcaagcctagagctgatggaccattcaaagttctcaaacgcatgggtgaaaatgcctacaagattgaactaccagctgagtatgagcatgtgagggaaatgccccgggtaccgaagttagcggatagagagggcggcgggtggagggagcttcacttaccgagagggatgaattcgagtagtagggatggatggcatgtctcattagctggcactggctttggacacagggggcaggctatttggctagaatattatgcctttctatcccttgattcgacgagagctttcccagagattctcatagatcggatgatcctgagacctattgtacctcagttggggaatcttccagcgactaagctatttgtctggccaggcgcttctctgtgggctcttgggaaacagtctcatctgtgcgcggtgtcactgcagcaagcgtatgcaggttccgaatctccgaagactctgttaccttttcctgtctcgttgacgaggtcag

SEQ ID NO: 77787 - DNA, 374 bp, Glycine max
  Peptide Sequence Number=SeqID_194565
atgctttctcatcagggtggacccttgggtactagcaccctctccttcagaggactgcacgtcctcaccttcagagggctgcatgccctcgcgttcggagggctacacgccctcgcctttaaaggactacatgtcctcgccattagaggactgcacgtcctcgccttcagaggattgcacgtccttgcctccagagggcttcacgtcctcaccttcagagggttacacaccctcatcttcagaggactatatgtcttccccttgagaggactacacgtcctcgccttcggagggcaacacgccctcgcctttagagggcaacacgtcctcgccttcggagggcagctcactccctcacctttagagggctacgc

SEQ ID NO: 77788 - DNA, 561 bp, Glycine max
  Peptide Sequence Number=SeqID_194566
atggcttcgaacaaaaggcatttcacggaggaagacgacgatcctcactcgttctccaagaaatcgaaggaatctgaatctgaatctgatgcatccccttcttctcttcgcatttttctcaatcctgcggactatgacttgggtattcattctcacttcactatcattcttgtgtgggattacataagtggaaagctgaagaaagatctacagtaccaggctgatgaagtgttcatgatgcatgatgatgttgtgctttgtgtagactttagcacagattcagaaatgctttcatctgggtctcaagatggaaagattaaagattttaggattagaatcccttcatccatacagataacccagccaccccaccctgtatttgtacctccttattcttccctcatcttttctggctaccaagtttggcgtattaggactggtcagtgcttacagcgtcttgaacgtgttcattctcaaggtgtcacaagtgtttccttctcccgtgatggaagccagttattaatcacttcatttgacagcacagcaaggtttttcatttaa

SEQ ID NO: 77789 - DNA, 1689 bp, Glycine max
  Peptide Sequence Number=SeqID_194567
atgtggatttattgcaggcctttaactaaaggtcagagaggagaggtatatgaggttaatggagatcgagttgctgtcatcttggatattaatgaagatagggtcaataagggcgaggtggagaatcttaatgatgatcatacaaaacccccaatttattggatacatgttaaggacattgagaatgatcttgatgctcaatcacaggattgctacatagcagtggaggctttatgtgaggttttgcatcacagacagcctcttattgtctattttccggacagttcacaatggttacataaagccgttcctaagtcaaacagaaatgagttttttcataaggttgaggagatgtttgaccggttatctggccctatagtattcatttgtgggcaaaacaaagttcagtcaggatcaaaggagaaagaagaattcacaatgattcttccaaactttggacgtgttgctaagctgcctctttctctgaagcgtttgactgagggaattaaaggggacaagacatcagaagatgatgaaattaacaagctcttctccaatgttttgagtatgcatccacctaaggatgagaatctgctggcaacatttaagaaacaacttgaggaagataagaaaattgtgacttcacgtagtaatttgaatgtattacggaaggttctcgaagaacatcagctatcatgcatggaccttttgcatgtaaatactgatggcatctttttgacaaagcataaagctgaaaaagtggtaggctgggcaaaaaatcattacttgtcatcatgcttgcttccttctgttaaaggagaaagattgtgcctacctcgtgaaagtctcaagattgaagggccaggaaactatgtcacggaagccttctcaaagcctcaaggcatgaaccttgcaaaggatgagtttgagagcaatttcatttcagctgtagtacctcctggtgaaattggggtgaagtttgatgacataggtgctcttgaagatgtgaaaaaggcacttaatgaacttgttattcttccaatgagaaggccagagcttttctctcgtgggaatctgttacggccctgtaaaggaatattactttttggtcctcctggcactgggaaaacccttctggccaaggcacttgcaaccgaagctggtgcaaattttatcagcataactggttcgacccttacttcaaagtggtttggagatgctgaaaaactaaccaaagcgcttttctcatttgccagcaagcttgctcctgtcattgtatttgtcgatgaagttgacagtctgcttggagctcgaggtggtgcttttgagcatgaggccactagaagaatgaggaacgagttcatggcagcttgggatggattgaggtcaaaagaaaaccaaagaatccttattctgggtgcaactaaccggccatttgaccttgatgatgctgttattcgtcgtttaccaagaaggatatatgttgatttaccagatgctgaaaatcgaatgaagattttaagaatctttcttgcacaagaaaatttgaattctgattttcagtttgacaaacttgctaacttgactgatggatactctggcagtgatttgaagaacctctgtattgctgcggcatatagacctgttcaagaactcttagaggaagaaaagaagatctggatgctgtaa

SEQ ID NO: 77790 - DNA, 354 bp, Glycine max
  Peptide Sequence Number=SeqID_194568
atggatcgctcaagagtgtttgtagcttttgtggacatgaataagaggcttatgggtctgagcctagcgtactacagcagcatgatgtgtcaatggatgaggcatttgtatcaaaaggtgaagaagttcaacccaagacccacttcccaacaaccatatgtagaaacaaacttcatgatgatgaaccaagcaattttgatgatgccaaaagcccaagtgattgattcaagacttcaagatcaagcatcaagaatccaatccaagattcaagattcaagagaagaaatcaagaagcagcaaagtgattactctctggtaatcgattaccagttatcagtaatcgattaccagtga

SEQ ID NO: 77791 - DNA, 1308 bp, Glycine max
  Peptide Sequence Number=SeqID_194569
atgtacttgaggagaatacaatgcagagatcggacatgggctttggtgttgcagccattgaaatacttttttaggccaagattctctgatcaacgatgttttcaatctttgtcccctaagaccactgtgaaagaatatgcttcacacggaaggatcatcagaaaacatcttttaggtttagattcatgcaggcatacttcatctagaaatagtttcaccgttccggacagaaggcctagtttatgtctaaacagtactcagttacgtgcctatagttctgaaagtgatggaagaaatgcaagtgaggataagcatgcacatgttaatgatggagctaattttgataaaggacggaaacaagacaagtttgggaaagatgtcaagtacagcaattcacatgctcgacttggagaacaggaacaagaggaatggcttaataatgagaagctttctatagaaagtaaaaggagagaatcaccatttttgacaagaagggataagtttaaaaaagagtttatgagaagaattattccttgggagatgataaacatttcctgggacacatttccttatcacattcatgagaataccaaaaatcttctggtggaatgtgctgcttcccatttgagacataataagcttgcttcatcttttggcagtcgcctctcatcttcaagtgggagaatattgcttcagagcattcctggaactgagctgtatcgagagagattggttagggctcttgcacaagatttacaagttcctctgttagtgcttgataacagcattcttgctccttatgatattgatgatgatttatcatcagattatgagtctgatgaggataatgcagagtctggggaggagggctctttggaatcagagaatgaggatgataatgatgctacaaatgaagaagagtgggctagcagtaccgaggcaaagtcagatgcaagtgataatgaagatgcaatagcggctgctgaggcacaccttaagaaggttaaagcagctgttcttcggaaacttgttccttacaatgttgaagaattagaaaaggaagtgtctggtgaatctgagaattctgagtcatccaagtctaatgatgtcaaatcttctaatgaatctggatgccagctaagaaaaggtgaccgtgtgaagtacattgggccatctgttaaagttacagatgaggatagcaaatacgtggttgtaatagtggcactattggtaattatagaggaagtggtgatactgttggataggggacatagtgcccaagtaactgtgaagcccatgtacaattag

SEQ ID NO: 77792 - DNA, 459 bp, Glycine max
  Peptide Sequence Number=SeqID_194570
atggttgttgcccacaagttgtttgatacaactgctctttctaatcttgtttgttggaacaccatgatatgtggttttgaccataatcaaatgtttgagaagtcattggagatgttttgtgggatgcatttgattggtgttgagcctatgagtttagttatgagagtgttctttcggcttgctatctttgcgagctccaatattttgcaaacaaggacgaagaacttggagatgggggcggaccaagggctaggcggcgaggaccagggtggagaggagttccaaagggtcatagcggcaaactccgtcatgtcattcccaacagcgagaaagggagaaaagagtaaacagagaatagggttgtccaaagggacagattgcaaaaagaaacaaaaatataagcatacatgtgtaattccagtcatgcaaaaatcacacgtggactgtctgcgtggttag

SEQ ID NO: 77793 - DNA, 972 bp, Glycine max
  Peptide Sequence Number=SeqID_194571
atggcgtatagaactttaagtatcacaagttttgtaatattcatacttgtgttgctaggcacaatatgtgatgcaaaattgtcatcaacattttatgacaatacatgccccgatgcacttagcacaatcagaactgtgattcgtagagcagtttctaaggaacgccgcatggctgcttctctcatacgccttcattttcacgattgttttgttcagggttgtgatgcatcaattttgcttgacgatagcacctctatcgagagcgaaaagactgcgcttcagaatgttaactcagtaagaggatttaatgtcatcgatcaagcaaaaactgaggtggagaaagtatgttccggagtggtgtcatgtgctgacattatggcagtagcagcacgagatgcatcatttgctgtgggtggtccatcatggactgtgaaacttggacgaagagattctaccaccgcaagcaaaagtttagcttctagtgaccttccactttttacagacgatcttgacactctcatctctagattcaatagcaagggactcactgccagagacatggttactctatctggtgcccacacaattggacaagctcaatgcttcacatttcgtggaaggatatacaacaatgcaagtgacattgatgcaggatttgctagcactcgtagacgtggttgtccttccctcaataacaatgataataataagaaattggcagcactggacttggtgacgcccaattcatttgataacaactacttcaagaatttgattcaaaagaagggacttcttcaatcagatcaagttctatatagtggaggatctacagattctattgtgtctgagtacagcaaaaatccaacaacttttaagtctgacttcgctgctgctatgataaaaatgggagatattgaaccattaactggatcagctggaatgataagaaagatatgtagctctataaactaa

SEQ ID NO: 77794 - DNA, 993 bp, Glycine max
  Peptide Sequence Number=SeqID_194572
atgacaacaacatcattttctggcttgcaatttgcaatgtcaagatcatgcattccttcatcacaaaagattgcagatgcaggggctgtggttcttggcggcaagtccaagattgggtcgtggaataaacttgcaagtgcatgtcatattgcatcagtgcaaccttttgggcggggcttcacttcatcgtccataaaatctgtcaaaagtgtcacaaaggctatgactgagtccagtgcacaaagtgcagtctcaggattgccaattaatctgaaaggtaaaagggcttttattgctggtgttgctgatgacaatggatatggatgggcaattgcaaaatctcttgctgcagccggagctgaaattcttgttggcacatgggtacctgctctgaatatttttgagtccagcctacggcgtggaaagtttgacgaatcacgcgtattaccagatggttcgctgatggagattaccaaagtttatccattggatgcagtttttgacaatcttgatgatgtgccagaagatataaaagcaaacaagcgctatgccggttcatctaaatggacagttcaggaagttgctgaatctgttaaagaagactttggcagcatagatatccttgtgcactcacttgccaatggaccagaggtgaccaaaccattgttggagacatctcggaaaggatatcttgctgcaatatctgcatctagtggatcttcaatctctctgacatacattgcttcagaaaggatcattcctggatatggtggtggtatgagttctgccaaagctgcactggagagtgatacacgagttcttgctttcgaagcaggaagaaagcgcaaaattagagtcaatactatatctgctggtactggtgacctctctcttttccaaattaataaatttctgttttccttgtcttgctatgatttcttaatgtggaagacatggtggcgggggcaaatgtttgtcttgctttgtctgtga

SEQ ID NO: 77795 - DNA, 1947 bp, Glycine max
  Peptide Sequence Number=SeqID_194573
atgcacacgaggctaaagaaaataggacaaataaacattatgcacgatcgacggttcaaactgatgaggcatatctcgagcctcatagaggtgcatcacgctcttgtattgcgcttagggggaagtgcaccctctggcttcaactatggtgatgcccttgataagagtctcatgttctttgaagcacaaaggtctggtaagttaccactgcagcagcgagtcaagtggcgtggtgattctggtctccaagatggttttcaacaaagagtagacctggtgggtgggtactatgatgcaggagatcatgtgaagtttgggttgccaatggcctacagtgtcacaatgcttgcatggggggccattgagttcaacaaggaaatcacggacttgaaccaaatgggacacgcattatgggcaattaaatggggaactgactactttatcaaagcacacactcagcctaatgttctttggggacaggtgggagatggagtttctgatcattactgctgggagcgtgctgaagacatgacaacttcaagaggtgcctacaaaattgatgaacaacaccctggctcagatctggcaggtgaaactgcagctgcattggctgctgcagctatagctttcaggccctacaactcttcttactctaatctcctcctagttcatgcaaaacagctcttcacattcgcagataggttcagaggtctctatgataactccatatcaagtgctcagcaattctatacttcttccggttactcggatgaattgttgtgggctgccacttggctgcacctagcaaccggcaatgaatactacataaagtatgtagtggacaatgctgtgtatatgggaggaactggctgggctgtaaaagagttctcttgggacaacaaatatgctggtgtgcagatccttctatcaaaggtgttactagaaggaaaggctggtgcttactctgctacactaaagcaataccaggccaaggcagaatattttacctgtgcttgcttgcaaaagaatgatgattacaatgtccaaaaaacaccaggcggcttactatacgtgcgtgaatggaacaacatgcaatatgtttcttctgctgcattccttttagctgtctactctaattacctctcagcaacaaaatcacagctcaactgtccagatggacaaactcagcctcaggagctcctcaattttgttaagtcacaggctgactatatccttggtaaaaaccctgcggatgtgagctacttggttggatatggagcaaaatatcctcttcatgttcaccacagaggcgcttccattgcttcagtctttgctcttcactatgacgttggctgcacccaaggatttgagatgtggtataaccgtgctgagccaaatcctaatgtcatctgtggtggcctcgtgggcggtccagataaaaatgatgacttctctgatgaaagatccaattatgaacaaactgagcctacaatttcaggttctgctcctcttgtaggcatcttcgctaaactgcaaagtttgtatggtaatataggtgaaggttacaaccataatgaatcaccagtgccccagcaaaaaacaccaagtacaaatccagggaaaacaacaatgtccaagacatcatcagaatcagaaggtgccccagttgaattccttcactcaataagtagctcatggactgttggaggagcaacttattaccatcacagggtgataatcaagaacacttcttcgaagccaatctcagatcttaagttggtgattaaggatctctcaggctctttatggggactctcgccaacagaagaaaaggacacctatgaacttccccaatggaacaaggtcttgaatcctggctccgaatgtatatttgtatatgttcaaggcggaccccaggctacagtctcgattaaaagcttacattga

SEQ ID NO: 77796 - DNA, 354 bp, Glycine max
  Peptide Sequence Number=SeqID_194574
atgatgaaccgcggaaattctactggatactatgtccaggattatcttacttataaccatgtcaatggcaatcttcgtacagcaccacaaaatagcagcatcatttttgggtgtggtgctgtacaatctgtgacattcagttcatcttctgaagaagcccttgatggaataattggttttgggcaatcaaattcttctgtgctttcacagcttgctgcatctggaaaggtgaaaaaaatattttcacactgccttgacaatattcgtggtggtggaatatttgccataggggaagtggtggaaccaaaagtcagcaactccattggtaccaagattgtatgtgctgtaacctag

SEQ ID NO: 77797 - DNA, 375 bp, Glycine max
  Peptide Sequence Number=SeqID_194575
atggggagcttcaatttcaaatttaaggatttgtctacggtgaagtctttaaagagtggttcacagtggcttatcagaaattaccggttacagcaggtaacagccggtgtgctgaaacagtatgctaaaataggtcttcaaaactcagatccgcaaaactccgatctgcaaaacagaggtgacgaacagagaaggggaaggattgccgcgcgtacaaacttggacggagaaaaaacaagaaaagaggatcagatccggactcgagggaggacgcagacgaagattgtggataggataaaaacggtggagggtggtggtggcggccatttcgtcttctttctgcttatcttcttttccattttcgaagcccattag

SEQ ID NO: 77798 - DNA, 2118 bp, Glycine max
  Peptide Sequence Number=SeqID_194576
atggagaaagaggaagagagggaagaaatgtctatgtttgatgagacaacaataagagcacagagagctgcaaggagtggaaactggagattgttcaagagaatattggaggaagacaccaagcgtttgctggagccttttgacttgtttggaaacactgccattcacattgcaactcgctccaacaatccatggctcctccatgagttgttggaagtgctacctgcaaaggacaggtggcatgccctgaggatggggaattgcgtgaacaacacccttctccatgagaccatcttttgtactagggtggagatggctggcgttgtgttcaagtttgagaaggaggcgccgccggaggacgcaccggaagaaaagaaagggttgccacttgtggagatcataaatgactcaggtgaaacccctctcttcagggctgccaaactaggcatgcttaagatgctcaagtatatggccaaacatgctcagggtgacattccaaggctttttgttagatttgacaaacattccattcttcacgctagtattcttggacaattttttgatgttgctatttggttgctgaatatggatgaaaaactagcccaacacagggatatgaatggaatgacgtgtcttcaacttctatctaatatgccgcttgtatttcggagccaagctacttccatgggagccgtgaagaatcttatatattacttgctacctgaggaaggatatgaaattgatgatgatgaggaggaggaggagaatggcagtgctgatttcggacagaggagcgatttagaaagtggtcaacaagacaaggccaagttgcccagttcagagttcaatggaattggacgaatatggcaacgcaagaagcagcataagttagcagaacatctggctgagcttttagtgcagagggacttttcatggcagatttcttttcatgaaaactttcaacccttaattgtattgccagttctttcatccaaatcagacaggataaaacacattcaccacatgaaggagatgcacaagactatatcacattctagaagttacaaacttataaccaccgcaacaagtattccccattctaaaaactacacgccacttctcatggcagctggctcaggaatcgtcgaaatcgttgagaaaatcattgacaagtttcccgaggccatttgtcacgttagccaggatgagcacaacgttctgcacatggctgtgaagcaccgtcagctcaaaatctttaacatgttgaagaaacattcagcatttaaatcattgctatttcggataactgcggaaggtcgtactctcttgcaccaaatttcgagaatggagttttatgtagagcaacacctacctggtgtggcattccaactacaagatgaattgcgttggtatgaacgagtgagaaacattgttccccctcactacctgatgcactgtgacaaagacgggctaacagctgaggatgttttggaaatggaacatcgtgaaatgcacaaagaagcaaaagggtggataaaggaaacggctcagtcatgctccacagtggctgtccttgttgccaccgtcgtgtttgctgcggcctacaccatcccaggtggcactgatcagaataatggcacacccgtgtttctcggttctcgaatttttctcttcttcactgccactgatgttgtggcacttgtgagctcactggcttcggtagtaatgttcctttcgatcctaacatctccgtttgagttgtgggatttccgtagctctctgccgcgaaaactgagcttaggatttgcctctctattcttctcattggtatgcacgatgctgacattcagtgcaacagttttgctcaccgttcggttggagaatcaactgcagcaatgggcttccgttttgtttttctgtgctgtgttctttcctgtggcaatattttggaggttgcaattcccactttacaagatggttcaaagacttgctaagcggctattcaagacgcttaaacaagccgtgccaactacggagattccagaatggtttgactgtgttaacgagggagggtatcctgttttcgaggctcgtggaaagttccctgcggttgtttaa

SEQ ID NO: 77799 - DNA, 672 bp, Glycine max
  Peptide Sequence Number=SeqID_194577
ttaactgaagaatttgaggaggttcctgttcaaagccggggttttggcattcttgatgttggatatcgttcaacggatgaggcatgggcagcaggaggaagtggtattcttttgagaactactaatggtggcaagtcatggatccgtgacaaagctgctgacaacattgctgcaaatttatactcagtgaaggatttgtattggggaatgatggagtcttgcttcgctaccttggatagagttgtaatgcaacatgctctagcctctatctctaagcccttgcccagtgctctttcagcggcacctaaaaccctttcggcggctgcgaaaacaccctccacgcccccaaacccaaacaatggcaagttgccggctcctctcaaacagcttcagatggacctcagaaagttgatgcttccgtacactgctctcagcctcagggaaaagaaacggaataatctgcgagactttctgaatgttgctggacctatgggtgtcacacatttcttcatattgtcaaaaaccgctacttcaccttacttgagggttgcaacaacccctcaagggcctactcttacgtttaagatacatgaatactcattggccgctgacattgctcgatctcaattgcatcctcgatgccctaaggatctgtttaaaagttctgctctg

SEQ ID NO: 77800 - DNA, 3366 bp, Glycine max
  Peptide Sequence Number=SeqID_194578
atggcattagaatgcgttggtggtgctgttctttcttctttcctcgcggctctatttcagaagctggcttctcctcaagttctggatttctttcgtggaacaaagatcgaccagaacctgcggagggacttagaaaacaagctcctctccatccaagctgtgcttgatgatgctgaacaaaaacagtttggaaatatgccagtgagagactggcttattgagctcaaagttgccatgcttgacgtagaagatgtcttggaggaaatacaacattccagacctcaagttcaacctcaatctgaatctcaaacctgtacttgcaaggtacccaaattcttcaaatcttgctcttttagttccattaacaaggaaattaattccagcatgaaaaaaatccttgatgacctagatggtcttgcaagccggatggatagtttaggtttgaaaaaggctactgatcttgtagcgggatcaggatcaggtggtaataagctacaatcaacatctttggtggtagaaagtgatatttgtggcagagatggtgataaagaaatgatcattaactggctcacttcttacactgatgaaaagctatcaaatactttctatcgtgggcatgggcgggttggagcaattcttgacacgattactgattcgactgatcatggtagagagctagaaatagttcagagaagactaaaagaaaaattggcagataaaaaatttctcctcgttttggatgacgtttggaacgaaagcagacctaaatgggaagctgtgcagaatgctcttgtttatggagctcagggaagtaagatccttgtcacaacacgcagtgaggaagttgcttctaccatggggtcagaacaacacaagctggagcaattacaagaagattattgctgggaattgttcgcaaaacatgcattcagagatgataatcttccacgagatccagtatgcacagatattggtaagaagattgttaaaaaatgtaaaggacttcctctggccttgaagtcaatgggaagtctattacacaacaaaccatttgcctgggaatgggaaagcgtattccaaagtgaaatatgggaattaaaggacagtattgttcctgctttagcattgagctatcaccaccttcctccccatctcaagacatgctttgcttactgtgctttattccccaaggattatgagtttgacaaggagtgtttaattcagttgtggatggctgaaaatttcctaaactgccatcaatgcagtacgagtccagaggaagttggccaacagtacttcaatgatctactatcaaggttgagagttgatcaagcaaaatgtacacagaaaacaacccgtcatttttcagtttcaatgattaccgaacgatattttgatgagtttggaacttcatgtgatactaaaaaattgcgtacatttatgccaacatggtggggaatgaatgaatattatgaccgtagttggaattgcaagatgtcgatacatgaattgttctccaagtttaagttcttacgcgtcttatctctgtctcactgttcaaacattgaagagctgcctgactctgtttgcaattttaaacatcttcgttcgttagacctttcccatactcgcattaaaaaactacctgaatccacatgttcactctacaagttgcaaatactgaagctgaatcattgtagatctttgaaggagctgccctcaaatttgcatgaactcaccaatttgcatcgccttgaatttgtaaatactaacattataaaggtgccaccgcatctaggaaagttgaagaatcttcaagtatccatgagttcgtttgacgttggtaaaagtagcgagttcactattcagcaattaggagagctcaatcttgttcatgaaagattatcatttagggagctgcagaatattgagaatccctcagatgcattagctgcagatttgaaaaataaaacacgcattgtggaactagagtttgaatggaattcgcaccggaaccctgatgattctgccaaagaaagggatgtaattgagaatctacaaccttccaaacacttggaggagttgtcaatcaggaactatggtggtaaacaattcccaaattggttatccgataattctttatcaaatgtggtgtccttaaagttgcacaactgtcaatcttgcgaacgtttgccttcccttggacttttgccatttctcgagaaccttgagatttcaagtcttgatgggatagtgagcattggtgctgattttcatgggaatagcacttcttcatttccatcgttggaaacattgaagttctactctatggaagcatgggaaaaatgggaatgtgaagctgtgataggtgcttttccatgtcttcaatatctttctataagcaaatgtcccaagctgaaaggtgacctcccagagcaacttcttcctttaaagaagctacaaattagtgagtgcaaacaacttgaggcttcagctcccagggctctagaactaaaactagaactagaacaacaagactttggaaagctgcaacttgactgggctactttgaaaaagctcagtatgggtggacacggcatgaaagcatcgttgctggtaaagtctgatactttggaagaactgaaaatttattgttgcccgaaagaaggaatgttttgcgattgtgaaatgagagatgatggctgtgactctcaaaagacttttccgctagatttcttcccagcactcaggacccttgagctcaatggcttgcgtaatctacagatgattacacaggatcagacccataatcatcttgaatttctgacaatcagaaggtgccctcaattagaatcattgcctggaagcacatctctcaaggggctaacgatatgtgattgtccaagagttgagtcgttccctgaaggaggtttgccatcaaatctaaaacagatgtatctctcttactgctcgtggggactcatggcctcactgaaaggggctttgggagacaatccctctctggaaaccttgtcgataacagagctggatgcggaatcttttcctgatgaaggtttgctgccactctctcttacttgtctaaccatcagtgattttccaaatctaaaaaaactggactacaagggactctgtcagctctcctctctcaagaaattgattcttgatgactgccccaacctccaacagctaccagaggagggtcttcccaaatccatttcatatcttgaaattgaagactgccccaagctcaagcagcgttgccagaacccaggaggcgaagactggccaaagattgctcacattccaaccctgaatattagtcaatggtgtgctgatgatttttaa

SEQ ID NO: 77801 - DNA, 573 bp, Glycine max
  Peptide Sequence Number=SeqID_194579
attgtgctttctggatttgtgagtggagatccaccactgcagcttacaactaacatgtttcagaatatttttccaacaattgatgtcaaaactgttaagctctccacatgccaaagaattgtgttgcttaattacaacaaagacactaagctcattgattttcgccattattccataagactacaacctgtaggtgtttcacgcagaataagaaaacttgtgcagagccatcaggttcctgatctaaggaatcttctagatgttagtaattttgtcacaaaggctggctatggatcagaaagtgaagctgatgaagaagcagcaacagttactttgtccagtgacattggtagagttaatcgtgcttctacaaaaagtgctgtcaaactgcatgaggttggacccagaatgactcttcaactagttagaattgagaagggactgtgttcgggtgaagttctcttcagtgaatatggaaaagctggtggcaaaggaaaaagtgatgatgagatgcagggtgaagaagatgaagaagatcaagatggagagcatccagaggatagtgaagactaa

SEQ ID NO: 77802 - DNA, 132 bp, Glycine max
  Peptide Sequence Number=SeqID_194580
aagttgaagaaggcagagaccttaatattggtggactttgtggagtgtcctaaggttgaagtagtctatggttcaagttggaaaagtggggaccttaaaatggaggaccttgacatagacttgatggagtag

SEQ ID NO: 77803 - DNA, 468 bp, Glycine max
  Peptide Sequence Number=SeqID_194581
atggctggttcaattggaagcggagggaacacaagcacgggtgtggagtggcacgtgcgacctccaaaccctaagaatcccatcgtcttcttcgatgtcaccatcggtaacattcccgccggtcgaatcaagatggaactcttcgccgatattgcccccaaaactgccgagaatttcaggcagttctgcactggggaatacaggaaagcaggactgcctgttggttacaagggttgtcaatttcatagagttattaaggattttatgattcaggctggtgattttgtaaagaaatatggtgttattccttctctaaatcatggcgtccatcacttccaaaagcttaactatcaaaataccaatattccaattagcaaacctaatcaaacacttctagactatccatctggaaaaatgagtgcccttgctcattttgcgctacattcaagtgccacgcagcaatactag

SEQ ID NO: 77804 - DNA, 801 bp, Glycine max
  Peptide Sequence Number=SeqID_194582
atggcagtagaattaattgctggtgctcttctttcttctttccttcaagttgcatttgagaagcttgcttctcctcaagttctggacttctttcacggaaaaaaacttgatgagacgcttctgagaaagttgaaaattaagctgcagtccatcgatgctctggctgatgatgcagaacgaaagcagttcgcagatccacgcgtgagaaactggcttcttgaggtcaaagatatggtttttgatgcagaggatctcttggatgaaatacaacatgaatcatccaaatgggaactggaagctgaatctgaatctcagacctgtacgagctgtacttgcaaggtaccaaatttcttcaaatcttctcatgctagttcctttaacagggaaattaaatccaggatggaagaaatccttgatagattagaacttctctcaagccaaaaggatgatctaggcttgaaaaatgttagtggtgttggcgttggatcagagttgggtagtgcagtaccacagatatcacaatcaacatcttcggttgttgaaagtgatatttatggcagagataaagacaaaaaagtgatttttgattggctgacatctgacaatggcaatcctaaccagccatggatactttctattgtgggcatgggtgggatgggtaagaccacacttgctcaacatgtattcaatgaccctaggatccaggaggctagatttgatgtcaaagcttgggtctgcgtttcagatgattttgatgctttcaagggtatcaaagaacaaattcttgaaggccatcactaa

SEQ ID NO: 77805 - DNA, 2277 bp, Glycine max
  Peptide Sequence Number=SeqID_194583
atgaggtcaaaagaacacctcctggagcaattacaagaagatcattgctggaagttgtttgctaaacatgcattccaagatgataatattcaaccaaatccagattgcaaggagattggtacgaagatagttaaaaaatgtaaaggacttcctctggccttgaaaacaatgggaagtctattacacgacaagtcatctgttacggaatggaaaagcatatggcagagcgagatatgggaattttcaacagagcgtagtgatattgtacctgctttagcactaagctatcaccatcttccttctcatctcaagagatgttttgcttattgtgccttattccccaaagattatgtgtttgataaggagtgcttaatacaattgtggatggctgaaaaatttctacaatgttctcaacagggtaagagaccagaagaagttggtgaacaatacttcaatgatctattatcaagcctaagagaggtgcctgactctgtgggtaatcttaaatatctccattcattagacctttcaaatactgacattgaaaaattacctgaatcaacatgttcactctacaacttgcaaatactgaagctaaatggttgtaataaattgaaggagctgccctcaaatttacataaactcactgatttgcatcgccttgaattaatagatactggagtgagaaaggtaccagcacatttgggaaaactgaagtatcttcaggtatcaatgagtccgtttaaggttggcaaaagtagggagttcagtatccagcagctaggagaactcaatcttcatggaagtctatcaattcagaacctgcagaatgtcgagagtccctcggatgcattagcagtggatttgaaaaataaaacacaccttgtcaagctgaagttagaatgggattcagactggaaccctgatgattcaacaaaagaaagggatgaaattgtaatcgagaatctacagcctcccaaacacttggagaagttgaggatgaggaactatgggggtaaacaatttccaaggtggttattaaacaattcattattgaatgaggtgtccttaaccttggagaactgtcaatcttgccaacgtttgcctccccttggacttttgccatttctgaaggagctctcaattcaagggcttgctgggattgtgagtattaatgctgattttttcgggagtagctcttgttcatttacgtccttggaatctttgatgttccacagtatgaaggaatgggaagaatgggaatgtaaaggtgtgacaggtgcttttccacgtcttcaacgtctttctatagagtattgtcccaagctgaaagggcacttgccagagcaactatgtcatttaaattatctaaagatttatgggtgcgaacaacttgtaccttctgctctcagtgcccctgatattcatcaattatccctaggagactgtggaaagctgcaaattgctcatccgacaactttgaaagagcttaccattacaggtcacaacgtggaggcagccttactcgaacagattggacgcagttactcttgttcaaataacaatattcccatgcacagttgctatgatttccttgtaaggttggtcatcaatggtggctgcgactctctaacgaccattccactagatatcttcccaatactcaggcagcttgatatcaagaagtgtcctaatctacagaggatttcacaggggcaggctcataatcatctccagcatctgagtattggagagtgcccccaattagaatcattgcctgaaggaatgcatgtcctccttccatctcttcatgatctgtggatagtgtattgtccaaaagttgaaatgtttccagaaggaggtttgccattaaatttaaaagaaatgactctctgtggtggtagttacaaacttatatcctcattgaaaagtgcctcgagaggcaatcactctctagaatacttagatattggaggagtggatgttgagtgtcttcctgacgaaggtgtactgccacactctcttgtttgtctagagatcaggaactgtccagatctaaaaagactggactacaaaggtctctgccacctctcctctctcaagacattgtttcttactaactgccccaggctccaatgcttaccagaggagggtctgcccaaatccatttcaactttgaggacttactattgtccgttgctcaatcaacgttgccgggaacccggaggcgaagactggccaaagattgctgacattgaaaacgtgtatataatataa

SEQ ID NO: 77806 - DNA, 1407 bp, Glycine max
  Peptide Sequence Number=SeqID_194584
ttgaaggttggtaagaatgatgattgcatcccccataacggaaggtggaattttaataagaagacacttctacaagcatcacatattgattattgggctgttgtcaacttttctgcaagttgtgatactagttacatatcaagggagctgatcagatgtggaatgagcaagggcattaacattgaacggccatatactttgatagaggaggaaccacagttgagaaaatctcaccctgttgcaagggttgaaagaatgtttgacctgcttgcatcaaaactgaatagagagccaaagttgattctttgtgtcttgccagagaggaaaatttgtgatatatatgggccttggaaaaagaagtgtctgagtgaaattggtgttgtcacacagtgcattgcccctgtcaagatcactaatcaataccttactaatgttcttcttaaaatcaattctaagcttggaggaataaattctctgttggcaatagagcattctgggcatcttcccctgattaaagataccccaacgatgattttggggatggatgtctctcacaattcacttggtcgattagatagtccatcaatagcagctgttgttggatctcgacattggccactgatttcaaggtatagagcgtctgtgagaatgcaggcatccaaggtggagatgattgatgctctatacaagccattggaaaatgggagtgatgatggtattatcagagaattgcttttagatttctatgattctagtaatggacgcaagccaactcaatttattgtattcagggatggagttagtgaatcacaattcgaacaagttttaactatcgagcttaaccagataatcaaggcctatcaacatcttggtgaggttaatgttccccagttcactgtgattgtggcacaaaaaaagcatcatattaagctgtttctgcctaatggcccagaaaatgttcctcctgggacggttgtggatacaacaattacgcatccaagaaattatgatttttacatgtgtgctcatgcagggatgcttggaacatccaggcctgtacattatcatgtgctacttgatgagattggtttctcggcagatggcttgcaaaatttgatccattcgttgtcctatgtgtatgcattcttcctttttgtttatacaaagtttcactacccctggcttatgcatgtatatacgtatttcaggaaccaaaggagcacaattgcaacctcagttgtggcacccatatgctatgctcaccatgctgcagctcagatgggacaacttttgaattttgatgattcatcagaaacaggttcaagtcctgcttcagagggaggcatccccatcccagagcttccaaggttgcacaggaatgtcaggagttccatgttcttctgttga

SEQ ID NO: 77807 - DNA, 309 bp, Glycine max
  Peptide Sequence Number=SeqID_194585
atggtttttcacttaaggcttgtaatcagctcaaaacaaagaaaggggaacataggctcaaagaggctatcaaaggaattaattcagggtaggctcatttggctagaggcttataagaataaaatgcctaaatcatctcccaacatgcatgtgaagcaagaagtatcaacaagagtcaagccaaggctattgtgcaagcaatcaatagggcaaaacacaccgaataaaatagatgatgatggctcaaattctcaccaaagagaaaaacaagggtttgaattcacaaaatgcaaagaaactcctatttaa

SEQ ID NO: 77808 - DNA, 1308 bp, Glycine max
  Peptide Sequence Number=SeqID_194586
atgacggaggaagttcctgggattgtagaagctgctgaacctccaacatcatcacaatcacctgctgatgtgccacataatttggaaacagaacaaatgactcctacaaagtattctattatcagtaggaatggggttgggaccacaggaaaacacatacctttacttgtgaatctctttgaagttgctgttaatgttccagacacagtattttttcagtatagtgatttccaggttgctattactttcgaagataaacaagctgttgaaagcaagggcattgggagaaaagtgattgataggctttaccaaacatactcttctgaacttggtggcaaaagcagtagtgccaagagtcctggtgctaatggaagccttcatgaggaaactaaaaggtcaaaacattcatttcagtcaaagacattcatggtggagataagttttgctaccaaaataccacttcagtccattgttatttccttgaaagaggttgagtcggataccaattctcaagatgctttgagagtgcttgatactatactgaggcagcgtgcagctaactgtgggtgtctcttggtaaggcaatctttttttcatgatgactcaagaaatttcaatgatgttggggctggtgtaacagcagtctcagacgtgtcaacaactattatcataaaacctggacctgtaattgattttctgttatcaaatcagcaagtgaaggaaccccgttatattgactgggaaaaggcgaaaaaaatgcttaaaaatttaagggtgcaagcaactcatcataaccaggaatttaaaatttctgggttgagtgagaaaccatgcattcagcaactttttagtatgaaggttaaaaatgatgacaacaatagcagagggcagacagtggatattactgtttatgaatattttgccaaacactgtggcatagagttgacctcatctgcttatcttccatgtcttgatgttgggaaaccaaaacgtcccgtctatcttcccttggagctatgttcacttgtttccctccaacggtatacaaaggttttatctctgatgcaaagagcatctttagttgaaaaatcacgccaaaagcctcaagatagaatcaaaattttaaaaagtgctgtaggaaaatgctatgatgatgatcctgttcttgctgcatgtggcatttctattgagaaacaactgaatctgattgaaggtcgtgttcttgaaacaccaaaggggttgagagggagtggtatggtgaaaaagaattgggactttgggagagacctggatctctttaatatctag

SEQ ID NO: 77809 - DNA, 3637 bp, Glycine max
  Peptide Sequence Number=SeqID_194587
gctgcaatgcatggagtcattgacttctaattactcgtttccattcgtccactccaacccttttcctaccatggcgttagaattcgttggtggtgctgttctctcttctttccttcaggttacatttgacaggctgggttctcatcaagttctggacttctttcgtggaagaaaactcgatgagacgctactgagcaagttgaaggtgaagttactgtccatagatgctctagctgatgatgcagaacaaaagcagttcagagattcacgtgtgaaagcatggcttgttgctgtcaaagatgcggtgcatgagtcagaggatgtcttggatgaaatagaatacgaacactccaaatgccaagtggaagctgaacctgaatctcaaacctgtacttgcaaggtaccaaatttcttcaaatcttctcctcttagttcctttaacaaggaagttaaatcaaggatggaacaactcattggcagcctagaatttctctcgagccaaaagggtgatctaggtttgaacaatgctagtggtgttggatctggattcggtagtgaagtgtcacagaaatcaccatcaacatctttggtggttgaaagtgttatttatggcagagataatgacaaggaaatgataattaattggctcacttctgactctggcaaccacagtaagttatcaatactttctattgtgggtatgggcggaatgggtaaaaccacacttgcccaacatgcatacaatgacccaaggatagatgatgtatttgacatcaaagcttgggtctgtgtttcagatgattttactgttttcaaggtaacaagaacaattcttgaggcaatcactaagtcaactgatgatagtagaaacctacagatggttcatgaaagattgctagtagagttgaaagataaaaagtttcttcttgttttggatgatgtttggaacgaaaaactggacgaatgggtagctgtgcagactcctctatattttggggctgagggaagtagaatcattgtcacaacacgcaataagaaagttgcttctagcatgaggtcaaaagaacactacctgcagcaattacaagaagattattgttggcagttgtttgcagaacacgcattccaaaatgctaatcctcaatcaaatccagacttcatgaagattggtatgaagatagttgaaaaatgtaaaggacttcctctagccttgaaaacaatgggaagtctattacacaccaaatctattttggaatggaaaggcatattggaaagtgagatatgggaattagataatagtgatattgtccctgctttagcacttagctatcaccacattccttcccatctcaaaagatgttttgcttattgtgcattatttcccaaaggttatttgtttgacaaggagtgtttaattcagttctggatggctcaaaaattgctacaatgccatcaacagagtaagagtccagaagaaattggtgaacagtacttcaatgatctattatcgaggtccttcttccaagaatcaagcaacatagaggggggaaggtgttttgtcatgcatgaccttctcaatgatttggcaaaatatgttagcgaggacatgtgtttcaggctggaagttgatcaagcaaaaaccataccaaaagcaacccgtcatttttcagttgtggtcaatgattatcgatattttgaaggttttggaactttatatgatacaaaaaggttgcatacgtttatgtcaacaactgactgcagagattctcatgaatattattggaggtgcaggatgtcaatacatgagttgatctccaagtttaagttcttacgcttcttatctttgtcttattggcatagactcacagaggtgcctgactctattggcaatcttaaacatcttcgttctttagacctttcccatactagcataagaaaactaccagagtcaacttgttcactctacaacttgcaaatactgaaactgaatgattgtaaatatttgaaggagctgccctcaaatttacataaactcacctatttgcgataccttgaatttatgaatactggagtgagaaagctgccagcacatttgggaaaacagaagaaccttctagtattgataaattcgtttgatgttgggaaaagtagggaattcactattcagcagttaggagaactcaatcttcatggaaggctatcaattggtaggctgcagaatgttgagaatccatcggatgcctcagctgtggatttgaaaaataaaacacaccttatgcagctagaattaaaatgggattacaatgggaaccttgatgattcttccaaagaaagggatgaaattgtaattgagaatctagagccttccaaacacttggagaggttgtcaatcaggaactatggtggtaaacattttccaaattggttactacataattctttattgaatgtggtgtccttagtgttggacagatgtcaatcttgccaacgtttgcctccccttggactcttgccattgctcaagaacctggagatttcaggccttgatgggatagtgagtactggtgctgattttcatgggaatagctcttcctcatttacatccttggaaaaattgaagttctacaatatgagagaatgggaaaaatgggaatgccaaaatgtgacaagtgcttttccaagtcttcaacatctttccataaaggaatgtcctaagctgaaagggaacctgccactgtccgtgccgcttgttcatttaaggacactaacaattcaggactgcaaaaatcttctaggcaatgatggatggttggaatttggtggggaacaattcaccatcaggggacagaacatggaagcaacgttgctggaaacgagtgggcacatcatatctgacacttgtcttaaaaagttgtatgtttattcttgtccagaaatgaatattcccatgagccgttgctacgatttccttgaatcgttgaccatctgtgatggctgcaactctctaatgaccttttcgctagatttattcccaacacttcggagacttcgtctttgggagtgtcgtaatctacagaggatttcacagaagcacgctcataatcatgtgatgtatatgacaatcaatgagtgtcctcaattagaattattgcatatcctccttccatctctggaggagctactcataaaagattgtccaaaagttctgcctttccctgacgtaggtttgccatcaaatctaaacaggttgactctctataattgctccaaatttataacctcaccagaaatagctttgggagcccatccctctctaaaaaccttggaaattggaaaactggacctggagtcatttcatgctcaagatttgttgccacattctcttcgttatctatgcatctatgactgccccagcctccaatacttaccagagggtctctgccaccactcctctctcagggaactgtttcttctgagctgccccaggctccaatgcttgccagatgaggatctgcccaagtccatttcaactctggtaattcggtattgtcccttgctccaaccgcgttgccagagaccagaaggcgaagactgcggaaagattgctcatattgaaaatctctttattattgactga

SEQ ID NO: 77810 - DNA, 348 bp, Glycine max
  Peptide Sequence Number=SeqID_194588
atggaggcaagctctagagagatcgtgcgaggagttccgcctttgttaggagccaacacaaacttatatataaaggacaatcccggtggggggaaatcattgaggagtcaatcctcccagattagtgatacttggggatggatcattgactcattgtttcttagggatatgacattgagtttccacgatgtaaacttagcaatcccgacaaatgcgagacatcaccaattagctagagcttgtcattataccatgatgagggtgtacttccaagagtcatccaacttaaaatgtgtaagaccattgagttctagaagttttagtggcagcagacccgtgatgtcataa

SEQ ID NO: 77811 - DNA, 839 bp, Glycine max
  Peptide Sequence Number=SeqID_194589
atgaatagtctacctttgaaaaaggctagtgatgatggagttggatcaggatcgggtagtaaagtgccacaatcaacatcttcggtggttgaaagtgatatttgtgacagagatgatgacaaagaaaggatttttgaatggctcacttctgacactgataagaagctatcaatactttctatagtgagcatgggcgggttgggtaagaccacacttgcccaacttgtatacaatgactcaaggatagatggtacatttgatattaaagcttcggtctgtgtctcagagaaatttgatgttttcaacgtatcaagatcaattcttgacacgattattgattcaactgatcatagtagagagctagaaatggttcagagaagactaaaagaaaatttggcagataaaagatttcttctcacgacacgcagtgagaaggtttcttctaccattcgcactgagctatccccaccttcctcccgtctcaagacatgctttgcttactgtggtttattcgggaaggattatgagtttgacaaggagtgtttaattcagttgtggatggctgaaaatttcctacactgtcataaaagcagtaagagtccagaagaagttgagcagcagtacttccatgatctactatcgagtatgtcaaagatacatgatttgttctccaagtttaagctcttgcgtgtcttatctctgtctcagtgttctgacattgaagagctgcctgactctctttccaatcgtaaacatctccgttcatttgagctctccaacacttgcatagaaaaactacctgaacccacacgttcactttacaacttgcaaatactgaa

SEQ ID NO: 77812 - DNA, 153 bp, Glycine max
  Peptide Sequence Number=SeqID_194590
atgcagatccaaacacgctctatgtatgattataatcatagccaaatgatgatgtcatcttctgcatcatcccctccaacgctaggctacattcagcatccaatttccaaattggacacgctagctggcatagcaatcaagtatggtgttgag

SEQ ID NO: 77813 - DNA, 2577 bp, Glycine max
  Peptide Sequence Number=SeqID_194591
ctggctcaaagaaattccagtgaacttgaggacacccatttgaaagagccgtcttcacaattacatgatgaccgtttgtcaattcagcagcctctaaaagagaaagatgacgaagtaattcctgtgcatgtcccttacagtcctgaaaaattagatttgaagcagtttccctccaatgtgacaaaattaagctctgtctctccactaaaatcaccacagttggtacctgcaactaagtcaaatgctgagcggaataaagtatccaaagtgtcgcttaaagtttccagtaatgctactcaaaagagggcagagcacgggtcttcaaagtcttcacataaccttagctcttctcagaatcaagttgtgactcataaaaagaaacctgcaatgtctgcagaaatttttaaaactacttcggagacattgcctcaggcagttgaagttcctgctacaacagtttgttctaaggatcctgatgctctacatgttgatagattggaggtgggcacagaagagaaaaatagtatatatactgtttctgggactcctgaatctgctaaaactatgaagcatcttattgcggctgccctggcaaaaaggaaacaagctcattcacaatgtcttccttctggctttcccaatgttcaggaggggactcctagcccctccacagttcagccatttctgcctgtctcgagcaattttgtgccagcagatatacagggagtttatgaacacacaacattggcttctccaccaactaaagagcttcactctgcttctcataatcaacttgatgctgatgacattgaggagaggagagttggttcagtgcaaaggggtctaggaggctcgctgagtggtggtactgaggctgctgttgctcgtgaagcttttgaaggaatgattgaaacattgtcaaggaccaaggaaagtattggccgtgcaactcgtcttgccattgactgtgccaagtatggcattgcgaacgaggttgttgaacttctcatccgaaagttggaaactgaaactagttttcatcgcaaagtagatttgttttttcttgttgattccatcacccagtgctcacataatcaaaaaggcattgctggagcctcctacatccctactgttcaggcagcgttgccacgtcttcttggtgctgctgctccccctggagctagtgcccgtgaaaatcgtcgtcagtgtctcaaggttttgaggctgtggcttgagaggaaaatttttcctgaatcagttcttcgccgttacatggatgatattggagtttcaaatgatgatatgacagttagcttttctctcagacgtccatctcgagcagagcgatctgtggatgacccaattagagaaatggaaggcatgcttgttgatgagtatggaagtaatgctacgtttcagctgcctgggtttttatcttcacatgcatttgaagaagatgaagatgaatatgaagatgctataccaatcaatttgtgtaaggagacatgtgatgcgtcgccagcagatcccccacatacccttggagaatcagaaacttctactgttaccccaaatgacaagcgccattgtatcttaaaggatgtggatggcgagctggaaatggaagatgtttcaggttatccaaaggatgaaaggcccatattttttaacagttctgatgaaattgatttgcaacatcaggactcagataggaatttagatccaacttcaaacatttcagaagagacgtcagttactccagagggttctcctcctatgccactcgattcacctcctccacccccacctttgccttcgtcacctccgccacctcctcctccattatctccatctcctcccccacctcccccacgcccaatgttgcaacccccacctcctcctttaccaccctcagcccctccagtgtcattggttcctcaatcgtcaggaccagctcggccacttctctcccagtcattaatgccatctcagtcatcacatcagtcttccccacagttgggttatcagcagagtgtacctcatgactttagtggcactactaatggtaaccaaatagttccaatgactgggaattcttttcctggaggtcacaataatgcagttgtcaagaatgaagtatttccacagccctctgcttatgctccaacagctggctgcagctcccaggaaccttctggttttaacccttcaaggcaattagaatacggacagaatgatatgtacctaaatgctcaagttcctcaacctaaccatcaatttcagcagggtaatcccccatttgctcagaggcatgcacatgctgccccaccccaaaatccaccaaatccatactcatattcaaatcctacagttcagcagcatcttccacattcattccatcctcccttccctttaccatcccttccagatggccggagacaatttgttgctgatgagcaatggagaatgtcatcgagtgaatttaaaacaaacagtcaacatggtgtatggagagggagaagtccttcatgtcctggtccaccctatgggcaagaaggtgaaagctttgtagtttaa

SEQ ID NO: 77814 - DNA, 1039 bp, Glycine max
  Peptide Sequence Number=SeqID_194592
atggctcccgggcgtcgacgcggagcgaacaaggctaaggccaatggccacttgagtttgggcgatcttgtactcgctaaggtcaagggcttccccgcttggcctgcgaagataagcaggcctgaagattgggacaaagtccctgatccgaagaaatattttgttcaattctttggtacaaaagaaatagcttttgttgccccagcagatattcaggcatttaccagtgaggctaaaaataagttgtctgctcgtcttcaaggcaagacaaagtactttgcccaagctgtgaaggaaatatgtgcagcatttgatgagatgcagaaacagaaggctagtggtttggcagatgacaccgatgattctcatattggttcagaggctccttctaatgatggggtagtaggtaacctaaaggatgctgctgatgctgtatcaaatgcagaaaaagataacattgatatggataatgtttgctctaatttggagtactgtgtgccgagaataggagaaaatgacagccaagatgaaaagctctctgtatctaaccatccaaatgaaagttcttctgtttcatcacctgtgataaaaaacaaattagccattggttcagagacaaagaaaaatgctaacaaatctagttttaaaggtgctagtaatgttaatgattttaggcaagatgctaatgggcatagtgatttaacaaatggaactaagacaagaaagcttgataatggctcaaggaagaaaagtgaagctgcaagtggtagtaatagaaatggtggatcatctactggaaaatttatgaaggagggaaattgtactggccgtggtgatctttctaggtctggagagacattgaaagctgtgaagaaaaggaaaaatgcattttctgtcaaatcagattctccagatactcttaagccaaacgataatggtactactggagaaaaagatagcaacttgatgaaagtgaaaacaagtcatgaggtaaaaaatgagctgcaggagatctcgtttgattctgaggatgccgatg

SEQ ID NO: 77815 - DNA, 1689 bp, Glycine max
  Peptide Sequence Number=SeqID_194593
atgaccaacaccaccacctccacaatattacccttcaatcaaaccaatcccatgcattcccacattccctttcattccaacaccatgaccaaaccaagaaacctcaatctcaccttcctcctgcaagacatccaaattttggagattttccttgcagttcttgtcttcataatcattcattcccttagacaaaagaagcatcatggcctagctgtttggcctgtccttggaatggttccttctttggtgacaggactcagaaccaacctgtatgaatggatcacagaagtgctcaaaagacaaaacgggacattcagattcaaagggccttggtttagcaacctcaactgcattgtcacttctgatcctcgcaacctcgagcaccttctcaaaaccaagttccctctctaccccaaaggagggtacttcaggaacacagttagagaactactaggagatggcatattcaacgcagacgacgacacgtggcagaagcaaaggaagacagcaagcattgaatttcattcaaccaagttcaggcaattaacaacagaatcattgtttgagcttgtccactataggctcttgcctgtgttagaagcatcagttaagaaatctgttgcaatagacctccaagacattctcttaaggctaacttttgacaatgtttgcatgatagcatttggtgtcgatcctggttgtttgcaattgggtttgcctgagataccatttgctaaagcctttgaggatgcaactgaagccacggtgtttcgctttgtgacccctacgtgtttgtggaaggccatgaagtttctcaacttggggatggaaaggaagctgaataagtccataaaaggggttgatgagtttgctgagagtgtcattcggactagaaagaaggaactctctttgcaatgcgaggactcgaagcagaggttggatttgttaaccgtgtttatgaggctgaaggatgaaaatggacaagcctattcggataagtttttgagggatatatgtgtgaactttatattggcagggagagacacttcttctgttgctttgagttggtttttctggttgcttgaacagaatcctcaagtggaggagaatatattagcagagatatgcaaggtggtgagtcaaaggaaggacatagaaagggaagagtttgataattctttgagatttaggccagaggagatcaagaagatggattatttgcatgctgctttatcagaagccctgaggttatacccttctgtgcctgtggatcacaaggaggtagttgaagatgatacattcccagatggaacggtgctgaagaaagggacgaaagtgatctatgcaatctatgcaatgggaagaatggaaggcatatgggggaaggactgcaaggagttcaagccagaaagatggttaagagatggaaggttcatgagtgagtctgcatacaaattcactgccttcaatggtggaccacgcttgtgcttaggcaaagattttgcatactatcagatgaaatatgctgcggccagcatcgtctaccgctaccatgtgaaggtggtggagaaccaccctgtggagccaaagcttgccttaaccatgtacatgaagcatggattaaaagttaatctctaccaaagggatgctgcacaaattcaaaaacacttggaagatggattaaaatga

SEQ ID NO: 77816 - DNA, 1182 bp, Glycine max
  Peptide Sequence Number=SeqID_194594
atggcttttttatttcagaaatttcaagaggctgtgaaaacccttgcaaaaaatcctgcttttgctagggatcctagtcaactacaatttgaagctgacattaaccgcttattcctttatacaagctacaatctgttgggaaagaatgctgatgaagcagatgcggaagagattattgaaattgccaataaagcctcttttgctgatcaacaaatgcaagtaaaagaaaatgttcattctcaaatcaaagcattttgcacgtacatggatgaaatgcttcttccaaatgaaaagagggtgaatgatcccatggaattatctcagcaggaaaacagttcacctcaccatagtgggctaaattctgctaaagttgtctctaaacaaagatcatatacccaagcagaagtttctcagaagttaaaagatcaacttggctacaagcttaatgttaaaccttctcaaatatctcacaaggattctggccaaggtctatttttagatggtgcagctgatgttggtgccgtaattgccttttatcctggtgtggtctattctccagcttattaccaatatattcccggataccttgatgagcagaacccctatttgattacaagatatgacgggactgtcattgatgcccaaccttggggttgtggaggtgaagggccggaacgattcaatggtagaaaaatgttagaaagaaagcttgacaatgaaggagctgagaagggttcagacagaatgagtaaacctttggaaggttcccaggtagaaaatgacaatgaaaatgatgatgtagagcgcagaaacccgttggccttggcacattttgctaatcaccccgcaaaagggatgcttccaaatgtcatgatttgcccttatgactttccattgactgaaaacaacatgagagtttacatacccaacatattatttggaaacgcagaagtaaacatcaagagacttggcagcttttggttcaaatctggagtttcaagaaatagtcaatcagatgttcttaccctgaaaactgttgttctggtagcaactaggagtcttcaagatgaagaactgctcctgaactacaggctgagcaactctaagaagtggccagaatggtatgctccagtggatgaagaagaggacataatgacaggaaaagatgaaagtagccaatga

SEQ ID NO: 77817 - DNA, 930 bp, Glycine max
  Peptide Sequence Number=SeqID_194595
atggagggaaccgcaacagggtgttacaagtgcggcagacctggtcactggtcacgggattgccctttctccgctcccaattccaatcctaaccctaatcctaaccctaaccctaaccccgccaccactcccaatcccaatactccaaatccttcttcgtcttctttcaagtccagatccgccaccgaaaagcccaagaagctcccccgaacaaagcccaaactcacaccggagcttcttctctccgacgacggcctcggttacgtcctccgctatttccctcgcgagttcaaataccgtggtcgcggccacgaggttcgcgatttgggtaatctgcttcggttgtacaccgaatggcactctcgcttgctcccttattactctttcaatcagtttgttcacaaagtagagaaagttgctgctactaggcgtgtaaagacttgccttagagaattgagagaaagagttgcaagtggtggagatccaacaaaactgcgtgaaccacctgttgtgcatgacattccatctgatgagcacggattttctgtatctgctgaagatgggggagcaactcatcaagaggcagatttgtttgcagaattcgaaaatgttaatgacattcaggaagatatgcttaatgatatatatgataaagctactgaagaaccttctcagtccatgcacaatgtgattggcactagcatggcttcagaaagtaacgcaactgaaaagacatcagaggaaaatggatccagccagtctggcaaagctgagataacagaagaacagagagcccgtatggaagcaaataggttgaaggcactagaaaggcgagctgagataacagaagagcaaagagctcgtatggaagcaaataggttgaaggcactagaaaggcgtgctgccttatcacaggcctcccaactttga

SEQ ID NO: 77818 - DNA, 225 bp, Glycine max
  Peptide Sequence Number=SeqID_194596
atggcctatcaatccgaggcctttattaataatggaaggtggatcactgttaaagatgtgaatcattgctatgggacttggataatatactgcaaggttcaagaaacaaaaacaaattcaagtggagtgattgatagtgacgatgatgagatggatcttgatgggaacaagagaaataatgggcatgctgtagggtgttcgaacaagttctttgtagatttatag

SEQ ID NO: 77819 - DNA, 1263 bp, Glycine max
  Peptide Sequence Number=SeqID_194597
atgtccatcctaaatgttttattggaggttgggatgacaccatcattgccaaagatatttcttcctggtccacctgaagctcttactgttctcttagatggttgtgttgttggttgtatagcttccagtgaagtggagaaagttgtggctcacatacgagaattaaaagtgtcatctgtcgcagtgattcctgatgatatggaagtaggatatgttcctttgagcatgggtggtgcctatcctggtctctacctgtgcacatccccttctagatttgttcggccagttagaaatatatcaattgcttccgatggaagtgaaaacatagaactcattgggccatttgagcaggtttttatggaaattagatgtcctgatggtggggatggtggaagaaaaagttcatttcctgcaactcacgaagaaattcatccaacagtaatgcttagtgtagttgctaatctcacaccatggtcagatcataatcagagtccacgaaatatgtaccagtgtcagatggcaaagcaaacaatggcattttcttcacaaactattcaacatcgtgcagaccaaaagttatatcatcttcagactcctcagactcccattgtacgcacaagtacatatactaaatacaacattgatgaatttccaacaggcacaaatgctatagttgcagttctggcatatacgggatatgatatggaggatgctatgattctaaataagtcatcagtggagcgtggaatgtttcatggacaaatatatcagacagaaactattgacttaactgaacaagggggaaggtcagaccgatcttcaagaatgttcagaaaaagtaatatagagaaatcagcttgtccgtccattgattcagatggacttccacatgttggtcagatgatacggccagatgaaccctattgtagcatttataatgaagtaacaagttccatacacaccttaaaaagaaagggttctgaagctgtttatgttgactatgttgctgctgatgtaaaaaacaagaagcaccttcagaaggttaacatacgttttcgacatccccggaaccctgttattggtgataaatttagcagcagacatgggcagaaaggtgtttgctctcagctgtggccagatgttgatatgccattttctggaactactgggatgcgcccagatctcattatcaatcctcatgcatttccttccaggatgacaattgctatgcttttggaatctgttgctgctaaggtactatga

SEQ ID NO: 77820 - DNA, 1359 bp, Glycine max
  Peptide Sequence Number=SeqID_194598
atgagacagctaatgtttggaaaccatatatccgagtcaatggatattagaacaagacaaggcttgctaaatgctctggtgggaaaggtggggaaaaggatggatactctattgattcctttggagttgctttgctgtatttcacgttcagaattttctgataagaaggcttttatacgttggcaaaagaggcagttaaaagttttagaggaggggcttgttaatcaccctgccgttggatttggtgaatctggacgcaagacaaatgagttgaggattctgttggccaagattgaagaagcagagtttctcccatcttcaactggtgaacttcaaaggacagaatgcttgagatccctaagggagattgccattccacttgctgagaggccagctcggggtgacttaactggtgaaatatgccattgggcagatggttaccacttaaatgtcagactatatgagaaattacttttaagtgtatttgacatgctagatgaaggaaagctgacagaggaagtggaagaaattcttgaacttttgaagtcgacttggagagttttaggaatcacggagacaatccatcaaacctgctatgcatgggttttatttcgtcagtatgttatcacaagggagcatggggttttgctgcatgctcttgagcaattaaataaaataccactgatggagcaaagaggccaacaagagaggttgcacttgaaaagcttgcattctaaggttgaaggcgaacgagatatgtctttcttacagtctttcttaacaccaattcagagatggactgacaagcagcttggagattaccatctgcatttcaatgagggttcagcaactatggaaaagattgtagcagttgcaatgattaccaggaggcttctactggaagaaccagaaactagcacacagtccttgccaattagtgatcgtgatcagatagagatatatatatcatcatcaattaagaatgcattttcaaggacagtgcaagttgttgacagagtagatatgtcacatgagcatcccttggcattgcttgcagaagaactcaagaagttcctaaaaaaggaatcagcatctttcttgcctattttatctcagaggcatcctcaagcaactgttgtatctgcatcattagttcacaaactttatggccacagactgaaaccctttttggatagtgcagaacatttaagtgaggatgtcatttctgtatttcctgcagctgaaagtctagagcagttcataatggcacttattacatctgtatgccatgaagaaaatgctgagatcctgttgaagaaattaaatctctaccaggttaggtggataaattgcttttag

SEQ ID NO: 77821 - DNA, 699 bp, Glycine max
  Peptide Sequence Number=SeqID_194599
atgcagtcaaagttatgcaacttgagaggtgctgatccccagaaacttgtgtcctacaaggaagaagcatcggagatgggtggttacttcatcttgaatggccttgagagagttgtccgactgttaattttgccaaaacggaattatcaacctatgagtatggtgcggaattcatttagtgacaggcgtgaaggatatacagataaagcagttgtaataaggtgtgtaagagctgatcagtcctcattatcagtaagattgtattaccttcgtaatgggagtgcaagacttggtttctggttaagaggaagggagtacttgcttcctgtgggcattattttgaaggctctcattgacacaactgaccgtgaaatttatgtaaatttgacaagctgctataatgagaagtatgaaaagggaaagggtgctgttgggacccagcttgttggtgaaagggcaaaaataatcttagatgaacttcgagatttgtctcttttcactcgtcttcaatgtctagaatatattggtacttcacatggcactcttcaaggagagcacttccaacctgttatgaatgaacttaagaatgacagttatcctattaaccttgggggtaccacaccacaaaagctagctattgtagttgtagatcacaaggccttatacactagaaataccaagttttcactttctgcttga

SEQ ID NO: 77822 - DNA, 582 bp, Glycine max
  Peptide Sequence Number=SeqID_194600
atggagttcagagtccctgaaggagctagccaattcttgtgggcacaaccctctatatcaaggtcaggggaattgaagaaatcatgcagtgagtggaaaggtggatgcaaaattaaggcatcaagtttggggacaaggagagtgtttcagattcagaatgcagtgatgtatgtagctgtttattcttggacaaacgaggagccacctttgataacatcacaagagggggaggaggtcaagacaatggaatgtgggaggaggtcaagacaatggaatgtgggcagaggtcaagacatggagatcactggaatccctgaggtcaaagaaatggagcattattgtggaggaacatctggtcaccacactaccactgcatcttccatagagttacccatcactattgaggtggaagatgcagaaggatctgcagagagggagatggacgacaaggaaaccattgttgaagagaagctcagcatcaaaaacacccccacacaaagggctcaaattggtgtccagggagtaaaacctcatgattttgcaaggaatcagggttgtccggcaccgatgtctgatctataa

SEQ ID NO: 77823 - DNA, 258 bp, Glycine max
  Peptide Sequence Number=SeqID_194601
atggtggctaaaccgggttcggttccggacttcgaggcgctgcgggagctcttcaagcatcacatagagtccttcgattacatggtcgatgctggattagataccatgctcggacacatcaaacccgtcgaagttttcgatgatttcacttccacaaagcttagaaatatcctttttttaatggaaaaaactcttgctgtatccgccgcagaaggagcggatttcgaggacaatgcgggaggctttacttccgtttga

SEQ ID NO: 77824 - DNA, 255 bp, Glycine max
  Peptide Sequence Number=SeqID_194602
atggcatttatcatagttgggataacagctcttggcagaaaaggaaaagctggacattcaatcgttgttgaaacctctactttctcaattctaataattggtatcagagttctgatcttggagtgcagaatcgttaatggtgatgaaggcgaatgcgagaatggaggcacgcatggaagccatggagaaagtaatagaagagaatcgcgaagtagtggaatcacggttgaattcaatctaaaggatgatacaaag

SEQ ID NO: 77825 - DNA, 1404 bp, Glycine max
  Peptide Sequence Number=SeqID_194603
ggcaagggatttccttgcaattttcagagtaatgggagttctatggaaggctttacagagcttaaaaatgagcctggtactcatccttctggggatgttgctgagcctaactgtcacttaggcagtgagtttcttgagccttccaatgaatttcacaccaaacctacttatcaccaaaattacagcacctggacaccctgccattttaactctcacaaggtgcagcaatgccaaatgaatgcttttgagagccattactatccttatcctgttgagaatccacttcagtatgttccaattaatatggttgctcagggttacccgcgtgagcaatatcaggaatttcagtattttgtggtgatagactttgaggctacctgtgacaaggataaaaatccccaccctcaagaaataattgagtttccatctgttatagtgagtagcatcactggccagctggaagcgtgttttcaaacatatgtgaggcccacctgcaatcagcttctgagtgatttctgcaaggatctgaccggcatccagcaaattcaggcgatcaacttttcctatctagacagtacagagtatagaaccaacaacagccaacaactgctttttgccaagagagctgatgtgatacctttgtgtatgggcagttccaatgaaggaggcaaagttggagaatttgatggagtaggagatgaaaataatggaccagaagggttggtacacctgatagtggcggaagaagtgccattggttagggctcaagacatggtggacagaggtgttacattgagtgaggctctactaaggcatgacaaatggcttgagaagaagggaataaagaattccaactttgctgtggttacatggtccaactgggattgtcgggtgatgcttgaatctgagtgccgattcaagaagatacggaagcctccttacttcaaccgctggatcaacttaaggattcctttccgtgaggtatttggtgctgtgaagtgcaatctaaaggaagctgttgagatagccggcttggcctggcagggtcgtgcacattgcggccttgatgatgccaaaaatactgctcgcctgttggcgcttctcatgcaccggggttttaaattttccattaccaattccataatgtggcagacagctgatcgaccactgatgtggaaacagtcaccagaacaaccaatcgttttccctcattgcccctacaaagcaaaggatatcactacccccgttgttcagtatcaccctttctgcttctgtggggtgaaaagcagcaggggcatggtgaggaagccgggtcccaagcaagggagcctcttctttggatgtggaaattggactgcgactagaggtgctcgctgccattacttcgaatgggcttctaactga

SEQ ID NO: 77826 - DNA, 498 bp, Glycine max
  Peptide Sequence Number=SeqID_194604
atgagcagaggaaatgaggacactgtggtgcatgacgacaatcggtggaggaatttggaaatgtccatattcgatggtgaggatcctatggactggttgacaaagatcgaaagatatttccagttgcatgtcgtaagggaaaaggacaagctggagactataatggtcgcaatggatggggaagctctaggttggttccaatggtggaaatcttggaatcaaaaccactcttgggatggattcaagattgttgtcacccaaaggttccaagcttctagccaaggaaatccttttcaagtgttgctagcactgaaacaagaagagacaatgcaaggattcatagtcaaatttgagaagtgctttggaatggtgaaggggttggtggaaccatttttggtggaagtgttcctcaaggggttaaatgaagagattagcactaaggatccaatggatgacaaggtagaagaaccttccataatttgtcactcacgaaagtaa

SEQ ID NO: 77827 - DNA, 570 bp, Glycine max
  Peptide Sequence Number=SeqID_194605
atggcggcgaccaagtcgagtctcgcttctttgagttctgcaagtgtttttaacggtctttttgctgtatttgacaaagttgagtgggattatggcaatttgacctgggaagatatttattgtgcaactcttaatgggctagcattggaagagaaaagctgtaaagaagcaacgaatctgtttggagaaaccaagcatattctactgtcaaatttttcgtcaatgggaaacggaacgtctgaagaagcagagaggtattggtttgcttttattttgtactctgtcaaaaaattgatccagaaaaatgatgagggtgagaaggaagacactgagaacactgggcttagcttgtgtcgtatattgagagcaacaaagcttaagttgttctattacttactttatgcttatcttatattcaacagcattgcagattttttcaaagaacttccacagtttgttgttaaggctggtccaactttaagtaatctatatggcacagattgggaaaacaggcttgaggcgaaggagatgcatgccaatgctattcacttgaagattcttagcaagtga

SEQ ID NO: 77828 - DNA, 2115 bp, Glycine max
  Peptide Sequence Number=SeqID_194606
atggagaaagccaataatgtaatagcagatatattgaagaagcagccttgcttggcatctgaatgtgaaaccgaaaacctagagaatatcgataaagatggtttgacctattttaaagacctgatggaagaatcgtctctaccttctagtctaagtatgttagaaaaagattatgattacatgattcgcaacaagagtgaattggatgaaaggttattcattaatgaggatgacagtctattagcttcagtaagcttatctggaggttctgtttcagctggtggtgtaaagaggaaatttgattcaatggcatcacctgctaagaccattacaagtccactctcaccacaccgctcccccgcatcacatgctaatggcatcccaggtagtgcaaactcaaagatggcggccacccctgtaagcacagcaatgactactgcgaagtggcttcgaactgtcatttctccacttccatcaaagccctcgccagagctggaacgatttttgacatcatgtgatagagatgctacaagtgatgtggttcgcagagcacagattatattgcaggctatatttcctagtagtcctctcggagaacgatgtgtaactggaagcctgcaaagtgcaaaccttatggacaatatatgggccgaacaacgaagactggaagcactgaagttatactacagggtattggaagcaatgtgcagagcagaagcccaagtacttcatgcaactaatttaacctctctacttaccaatgagaggttccatcggtgtatgcttgcatgttctgcagagttagtcctggcaactcacaagactgtaacaatgttgttccctgcagtactagagaggactggaattacagcctttgatcttagcaaggtgattgaaagtttcattagacatgaagaatctctcccaagagaattgagaagacatctgaattcattggaagaacgtcttttggagagcatggtatgggaaaagggttcttcaatgtataactctttggcagttgccagaccttccctttctgcagagataaatcgtcttggactgttagctgaaccaatgccatcattggatgaaattgcaatgcatattaacttctcttgtggaggactgccgccagtgcctaccttgcccaaacttgaaagctcttcaaatcagaatggggatatcagatcaccaaagcgaaatgttttaatggaaagaaattctttcacttcaccagtgaaagatcgccttcttccctttaacagccttaagtcaaaactacccccacctcctttgcagtcagcatttgccagcccaacaaagccaaatccaggaggtggaggggaaacatgtgcagaaactgggatcaacattttttttggcaagatcattaagttgggagcagtcagaataagtggcatggttgaaaggctacagttatctcagcagataagggagaatatttcacaactcaacctaacttttaaggagatcgtatacaactacagaaagcaaccacactgcaaaccacaagtttttcgtagtgtatttgttgattggtcattggctcgccgaaatgggagaacaggacaggagcatattgacataattaccttttacaatgaaatattcattccttctgtaaagccactgcttgttgaacttggccctgctggaccaactacaaaaagcgaccgaatacctgaaattaataaaaatgatggccatttagctcaatgtccagggtctcctaaaatatcacctttcccaacccttcctgatatgtctccaaaaaaagtgtcagccacacataacgtatatgtctctccattacgatcgtccaagatggaggctctaatatcacacagctcaaaaagctattatgcatgtgttggggagagcactcatgcatatcagagcccgtcaaaagacctgaccgccatcaataaccgtttgaatggcaaccggaaggtgagaggtcccctcaactttgatgatgttgatatcgggttggtgagtgactctatggttgcaaacagcctctatctgcagaatggaagctgtgcttcatcatcaggtgcaccattgaaatcagagcaacctgactcctag

SEQ ID NO: 77829 - DNA, 468 bp, Glycine max
  Peptide Sequence Number=SeqID_194607
atgtcgtacaggatgtcacgacatcacgcttcagaacatgcagattgtatgtgtccgtatgaacagattaatcaagtaaataacacaagagaattgttaacccagttcggtgcacctcacctacatctgggggctaccaagccagggaggaaatccactctcaatagtgttagttcaaggtctaacaacccctgtttacaaccttctcacctaaccactacccatataacagatttatatgtccagtattatcgggccagatgtcaggacatcgtatccgacatcttggatcctgcagcttcaatgcttcacttgacttttatcttgcattgtacagcacttccagtattctcgagcaggatgtcaggacattgtatccgacatcgtggatccttcaacttcaattcatcacttgacactttatcttgccttgtgcattatgcagcccgatcttattccttgacataa

SEQ ID NO: 77830 - DNA, 3699 bp, Glycine max
  Peptide Sequence Number=SeqID_194608
atggcagaaacattagttggtggtgctcttctttctgctttccttcaggttgtatttgacaagcttgcttcacgtcaagttctgaacttctttcatggaagaaaattggatgagatgctgctgagcaatttgaatgtcaagctgctctccattgatgctctggctgctgatgcagaacaaaagcagttcagagatcctcgtgtgagagcatggctcgttgatgtcaaagatgttgtgcttgacgcagaggatgttttggatgaaatagactatgaactctccaaatttgaagtggaaactgaattggaatctcaatctctaacctgtacttgcaaggtaccaaatctcttcaacgcgtgtttcagttcattaaataaagggaaaattgagtcaaggatgagagaagtccttcaaaaactagaatatctctcaagccaaaagggtgatttaggattaaaagaaggtagtggtggtggggttggatcaggtaggaaaatgccacacaaattgccatcaacatctttactgagtgaaagtgttatatatggtagagatgatgacagagaaatggttattaattggctgatatctgacaatgagaattgtaatcagctatcaatactttctattgtgggtatgggcgggttgggtaagaccacccttgcccaacatgtatttaatgacccaaagatggaggatcaatttagtatccaagcttgggtatgtgtttcagatgaacttgatgtcttcaaggtaacaagaacaattcttgaggcaatcactaaatcaactgatgatagtagagacctagaaatggttcagggaaggttgaaagataaattggcaggaaagagatttcttcttgttttagacgacatttggaatgaaaatcgagagaactgggaagccgtgcaaactccgcttaaatatggagctcagggaagtagaattcttgtcactacacgcagtaagaaagttgcttccattatgcggtcaaataaagtacatcacctaaaccagttacaagaagatcactgttggcaagtttttggtaaacatgcattccaagatgataatagtctgttaaatcctgagttgaaggagattggtataaagatagttgaaaagtgtaaaggattgcctctagccttgaaaacaattggaagtcttttacacacaaagtcgtctgtttcggaatggggaagtgtattaacgagcaaaatatgggacttaccaaaagaagatagtgaaattattcctgctttgttattgagctataaccaccttccttcacatctcaagagatgctttgcttattgttccttattccccaaagattataagtttgacaaggagcatttaattctgttgtggatggctgaaaattttcttcactgccttaaccagagtcagagtccagaagaagttggtgaacagtactttgatgatctgctgtcaaggtccttctttcaacaatcaagcagatttccaacatgttttgtcatgcatgaccttctcaatgatttggcaaaatatgtttgtggggacatctgtttcaggttgggagttgatagagcaaaaagtacaccaaaaacaacccgtcatttttcagttgcaatcaatcatgttcaatattttgatggatttggggcttcatatgatactaaaaggttacgtacatttatgccaacaagtgggggaatgaattttctttgtggttggcattgcaacatgtctatacatgagttctctaggtttaagttcttacacgtcttatctttgtcttattgttctggccttacagatgtgcctgattctgtagatgatcttaaacatcttcgttcattagacctctctggtacccgcataaaaaaactacctgattcaatatgttctctctataacctgcaaatactgaaggtgggattttgtcgcaatttggaggagcttccatataatttgcacaaactcatcaatttgcgtcaccttgaatttataggaactaaagtgagaaaggtgccaatgcatttgggaaaactgaagaatcttcatgtatggatgagttggtttgatgttggcaatagtagcgagttcagtattcagatgctaggagagctcaatcttcatggaagtttatcaattggggagttgcagaatattgtgaatccctctgatgcattagcagtgaatatgaaaaataaaatacacattgtggagcttgagtttgaatggaattggaactggaacccagaagattcaaggaaagaaagggaagtacttgagaatctacaaccttacaaacacttggagaagttgtcaatcaggaactatggtggtacacaatttcccagatggttatttgataattcatcattgaatgtgctgtccttaaagttagattgctgtaaatattgctcatgtttgcctccccttggacttttgccatctctcaaacacctgacagttgcagggctggatgggatagtgggtattaatgctgatttttatgggagtagctcttcttcatttaaatccttggaaacattgcacttctctgatatggaggaatgggaagaatgggaatgtaactctgtcacaggtgcttttccacgtcttcaacatctttctatagagcaatgtcccaaattgaaagggaatctaccagaacaacttcttcatttaaagaatctagttatatgtgactgcaaaaaactcgtggcttctgctcccagggctctacaaatccgtgaattagaactccgggactgtggcaatgtgcaatttgattatcatccaagtactttgaaatggctgacaattacaggacacaacatagaagcatcttcactcgaaaagattgggcacatcatatctgatacttctcttgaattcttgcacatttattattgcccaaatatgaaaattcccacgagtcattgctatgatttccttgtaacattgaagatcagtggtggctgtgactctctaataacttttccactggatttcttcccaaaactcagttcgcttgatcttaggtgttgtaatctaaaaacaatttcacaggggcagcctcataatcatctcaaggatctgaaaattagtgggtgccctcaatttgagtcatttcctagagaaggattatctgcaccttggctagagagatttagtattgaagggttggagagcatgaaatcattgccagaacgcatgcatttccttcttccatctcttactagcatatcaatacttgattgtccacaagtggagtcgttctctgatggaggttttccatcaaatctaaaaaagatggatctctcaaattgctccaaacttattgcttcacttgaaggggctttgggagccaacacctctctagaaaccttgtctattcgaaaagtggatgtagagtcttttcctgatgaaggattgcttccaccctctctcacttctctgtggatctataattgtccaaatcttaaaaaattggactacaagggtctttgccacctctcctttctcgagatattgcttctttattactgtggcagcctccaatgcttaccagaggaaggtctgcccaaatccatttcaactcttgaaatttttggctgtccgttgctcaaacagcgttgccaacaaccagaaggtgaagactggggaaagattgctcacataaaaaacataaggctttggtaa

SEQ ID NO: 77831 - DNA, 630 bp, Glycine max
  Peptide Sequence Number=SeqID_194609
atggtggattctctattcaaagagacatgctacttagactgcactctccaccggagttttgttggccgaattagtggtgccggtgaatacaacggggattacagttttgattcacatgaaaaagttatctacaaagtaattggctacagatcaaaaaccgcaggaaattcgcacctaagagacaattctagtatcacgaggtgtgtggaacatcaggaatgccaactatcttcaaaaatcaggattttcagagaagcaagcttgtacaggatttatctttactacttggtcgtggttttaattattcctttatgcagtgttctaccaacccagcaagatgctttctccatgtgttacttatttctgcgagactggatttttgaagacctggtggctttgattcggttaagaggggatgacagcgattttactactgtttcattggtgtttctatggagggtacgtaatggcatgtgttccggagtaaatatgaatttcacacgtacagacacatggcacaaaacatatagtcatcagaggattttggagaaggatagtttatgtggttttgagagaagcaagcttgcaagcatcattggaatatggagcattaaattcactgagaattaa

SEQ ID NO: 77832 - DNA, 2817 bp, Glycine max
  Peptide Sequence Number=SeqID_194610
atgatgatcgatcagtctctcacccaagttgttggaggcatcaaagaactcgcccaacttcttgaaaccgatttgaagcatggcatcggcgacaacaacaaggatgacattgatcaccgaaaacgtgtcttcggtgtcaacatgctcacgaagcctccttccaaatgctttctttcttttgtccttgaatcttttaacgacaccaccatcatcattctcttggtttgttctttactttctcttttctttgggatcaagcaacatggttggaaggagggatggtacgatggaggtagcatcatattagcggttattcttgtcattgctgtctcttctgtcagcaactttaaccaatctaaacagttccagaagctttctgcgaaaagtaacaacatgggaggagtggaagtagtacgaggtggtcggcgacaaagcatatcaacctttgacgtggtcgtgggtgacatcgtgtgcttgaaggtcggtgatcaggttccagcagatggggtttttttggagggacattcgttgaaggtggatgaatctagaatgacgggggagagtgaccacgtgcatgtgcatgcgaatggcacaaaggtcaccgatggatttgcacgcatgcttgttacttctgtgggaatgaatactgcatggggtaccatgatgggtttcataaccaataaagaggttaataatgaggagacacctttgcaagtgcgtctcaataagttgacttctgctattggaaaggttgggttgttggtggctgcacttgtcttggtggtgtctatggcacgttacttcgcgggttgcacgagagatgactttgggaaccgtgaatttgttcggggaaggaccgagtctgatgatgttgtgaatgcggttgtggcgattgttgccgcggcggtgacaattgtggtggtggcgatccctgaagggttgccgcttgctgttactctgagtctggctttttccatgaagaagatgatgagggacaatgccatggttaggagaatctctgcctgtgagacgatgggatcagcaacaacaatctgcactgataaaacaggtacacttacgttgaatgagatgaaggtgacagaggtgtgggtggggaaaaggaaaataaaagcggatcaggaagaagatttggcaccgagtttagtccaattgctgaaagaaggaataggattgaataccactggaagcgtttattttcatccccaccaaacttcttcatcattgcctgaaatttcaggtagccctactgaaaaagcgttgctttcctgggctgtggaggatttggggatgggcgacatcgatgaagtgaagcagcattgtgagataattcatgtggagacattcaactctgagaaaaagagaagtgggattctgatgagggagaagagaggaagaagcaacagcagcaacaacagggtccatacacactggaagggtgctgctgagatgatattgcgcatgtgctcaacttactacgaccatacagggcaaatcataatcattgatgatgaagagagggctcaaatagagaacattgtcgagtgcatggcaacgaaaagtttgagatgcattgcctttgcccaaaagagcttattatgcgaaaaacttgaacttgaagagacagaactcacactgttggggatacttgggttgaaagacccttgtaggccaggagttggagcagcagttgaatcgtgcaagaatgctggagtgaagattaagatgattacaggagataatgcgcacacagcaagggccatagcctctgaatgtgggattcttgatgatgaattggatgatgatcaagcagcagtggttgaaggctttcaattcagaaatttctcacatgaggaaagaatggataagattgatagaatcaaagtcatggccagatcatctccatctgacaagcttctgatggttcaatgtttgaagcagaagggtcatgtggtggcagtcacaggtgatggcacaaatgacgcacctgctctgaaggaagctgatattggactttccatgggaatacaaggcactgacgtggcaaaggagagctcagacattgttatccttgatgacaatttctcttctgtggtcactgtattggagcgggggagatgtgtgtacgcaaacattcaaaagttcattcagtttcagctcacagtcaatgttgctgcacttgccatcaactttgtagctgcagtttcttctggtaaagtgtctctttcagctgtccagcttctgtgggtaaacctggtaatggatactcttggagctttggccttggccactgagcaaccaactaatgatctcatgaatatgccacctgtgggaagagttgacccacttataactagagttatgtggaggaacctcatttcacaagcagtgtatcaagtgcttgtcttgctcactttacaattcgagggaagatcatcaatctttggtggtgtcaatgagaaggtgaagaacactatgattttcaatgcttttgtcctctgccaagtcttcaatgagttcaacgcaaggaagctggagacgaagaacatatttgaagggcttggtaaaaataagttgttcatggtaattgtgggcctaactgtagttcttcagctagtgatggttgagtttctcaacaagtttgccaatactgagagattgacttgggagcaatggtgtgtgtgtgttgccattggagttttgtcttggccaattggtctgctggtgaagtgtctcccagttcgcaacaagtgtctcccaattgttactgacttaaggtcaatagcaagaagaaaatga

SEQ ID NO: 77833 - DNA, 1323 bp, Glycine max
  Peptide Sequence Number=SeqID_194611
atgctagaacaaggttatgttgatcaagccggttattgtcttttaaaagcaataaaagcagatcccaaagatgttactcttagatgtcatcttgcaaggctttatgctgaacttggacattatcaaaaagctgctgttacatatgagcaagtacataaactatgttgtgagaatattgatgcactgaaagcagcagctaagttctacaaaaaatgtggtcaagttgaatactctgttcgtattcttgaagactatattaagagtcaaccggatgtagcaaatgcaagtgtagttgatctgctgggtaccatattgatggaaactaaggcacatgatagagctctgcagcatattgaacatgctcaagcagtaaatgcgaggaaagaattgcctttgaatttgaaaattaaggccggaatttgccatgctcatcttggaaacctagagatggctcaggttctctttaatgatttgaaaccagagaatgcaagcaagcatattgacttggttactggggttgcagactcattaatgggtcttgaacattataatcctgcattgaattattatttgatgttggaaggaaatgttgaaaaagaaaatgtatggcttttctttagggaattttacaaggatcatttagtcatcatagtcctcacccctcacataaaaagaattgatggtcaatgttatgttacacaactattgagatctattgggaaaaatccaagtcccacgttgcctagaaatagtgccaagatagagtatataagtggaggacaatcctcaccctatgagttagcttttgggggtcttctatatctgaaaattgctaggtgttatatgtccttgaaagaaaggtcacaagcaattctcttttattccaaaggcaagaattgggacttcagaattgagttcagttctcttgaaacactacaagatgatgttgatgcacgcataactctagcttcacttctgcttgaagagggaaaagaagatgaagccatattcttgctgtctcctccaaaggattctgattttggtgaagcaccttctggaaagtcaaatagatggtggtttgatataagaataaaactgaagctctgcaacatttattggaatagagggacgcttgatgattttgtggatacaattttccctttgattcgtgaatcattgtatgttgcaacttgtcgacagaagataatgtcatacaaagaaaggggtttgtatttaggtggaaaaatcaactgtgaaccacaaacttggacccaaacactggacaatggacattacatggatacagatgcagttgatgtttaa

SEQ ID NO: 77834 - DNA, 732 bp, Glycine max
  Peptide Sequence Number=SeqID_194612
atggagagaataatttgtgtttgtgtagaggagaagatgataacggagagcacgacaatttcattgcagcgagcgtcttcttccgactccactccgaggtttgttaagctgaagactaagagcggttttgaactcgcacgcgagattattcataattcaactgagaaacagaatttgcccctctctcgtgaaggtaattacgatgaagtcaattcccaatctcttcatgtttgccctggctgtggggtttatatgcaagattccaaccctaagcaccctggttattttatcaaaccctctgagaaggacttgagttatagattgtataacaatcttgaacccgttgctcaagagcctgagttctctaacactgttaaaaggggaattgttattgaaccagaaaagcttgatgatgatgatgcaaacttgattaggaaaccagagaagccagtggtgtgtgcgcgctgtcattcgttgaggcactatgggaaggtgaaggatcctaccgtggaaaacttgctacctgattttgactttgatcacacggtgggtaggaagttagcatcagctagtgggacccggtctgtggtgctgatggttgtggatgtagtggattttgatgggtcttttccaaggaaggttgcaaagttggtttctaagacaattgaggatcattctgctgcatggaagcagggtaagtcaggaatgtgcctagagtggtgcttgtggtga

SEQ ID NO: 77835 - DNA, 857 bp, Glycine max
  Peptide Sequence Number=SeqID_194613
tagttgatttggctggacctagagggaatgtgtgggctgttggagcacagaatgcaggaaagagtactttgataaactctatagggaaatatgctggagggaagattacacatctgactgaagcacctgtgccagggactacactaggcattgttagagtggagggtgttttttcaagtcaagcaaaactgtttgatacacccggccttcttcatccttaccagattacaacgaggttgatgagggaagagcaaaagcttgttcatgtgggcaaggaattgaaacctaggacttacagaattaaggctggtcattcaattcacatagctggtctagtgagattagatattgaagaaactcccttggattctatttacgtcacagtgtgggcatctccttatcttccactacatatgggtaaaatagaaaatgcatgtaaaatgttccaagatcattttgggtgccagttacagccaccaattggagaaaaacgagtacaagaactggggaattgggtgagaagggaattccatgtcagtgggaacagttgggagtcaagttcagtagacattgctgttgctggcctcggttggtttgcctttggacttaaaggagatgcagtgttaggagtttggacttatgaaggagttgatgctgttcttcgcaatgctttaataccctatagatcaaatacttttgaaattgcagggtttactgtgtccaagattgtatcccagtctgaccaagctttaaacaagtcaaagcaacgaaatgacaaaaaggcaaagggaattgactcaaaagcgccaaccagttttgtagaatcaccacttttgacttctggtggagacatctaa

SEQ ID NO: 77836 - DNA, 354 bp, Glycine max
  Peptide Sequence Number=SeqID_194614
atgcctcgatgttttcagcaagagattgatttgttgaagctgtcatggtattatctgcttcatttcttccaagtatatattgtgcataatttgaaccacaaaaacattgtaaagtatcttggatcttcaaagacaaaaagtcacctgcacatagttcttgagtatgtggagaatggctcacttgcaaatattatcaagccaaataaatttggaccttttccagaatcattggtggcagtatatattgcccagggtcttgtcaaacttgctgattttggcgttgctacaaaattaacagaggctgatgttaacactcattcagttgttggaacaccttactggatggccccagag

SEQ ID NO: 77837 - DNA, 848 bp, Glycine max
  Peptide Sequence Number=SeqID_194615
atggactggtactatggatgtgaaagtagtgattttcttgttcccaaagatcaagaagatttattggaaaggcatccttcaccagaaaattggtcagaatggggaataaatgcacctgaaggctttaattcaccccaggagtatttgatcatggacacagatgaaacagaagtagaattcaatttcattgatgaaagtttcaaaaatgaaattgagtttgacccttgtctgtatgataaagatcagtctagcagttcaagtgcatgtggaggattgcctgagcaatcgtttcaacaaacggaactttcgtgtgatcaccagcttcaagaccaatcaactttagaacagaaggatgacattttcttggattctgtacttgaagattttccatgtgttgaaagcctacgcaaatctttcttttaccctgaaaaccagtgcagcaacacaactggtgagaactacattttagtttctgaacaagtaatttctaaaagatctataatatggatgtacaaaattacaaatttgttctttccatcaggtggagtgcagaaagatattgcagcttcaggaactaatttccatacaaattctaattgcaaagtcttggacccttttgagcagttcaatgaagatgacatcatggttgagcagttatctcttgaggaatttacactgcagggttttgagatgttaattgcacagttcactgagaagactcgtatttgtttccgagatgccctttaccgtcttgctagaaatacaaaacaacatgtagtagaggacctggatggagatcttaacatgcatcaggaaatgccagactcagtttacaatgataccatgag

SEQ ID NO: 77838 - DNA, 210 bp, Glycine max
  Peptide Sequence Number=SeqID_194616
atggaggtgagaactttgaaggccgaagaggggaaaggttccatcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggtga

SEQ ID NO: 77839 - DNA, 264 bp, Glycine max
  Peptide Sequence Number=SeqID_194617
atgagaaccctagggccttcttcagcagctctagcccaatcttcttggagcctcttgctcatggttctagtgattggtcccttcctagggaggattgcatcagcccgcaccaagaaaactaggcaaatgacgtctaaggcagcaaaggaaattgctgacaagattgattcgttggagaaccaggcctcacaaggttcgtttatcgcccatggacgtcaggatgtactgactgctgccattggtcgaccaaaacaccctggtcat

SEQ ID NO: 77840 - DNA, 537 bp, Glycine max
  Peptide Sequence Number=SeqID_194618
gtagtaggtgctgctgccaatggtggtggccatgcgccgggtggtggtggcggcgggattgttctggccgttgttcaggctgatctggaaggcggtgttcttcaggcaggtcagcgtcagggtggcggtctggtcgatgttggccggaatgccgccggtgacgttgccgaaattcatgttggtggtgacgtatctgccgcattgcggcagcacgttggcggtagcggtgaaactgaaggccgcactcgcgctgttggtaccggtggcaccgccgttgcaggtggcggggacggtggcgctaccggccagcacctcgttccaggcccaggtcagcaccacgctggcaccgctgaaagtgctgctgtacgcgccggaggcgaggacctggttggcctggaatctgaccgaacagctgcacagtctgcgcaccactgcgcgccggtcagcagcggtactgttgtagctcatggtcagctcctgcgctggctggtgtgccgcgcgggaccagtgccattgacctggccgaagctggcgtag

SEQ ID NO: 77841 - DNA, 876 bp, Glycine max
  Peptide Sequence Number=SeqID_194619
atggcggcaaaggtggagagaggctgggcaagggcaatctcgccgttagcattggcgagatgctccctgttgactggtgccgctagcccttctggcgggattggcgctgttcatttcggtgttcagaggcacatgcattgctttgttgttatgctcttcttgttcatgatgagactaaacataaggtctgaaatagggtttaaagctagctgtagatgttcacaggttgcgcatgctctccttgttcatgatgagactaaacataagaacacttgcaatgacattgaatacttgcaaaatttcatagtgaaagagagtaagaaactgaagagaggaagaaagaggtatatcatgaattcaattattacagtgttgtatttcaacggaagagtatatgaagacaatgatggtgtaatatttgaaggcagtaaaaaggccattcagattaaacgcggaattagtttcaatgctttgaaaaaaaaattggagataagatttttagtttcaggaaaatatgttgcgttgcaaatttgtgatgacgaagatgttgaaactatgatcgaaagttttcaacaacaacaacaaatgtcagttctagagttgtacgtagaaaaggatgttgctggtggttctatgtttcatgctgcaaattctgttacgtcatgtggacgtaatgtatctcattatgagtcggaactgccaaaaaatataagcaatttacatgttgatgaagatgatgatgatgatgatgatgatgatgattatcttgcatctaactcatacgttgaagagtctttcgatgaagatgatagtgatgatggaatatctcatacagacgatgaagtcactgacatcgttgaacctgttaggggttag

SEQ ID NO: 77842 - DNA, 174 bp, Glycine max
  Peptide Sequence Number=SeqID_194620
atgcatgaaatggctccgaaaaagctttccgtgaagagatctaggagaaacgccgcagctgaagggaccagtgccgccctcgagtttgataaccaccgtttccggagcgccatgcaccagcagcgcttcgaggccatcaaaggatggtcgttccacagagagaggcgcgtctag

SEQ ID NO: 77843 - DNA, 273 bp, Glycine max
  misc_feature (175)..(175): n is a, c, g, or t
  Peptide Sequence Number=SeqID_194621
atggccggaaaaggagatggtcctgctatcggaatcgatctcggcaccacctactcctgcgtcggagtgtggcagcacgaccgtgtcgaaatcatcgccaatgaccagggtaacagaaccacgccgtcttacgtcgctttcactgattccgagcgtttgatcggtgacgccgccnagaaccaggtcgccatgaaccccgtcaacaccgtcttcggtaaaatccctaaccgactttttgctttatcgagatctgcattgttcctagatttttga

SEQ ID NO: 77844 - DNA, 1782 bp, Glycine max
  Peptide Sequence Number=SeqID_194622
atggggataaggatggaaggaggcattcaaaaacttatgaagtttgtaaggggaaaccctgagcaacaacctctgcgattgaaccccgctgaggtacaggatgttattgctgcagtttgctcagaggcttattccccgaataccaatgctactacagcatcaactagactaagtaataacagtggaaaaccatcaacggatgtggcttatgggtcactggataatgtattgctaatacattgttgcatgaaagcattgccaagatatggctacgtggatatgcttagttcttctaaaacagcatgcagggttcgtgcttttgatttaattctaaaccttgcggttcatgcacatctcctagaaccgataattgctgatgatgcttccactattgaagaagaatattctcaagaatcctattatgacagtgacactcaagttatggtgcaaggaagcagtaaaggaagtcctcagaacaaatcagacacaggctctgctattgataagtttgagtcttggattttaaatattctgtatgagatactacttcttcttgttcagtctgaagaaaaggatgaatctgtttgggcatctgctctcagctgtttgctgtattttgtctgtgatagagggaagatcaagagaaaccgtttgcgtggtcttgacataagggttctgaaggcactcgtaaaaagcagtagggagaactcctgggcagagttagttcattgtaagcttatttccatgttaaccaacatgttttatgaagttgctgagtctgtacctggcaaaccaaagtttcttgtggatcaacttgatctgatcggaggggttcaatttatttttattgagtattcccttgcaaactcaagagaagagaggaaaaatctgtatttggtgctttttgattacattctgcatcaaataaatgaaacatgcattgctagtggtgtcaatgaatataatgatgatgagatccaacctcttgctgctcttcttgctcaaacaaatgcgcctgaggcattttatatttctgttaaacttggggtagaaggtattggagagattctgagaagatcaattgcatcagcactgtccagatatcccaacagtgaacgactaaatatgctactggaagttgtagcagagaaatttgattctgtaataagtacatttactcatttggacaaagagttctctcatatgaatcagataaccaaatctctcaagtttctggaaaatatggaaggtgtgattatgagaaatggcattggtttgcaggcaaagcactcatgggctactttacattctcttcttcactctgagagaatttcttaccgtcaaaatgggtatatctggttaggtgatctgcttattgctgaaattaatggagaaagagatggaaatatatggtcgagtatcacatacttcctgcagaaaattgctcaagctggaactcaagattcttcaaatacatcagatgttcctttgcctattttacttatgtgtggccttctaaaatcaaaatactgctacattagatggggatttttgtttgttcttgaaaggcttctcatgagatgcaaatttttgttagatgagcatgaaatgcaacaatcaagcaccagagatctgggtcatgggaagaaagattggcatcttgagaaagccaatgcaatgattgacataatgagtggagctttgtctttggtgtttcagataaatgaaacagatcgcatcaatattctaaaagtaattgtttctgaactcaatgctttttga

SEQ ID NO: 77845 - DNA, 3294 bp, Glycine max
  Peptide Sequence Number=SeqID_194623
atggataattatggatcatcttctccataccggtatccaaaccaatatatgtaccctcccaatcctcaccaaccgtaccctcctcctccaggttcagctcctgatccatatgcacaacatgttccttatcaaccatatccttacctttcttcacattccttcaactattcctatcctccacctcctagatcttcctcacattctggccattttgagtattcctatccccctcctcaccctccaccatcttatgctaatcctccttacccttatccctaccatgttcctccaccaaatcatgatcctcccaagccttccctttcacaccatgctagtttccaacatgaaccatctcattattattatcaacaaccaaacgacgcctattcagcttcagctcctcaagtccatcctgatgtccatttgcgcaccaacagcttctctggtccctactggcatgagaacactagcactgcaggagatgaagtgtcacaaactagtgacaattccaagccttctcagggttctgcttacccgtctttggatgatcttatgagtaatgttcgattgtctgatgaccagccaactgctcctgcatcaccacctgcgcctgcagggcaaccatttatgcattccatttcagttccaaagttgcaacagaagagagaggagttttatggatattcgaataactccttctcggggtggggatcctcctaccacagtcgggtggattcgtctagactttcagatttttctggctcatttaatgaatcagtgcatagtcagagtttgcagattgttccagtgcagaataaagggtccttgagagttttgctcctacatggaaatttagatatatgggtccatgaagccaagaatcttccaaatatggacatgtttcacaaaacattaggagatatgtttggtaaattaccaggcagtgtgggcaacaaaattgaaggaactatgaataagaagattactagtgatccttatgtatcaatttcagtatccaatgctgtaattgggaggacttacgtcattagcaactctgaaaatcctgtttggttgcagcatttctatgttcctgttgcatatcatgctgctgaagtgcactttcttgttaaagacagtgatattgtgggttcacagctcattggcattgtggcaattccagtggagaaaatatactcaggagaagtagttgaaggaaccttccctatcctgaataataatgggaagccttgtaagcaaggtgctgtccttaccctatccattcagtacatacctatggagaaattgagcatttatcaccaaggagttggagcagggccagaatacattggggttcccggcacatattttcctttgaggaggggtggaaccgttactctgtatcaagatgctcatgttccagatggcagcctccctaatgtgttgcttgacagtggaatgtattatgtgaatggaaagtgttggcaagatatctttgattccataagtcaagctcggcgtttgatttatattacaggatggtcagtgtggcacaaagtaaggttggttagggatgctgctggttatgcttcagattatacattgggtgatcttctaaggtcaaagtcacaggaaggagtaagagtgcttctccttatctgggatgatcctacatcaagaagcattttaggttataaaacagatggtgtcatggcaactcatgatgaggagactcgtagattttttaagcactcttcagtgcaagtgcttctttgtcctcgcagtggcaaacgacatagctggatcaagcaaaaggaagttggaacaatatatacacatcatcagaaaactgtgattgtggatgctgacgccggaaataatagaagaaaaattatagcatttgttggtggacttgatttgtgtgatgggcgatatgatactccccaccatcctctttttagaacattgaatacaatacataaggatgactaccacaaccctactttcacgggcaatgctggaggttgtccacgggagccatggcatgatttgcattctaaaattgatggtccagcagcttatgatgttttgactaactttgaggagcgctggttaaaagcttcaaaacctcacgggattaaaaagttgaaaatttcagatgatgatgctttgctaaggctggaaagaattccagatgttattggcatcaatgatgctccaagtgttggtgaagatgatcctgaagtttggcatgctcagatatttcgttcaattgattcaaattccgttaagaggtttccaaaggatccaaaagatgcaacaagcaagaacctagtatgtggaaagaatgtgctgattgacatgagcatacatacagcatatgttaagaccattcgtgctgcacaacattacatttatatagagaatcaatatttcattggctcttcatacaattggagtcaacataaagacctaggtgctaataacttaatcccaatggaaattgctctaaagattgctgaaaagataaaagcaaatgagagatttgcagtgtatgttgttattccaatgtggccagaaggtgttccaacaggggctgccacacaaaggattctattttggcagaataaaacaatgcaaatgatgtatgagacaatttacaaggctttggttgaggcagggcttgaagcagcattttctccacaagattatttgaactttttctgtcttggtaatcgagaggccgggaatttgtatgataatgtcagcatgaccggagctcctcccccagcaaatagtccacaagcagccagcagaaatagccaacgcttcatgatttatgttcattctaaaggcatgatagttgatgatgaatatgtgatattggggtctgcaaacatcaaccagcgctccatggaaggaacaagggacagtgagattgcaatgggagcctatcaacctcatcatacttgggcaagaaaacaatcttatccacatggacaaatccatggatataggatgtcactttgggcagaacatacaggaacaattgaagagtgctttttgaaaccggagagccttgaatgtgtaagaagggttagagcaatgggtgaaatgaactggaaacaattttcagctaatgaagcaacagagatgaaagggcatctaatgaaatacccagtagaagttgatcgaaagggcaaggttagaccccttcaggactgtgaagagttcccggatgtaggaggaaaaatagtaggatcttttcttgccatgaaggagaacctaaccatttga

SEQ ID NO: 77846 - DNA, 243 bp, Glycine max
  Peptide Sequence Number=SeqID_194624
atgtcttccagcttcagctcctcgcgcccgctgcagcagttaattgccgtctcccgcctcaaatcctccacagtcaagaagctgccggaacccttgcgccgtgccgtcgcggattgcctctcctcgcctctctccccctccaatgaaccttctagaactcttcaggaagttattagtccttgtggttggttgggaaagagagtgggatcgagtaagcttagcttctcttacgcacttagctga

SEQ ID NO: 77847 - DNA, 2265 bp, Glycine max
  Peptide Sequence Number=SeqID_194625
atggtgacaaattcaatagctttctcggaccaacagacatacatagtacacatggaccagacgaaaatcaaagcctcaaatcaagacagcacaaaaccatggtatgaatcaatcattgatttcatttctgaatcttcaatgcaagaagatgatgaagaagacattttagctcctcaactcctttacacctatgaaaccagcatgtttggttttgctgtccatctttccaagaaacacctcaaatacttgaaccaagtggatggttttctctcagccatacctgatgaactgtcaaccctccacacaacatacagccctcactttcttggcctaaggaatggaagatcactttggagtgcttctaacttggccacagatgtgatcataggagttcttgattcgggaatatggcccgagcacatcagcttccaagactcaggcatgtccccagtgccttctcattggaaaggtgtttgtgaaaagggcaccaagttctcttcctcaaattgcaacaagaagcttattggtgcaagaacctattacaaggggtatgaaaaattctttgggaaaaaaatcaatgaaacagtggattatctttctccaagagattccgaagggcatggaacacacactgcctcaactgcagctggtagagtggtgaaaaatgccaacctttttggccaggctagaggtacagcaagtggaatgaggtatacctctagaattgcagtttataaagtatgctggtcttctggttgtactaatgccgacgtattagcagccatggaccaagcagtttctgatggggttgatgtattgtcactctctttagggagtattcccaaacctttttatagtgatagcattgccatagcttcatttggggcaaccaagaaaggggtttttgttgcttgctccgcaggcaattcaggcccctttccatcgacagttggaaatggtgctccatggatcacgacagttgctgctagctccactgaccgaagctttccgacaaaagtaaaacttgggaatggaaaaaccttcgaagggtcatctttatatcaaggtaagaagacaaaccaattgccccttgtctatggcaaatcagcaggtgcaaaaaaggaagcacagtattgcattggaggctcccttgatccaaagcttgtccatgggaaaatagttgcttgtgaaagaggtataaatggtagaactgagaagggagaggaagtgaaagtggcaggaggggcaggaatgatactactcaacaatgaatatcaaggagaagagcttttcgctgaccctcatattttgccagccacttccttaggggcttcagcaagtaaaactattagaagctatagtcaatctgttaaaaaaccaacagcttcaatttcctttatggggacaaggtttggtgaccctgcacctgtgatggcagcattttcttcaagaggaccaagcctagtgggaccagatgtaattaagcctgatgtgactgcacctggtgtgaacatcttggctgcttggccaagcaaaattagcccaagctttctcatgagtgacaaaagaaaagtactatttaacatactttctggtacttcaatgtcttgtcctcatgttagtggcatagcagcactgctcaagtctttccacaaagattggtcccctgcagccattaaatctgctctgatgactactgcttacacattgaacaacaaaggagctccaatttcagacatggcctcagataactcaccatttgctaccccctttgcatttggttcaggccatgttaaccctgtaaatgcttctgatccaggattagtctatgatatcagcaccaaagactacttaaattatttatgcagcataaactatacctcttctcagattgctttattatcaagaggtaaatttgtatgttctaaaaaaacacttcttcaagctggtaacttgaactacccttcattttctgttctatttggcagaagtgcctccaatgctagtgtgacatacaggagggttgtcacaaatgttggaaacccccaaagtgcttatgcagttaaattggaacagccaaatggagtttcagttactgttgaaccaaggaaattgaaatttgaaaaagtgggtcagaaattgagctacaaggtgacatttttgtcaattggaggagcaagagttgcaggctttgtatttctcataaagtgtcctccgatctttaagtatgaacttattcccttcctagcattaagagattgttga

SEQ ID NO: 77848 - DNA, 2274 bp, Glycine max
  Peptide Sequence Number=SeqID_194626
atggcgacaaattcaatagctgttgcagaccaacagacatacatagtacacatggacaagaccaagctcaaagtctcaattcattctcatgacagatcaaaaccatggtctgaatcaatcatttatttcatttctgaagcttcaatgcaagaagaagaagaaaaagaagagattttagcccctcaactcctttacacctatgaaaccaccatgtttggttttgcagcccagctttccaagaaacaccttaaatacttgaaccaagtggatggcttcctctcggccatacctgatgaactatcgaccctccacacaacatacacccctcactttcttggcctagataatggaagtgcactttggagtgcttctaacttggcctcagatatgattattggtgttatagattcaggaatatggcctgaacatatcagtttccaagactcaggcttgtctccagtaccttctcattggaaaggtgtctgtgaacaaggcaccaatttctctgcctcagattgtaacaagaagcttattggtgcaagaacctatttcaaggggtatgaaaaagtttttggaaaattaaatgaaacagtgagttatctttccccaagagattccgaagggcatggaacacacactgcctcaactgcagctggtaatgtggtgaaaaatgccaacctttatggccaggctggaggtacagcaagtggaatgaggtatacctctagaattgcagtttataaagtatgctggccaaaaggttgtgctaactctgacatattagccgcggtggaccaagcagtttctgatggggttgatgtattgtcactctctttagggagtgatcccaaacctttttatgatgatttaattgccgtagcttcatttggggcaaccaagaaaggggtttttgttgcttgctccgcaggcaataaagggccctctccatcaacagtttcaaatggtgctccatggatcatgacagttgctgctagctccactgaccgaagctttccaacggaagtaatgcttggaaatggaaaatttttcaaagggacatctttatatcaaggcaacctgacaaaccaattgccccttgtatttggcaaatcggcaggtaccaaaaaagaagcacagcattgcagtgaaggctcccttgatccaaagcttgtgcatgggaaaatagttgtttgtgaaagaggaaaaaatggaagaactgaaatgggagaggtagtgaaagtggctggtggggcaggaatgatagtacttaatgctgaaaatcaaggagaagaaatttatgctgatcttcatattttgccagccacttctttaggggcctcagaaggtaagacgattgaaacctatattcaatctgataaaaaaccaacagcttcaatttcctttatgggaacaaagtttggtgaccctgcaccagtaatgggagcattttcttctagaggaccaagtatagtggggccagatgtgatcaagccagatgtaactgcacctggtgtgaacatcttggctgcttggccacctaaaactagcccaagttttatcatgaatgacaaaagagaagtactatttaacatactttggggtacctcaatgtcttgtcctcatgttagtggcatagcagcactgcttaagtctttgcacaaagattggtcacctgcagctatcaaatctgctttgatgactactgcttacacattgaacaacaaaggagctccaatttcagacatggcctcagataataaagcatttgctacaccctttgcatttggttcaggccatgttaaccctgtaagtgcttttgatccagggttggtctatgatatcggcactgaagactacttaaattatttatgcagcctaaattatacctcttcgcagattgctttgttatcaagaggtaagtttgcatgttctaagaaagcagttcttcaagctggtgacttgaactacccttcatttgctgttcttttcgacagaagtgccttaaatgctaatgtgacatacacgagagttgtcacaaatgttggaaaaccccaaagtgcttatgcagttaaggtgaaacagccagatggagtatcagttactgttgaaccaagggtattgaagtttgaaaaagtgggtcagaaattgagctacaaggttacatttttggcagttggaaaagcaagagttgcgggtacctcctcgtttgggtcactgatttgggtatctggccgatatcaagttagaagtcctatagcattaacctggaaatag

SEQ ID NO: 77849 - DNA, 3780 bp, Glycine max
  Peptide Sequence Number=SeqID_194627
atgggtagggatcagaaaagtgtggtagctatggttggccaggagagaaaaacaaacaagaaaaatgggtctcttgggtttaggtccattttcatgcatgccgatggcaaagatttgtttcttatggttttaggtactattggggcagttggggaaggcttgaccacccctctagtgttgtatatcagtagccgcatgatgaataacattggaagttcctctaacatggatggaaacactttcatccatagcatcaataagaatgcagtgtcttggttatatttggctggtgcctcttttgcggtttgcttcctcgagggttattgttggacaagaacaagcgaaagacaagcggcgagaatgagatgcaggtatctgaaagcagtactcagacaagatgtagagtacttcgatttgcatgtcacgagcacctcagagatcatcactagcgtctccagcgacagcctcgtaattcaagatgttcttagtgaaaaggttccgaatttcttgatgaacatgtcattgttcgtcgggagctacatagcggcgtttgcaatgttgtggaggctggccattgtggggtttcctttcgtcgttcttctcgtgatcccgggtttaatttacggcaagaccttgattgggttgtctagtaaactcagagaagagtacaaccaagctgggacagtggcggaacaaacaatttcgtccatcagaaccgttttttcatttgtgggggaaagcaagaccatgaacgctttctcaaacgcgcttcaaggaacggttaagttgggtctcaaacaaggcttggctaagggattagccgttggaagcaacggcgtcgttttcggcatttggtccttcatgtgctactacggcagcaggctcgtcatttatcatggcgtcaaaggagggacagtttttgctgtcggagcagcaatcgccgttggtggattggcattaggggcggggttatccaacgtgaggtacttttcggaggcgggtgcggcagcggagcgtataaaggaagtgataaagagggttcccaagatagattctgacaacaaggaaggggaaatcctggaaaacatttacggggaagtggaatttgaccgagtggaattcgcatacccgtcgagacccgaaagcgcgattctgaagggactgaacctgagggtgccagcagggaagagagtggcgttggtgggagagagtgggtcaggaaaatctacggtgatagctttattacagagattttatgacccttgtgggggagaggtgcgtgtggatggggtggggatccagaagctgcagctgaagtggctgaggtcgtgtatggggctggttagccaggaacctgctctgttcgcgaccagcattaaagacaacatacttttcggcaaagaggatgccacccaggaccaggtggttgaggctgcaaaagctgcccatgctcataatttcatttcgcttctgcctcacggttaccatacacaggtgggagagagggggattcagatgtcagggggacaaaaacagaggatagcaattgcgagggcaataattaagaaaccacgaattctccttctggacgaagcaacaagcgcgctggactcagagtcagagagactcgtccaagaagcgttggacaatgcagcagtgggttgcaccaccatcatcatagcgcaccgcttgtccaccatccaaaacgcggacctcattgccgtcgtcggaggcggaaaaatcatcgagatgggctcgcacgacgagctcatcaaaaacgacaccggcgcttacgcctccgcgtttcgcctccagcaacaaatgggcaaagacaaggtagaggaaagcacggaaaaaaccgttattccagggactgttttatccacaaccgaaacccaagacatgggacttacttctgtaggccccacaatatccggtggttgtgatgataacatggcgacagcgccatcattttggagactgatggcgctgagctaccccgagtggaagcatggcgtttttgggtgtctgaatgccatggtgttcggtgccgttcagccggtgtacgcatttacgatgggttccaccatacttttgtattttaactctgatcatgaggagataatgaggaggacgaggttctactcgtttacctttctgggcctctttgtggtgtctttgctttcgaatattgggcagcattattgcttcggttacatgggggaatacttgaccaaacgggtcagagagaccgtgcttgccaaaatcctcactttcgaagttgggtggtttgatttggatcagaactccactgcctccatctgttccagacttgccaaagatgctagtgtggtgaggtctctagtgggagatagaatggcattgctagtacaaacattttcagcggtaataacagcctatacgatgggtcttatcatttcttggaggctttccatcgttatgatagctgtacaacccatcatcatagcatgcttttacacaaggcgtgtgcttctcaagagcatgtccaacaagtccatgaaggcacaacaacaaagcagtaacatagcttccgaagcagtttccaaccttagaactgtcacagccttttcttctcaagataggattctcaaaatgcttgaagaggctcaacaacgaccaagtctagagaacataagacaatcttggtttgctggaattgggcttggatgctcccagggccttgcgtcttgcatttgggccttagatttttggtatggtggcaagcttatttcatatgggtacataacaacaaaaacgttttttgagagcttcatggttttggtgagcacgggaaggatcattgctgatgctggaagcatgaccacggatcttgctagaggtgctgatgttgtaggtgatatttttgggatcattgatcggtgtacgaaaattgagcctgatgacccaaatgggtacataccggagaggttaattggtgaaatagagtttcatgaagtgcatttcgcgtaccctgctaggcctaatgtggccatctttgaaaatttctccatgaaaatagaggcgggaaaatctacggcaatggtgggacaaagtgggtccgggaaatcgacgatcattggtctaatagagaggttttatgatccacttaaagggatggtgacaatagatggcatggacataaaatcgtataacctaaagtcactaaggaagcacatagcactagtgagccaagagccaacgttgttcggtgggaccataagggagaacattgcatacggaagatgtgagagtgagagggttgatgagagcgagatcatagaggcggcacgagcggcgaacgcgcacgatttcatagctagcttgaaggaagggtatgagacatggtgtggggataaaggggtgcaactttcagggggtcaaaagcaaaggatagcaatagcgagggcaatactgaaaaaccctaaggtgttgttgttggacgaggccacaagcgcattagatggtccatcagagaaggtggtgcaagatacgttgatgagggtgatgagagggaggaccggcgtagtggtggcacacaggttgagcaccatacacaattgtgatgttattggtgtgttggaaaaggggagggtggtggagattggaacccactcgtccttgttggccaaagggtcatgtggagcttattactccttggtcagtcttcagacgagacatgcaacaacaccaaataacactagttgtactaaagctggtagtacccactctatcaattga

SEQ ID NO: 77850 - DNA, 555 bp, Glycine max
  Peptide Sequence Number=SeqID_194628
atgacaaccttgtcattcttctggtttatgaattcgaagtcgggtcacatctcagttttttccccctcctcggttgaggtcaatcattatgaccagagtgggagatcaaagggaacagcagaagttgtgttcgtgaggtaccatgatgctttagcagccatcaagaaatacaacaatatgaggcttgatggaaagccattgcaaattgagcttgctggaacaagttcggctactcctgctgtcacgcctctttgtcaaaataacttgatgggaagaccaaatgatcatatgaggaagggttggaggtattgggttccgcaatgctttgctcagggccaccttccaaggggccgtggagaagagaaggaccatattcgaaaggtgtcttctggatatcttgatcatagctttgagaggttccaccgcactcagactcagaggccacgcaaaaatcttgatgatgacttggagaggtatcacttagaggctctaagcggattaaaaagcaaaatggaaagtgagataaccactgatagctttaatgactcattctga

SEQ ID NO: 77851 - DNA, 633 bp, Glycine max
  Peptide Sequence Number=SeqID_194629
atgtgtgacatactattctctcaattgtgcctaagagttcctcctgctgcagctcttacctttggagatgatgtgcaacatggcagaaattcaaatcacactaatgtaagcaaaaggtttgatggtgataatcatgtcaaacaagatacttttcattgggatggacacatggaagaagcaaatagaaggtccggctaccataataactaccacctggatcatgagactgcatcaatggcagcacttttccaaggacgagctgttgtcccaatgcaattaattgcacgcgtccctgctgccatactatattggccactaattcaattggctggagcagcaacagatgatattgcattgggtgttgctgttggaagtaaaggaagaggaaacctgcctggtgctacatctgatattcgggccacacttcttctactacttattggtaaatgcacagcagatcctgttgctttccaggagcgaatgatgaccgagaacccagagaaatatcaacacatgcttcagaatcttgttgttaaggctcagcagagtaacaatgaaaaactgttagagaacccgtatcttcaaatgtgtggcatacttcaactggcaaatgatctggggattgacctgtga

SEQ ID NO: 77852 - DNA, 903 bp, Glycine max
  Peptide Sequence Number=SeqID_194630
atgataaggggactctcaaatttggaagttgaatatattttggtccaagatgtagaagtacaatgcattgagagtcctgaaaggagcatctttgtggatttgagggatattcaaagtcagcaaaacattggtgggaattcattgaatgtcaactacagcattggttcaagagatatgccttgtcttacaaataaagtgaacatcccgcttttgatttttaggagtgcattcagtgatctgagagaaatgtttccattcaattcaaatcaattacagagtaaaaatatgtttattcatgctaatgatggtcaaaatgaaaatgctacttctctcagttctgatgaaacaaagtctagcgatgtgttagcaatctccatgcctgtcactgtaggaaatttaatctcagatgacagctcttacagctgcagtacttcagttgatccattttggccgctttgcatgtatgaactgcgaggaaaatgcaacaatgatgagtgtccctggcagcatgctaaggactatggtgataaaaacattcagcacgctggttctaaaaatgaagattgtcaaggtagattaccattgcctctacagaacgctaatggtgtggcaaaagttcccaagtgttacaaagctacgattctgccaacttaccttgttggtttagatactctgaaagcagatcaatttgcatataaacctgttgtggtacatagaaatgctcaatgctggcagaaacatttcacccttactttagcaacatcaaatctgcttggaaatggtttacctgctgatggtccattattgcatggtggtgatgaacgcatagaggtccatggggcatgtaacacacaattatcttcttttcattggagaactggagctggggtttgttgcttttaa

SEQ ID NO: 77853 - DNA, 2658 bp, Glycine max
  Peptide Sequence Number=SeqID_194631
atgaggttgagaataagaaccataacagcgagacattcacttcacaacattcacaataatagatacgaccactctcactatgttcattccgatgccagggcaatttctcgaaccaccaacacaattccacaccattgcaaccacaaccaccactactaccttcaccttcttcgttcatgcaaatacttgaaccctctgctccaaatccatgctcgtctaattgtccaacaatgcaccttggcacccaattccatcacaaacccttctctgattctgtggaactcattgattagagcttattctagactccatctattccaggaagcaataaaatcgtatcaaacaatgtcatacatgggacttgaacctgacaagtacacattcacctttgttttgaaggcttgtactggtgctttggacttccatgagggtgttgccattcatcaagatatagcttccagggagttagaatgtgatgtttttattgggactggacttgttgacatgtactgtaagatgggccacttggacaatgcaagaaaggtatttgataaaatgcccgggaaggatgttgcttcttggaatgcaatgatttcaggcttatctcagagctcaaacccttgtgaggcactggaaatatttcagaggatgcagatggaggaaggtgtggagccggactctgtgagtatcttgaacttggctccagctgtttctagattagaggatgttgattcttgcaagtctattcatggttatgtggttaggagatgtgttttcggtgtggtttctaattcattgattgatatgtactctaaatgtggtgaggtaaagttggctcatcagatttttgaccagatgtgggttaaggatgatatctcgtgggcaacaatgatggctggatatgtacatcatggttgttactttgaggttcttcaattactagatgaaatgaaacgaaagcacataaagatgaataagatatcagttgtaaactccgttttggcagctacagagacgagagacctggagaaagggaaggaagttcataattatgctttacagctagggatgacgtcagatattgtagttgctactcctatcgtgagcatgtatgcaaaatgtggtgagttgaagaaagctaaagagttttttctgagtcttgaaggaagagatttggttgtttggtctgcttttttatcagctcttgtccaagcaggatatcctggagaagcattgtctatattccaagagatgcagcatgaaggtttgaaaccagataaaacaattctatcaagtctggtttccgcatgtgctgaaatttcaagttccagattaggtaagatgatgcactgctatgttattaaagcagacatggggtcagatatttcagtagcaacaacccttgtctcaatgtacactagatgtaaatcatttatgtatgctatgacgctattcaacagaatgcattataaagatgttgtggcatggaatactttgataaatggatttaccaaatgtggtgacccacgtcttgcattggaaatgttccttagattacaattaagtggggttcaaccagatagtggaaccatggtgagtttgctttcagcttgtgcccttctggatgacctttatctaggaatctgctttcatggaaatatcataaagaatggtattgaatctgaaatgcatgtaaaagttgctctaatagacatgtatgccaaatgtgggagcctttgcacagctgaaaacttgtttcacttaaacaagcatgtaaaggatgaggtatcttggaatgtaatgattgcagggtacctgcataatggatgtgccaatgaagcaatttccacatttaatcagatgaaattggaaagtgtaaggcccaatttagtcacatttgtgaccattcttccggctgtatcatatttatcaatattaagagaggccatggcttttcatgcctgcataatccgaatgggattcatatctagtacccttattggaaacagtcttatagatatgtatgctaaaagtgggcaactcagttattctgagaaatgctttcatgagatggaaaataaaggcactatctcatggaatgcaatgctttcaggttatgctatgcatggccaaggtgaagttgcccttgcccttttttcacttatgcaagagactcatgtccctgttgattcagtttcctacatcagtgtattatctgcctgcagacatgctggcttaattcaagaaggaaggaacattttccagtctatgaccgaaaagcacaatcttgaaccaagtatggaacactatgcctgcatggttgatcttttaggctgtgctggtttatttgatgaagttttgtgtttaattgataaaatgccaacagaacctgatgctcaagtctggggagccctgctgggagcatgtaaaatgcattccaatgtgaaattaggagagattgccctccatcacctcctcaaacttgaaccaagaaatgcagttcattacatagttttgtcagacatatatgctcaatgtggtaggtggattgatgccaggaggacaagatcaaatatgaccgaccatggattgaagaaaaatcccggatatagttgggttggagctcataaacaaggactatccctttctggcaaatga

SEQ ID NO: 77854 - DNA, 219 bp, Glycine max
  Peptide Sequence Number=SeqID_194632
atgctagaacgtgttcgcgccaatggcgggactgcccagatgcctagtcagcatgtcccgccacgccagtttgaatggcggtatggaccctgtcccgctgctgtcaatggcggcatccatggttttgcaccctccgctgtttcacaagaacataagattgtggtatgttttataatagaggcagagtgtgagtgcatcttagaagatgatgatgcatga

SEQ ID NO: 77855 - DNA, 867 bp, Glycine max
  Peptide Sequence Number=SeqID_194633
atgagggcagagaacctattgcaattgcaacaccgcacccagaagtgcaccctgggctgtcccgtactcgatcgctgcctcgccggcggcgtcccctgcgcctccgtcaccgagttcgtcggcgagagcggttgcggcaagacgcagctctgcctccaactcgccctctccgcccagctccccccctctcacggcggtctctccgcctcctccatcttcatccacaccgagttccccttccccttccgccgcctccgccacctctcacgcgccttccgcgcctcccaccccgacctcccttgctccgacccctgcgaccgcgtcttcctacgcgccgtccactccgcgcacgaattactcaacctaatcccaaccatcgagactttcctcttgcactcgaaatcgccgtggcggccggtgagaatcatcgtgatcgattccatcgccgcgcttttccgctccgatttcgagaacaccggatcggatctccggcggaggtcgtcgctgtttttcggaatctcggggggattgcggcagttggcgaagaggtttgggattgcggtggtggtgacgaaccaggttgtggatttgatcggtgatggtgacgtgagctttgggagtttgggtaatgggctttattcttcgggccgaagggtttgtcctgcgttgggcctggcttgggcccattgtgttaactcgagactgtttttgtcgaaggatgaggatgagccgccggtgaagacaaggaaaatgagagttgtgtttgctcctcatttgccgcactcttcttgcgagtatgttattaaaggggaaggcgttttcggcgtggagatgatgcaacaccgagaagaagagataaatctttga

SEQ ID NO: 77856 - DNA, 1872 bp, Glycine max
  Peptide Sequence Number=SeqID_194634
atggatgacgatgccagcttttcaagttttgaagtcaaatctccttactataagcaaaccggccacgcaaagcgcctaattggtaggagatttagtgatcaagaggttcaaagtgatatggagctatggccattcaaagtcattgctgatgttaatggcaaaccaatgattgctgttgattacaattgtgagaaaaagcaattttctgcagaagaaatttcatccatggttttggcaaagatgcttgacattgcagagtctttccttggatcaacagtgaagaatgctgttatcactgtgcctgcttacttcaatgattctcagcgacaagctactaaagatgctggtaaaattgctggcctcaatgttttgagaatcctccatgagccaactgctgctgcaattgcatatcggcttgaaatgaaaaattgtaataatgatagaaggaacgtttttgtgtttgatcttggtggtggtactttggatgtgtctcttcttgtttttgagaaggatcatatccgagttaaggcaactactggagacactcacctcggaggagaggacttcgataacaatatggtgacttactgtgtgaaagagtttaagagaaagaataaaatggacattagtggaaacaaaagagcccttaggaggttgaggactgcttgtgagaaagcaaagaggatactctcatgctctacaatgaccaccattgaggtagactctttgtatgatggtattgatttccactcatcaataagtcgcgcaaagtttgaggaactcaacaaggactaccttaacaagtgtattgagtttgtagggaagtgtctgatagatgctaagatggacaagagtagtgttcatgatgttgtcctcgcaggtggatctactaggattcccaaattgcagcaactattaagtgacttctttgatgggaaggatctctgcaaatgcatcaatgctgatgaggccgttgcatatggtgctgctgtccatgcttatatgcttaatggtgagtccagtgagaaggttcaaaacgcttcactttgggaagtcactcctctttcccttgggttgcaagaagatggaggtatcatgaaagtaatcattcctaggaatactagcattcctacaaagatggaagatgtactcacaacacattttgataaccaaaccaatatcttgattcatgtatacgagggtgagaggaaaagaactagagacaacaacttgttgggtaagtttgtgctagaaattcctccagttccacgtggtgttcctcaaattagcgtttgctttgaacttgattatgatggcatcctacatgtttctgccgaggaaaaatctaggggaatatccaagaagctggccataacaaatgacaaaggaaggctttcgaagaaagaaattgaaaggatgatatcagaagcagagaagtacaaagctgaagatgagatgtataggaacaaggtacaatcaaggcatgcattggagaagtacgcttacaacatgagggatgctataaacattaaggagattagcttgaagctttctccagaagacaagaaaaatatcaatgatgcaattgattctgccttagagtggctcgaggtcagcatggatgcaaacccaaatgattttgacaacatgcggagcactctttctagcgtttttaatccagttattgtgaagatgataaaggatgaggataatgttgcgcctccagatactgttgctagctctggtagcaatagtgtgaagaatggcttgttatcaatattggcaaattttgctctcgatgcagtgtattcagctgctacaggtgatatcattggatttgcttccgtgattgttgactgtttgtcaatttag

SEQ ID NO: 77857 - DNA, 2007 bp, Glycine max
  Peptide Sequence Number=SeqID_194635
atggctgacactgaacaagttgttgagatggctcttcttattctcaaccaggaaattaataaattgcagggtgtaaggaaggctctgtctgtgctgtccaaagctctggacaatgatccaacatctgtggttctctggattgtttatctactcatttactatggaaatttgaagccaaatgaaaaggatgacatgttcttgtgtgcggttaagctctgtgaagaatcttatgtgctgtggctcatgtacatcaatagtcgggggaagcttgctgaccgattggttgcctatgatactgctctttcagtgctctgtcagcatgcagctgccagtcccaaggacataatacatgaaagtccatgcatcttagacctgtttttacagatgatgcattgcttatgcatgtcagggaatgttgagaaggccattgaaagaagttatggaatattccctactacaacaaaatccaatgagcctcatcatctgtcactctcagaaatactcaattgcttaacagtttctgacaaatgtgtattctgggtttgttgtgtttacttagttatttacaggagactgcctgatgctgttgttcagaagtttgaatctgagaaaagtctccttgatattgaatggcccgttgtcagtttatctgaagatgacaaggagatggctattaaacttgtggagacagctgttgaatctattgattcttttgtctatagtgaatctgtaaaaagtgaagttaatcttaggtctgctcaactttttgcactcaatcatatcagatgcatggctgctcttgataacaaagaatgctttagagatttgctggataaatatgttaagctgtatccttcctgcatagaattggtcctggcatcagctcgtatacagaaacaggatattgatgttgatggtttcatgggatttgaggaagccattaacagatggccaaaagaagttcctggaatccagtgcatctggaatcagtacattgaaaatgctatccacaatcgaagaattgatctggcaaaagcaattacagtccggtggttcaagtgtatttggcaagtacaaaatctcccaaatggagggaaggagatcactgatgatggtaattcttgtggctcattgggattggattcaaaatctgtttcagacagattcagttctgatcataaacagatagatatgatgtttggatttcttaatctgtctctctataattttttacagaatgataaaacagaagcatgcatagcttttgacaaggctaagagtactgctagttttggaggtttagaacaatgtatgaagacatatgtgatgtttctggtttatgatgcgtggagcttgaaggaggatggttctgatggtgccatcaagaggattttggagttgtatgcagatggttcctctcaggcattgctagtccccaaggtgttgaccagaaaatttgttgacaacatcaagaagccaagagtacagcatcttattggtaacatattaagtccagtttcatttgactgttctctgctaaacttgatacttcagtcatggtttggttcatctcttttaccccaaactgttagtgaccccaaacatctggtggattttgttgaagccattatggaggttgttcctcacaacttccaattagctattgctgtttgcaagctactaaccaaggaatacaattctgactcaaactcagccagtctatggttttgggcttgttcaaacctgctaaatgcaattttagatgccatgccaataccacctgaatacgtctgggtggaggctggagagcttttgcacaattctatgggcattgagacaatatgtgacaggttttatagaagggctctatcagtgtatccattttctatcatgttgtggaaatgcttctataagctgtatatgaccagtggagatgcaaaagatgctgttgatgcagcaaaacaaatgggtattgaactgttaactaaagatttaggaaccgattga

SEQ ID NO: 77858 - DNA, 240 bp, Glycine max
  Peptide Sequence Number=SeqID_194636
atggcaacaaatggcaagacacctgcgataggaatcgatttgggcacgacatactcatgcgttgcagtgtggcagcgtgatcgagtggagatcatcgcgaacgaccaaggaaacagaacaacaccctcttatgttgctttcaataacacccaaaggatgattggtgatgctgccaagaaccaggctgctaccaatccaaccaacactgtctttggtaaaatactaaaccctttagcttaa

SEQ ID NO: 77859 - DNA, 1532 bp, Glycine max
  Peptide Sequence Number=SeqID_194637
atgctggtgccattgctggcctcaatgttttgagaatcatcaatgagccaactgctgcggcaattgcatatcggcttgaaaggaaaaattgtaataatgaaagaaggaatgtttttgtgtttgatcttggtggtggtactttggatgtgtctcttcttgtttttgagaaggattatatccgagttaaggcaacatctggagacactcacctcagaggagaggacttcgataacaatatggtgacttactgtgtgaaagagtttcagagaaagaataaaaaggacattagtggaaacgaaagagcccttaggaggttgaggactgcttgtgagaaagcaaagagaatactttcatccactgtaatgaccaccattgaggtagactctttgtatgatggtattgatttccactcatcaataagtcgcgcaaagtttgaggaactcaacatggactaccttaacaagtgtatggagtttgtagagaagtgtctgatagatgctaagatggacaagagtagtgttcatgatgttgtcctcgcaggtggatctactaggattcccaaattgcagcaactattaagtgacttctttgatgggaaggatctctgcaaatgcatcaatgctgatgaggccgttgcatatggtgctgctgtccatgcttctatgcttaatggtgagtccagtgagaaggttcaaaacactttaccgagggaagtcactcctctttcccttgggttggaaaaagaaggaggtatcatgaaagtaatcattcctaggaatactagcattcctacaaagatggaagatgtattcacaacacatttggataaccaaatcaatatcttgattcatgtttatgagggtgagaggcaaagaactagagacaacaacttgttgggcaagtttgtgctagaaattcctccagttccgcgtggtgttcctcaaataatcgtttgctttgaagttgatgatgagggtatcttgcacgtctctgccaaggagaattccttgggaataaccaagaaggtgaccataataaatgacaaaggaaggctttctgaggaagaaattaagaggatgatatcagaagcagagaggtacaaagctgaagatgagatgtataggaagaaggtagaagcaaggtatgcattggagaagtacgcatacaacataaggaatgctataaagcataaggggattagtttgaagctttctccggaagacaaggaaaagatcaatgatgcagttgatcgtgccttagaatggcttgaggtcagtgtggatgctgaaaaagaagatgttgacaatttccggggcaatctttctagcgtttttgatacaatcatggttaaaatgataaagggtgaggataatggtgcgcctccaggtgctgttgctagctctggtagcaaaagtgggaagaatcgctggttatcaatattggcaaaatttggtctccaggcagtgtattcagctgttacaggtgatatcattggatttgtttccgtgattgttgactgtttggcaaattag

SEQ ID NO: 77860 - DNA, 615 bp, Glycine max
  Peptide Sequence Number=SeqID_194638
atggtggccacagcgtgcgcggcggccttgctcccgcacgacagcattcccaatcggatctcgatgacattaaccatggacaggacgaggaagaggcagcccatgacggagccaatggcggagcccagcatgccgagccttagggctttcaggttgatgtgggcccggaaggcctcgtcggcgtccttgctgttgagcaggttcagcgccagcttcagcccctgggccaccagcgacgagaaaaggaagaagctgaaggagacgacttcgaagacgagaagcttcttggccacgtcgacaccggcgtcgcaggaggagcggttctcgaggctgcgctggcccggggtggtcagggagaggcccacgaacactgcgattgtgaagagggagttgacgttcaccaggccgtctagggctgtcacgtggacgctggtcgtcgaagaggacgaggagactcttctgagagatactcgtccatggagaatcaatggctgtgagagaaagaggaagattttgagggttaagggcaattgcttgcttaggagagagggagatgctttcgttttctactttgcaaggaaaaggaaggacaggacaaagacattagaaatttag

SEQ ID NO: 77861 - DNA, 945 bp, Glycine max
  Peptide Sequence Number=SeqID_194639
atggatattgtctggcaactgcagcagcagtcggcgcgttttgatgcgcaggaatcaaagctggcgcgatttattctggataacctgcacgccagcgcgcaggccaccatggagagtctggcggcgcaggcgggtgtcagcccggctgtactccagcgctttgctgcctcggcgggctaccgcgatctggatgattttctgcaccaggtgcgccaggccggccagcaggaaagtgcgtttatgacggtgattcgtcagcggcaggcttcgctcagccagcaggagcagcgggtggcgcgcgccatcctgcgtgacgccgcgttcgcggcctcggccaccattgaacagctggccagccgggcggaagtcagtgcggcgaccattacccgctttgcccgttcggtcggctgcgacgatattcgcgatctgcgtatgcggctggcacgcgccagcgccgagccagccagcgccagccacggtgcggtgccgcagctggtgagtctgcatcaggcgctgacccggcagtggcagctgctggatgacagccgctggcagcaggcggcgcaggcgctgcgtcaggcacgcagcgtgttgctgatcggtgccgccggccagcacacgccgctggtggcggaagtgcagcagcggttgagtgaagccgggctggcgctggcgtggatccaggacgacaacctgctgcgcctgacgctcagccgtttgcagccggacgatctgctgctgatcctcgcgccggacaccatcaacagcagcgtgctcagcgcggtgcatcacgctcacatccagcagaccccagtgatggcgctgtgcccagcggcgctggatctcgccagccaggccaactactggctgccgctgccggatgcagcaccggcgcggcgctatggcattctgctggcgctggaccggctggcggcggcgctgtaa

SEQ ID NO: 77862 - DNA, 339 bp, Glycine max
  Peptide Sequence Number=SeqID_194640
atgtctaccagcatgctggtgaataaaatgcagcacgccgcacaagcgcgcgggctggcgatcaacattcaggccgtcccggtagccgatttcgaacgtatcctgccggatgcggatgtcgtgctgctcggcccgcaggtgcagtttgaagctgcccgcctcaccgccatcgcggccccgcagggcaaggcggtcgccgttatcgacatgatggattacggcatgatgcgcggcgaacaggccggtgctgcgcgcagcgccgctctcagcgccctgcggctggcgcgcgccggccagtttgaggcggcacagcagcagctggcggcggcgcgggaaaac

SEQ ID NO: 77863 - DNA, 585 bp, Glycine max
  Peptide Sequence Number=SeqID_194641
atgcgctacgcctttaaactggcgcagtcgcggccgcgcaaactgctgacggtggtgaccaaatccaatgcccagcggcacggcatggtgatgtgggatgaaattgcggcggaagtggcgcaggagttcccggatgtgcagtgggacaagatgctggtggatgccatgacgcaccgcatgacgctccacccgcaatcgctggataccattgtcgccactaacctgcatgcggatattctctccgacctcgccggcgcgctggccggcagtctcggcgtcgcgccaaccgccaatatcgatccggagcggcgctttccgtcgatgttcgaaccgattcacggctcggcgtttgatatcaccggtaaaggcatcgctaacccgatcgccaccttctggaccgcggtacagatgctggagcatctgggcgagcgcaacgcggccgcgctgataatgcagggcattgagcacgtgtgcgcggcgggcattctgacgccggacgtcggcggcagcgccaccaccgctgacgtgacgcgcgcgctggtgcagtttattgaagccaaatctcaggtggcggcaaccgcctga

SEQ ID NO: 77864 - DNA, 240 bp, Glycine max
  Peptide Sequence Number=SeqID_194642
atggcaacaaatggcaagacacctgcgataggaatcgatttgggcacgacatactcatgcgttgcagtgtggcggcatgatcgagtggagatcatcgtgaacgaccaaggaaacagaacaacaccctcttatgttgctttcaataacacccaaaggatgattggtgatgctgccaagaaccaggctgctaccaatccaaccaacactgtctttggaaaaatactaaaccctttagcttaa

SEQ ID NO: 77865 - DNA, 5331 bp, Glycine max
  Peptide Sequence Number=SeqID_194643
atggcttcgaaactcctcagcatatctccccttgcaaccaaaaaccaaaaggttacaactcctcaaatacccagatgctttgtcctcaagtttgtcaaatatctttgtttttcatcagctcttcaccctgaacactttgttaaccatgaccattgcttcaattcagactcattctatgcatctcttattgataattctacccacaagagacaccttgatcaaatacataaccggttagttatctccgggctgcaacataatgggtttctcatgaccaaactggttaatgggagttcaaatcttggacaaatttgttatgctcgcaagctgtttgatgaattttgttaccctgacgtgtttatgtggaatgctatcattaggagttattcgaggaacaatatgtacagggacaccgttgaaatgtatagatggatgagatggacaggagtgcatccagatggattcacttttccttatgtactaaaagcttgtactgagttgttagattttggtttgagttgcataattcatgggcagataatcaaatatggctttgggtcagatgtgtttgtgcagaatggccttgttgcattgtatgctaaatgtggccatattggtgtggcaaaagtggtgtttgatgggttataccatagaacaattgtttcatggacttccatcatttctggatatgcacagaatgggaaagctgtggaagcattgagaatgttcagtcaaatgagaaataatggtgtgaaaccagattggattgctctggtaagcattctgagggcgtatactgatgtagatgacttagagcaagggagatctattcatggctttgtcatcaaaatgggtcttgaagatgagcctgctttgcttatctctcttacagctttttatgctaaatgtgggctggtgacagttgcaaaatctttctttgatcaaatgaagacaacaaacgtgattatgtggaatgcaatgatatctggctatgcaaagaatggccatgctgaggaagcagtaaatctattccattacatgatctcgagaaatattaaaccagattctgtcactgtgaggtctgcagtcttagctagtgcgcaagttggttccctcgaattagcacaatggatggatgactatgttagcaagagtaactatggaagtgacatttttgttaatacttctctcattgatatgtatgcaaaatgtggaagtgtggaatttgctcgaagggtatttgatcgtaattctgataaggatgttgttatgtggagtgccatgattatgggatatggattgcatggtcaaggatgggaagccattaatctttaccatgtgatgaagcaagcaggggtgttcccaaatgatgtcacctttattgggcttctcacagcatgcaatcattctggccttgtaaaagagggatgggagctattccattgcatgaaagactttgaaattgtgcctcgtaatgagcattattcttgtgttgtagatctcttgggacgagcaggttatttgggtgaggcttgtgcatttataatgaaaattcccattgaacctggtgtaagtgtatggggggcacttttaagtgcatgcaagatctatcgctgtgtaacattgggagaatatgctgcaaacaagctattctcattggatccatacaatacagggcattatgtacaactctctaatctctatgcttcctcctgcttgtgggattgtgttgcacatgttcgagttctaatgagggagaaaggattgaataaggaccttggttacagtgtaattgaaataaatgggaagctacaggcatttcatgtaggggacaagtcacacccaatggctaaggaaatattcgatgagcttcagagattagaaagaaggttaaaggaggttgggtttgtcccatatacagaatctgttttgcatgatctgaattatgaagagaaggaggagaatcttagttttcatagtgagaggatagctgttgcttatggtcttattagtactgctcctggaactacacttagaataacaaagaatcttcgagcatgtgtgaactgtcattctgccataaagcttatatcaaagcttgttgagagggaaataattgccgtgcctacctccaaaggtcaagcccttgctgatgagtatggtgtcaagttttttgaaaccagtgcaaagacaaacatgaatgtggagaagtctcagattatcaagattaaccaacccgaccaggcagccacaggggcatcgtcctcatcatcatctatcatggcatggtttagagctggagcaagcatagcaaaacatgcaattaggagaactctttctaagggtggatccacacaccttgtgtcaagggcaagggtccttccatcgataccatcatcacatagcagaagcttccacagctcggttttcaaggagcaagctgcacctgttcctcgtgcggttcctctttcaaagctaacagatagtttcttagatggcacaagcagtgtgtatctggaggagcttcaaagggcttgggaggctgatcccaacagtgttgatgagtcatgggacaatttcttcaggaactttgtggggcaggccacaacctcacctgggatttctggtcagacaattcatgagagcatgaggttgttgttgctggtgagggcgtaccaggttaatggccacatgaaggcgaagttggatcccttgaatctggaaccaagggaaatccctgaggatttggaccctgcactttatggcttcactgaggctgatcttgatagagagttcttcttgggggtgtggaggatggctggtttcttatctgagaaccgccccgtgcaaacccttagatccattttgacaaggcttgagcaggcctattgtggaagcattggatatgagtatatgcacattgctgatcgtcacaagtgtaattggcttagggataggattgagacccccacccctacacagtttaatagggagaggcgcgaggctatctttgataggcttgcttggagttctttgtttgagaacttcttggccaccaagtggacctctgcaaagaggtttggacttgagggtggagagactcttattcctggaatgaaggaaatgtttgatagggcatctgatcttggggttgagagcatagttataggaatggcacatagagggaggctgaatgttttggggaatgtggttaggaagccgctgcggcagattttctgcgagtttagtggtggtcttcagcctgagggggaagttggactctacactggaactggagatgttaagtatcacttggggacgtcgtatgatcgccctactcggggtggcaagaggattcatttgtctttggtggcaaatcctagtcacttggaagctgttaatccagttgttgttgggaaaactcgtgccaagcagtattactcaaatgatgtggatagaacaaagaacatgggtgtgctgattcatggagatggaagttttgctggacagggtgtggtctatgaaaccctgcatttaagtgctcttccaaattacactactggtgggacgattcacatcgtgtttaataatcaggttgcatttacaactgatccaacgtctggcaggtcttcacaatattgcactgatgttgccaaggctttggatgctcccatctttcacgtgaatggtgatgatgttgaagcagttgttcatgcctgtgaacttgctgctgagtggcgccagactttccactctgatgtggttgtcgacttggtgtgttaccgtcgatttggccataatgagattgatgaaccatctttcactcagcctaaaatgtacaaggtaatccgaagccatccatcaactcttgagatctatgagaagaagcttttggaatcaggggagttgacacaagaagaaattgataggatacacaagaaggtcacatcaattctaaatgaagaatttttggctagcaaagaatacattccaaaaagaagagattggctttcagcgtattggcttggtttcaagtcacctgaacagctttcacgtatccgaaacactggtgtgaaaccagagatcttgaaaaatgttggaaaagcaatcacaaccatccctgaaaatttcacacctcatagagcagtgaagaggatatatgaacaacgggcccaaatgattgaaactggggaagatattgactggggatttgcagaggcgcttgcttatgctaccttgcttattgaaggtaaccatgttcgattaagtggtcaggatgttgaaagaggaacttttagtcaccgccatgctgtagttcacgatcagacaacaggagagaaatattgtcccctggacaatgttataatgaaccaagatgaagagatgtttaccgttagcaatagttcactttctgagtttggtgttcttggatttgaattgggttactcaatggaaaatcccaattcattgataatttgggaggctcagtttggtgattttgctaatggtgctcatgtcatatttgacaatttcttggcttctggtgaggctaagtggctccgtcagactggtcttgttgtgttacttcctcatggttatgatggccagggcccagagcattcaagtgcaagattggaacgctttcttcagatggctgatgacaaccctcatgttatccctgagatggatccaactcttcggaagcagattcaggagtgtaatttgcagattgtgaatgttacaactcctgctaattttttccatgttctaaggaggcaggtacatagagaattccgcaagcctctcattgtaatgtcccctaagaacctgcttcgtagcaaggcttgcagatcaaatttatctgagtttgatgatgtccaaggccacccaggctttgacaaacagggaaccagattcaagcgcctcataaaagatcaaaatgagcacaaagatgttgaggagggtattagacgtttagtactttgctctggaaaggtttactatgaacttgatgaacatcgaacaaaggttgatgcaaaggatgttgcaatatgtagggtggaacagctttgtcctttcccttatgaccttgtccaacgagagcttaaacgatatccaaagccaatgaacatgggtggatacacttacattttaccccgacttatatcttcaatgaaagctgtaaataggggaggttatgatgatgtcaaatatgttggtcgtgctccatctgcggccacagccactggtttcctcaaggttcaccagaaggagcagactgagattgctgaaaaagcccttcaacaggaaccgatcgacttcccattttga

SEQ ID NO: 77866 - DNA, 192 bp, Glycine max
  Peptide Sequence Number=SeqID_194644
atggataaccatgagcatgcaaatcatcgtgacacagtacaagccaggataaagaataaaggtatcaggcagcacaaagttaatgatcaggctcagaatattgattgctgtgtttcagtttcttcacctgaaaaccaaaattatatgtcctcagctaatgaccccgcaattaatagagaaggtaacgattaa

SEQ ID NO: 77867 - DNA, 324 bp, Glycine max
  Peptide Sequence Number=SeqID_194645
atggtttgttgttggttggagaaccccaattcccaagcatttaagcgtcacatttcaagaatcaaagacgatctctgggtggctgaggatggaatgaaaatgcagctgcaaattctaatgaatgcaattcaatgtcagtcatatggtggttctcaattatgggacacggttctttctattcaagcaatcttagctactaatcttaaggatgaatatggttccatgcttaagaaagcaaataatttcataaaattctcacagattacaacaaatagttctggtactccaagtgactggtatcgccacatttctaaaggtggttga

SEQ ID NO: 77868 - DNA, 377 bp, Glycine max
  Peptide Sequence Number=SeqID_194646
gtgaaggtattactggtatgatgagacaagcagtccacagaaacctctatagaagcttcttggttggaaagaaaaaggagcctatcaacattttgcagtatgctgatgatactgtctttgttggagaggctgtgtgggagaatattcatgttataaaggcttggaaggttgggagtggggagaatattaaattctggactgataactggctaggggaacaacacaccctgcagcagaagtataataagcttttcctcataagtagagaacaaaaggaccacatctctcaaatgggacattttaatcataatagctggaggtgggacatgaggtggaggaggaatctctttgatcatgaaagccatttggctgtgtag

SEQ ID NO: 77869 - DNA, 207 bp, Glycine max
  Peptide Sequence Number=SeqID_194647
atggaaggaaacaagtctaatgtagttaacactgcatgggctatgttggcacttattgaagcagggcaggctgaaagagatccagccccattgcatcatgcggccaaggttttaatcgatttacagctagaaaatggggagtttcctcaacaggggagcaatgagagagtaaggaggattaatcttagtcataaaatcaaattgtaa

SEQ ID NO: 77870 - DNA, 2061 bp, Glycine max
  Peptide Sequence Number=SeqID_194648
atgggcgagaaactgattaagctgccggtatggcatgacggtgaaattgcgctgcagcagcaggcgggggtggcggaacgtatggccgatgtcgggcagcgcgtgattcgcgattacatgcccgatcagcatcgtgacttttacgcgcagctgccgtttatcgttgccagcagcgttgatgcacagggtgatgcctgggccacgctgctggaaggccagcccggttttatcttctcgcccaacgccaccacgctggatatcgcggcccgccctgacgtcagcgatccggcggccgccgggatgaccgatggcgcaccggtgggcctgctcggcatcgagctgcacacgcggcggcgcaaccgcatgaatggcgtgctgacggcgattggcggcggcctgcgcgtgcaggttgaccagagcttcggcaactgcccgcgctatattcagctgcgcgatttccgcttcgaccatgcgcccggcagggcttatcagggcgaagttgagacgctcagcgcgctggatgacgccgcgcgcgccgccatccggcaggcagatacgttttatgtcaccacctatgccgaccaggcgcgccggcaggtggacgtttcgcatcgcggcggcaaagccggttttgtgcgcatcgctgccgatgatgtgctgaccattccggacttcaacggcaacctgttcttctccaccctcggcaatatcgtgctcaacggcaaggccgggctgctgtttatcgactacgccagcggcgatgtattacaaatgagcggcgatgccacggtgataaccgattccgccgaaatcgtggcctttcagggtgccgagcggctgtggcgctttagcgcgcgccgcatcgtgcgccggcgcgcggccctcgccctgcgctgggccgatcagccagacggcgtatcgcccgcctcgctgatgaccggtgactggccgtccgccagcaaacgcctgcaggcgcagcagctggcggcgcagtggcgaccattccgcatcacgcggatcgtcgaggagagcgcgcagattcgctcgtttcatcttatgccggatgatggcgctggcgtgctgccgcatctggcgggccagcatctgccgatccgcctgacgctgccgggcagcactaaaccactgattcggcaatacacgctgtcagttgcgccgtcggatggttattaccgcatcagcgtgaagcgtgaaggcgccgtatcgcagtatctgcacgatgccctgcgcgtcggcgatcggctggaggtgcgcgcaccggccggtgatttcactattgatgcacacgaaacgcggccagcggtgctgctggcagcgggcgtcggcatcacgccgctgctggcgatgctgcgtcacctgttctatgaaggccgacgcaaacgccggatgcgcccggtgtatttgctgcagtcggcgcgtaacctggccgaacgcccgtttgcgcgtgagatcgatgcgctgctggcagccagcgaaggtgcgttgaaactggtgcgggtgctgagccagccgggtgcagccgaagcgggcgtggattacgacgttgccggacgcatcgatatggcgctgctgtcgcaggtgctgccgttcaacgattacgatttctatctgtgcggcccgccgtcattcacccaggcgatgtatgacggactgcgcggcctgaatattgccgacgcgcgtattcacgccgaagcgtttggtccgtcgtcgctgcagcgtcagcaggaggatgtgccagaacccgccgtgctgccgccggtagcgaccgaagcggtgccggtggtgtttacagagtcactgaaagaagcgcgctggacgccgcagtccggcacgctgctggagctggccgaagcgcgcggcctgagcccggcctacagctgtcgcgccggacattgcggcagctgtaagacaaaactggtgaaaggtgcggtgacttacaccacccggccaggcatcacgctggcgcaggatgaggtgctgatctgctgcgcggtgccggcgcaagtcgaagacggggacgcggcggtgcagctggcgttgtga

SEQ ID NO: 77871 - DNA, 456 bp, Glycine max
  Peptide Sequence Number=SeqID_194649
atggccgagtcgggtagatatattccggtcaatatactggaaaaagctatccgctatggttcacgaagccctgatgctcaaaaaatgcccggcatgtttttatatcgtataaaaatgacccgtctgaaaaagattgtggagcatgataaaatcagtataaacctgcaatgtcagtgcgaactgacgattttcgaccttgaaagtctgaaggaaatgttatcggagttttatgcatccctgtacaaaaatggacgacctaagccggtaaatttcgcaccaagaatgaaagcgttcacctgcgaattcaatgctgtcgagggaagtgatttaatcggtttcaacttcactgcgactcccgctatttatgatagctggcaactgaccggcgggatcgctattgatcaatcctatttccctgcgttgatacagggaatcgaatcgattctgaccaactga

SEQ ID NO: 77872 - DNA, 210 bp, Glycine max
  Peptide Sequence Number=SeqID_194650
atggctatagctaggtgggcactcaagcatcctgtttatggcattgtcatactacggttgggaatttacacagacagaccccacgtttccaagttatgttctttcatcagttcaatgaattcatccatctttatctcggttcattccagaaaatacactcttagcatcagtcccttgtttccagaagatacgtttgctctttacgaatga

SEQ ID NO: 77873 - DNA, 178 bp, Glycine max
  Peptide Sequence Number=SeqID_194651
atgcctaagcactacacagcaccaccaacaatggaaacgcaaacgacggggagggagaagagggcttacctcgacaatgccgacgagctgaagaagaagacaccacgggacgacgctgcaatgctgaagaacgaaaaggaagcagaagaagaagggagctgcgatgctgaagaagaag

SEQ ID NO: 77874 - DNA, 246 bp, Glycine max
  Peptide Sequence Number=SeqID_194652
atgttcagcccttctggtattttgggatcacgtaaaattagtgaggaaaattgtttccgtgaagaaaatctaagtcgaggcgcttccgtaacgtttccatgggtgatttcgcgaagattttcaaccattcttcgacgttcttcatcgttcttcgatcttcaaccgatttctaaaaggcctaaatcaatatgtaactttgttacttctttcaaaaataaagaaatcattaatggtccaatgccttaa

SEQ ID NO: 77875 - DNA, 360 bp, Glycine max
  Peptide Sequence Number=SeqID_194653
atggattggttcttcgtcatttctcatccactcacgatcacggcacaaccatcagatctgccgcaagatccacctgcgacgcatgatgcctcatttatagagccatatatccctcaggtcccagagctagtagcaacatcgattcatgcccgttctaatgtggacgagcctagacatgcagtggaggcttgccatgcgattcctgaaaggttggagcgtcatttcaacctaaggatagtcacgccaggcacaaagacacatgaggtcatggaacaatgcctcaggattgtcaggggtgtcacagaagaccgcattgtgtatgtgaggtctcgtcgtaggtggcgcacggatcaattatag

SEQ ID NO: 77876 - DNA, 647 bp, Glycine max
  Peptide Sequence Number=SeqID_194654
atgcctgagcggggcgaagccagaggaaactctgtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaaggagtgtgtaacaactcaccctgccgaatcaactagccccgaaaaatggatggcgctaaagcgcgcgacctatacccggccgtcggggcaaaggaccaagcccccgatgagtaggagggcgcggcggtcgctgcaaaaacccagggcgcgagcccgggcggagcggtcgtcggtgcagatctttggtggtagtagcaaaatattcaaaatgagaactttgaaggccgaagaggggaaagggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 77877 - DNA, 165 bp, Glycine max
  Peptide Sequence Number=SeqID_194655
gtcagcggagtaggatcaaacggacagataggaagtaagaatgcaatatcaagggcacaccggagaccggcttacaaaccccaggttttcataaacaaagaaaccgaagcggcggcagagccgcacaggatcggtgaagggagaagagagaaggatgaaaaatag

SEQ ID NO: 77878 - DNA, 198 bp, Glycine max
  Peptide Sequence Number=SeqID_194656
atgatgggctacattgaagcagatgaagaaggaggaggttggattgagaagcttaaggaaggtgaaggaacaacagcaattgaagaaaaaccaatgagtttttttgagctgatgatgatggcaaagatggatgagctcatgaggatgcacaaagaagactacagggatctaaaagagtgctttgaaacaatttcatag

SEQ ID NO: 77879 - DNA, 345 bp, Glycine max
  Peptide Sequence Number=SeqID_194657
atggagaattgcactaggcaatcactacgcatggctccaaactcgttggtggaggaatcaattgggaaaataacaaagacaacatttcccaatcaagagggtccgcacttgacggcaatcactacgcatggctccaaactcgttggtggaggaatcaaacgggaaaataacaaagaccacatttcccagtcaagaggatccgcacttgacggtggaggacacatgaacagtgctaggcaatcgattcatggggctccgaataaaaggcgagaatggagaattgcactaggcaattactacgcatggctccaaactcgttggtggaggaatcaaatgggaaaataa

SEQ ID NO: 77880 - DNA, 732 bp, Glycine max
  Peptide Sequence Number=SeqID_194658
atgccagttaagggtaagggacacaacaaagctttgcacgtgtctttcaagtgcatggaccatatagtagccaaggccaagctccatggtggtgagagcttcgatggtcaactcatcatagtctttggagaagaggataaattggttagttgcccgtctgctactccctatgttgaggtggtagaggaatctcttgaaacaactttccaaacattgaaggttgtggacaatgcctatgtggagtccttcctgatacaaccaagaatgtctaatgcctccatgatggtggctcggattatgttgagggatagatatgagcccaagatggggttaggccgaaatggtgatggcatggtgactttgctggaagttgccgaaaatcgtgggaggtttgggttgggttacaagcccaccaatattgacaagagaagaattgctctggagagaaaagaaaagtgcttagcttgtcttcaagggcatgaaccacgggtagagagggtccctattttccatattagcaagagcttcaggagtgcgagatggatgtatgcgggacaggttgccatgctaaaagaggaggatatgcctggttttagcttagaaattgtgcagcataggttaccgttgaatctcgaatgctccccggccgtcgcccggtatccagagtgggtggccaacatcgtgtctgtcccaaaaaaggatggaaaagtgcaaatgtgcatggattattga

SEQ ID NO: 77881 - DNA, 304 bp, Glycine max
  Peptide Sequence Number=SeqID_194659
atggatgatgagatagtgaagcctcagccacagcaatggcatccagctataaagacatttaagaagcgctcctgggaggatgggtacattgcacatgctccaaagaaactcacctgtaagagagctaggaagaccactgcaagagaagggtctagcatagctttgcttgtagaaattgaatttgatggacaccactttcgtaagattgctagaaggtgctggacacaacttgcagagcccatgcctaaatatgaccctgagattgtcatggaattttatgtaaatgcttggcctacggaggaag

SEQ ID NO: 77882 - DNA, 2745 bp, Glycine max
  Peptide Sequence Number=SeqID_194660
atggcggatgcaattgtgaacttcttggcagagaagttgacgaggctgcttgaggaggaagccaagcttctcaccgaggtgcatgacaacgtgacctcgttgcacgacgagcttaagatattgaacctcttcctcaaagagacccaagggaccaagcagagagagcacggactggtggcggaaatggtcggccaaatcagagacgctgcataccaagccgaagacatcatcgacacctatgtggcggacatgattcgacgtcgaaagatgaaccggttggagaaggtggtcatcggcagtgtcaatcacgcgctcatgcttcacaaagtggccgtcaagataggcgacatcaagacaagaatcgacaataggttcggcaacatagaaaaatacggcgtcagactcatcagtgcaaaaggtgaaaaaagtaacggagaagaagaagaaacagagcgcgtgaggaaacagaggagcgaggtggaggaagataaagtggcggggttcgagagttactccagggctgttatagaaaaactcacggcaagggtcagggacagggattcacgccttaacgttgtttccatcaccggtgttggtggcttggggaaaaccacccttgccagaaaaacatacaacaacgttagggtcaaggacacgttttcttgtcgtgcatggggttatgtttcaaatgattatcggcccagggaattcttcttgagtcttctaaagtgtttgcaacccggggaatatagtgatatgtccgagagaagggagagcgacgaagaactgaagatgaaggtgcgagaatgcttgaataaaagcggaaagtacttggtggtggtggacgatgtttgggaaacccaagtgtgggatgagattaaaagcgcttttccagatgccaacaacggaagcagaatattgataacaagtcgttcgacaaaggtggcttcttatgctggaacaacccctccctactcgcttcccttcctcaacaaacaaaaaagttgggagctacttttcaagaagttgtttaagggacgaagaaagtgtcccccagaattagtggaactgggaaaatccatagccgaaagatgtgatggcttgccacttgccatcatcttcatggcggggattctggccaacaaggaattgcacaaggagtggtctgatatcaaggaccatatggattggcatcttggtagtgacaatgacaacatactaatggatatactgagactaagctacgacaccttgccttcacggttgaagccttgctttctatattttggcatgttccctcagggatacaatatccccgtcaagcaattgatccgcttgtggacatctgaaggactattaacaacacatgattcttcttccggaagcaggaccaacgcaccggagcccgaatacattgcggaacagtacttggctgaactagtggaacgaagcttggtccaagtcatacataggaccagctatggcagtgccaagacatgtcgtgttcatctcgttctccgccacttctgcatatccgaggcccggaaggacaagtttttccaagttggtggaattattaatgattcttctcaaatgcacagtcgtaggttgtccctccaaggcacactatttcacaagtcctctgtttcaagcacttcattatctaataattcctctgtctccggaactcgttccctcttatgcttcggcaaagaagaggtgtccgacgttaagaaagaccaatgggaatggcttttcaagagtttcaagttggctcgggtgttggatctaggacaaatgaatgttacctcactacctagtggtttgaagaagctcatccacttaaggtacttgagtatacactcacacaatctcgaaactattccggattcaatatgcaacctatggaatctagaaacgcttgatctaaggggttcccctataaaatccttctctgccgaactctggcagcttaagcatctgagaaatcttctgttgcttggacccgtggtgcttccggaaagtgaaaccatgccgaatctccaaactctctctacggtggcacttgatccacgcacggcatcgttgttggagaatggtagattccccgagttgaaaaaactgggtttacattatgaaaaacgtgatgacacaatgtatgagtgtgatcctcgtgtgctgttacaaagttgcctccaccggctaagctatctccggaagctaaaacttattggcactactgagatcccgcaaaatgcagcaaatgtgtgtgtgtttccctcaaccatcaccaagataaccctaacaaagtttggtttcttcaactctagtgccatgaacacactaggaaagcttccaaacctcttggtgctgaaattgtcatcgcagaaaagtgatgctagttttgacctgcattgtgccgcgggagggttctcaaagcttcaagtgtttgtgatggtagagatcatggttaaaagctggagagtagtgaaaggttcgatgccaagtgttcaacgtgtagtcgtcagaaactgcgaatacttaactgagcttccagaagaaatctggtccttgactgcattgtgccaagtgaatgtttcttgtcccagtagaaaattggcaaaaacactgcaaaatttggagggcccatttaaagatgccacttatgctgcaattttgaacgaagaggtggaaggaattgttggcttgacattgttgaagatgaccacacgtttctttgcttaa

SEQ ID NO: 77883 - DNA, 495 bp, Glycine max
  Peptide Sequence Number=SeqID_194661
atggtggcggaaatcgtcggccaaatcagagaggctgcatacgaagccgaagacatcatcgacacctatgtggcggacatgattcgacgtcgaaagatgaacctgttggagaaggtggtcatcgaggccatgcttgatttcaacctgagtgatgccatgcttgatttcagattaggactcagctgcagaggtttaaaggccaaggattttgatgcaacccttttaacaataaagaactttgaagttcttactctgtgtaaatggacttttgagaatgatcctgaaagttatttggctggagggtccaattcatgtgtagtgaaagggactaaatgcacaggaatggaacatcttaaagtgataaagtttatggggttttcaagtcgaagagatgaagtctccctggctaaatgtttgattcatatgatcaagggaaagcctccaaagataaagacttcagatgggaattgcttggatgcaatgtttgtcgagtga

SEQ ID NO: 77884 - DNA, 1338 bp, Glycine max
  Peptide Sequence Number=SeqID_194662
atgtaccctgaagactacaagatccccgtgaagcaattgatccagttgtggatatctgaagggctattaacacaagaaacttgcggaagcagcaccaacataccggagccggaatacattgcggaagagtacttggatgaactagtggaccgaagcttgatccaagtggtgagtaggaccagcgacgggggtgtcaaaacatgccggattcatgatcttctccgcgatctttgcatatccgagagcaaggaagacaagtttttcgaggtttgtggagaggttgattttcaaatccgagatagttgtccccgtaagttgtctctccacggcactctatttcatttctcttcttcaagtgccgtttctgattactccatcactggcacgcgttccttgttatgcttcggccaagaagtgtacaaggtcaagccaaaccactggagatggcttctcaagagtttcaggctggctcgcgtgttggatttaggacgaatgaatgttaactcaatacccaatgatttggagaagctcatccatttaaggttgtggaatcttgaaaccttggacttaaggggttctcccataaaatcattttctggtgacttgtggcaacttaagcaactaaggcatcttctgatgtttggacctgtggggcttccagacatgccatcagagagtaaaactatgcagaatcttcaaactctctctacagtggcgcttgatccacgcacaacttcattgttggatagtcgtagattccccaggttgacaaaattgggtatacaccatgaaagacgtgataagtgcaatgctcgtatacagttacaaagccttaaccgcttaagccatctccgcaagctaaaagtgattggcaccacggagattccgcaaaatgcaaatgtgtttccctcaaacatcaccaaaatatccctcacaaagtttggttgcttcaactccaatgccatgcatatactaggaaagcttcccagcctccaagttctgaaactgtcatcgcagacaaatgatactcgttttgacctccactgtgccacgggagggttccttcagctccaagtgtttgagatgatagcaatcaaggtaaaaaattggagacttgacaaaggttcaatgccacgcattcgacgtttagacgttagaagctgcaaatccttgacggagcttccaaaagaactatggtctttgactagcttgcgggaagtgcaggtcttgtggccatgtactgaattggtaaaaaggctccaaaatttggtggtgaacaatgggtgcaagctcgtggtctatcctctctcaacaaatgatgaattagattttctctaa

SEQ ID NO: 77885 - DNA, 913 bp, Glycine max
  Peptide Sequence Number=SeqID_194663
gtggagagacctgtggaatgaagctcttgtcaaacatggaactcaagaggatatcataggtgttgttgctgattttatcacaaattttgaggagtttgatcccttgaagcatcccagaaagcttcaatttcactttgctgaagagagtgtagtctcagtaactgttgcaaacaatagcaagctcatgcttgatttctccccttggaaggaagagattccaatagggtatgaattggagttcaagctaagtaagcaacacatagccacctaccagtcttttccttccacattctcagtcaaaaccctccatttgaaatcagtgagttgtttcacaagtgaggttgctgcttccattgtttcaaatttggagcatctagagaacttggtggtcattgactgcaaagggttggaatctttgagtgttgactccacctctgagcttcacaagttaaccatcttggattgcttagagttgaagactctccgtcttaaaacttctaaactcaagtcttttcggtatcgtgggcctcttcctttgattaggccagagtatcatttcaacctgagtaatgccatgcttgatttcagattaggactcagctgcagtggtttaaaggccaaggattttgatgcaacccttttaacaataaagaactctgaagttcttactctgtgtaaatggacttttgagaatgatcctgaaagttatttggctggagggtccaattcatacgtagtgaaagggactaaatgcacaggaatggaacatcttaaactgataaagtttatggggttttcaagtcgaagagatgaaatctccctggctaaatgtttgattcatctgatcaagggaaagcctccaaagataaagacttcagatgggaatagcttggatgcaatgtttgtggagtga

SEQ ID NO: 77886 - DNA, 1749 bp, Glycine max
  Peptide Sequence Number=SeqID_194664
atgtctgagggaaatgcagggaaaggaaagagaatcgccatcattggcgtctcagccttattgttggtggctatggttgtggcaatcacagttggggtcaatctcaatgagaatggttccaacaatgatacagaggacaacaagaaaaatcatgttgtttcttctataaaagccgtccaaaccctttgtcatcccacaaattataagaaagaatgcgaggaaagccttatagctggggctggaaataccacagatccaaaagaacttatcaaaattttcttcaacatcaccattacaaaaattggtgataaactcaaagaaactaatattttgcatgaggttgaggaggaacccagagccaagatggcacttgaaacatgcaagcaactcatggatctttctattggggaattaacaaggtcacttgatggaataggtgagtttaacctcataaatgttgacaaaatcctcatgaatttaaaagtttggcttagtggcgcggttacataccaagatacttgcttggatgggtttgagaacaccactagtgatgctggcaaaaagatgaaggatttgttgacgataggcatgcatatgagcagcaacgcccttgccattgtaacagatttagctgacactgttaatgattggaatatcacaaaatcatttgggcgtcgcctccttcaagattctgagcttccgtcatgggttgatcaacatagactccttaatgaaaatgcaagtccattaaaacgcaagcctaatgttactgtagccatagatggtagtggagatttcaaaagcatcaatgaggcattgaagcaagtgcctgagaaaaaccgaaagccatttgtgatctacatcaaggaaggcgtttaccaagagtatgttgaagttacaaaaaaaatgacccatgtggtgtttattggtgaaggggggaaaaagacacgaatatctggtaacaaaaacttcatagatggaacgaacacttatagaactgccactgtcgctattcaaggagatcactttgtggccatcaatatggggtttgagaattctgctggacctcataagcatcaagcggtggcattgagagtccaagcagacaagtccatcttttacaattgctcaatggatgggtatcaagacacactttatgcacacaccatgcgtcaattctatagagattgcaccatttcaggtaccatcgactttgtgttcggtaatgcactagctgtttttcaaaattgcactttcgtggtccgaaagccactggagaaccaacaatgcattgtgactgcacaaggtagaaaagagagacaacaaccatctggaatagtaatccaagggggatccattgtgtctgaccctgagttctactcagtgagatttgagaacaaggcttacctagctcgtccatggaagaattactctaggaccattatcatggacacgtacattgatgatttgattgacgctgatgggtatttgccatggcaaggactagagggtccttctggtatggatacttgcttctatgccgagtaccacaacattggccccggttcagacaaatccaagcgtgtgaaatgggctgggatttggaacctcaattcaaaagcagcacgttggttctcaccatctaagttttttcatggaactgattggattgaggttaccggaattccttgctttcctggcgtgccgaaacaccataggcacaaaaagacaatacttaattggcaataa

SEQ ID NO: 77887 - DNA, 373 bp, Glycine max
  Peptide Sequence Number=SeqID_194665
atgacgagggaagggcacgtggcatatcgccactgccactggcgacacagccaatggttgtcgccattcccattgacgactccagcttggactgaagccgctggtttgattgacgagttcggaggcagcaaggtgcagggggcacaggggttgcagcctttgagggagggagtcgtcattgcagctggcaggacaggttcgaaaatcgccattgaacgctatacattcagccgagctacacttagacttttggcatggggcaacctcctgcaagatgccattcattacctcactggatttcttgtcacagggaagatcaaattagagcctgaaaatttgccatacaaagggataactgctggtgctggaaaag

SEQ ID NO: 77888 - DNA, 4260 bp, Glycine max
  Peptide Sequence Number=SeqID_194666
atgatggtatcgagagggttgttcgggtggtccccgccgcacgtgcaaccgctcacgccggtatcggaggtttcggagccaccggagtcaccgtcgccatacctggaccccggcgcagagacctccgcgtcgcagcaggtggaggcggaggaggagatggaggagccggaggagatcgagccgccgcccgccgcggttccgttttcgcagctcttcgcatgcgccgaccgcttcgattggttcctcatggccattggttccgtcgccgccgcggcgcacggcaccgcgctcgtcgtttacttgcactacttcgcgaagatcatccacgtgctgcggttggatcctcctaacggcacgtcgcaggagcagtttgacaggttcaccgagcttgctttaaccattgtttatattgctgcgggagtttttgttgctggttggattgaacggcagactgctgtcatcaggtcaaattatgttcaagtactacttaatcaagacatgagtttttttgatacttatgggaataatggagacattgtgagtcaagtattaagtgatgtgctgcttatccagtccgcccttagtgaaaaagttgggaattatattcataatatggctacattcttcagtggtcttgtcattggccttgtcaattgttggcagattgctttgataacgttagccacgggtccgtttattgttgctgctggaggaatatcaaacatattcctccataggcttgcagagaatatccaagatgcatatgctgaagcagctagcattgctgaacaggcagtttcctatataaggacattgtatgcattttcaaatgaaactttggctaagtattcatatgcaacatcactgcaagctactcttagatatggtatattaataagtcttgttcaagggcttggtcttggatttacttatggactagcaatatgttcttgtgcattacaactctgggttggaagattcttggttattcacggaaaagcacatggtggtgaaattataacagctctttttgctgtaattctaagtggcctgggattaaatcaagcagcgacaaatttctactcatttgatcagggacgaatagctgcttatagactatttgagatgataagtcggtcatcctcatctgttaatcatgatggcacttcccctgattctgtgctaggaaatatagagttccggaatgtttatttcagctatctttctcgtcctgaaatccctatcttgagtggattttatctcactgtacctgctaagaaagctgtagcacttgttggcagaaatggctctggaaaaagtagtattattccactcatggagcgtttttatgatcctacattaggagaagttcttttagatggtgaaaatatcaagaatttgaaactggaatggctgaggagccaaataggactagtcacccaggagcctgctttgctcagtttgagtataacagacaacattgcttatgggagggatgctaccatggatcaaattgaagaggctgctaaaatagctcatgcacatacatttatcagctcattagagaaaggttatgacacacaggttggcagggcttgtctagctttgaccgaagagcagaaaataaaactttctattgctagagctgtgcttctaaatccatcaattcttcttcttgatgaggttactggtggacttgattttgaggctgagagggctgttcagggggctctggatttgcttatgttgggacgctcaacaataataattgctcgaaggcttagtctcataaagaatgctgactatatagccgttatggaggaaggtcagcttgttgaaatgggtactcatgatgaattattaacactggatggcttatatgcagagcttcatcgatgtgaagaggccgcaaaacttcccaagaggatgcctgttcgaaactacaaggaaacttcagccttccaaattgagaaggattcttcaagtcatagcttcaaagaaccatcatcccctaaaatgatgaagtcaccctctcttcaaagagtttctaatgtatcccgacctccagatggcgtctttaacttgctagaatcacctcaagtccggagtccaccgcctgagaaaatgcttgaaaatggtctggcgttggatgtagcagataaggagccatcaataagaaggcaggatagttttgaaatgagactgccggagttacccaagattgatgttcattctgtgcaacgacatatgtcaaatgattctgatccagaatctcccatttcacctcttttaacatctgatcctaaaagtgaacgctcccattcacagacttttagtagaccacatagtcattctgatgatgtttcagttataatgagagaaacaaagggtgcacggcatcgaaaaccaccatcactgcagaagctggctgagcttagttttgctgagtggctttatgctgtgttaggaagcataggtgctgctatctttgggtctttcaatccccttcttgcttatgttattggtcttgtggtgacagcttactatagaattgatgacactcatcaccttgaacgggaggtagacaggtggtgcttgatcattggctgcatgggtattgtaactttagttgccaactttttacagcatttctactttggtattatgggagagaaaatgacggaaagagttaggagaatgatgttctcagccatgctacgcaatgaagtgggatggtttgatgatgaggaaaacagtgctgacaatttgtccatgcgattggccaatgatgctacttttgtgcgagctgcttttagcaacaggctttccatatttatacaggacagtgctgcagttattgttggtcttctcattggtgctttgctgcactggcggttagcacttgtggcttttgcaacccttccaattctctctgtttctgccattgcccagaaattttggcttgcgggattttcgaggggcatccaggaaatgcacaaaaaggcatctttggttcttgaagatgcagttaggaacatttacactgttgttgccttttgtgctggtaataaggtaatggagctctacaggctgcaattaaagaaaatatttaagcagagctttcttcatgggatggcaattggttttgcatttggcttttcacagtttctactttttgcctgtaatgccctgctactttggtacactgcaatatgtataaaacgtggttacatggatccacctactgcactcaaggagtacatggttttttcatttgcaacatttgcacttgtggagccttttggattggctccttacatacttaaacgacgaaaatctctcatatctgtgtttgacattatagatcgtgtgcctaaaattgatcctgatgatacctcagcattgaagccacccaatgtatatggaagcctcgagttaaaaaatgttgatttttgttacccatctcgtcctgaagtgttggtattgagcaattttagcctcaaagtcactgggggccaaacagttgctattgtgggagtttctgggtcaggaaagagcactataatatctttgatcgagaggttttatgatccagttgcaggccaagttttcctggatggtagggatttaaaggaatataacttgagatggttgaggagccaccttggtcttgttcagcaggaacctattatcttctcaacaaccataagggaaaacattatatatgcaaggcataatgcaactgaagctgagatgaaagaggctgcaagaatagcaaatgctcatcatttcattagcagtttgcctcatggttatgatactcatgttgggatgagaggtgttgacttaaccccaggacagaaacagagaattgcaattgctagggtagtgctgaaaaatgcccctatcttgttgttggatgaagctagttcagcaattgaatctgagtcaagccgagtagtgcaagaggctctagacacgctaattatgggaaacaagactactattttaatagcacatagggctgcaatgatgaggcatgtggacaatattgtagtgcttaatggaggacggatagtggaggagggcagtcatgatacattggtagccaagaatggtttgtatgtccgactgatgcaacctcattttgttgaatcactggtgacttctgcacctgaagggtttttccaagaatgtcaggtgaaaattgtgggtggaaatgggaatgatgggacttggatcagcacctggcatttgtag

SEQ ID NO: 77889 - DNA, 603 bp, Glycine max
  Peptide Sequence Number=SeqID_194667
atggctcctgctaagggtgtccatgtgtccgtgtccgtgtcgtgtccggtgttggtgttggtgtcggtgtcggtgcttcatagcttattatggttgatgcattgttttatagacattggtggcaaatgctcaaagcagtactggtttcctgcggacaatgccaaaaaggctgatcccaaagctcaggctttgaagacagcaaaggctgtcaaatcaggtggccaagtgtttaagaagaaagctaaaaagatcaggacatctgttacatttcacaggccaaggacattgaagaaagaaaggaaccctaagtaccctcgtattagtgctccacccagaaacaagttggaccattaccagatacttaaatttcctctaactactgagtctgcaatgaagaaaattgaggataacaacacactggtttttattgttgacctccgtgctgacaaaaagaagattaaagatgctgtgaagaagatgtatgacattcaggcgaagaaagtgaatactttaatcaggcctgatggaacaaagaaagcctatgttaggttgactccagactatgatgccttggatgtagctaacaagattggtatcatctaa

SEQ ID NO: 77890 - DNA, 426 bp, Glycine max
  Peptide Sequence Number=SeqID_194668
atgacgtccctgcagaattcaccaacgcttcaccgaactatgctccacaactctttccctcagaagcatgccactcgttcatctcgaagagatgccatttccttcattgtcaaagctgcccaagaaccctctgcttctttagcttctcaagaaaataagaagggatttttgcctgttttggacaagaaagatggatattcatttctctaccctttcgggtggcaggaagtagtaattgaaggtcaagataaggtgttcaaagatgtcattgaaccactggagaacgtcagtgtaaatgtgataccaactggcaaacaggatattacagaatttgggtcccctcaagaggttgctgaaactctaataaaaaaggttttggcacctccaaaccagaaaaccaagatagtagaagcaaaagaggtttga

SEQ ID NO: 77891 - DNA, 396 bp, Glycine max
  Peptide Sequence Number=SeqID_194669
atgacgactgagacaaatgcatcttacagtgcagtaatgcacagaaaaaaacgatggccaagatggattagaaaaaataacagaaggcacattgaatgtttccacctactcatgatcagttcttctgtaattgagaatgtaaagatacgtggatttgctgtcatgatcatcatattctccataggaaacatctctgagactcatctcaatcccattgtcaccatttcctttgctgcattaaagcacttccctggaaagaatgtgcctgtgtatattggtgcacaagttttggcatcagtgagtgctgcatttgctctgaaggcgctttttcatccgtacatgagcggtggagtgacggtcccttcaatgggggatatgggcaagctttcgctatag

SEQ ID NO: 77892 - DNA, 1715 bp, Glycine max
  Peptide Sequence Number=SeqID_194670
gggtgtctaggtctacctccttggtcattgcttaccttatgtggagggaagggcagagttttgatgatgcttttcagtttgtgaaggcggcgagagggattgctgatccaaatatggggtttgcttgccagctgttgcagtgccagaagagggttcatgctgtccctcttagccctagctctttgctgaggatgtatagaattgctccccattcgccgtatgatcctttgcatcttgttccaaaaatgttggtggatccttcattagctgcattggactccagaggtgcgtttatcgtgcacattccttcagcaatatatgtttgggtgggtaagaactgtgaggccaccatggagagggacgccagaggggctgttggccagattgtccggtatgagaaggtacaagggcctattgtgatgattaaggaaggtgaggagcctgtttacttttgggatgctttttcagattttctgcccttaatggacaaatctggcaaatctggcagtaggatagaagatggaaaactatttgttttgcctggtaagaggagagtagatgcatacaatgttgattacgaagttttcacaaaagcaatcacgggaggcttcgtgcctccatttggttcatctggtgaacatgaaacccatttgcctgcaagggagagtagttggagtgtaaggcgtaaagtttcccatggtaacatgaaagaggttgtttcggtccctcatggtaacatgaaagaggttgtttcggtccctcggctatcgtttccaagggtttattcggattccatgttgtgtcttcgtacatcagcaaatgcaattttgtctccatcctcatccctgtcgtcatcttcatcatctatatcatcatcatcctcaccgtcttttgtttctccagattccattacttctgattctagcattcattcaaagtttttgttagaagtgtccccagactcttcatctctgtctaatttttctagtttgtcaatcacatcaaattctacttctcataatttttctagtttgtccatcacatcaaattctacttctcaaccagtgtctcacagtacagatatccttggtgtcaagttatcacatcccttgtttcagtcagcctctttaccattgaagaaaccatcaacttcccttgctgaacgcagaggtagcttgtcaaaaattctgatgttgccgctaatgaatgataagacacaagtaacagataaatcgacaacgtctcatgctagtcaagaatctgacattcttgttaatgacaatgttagctatcaacaacaatcagatagtaaagattatttttgcgggtctaacaaccatgccaaggatggaggtgtgaattccattcaaaagtgtgagccaagcattgctgatagcatgcacctcaaggaatcatcacttagtcagtctaccacattgaagggaactaatgacagtggcttactgcagtataatgtcgcacagacttcggtatatcactggcccagtatagaaaagattgagacatttggtgcaagtcatttggattctaaatctgcttttgtcatattctctcccaggaggtctttcagttgtgacgcttcacaggttcacttagatattgataaacaatcagatgtaggagctgtcgactggaatcaaattggatgtgatctccttgctcggtttagtttgccaaagaactcagtcatcaag

SEQ ID NO: 77893 - DNA, 532 bp, Glycine max
  Peptide Sequence Number=SeqID_194671
ccttcaacgcgcaccgtctctgcgttgcccagaaaacctaggtgcttagggctcttcaaatccttcgtgggttttgctcaaaattcgaattttccgattcttttgcaagtgggtatggtggggaacgatgacgcgggccacctctccgcctcccggaagatgttctggcggtcggcgtcgtggtcctcctcgcgaaccgccgccggaaacgcctcttccggcgagacggagaagggtttcgccgattccggtgccgctgacggtactcacggccagaaccggcggtttggtccgccgccgctgacgcctcggtcgcagcagaattgcaaggcgcggtcgtgcctgccaccgctgcagccgctctccatcgcccggcggagcctcgacgagtggccgaaggcgggctccgacgacatcggtgagtggccgcagccgcctaccacccccggcgggagaggtaatggtagcaatggtgaaaggttgaaacttgatttgtcttccattctgcataataaccctgatcatagtagga

SEQ ID NO: 77894 - DNA, 243 bp, Glycine max
  Peptide Sequence Number=SeqID_194672
atctgggacgaggatacaaagagtgaagaaagaagtgttcgatgtgagaaagatacattggttgaaactgatgttgggtgtggcgagtttggaaaactgatggctgttagatacaaaggaaaagaagagttatcggttaacttgtacgtggaatgtgacaaatgtaatatggaatttgagaaagaggcctttaacgtcagacatcaatcattggtacaaacatattcacagcttatagcataa

SEQ ID NO: 77895 - DNA, 458 bp, Glycine max
  Peptide Sequence Number=SeqID_194673
taccaaatcgccgttgaggggaagggcaaattgatcaagggtgaaatgatggccttggatatcgatgggaacctgagaataggaggtggtgtgcactccatggaggttcaaatacttcatcacactggattggatgaagttgtggatgctcccaccatccacaaagatcatgacactatggcgatgaatgtggccataaacatggaaggcatggtttacaacgatggccctggacccacttgtcatcacaacggtagcacgacagtggttcctcagtgggataaaatcaagcaccgtgacaatgatccaaaagtttgtattcctgctgactcaaatatgaatcctgtaggagactggccaattagcagaggcagaaacctgaataatctgggaaaatactgcaaaaggattgctgcacgcagaagatttttagcaaaatttgctcctgatattcccaa

SEQ ID NO: 77896 - DNA, 312 bp, Glycine max
  Peptide Sequence Number=SeqID_194674
atggtttacaacgatggccctggacccacttgtcatcacaatggtagcacgacggtggttcctcaggtgagaattgaggagaaatggtggtgcaaggcttacgattctattggcaaaccgcttaaactccgtgagataatcattcacgaatccacgttgttggagtttgaaaagagcgtcgtgaggatcgtcttaaaaggatggggtgaaacacgactccaaggcatgaagcattgccgaccatgtggtgaggaagccattccaggacatccatcggtaccagcagagggctggaccttccatgttgaatga

SEQ ID NO: 77897 - DNA, 183 bp, Glycine max
  Peptide Sequence Number=SeqID_194675
atgaacagggcaagaaggccagaacctttattatacctcaaattagttccttctagcaagcatagcaacaagacaatcagggaagggaaggacaacaccaaagggttcctgcagcagacaggggagaaggtgaagggcacagcccaaggtgctacagagactgtgaagcaaacccttggctag

SEQ ID NO: 77898 - DNA, 429 bp, Glycine max
  Peptide Sequence Number=SeqID_194676
atggcgcttcaggaggcagagtgtgaagttgcgcctctcatcgagggagtcctgcacagtctccacgtggtgcgtctatgtgatacggtggccacgaaggcgttgtggacaatgtggttcaacacaacagagaaggagacgcgattcgacaacagcgagcgggggagatttggggtgaatcttgtgacgagattttttctttatggacctcctggttgtggtaaaacactgattgccaaagctgttgccaatgaggcacgggctgattttattcatattaagattaagttgggagaacctggctggaaagagaggtattatgaggaaaaattttctgccaaaactcctgaggaacttgaagctatacgtaaagatgtcgtcttgaaatacactgaaggcctatgttgggtgatgcacatggaaatttga

SEQ ID NO: 77899 - DNA, 474 bp, Glycine max
  Peptide Sequence Number=SeqID_194677
atgcctcaacttgagcttctcccacatcactccaacccccaatttaattctccaaaccctaaacctctcccctcaagctggttgcactatattagggttccaccaatggcagcgagtgggggttgcaacagcttcttaacattgttgtgtgcaggtgcagtgcaaaatcaacatgtatcacaccctacagcatttttgggagttcctaagaacaatcagagaaaaatgaaaacaccgcacaggttagttgtggttgcggtgactcaaggctctactgaatcaagcaagtccgatgaaaaaatcccttcgtgggccaaaccgaacttcgatgaaccaccgccatgggcccaggacgagcccaacaacaacagttcacaacaagaaggatttgagatcccgttctatgcttatttgcttgcctctgctatcactgcaattgccactgtaactaaccgacatcttattactaattaa

SEQ ID NO: 77900 - DNA, 174 bp, Glycine max
  Peptide Sequence Number=SeqID_194678
atgccaattcatctcaatttccttccacccaatcaatggggaacagtgacaggacgactactagtcctagatgggggaaagagagctcaacctgctaacaatgcttatgttggtctagctttgcctagagatgaaggatcatggctgagagaaagcaaggtgcatttggtttag

SEQ ID NO: 77901 - DNA, 321 bp, Glycine max
  Peptide Sequence Number=SeqID_194679
atgtttaccatcagaggaggcaatccaagtacttttttccacatacaggcagttgatttactaataatcagacatatgagtacagtgttggtgaggaagctgaagctgaaagtggttagtggggtccacttgagatggatgagcatcgtgatgtgtttcggagatggcagccaggctgctgttggatctccaatagatgccgaaaagcataaggtcttcaaaggaggctgcaaagatcctagagatactggtgctggggtccaaagctattacgcgatctatcagacaaaatccgcaaaccagcttgttcgtgttcaatag

SEQ ID NO: 77902 - DNA, 813 bp, Glycine max
  Peptide Sequence Number=SeqID_194680
atgacaactaatcaggctcagacctttatggattacctcacacttgccttatgggacatccatcccatcttactacccgagctgccagaaggagtcacttttgacttcaagcatgggttcctacaaatgtcaaagaacattctgttcagtggtgttgcccacgaagatcctatgcgacacttgaggaagttcatcaagttgaacaacacgatgagacaaaaccgtgaactagtagagtatatcagactttatgcctttcctttctttcttaatgggaaggcatgggaccgactagggaacaagagagtctacctgaagcctgggaaagttccaagagatgatcagaagctatccacatcatcgtttctccctacaaaggctaattcacattttccatggattatgaagaaaggcaccaaccaggtggagaaaaatgattcccaaactgaattgggaaaacagatgcaagctttgacattgaagattgagacactcatgagatctcaagcccaagtccccatcactacaccttcattcccaacctatgatagatgtgggattatgcatgggccaagaaagtgcattgttgatgacaagctagctgcagccatggatgagatcaactttgtgggggagaaaaaaattcttacaatcaataccccaacaatttcaatcaaggacaaggcttcaggcaaagtcaagggatgtatagacatcaaaccatacaaaattaggggcctagacaagaggagagtcaacctactcttcaagagaccatgcttcaatatatggctcagaatgatcagagaatga

SEQ ID NO: 77903 - DNA, 501 bp, Glycine max
  Peptide Sequence Number=SeqID_194681
atggtgcatattaatatccccatcatagaggcaattgctcaaatgcaaaaatacaccaaatatttaaaagaaattctttcaaataaaggaaacttggatgattttactacaattggtctcaacgaagaatgctctactatagttttaaggaagttgccacttaagcttagtgatcgagggagtttttcagtcccttgtactattggcaacttgcaaatcaatagagctttatgtgatttgggtactagcattaatttgatgccttattctgtctataagaagttgggccaccataacaagatgaacactattatggctatacctcacccaagtgtggggaaggaataccctccaaggaagaaagtcattccaaaagaccctggatggagtaaaaaaaaaaaggaagatagcatcatcgttcaagctcttagttatggagtggatgattatactggaggatccacgcaaaaagggaaaatcaccttgtttaggagtggttaa

SEQ ID NO: 77904 - DNA, 285 bp, Glycine max
  Peptide Sequence Number=SeqID_194682
atgtatcaaaacgctcagaataaaaccccgagcgtggttcagagacaacctgacaacctcccatcacaacatgaaccaaatcctaagagggaggatgtcaatgttgtgatgactagaagcaagaggattcaagaggactccgagaagaaggaaatttttttcccaaaagttgcagatggcatccttactaagaaggacaaggcatctcggaaagttgaggttcctactgatgagaatccagtggcaaacaaggagggtgagaaggaggtagtgacacttccctaa

SEQ ID NO: 77905 - DNA, 3324 bp, Glycine max
  Peptide Sequence Number=SeqID_194683
atggcagaccatactaccagaaagactattaccgacagacttgaagacgcaatagctcgcctctctaccagccaatccaccctcatcgacaagcacgaagaccttgttgacaaatatttagagcttttcggcaagctggatatttcgagattcgatggccgcgaccccatggactggatattcaagatatcccagctattcgaataccagaatacgtcggaagaagaaagaataacagtagctttattttacctcgatggtgccactttaagctggtaccaatggatgtttagaaatggatttatcacgtcttggtcgggattcttgcaatctttggaatccagatttgctccttcatactatgatgatccaaaaggcgctcttttcaaactcacacaacgaagcacgatgaatgaatacttaacagagttcgaacggctggcaaatcgtgtgataggtttgccttctcctttcttgttaagttgctttatctctggattaacaccagatattcgtcgtgaagtattagcactacaacctatctctttgccgcaagcaatggcccttgcaaaattgcaggaagataagctaaatccacatacgttcaacgaactcccgacgagattgccctacaacgcgagaaaggattatgctataattgtgatgagaagtggagctcttctcatcgttgcaaggggcgtactcggccatggacacaaaccacccccacataagccttcacgccctctccggtcgcccttcttcagaaacctttcgcctcaatggcatcatcaaccacaccaaccttaccattctctcgacagcgatagcacccataatttccttcagccacgtattgctcagttcctccatttgaagactcagagcacgagccctctccacgtcttggttggcaatgggtcagtccttgactgcaaccaaaccccatctagcctaccccctccacgacagatagtccaccatatcaaccttctcccaaacacagctccaatcaacgtacgtccttaccgatacccacaatttcagaagtctgagatagaaaagcaggatggcacttggaggatgtgtgtcgactatcgtgcgctcaactcagccactgtttgcgaccgttttccaatctcgacaatagacgagctacttgatgagctaggccatgcttcttggttctctaagctggacctcagacaaggttttcatcaaatccttatgcatgctcctgacgttgagaagacaaccttccgaacacaccaagggcattacgaatatcaagtaatgccatttcaggcggccatgaacagtctactaactccatttctccggcgatttgctgctgtgttcttcgacgacatcttggtgtataacaagtctttgtcttcccatcttcaacacctcgagagcatttttcaaacgttggtgcaaggacagttctatctcaaacgaagcaaatgtctctttgcacaaaaccaagttgaatatcttggccacgtagtttccggcagaggggtcgagcctgaaccatccaaaattcatgccatggtgcaatggcccacaccagcctcatccaaggacctcaaagcatttcttggccttactggcttttataggaagttcgtcaagaactacgcaacaatcacagctccactaacttcacttctgggcaaagacgcgtttgaatggtcgttaactgcacaatctgcattcgagcaacttaagaatgccatgacgagtgcccctgtgcttgctttgcctgatttcaacgagccattcatcatcgagaccgacgcctccggtattggcatgggtgttgtcttaatgcaaaaggatctcaaaagcctccgcgaactcatgtcacaggttgtccaaaccccagaacaacattattacctttctaaacttttaggctttgattatacgatccagtacaaggtgggatcatccaatgcagtcgtagacgctctatctcggacaaactccagtccctccggcgaacttttgctactttcggtacccaaccctgactttatggacgaccttagacgcactcttcattccaatgctgagtttcaaacacaaatctctaaggtacgtgctcaacctggagattattctgattatcgcattcataatgaactcctgctgttcaaaaatcatatatggctatatgacgataacccatatatccctaacctcatgctcgagttccatgccaccccactgggaggacatttcggggtcgctaaaactactcacagaatagaatcaagtttctattggtcatccctccgaagggatatcaaacgcttcatcagagaatgcaccgcctgtcaacaaacaaagacgagcactcagcggccagccggtcttctccaaccactaccaacaccttcgggagtttgggaagatatgtccgtggacttcattactcatcttccacaatctcacggttacaccgtcatattggttgtggtggatagatactccaagggagttcatctcggagcactgcccaccaatcattcagccttcaagcgcgagcttttccggctaagtggagcacgcctccgcatgagcacagcctatcacccacagtccgacggccaaacggaggtcatgagccgtattttggaacaatatttgagagcatttgtccacgcgcaaccgaccaactggtatcgctatctcacattatcagaatggatttataacacctccctccattccagctccggtctcaccccatttcaaatcatttacggcaaaccgccaccaacattgcctcattatcttcaaggaatgtcgtcaaacgaggccgtcgattcgctaataacctctagacaagagattcatcaaaagctccaacgtcgttttactaagacacaagacaccatgaaaaggttggctgacgctaaacgtcgggatgtgacctacaccatcggacaatgggtctacgtgatagagcgcataggacaggtttctaatcgtctccaattacccgaggaagctcgaattcaccccgttttccattgttcgctcctacggaaacatcaaggtcctcctccagcatcactagacacttcaccactgaagtttatcgcccagagacccgtccaccaccccctctgcatcttgaactctaagctcgacacttcaatgtccccaccaacacgccttgtcttaatccagtgggaaggacaatcaccagaagacacgacttgggaaaagtggtcgaaagttcgcaattcttaccaccttgaggacaaggtggtgtttccgggcgagggtattgatagcagtagcctgtag

SEQ ID NO: 77906 - DNA, 563 bp, Glycine max
  Peptide Sequence Number=SeqID_194684
gggaccctgattatgctccagtaaaaggcacagtgtttaaccagctgttacacttcaacacactccatgactaccaagctcaagtggccaaaactaatccaacttttcggttactggctcctgatcaaagcgagttgtacaccgcggacccacgaaatgttgaacacatactgaaaaccaactttggtaagtactcaaaaggcaagtataaccaggatattgtgactgatctttttggagaggggatttttgctgttgatggtgacaagtggaggcagcaaaggaagcttgcaagttttgaattctccacaagggttcttagagatttcagttgttctgtttttagaaggaatgctgccaagttggtcagggttatctcagaatttctccatcagggtcaggaggctttaatttggttccgtttggataaattttttcacaaacacttatcagataaaagaatgagaagcctagctgttagagcagaggttgggataaaaggggtgagggaaatcaagagagagaaaatgggccttgcttcgagggaaggaaacctcctgtga

SEQ ID NO: 77907 - DNA, 768 bp, Glycine max
  Peptide Sequence Number=SeqID_194685
atggatgactggtgtccttcaaatgattgctttgattttcagaatgtcaaagaggacatactatcgaggtttttgattgagagcaagaaggaccaaaaaactatgactgatcagtacttgagggatataattctgaactttatgatagctggcaaagacacaagtgcaaacactctttcatggttcttctacatgctctgcaagaaccctcttatagaggaaaagattgtgcaagaagtgagagatgtcacttgtagttgtagtcaccaaagtgaaccaaacatagaagaatttgtggccaaaataacagatgacacccttgataaaatgcattatcttcatgcagcattgacagagaccttgagactttaccctgcagtcccggcggatgggaggactgcagaggcacatgatattcttcctgatggccacaaactgaaaaagggggatggagtgtactacttggcctatggtatgggtcgaatgtgttcaatttggggtgaagatgctaaggaatttcgtcctgaaggatggctcaacaatggaattttccaacccgaatcgccattcaaattcgtagctttccatgctggacctcgtatctgcttagggaaggactttgcatacaggcaaatgaaaatagtagcaacggctcttgttggtttcttcaggtttaaactggcaaatggaacacaaagtgtgacttacaaggtcatgtttacgcttcacatggacaagggtcttcctctatgtgcaattccaaggtaa

SEQ ID NO: 77908 - DNA, 156 bp, Glycine max
  Peptide Sequence Number=SeqID_194686
atgagaggcataaatgtgatggcagaagtggatgtccctggtcatgcagaatcatggggtgctggatatcctgatctttggccatcaccttactgtagggagccacttgatgtttcaaagaactttacttttgatgtcatttctgatagcgcttga

SEQ ID NO: 77909 - DNA, 342 bp, Glycine max
  Peptide Sequence Number=SeqID_194687
atgccgatctccccctacggaagtatcagttggtctgtgccgtcccgacataaggatcgcacccgcaagacacccagtggacccggaggagcccaacagggccctggggtttccggctctggttacgggcctctggatcgcgcctgcaagacacccagtggacccgaagaagcctctgtcagttctacagagtgcttgtcgcccccagcaaggtcatcaggccccctactaatcgagctttcatcaagaagtactgcgcccccaggcaggcgcagggcgaaacaccacagcagcctggggatggccggcagcgggcaacagatgcaccgccaccacctctag

SEQ ID NO: 77910 - DNA, 456 bp, Glycine max
  Peptide Sequence Number=SeqID_194688
atgaagctccctagcggtaaaggcccacaacatctgcacgtaggcaacgggaaactgccgttgttgctaaggatgttcatcacgtggatgatgcaactgaagagatcttccaacaacctaaagaaagaggaacgtcttgaattgaagttatccttccacggaaagaaggttcagaaatccgggaggccagctgttaagattgaaggtttccatattccagtaggagaggtcaccatcaccctcgatgatgtggcctctttgcttcatctacccatcacaggcaccttccatagcttcgagactcttcatgtcgacgaagcggtgttgatgttagtggaattacttgaagttagtgtcgatgaagccaaagctgagacagtacagtgtcatgggacatatgtacaactatcatggctacgagacatttatcgtagcaaatgtgatgttgaacactag

SEQ ID NO: 77911 - DNA, 423 bp, Glycine max
  Peptide Sequence Number=SeqID_194689
atggtggaattagagggaaacttggttctgcactggatcatcgtcgctctaggttcattgtgcccgagaaagaaacctctcatcaccaccactaccatcatcaacaacctaatcgcctcacaaggtgctgaaaaaaaacatcaactaaagggttttcttcatgattttcttcgtaagacaggtgagggaaaggtcaatgttggcgatggtggtggtcttgcccatgttgcccttgccagaggtgataacagtgatacaggggatggagccaaagagcttgggctcgcggttccactagaggggggagggggggggagaatggaggaggaggaatgcggagttggaggcagtgatagtgccagggagaaggtggagaaagagcattgggaaggggagagagggagaaaaagaagaagaagatga

SEQ ID NO: 77912 - DNA, 384 bp, Glycine max
  Peptide Sequence Number=SeqID_194690
gatttaggtgtgactatatcacttcctaagtctttagtctcagatgtgggtggcgctgagtttgctaagaagtttaggcttctttgtaaacttaaccacactaagtcgtctacagtcttacggctgaaggcgatttggttaaaggctaagctacctttcgagttgtggcttggccagtgctgtcctgtcgacccttatttaaaaggtcgattgatctggaagcttcaacaagctttcagacctaaggatcttgtggtgcctccaacgagtacttataagtctgagacttttgagtacttagaggatatgacacttctaagatcttggactgaagcctggctcaagtacgtcaggtggtattacgctactgctttatccccagat

SEQ ID NO: 77913 - DNA, 441 bp, Glycine max
  Peptide Sequence Number=SeqID_194691
atgggcgaacgcctgctggaggtgttaaaaaatacccatagcctcgaccgggtacgggtttattccaccgaagaccgctatatcgccgctctgccgcaaccgatcccccgctttgttagccgcagcgaaacccgaaccaggcttgcaaacgtttcgctcagccaccagtgccagcaagacagccagcgcgatggcgataagtggtacgggctggaactaaagcgcaaggtggaggtagtcgagaagtttacccttggtgaaggcgtttctccggcgacgctcacctgggataaagaggcgatggattgcttccgctcgcagggccaggcccacatcattttcttcggcatcaatagcgcggaagattatcgaacggcgaaagaattaggcgccgacggcgtgatggtggattctccggcgcaggcgaaaaactggcagtaa

SEQ ID NO: 77914 - DNA, 417 bp, Glycine max
  Peptide Sequence Number=SeqID_194692
atggatgatatcgattctaatggagatgcagtggcgttcgccaccagagacggtccattggctctcgtcattgatggtgacggtggaatgaaggccaaccttacccccataagccaaattaagttccttgagctagaaactgaatttgctcttcatgcacatgcacacaccctgtgtttgctaaccactagaaccagcgcacaacaccatcatccttatccacgattgcatgctaaggttcaaagtgttgaaggagaagaaggtagaaggaagagggagaggagacaccacttcaaggagaagatgagtctagaagaagctcaccaccatatgaggccatggataagagcttggaggaagaaggagatgaataaagggagaggaagagaagagcacgaaattttgtgctctaaatga

SEQ ID NO: 77915 - DNA, 336 bp, Glycine max
  Peptide Sequence Number=SeqID_194693
atggagtccaaagtgaaacccagcctctacactcatcaggtcgctccccctctaaagaatgcatggttagttattcctatagctctttctcctccactatcacaaccacaaaataaaactacagttgcatgcatgggtcgtatttttccagaatgtcctgagagacaaaggatctcatggaaacagagacgttaccgtgactgctaccaccaacgtttcctcgattatccgatgaccggtgccggacctggcggtgttgaagaccctccgccgcctgtcttgaatcacgtgattaaatttaatttttcaggtaccatgctatcgaatatagggtaa

SEQ ID NO: 77916 - DNA, 621 bp, Glycine max
  Peptide Sequence Number=SeqID_194694
atgattaaaatcacgaaagggctggatttgcccatagctggcatgccattacagcagatctcgccccggcctgcggtgaaacgcgtcgcgctgctcggcgaggagtacgtcggcatgcgcccctcgatggccgtgagcgaaggcgatcgggtgcaaaaaggccaggtgctgttcgaagataaaaagaacgccggggtacgttttaccgcgccagccagtggggtggtcagcgccattcatcgcggcgagcgccgggtgctgcaatcggtggtgattgatatcgacggcagcaatgaggcggtgtcgtttacccgctatgcattagaagatcttaacgatttgccacgggaagcggtgcagcaacagctgctggaatccgggcagtggacggcgtttcgtacccgtcctttcagcaaaattcccgcgccgggtagcgttccggcggctattttcgtcactgctatcgataccaacccgctggcggctgaaccgcagccgattatcctggcccagcgtgaagcctttgatgccggtctgacggtgctaacgcacctgacggacggtaaagtccacgtctgtcaggccagcggcggcaagctgggcggccatcccgccgggcag

SEQ ID NO: 77917 - DNA, 300 bp, Glycine max
  Peptide Sequence Number=SeqID_194695
atgggagagtcttctaattcttcttctgcttcatacattcatatggtgcaccacctgattgagaagtgtttgacctttcacatgtcaaaggaagagtgcatggaagctctctccaagcatgcaaatattaagcctgtcataacatccactgtgtggaacgagctagagaaagaaaacaaggagtttttcgaggagtatgccaaaggtaagagtaaagaagaccgaatgtcggaggaagagacaacccaaatgttacagaagatgatctcagattcctctaaaggtgctgccaaggactaa

SEQ ID NO: 77918 - DNA, 204 bp, Glycine max
  Peptide Sequence Number=SeqID_194696
atgtggaatggcaaggaaggtttgaacgataacatttttggtgtagtcaatgatgatttggtggtcatcggggaggagatggttgatggagtactaggggcgggcgaaaagggtggtggaggggagttcaagccaagggaagagggagaattatatttgtcacgactcattgatgtaaatatcccaggtggttaccacccttaa

SEQ ID NO: 77919 - DNA, 621 bp, Glycine max
  Peptide Sequence Number=SeqID_194697
atggcttcttcactgggtcgaagaagaacccacgctcccaaatcttcctccaccctaaacgacgacgtttcctgcgaggaatgcggcggaggccactctccttcgaagcttcttctctgcgacaaatgcgaccgtggctaccacctcttctgcctccgtcccattcttccctctgtccccaaaggctcttggttctgcccctcttgctccaatcacaaacctaagtgtttccctcttgtgcagaccaaaatcattgacttctttcgaatccaacgctcgcccgaggcattggcgaaccaagacacgcggaagaagcgaaagaggggtgggggcttggtggtttcgaagaagaagaggaagctgttggcgttcgtgccgagcgaggatccgaagaggagattggagcaaatggcgtcgctggcgacggcgttgatcgcaactgaaacggagttcagcaatgagcttacttacatgcctgcaatggcgccaaggtccgctaatcgccctgctcttgagcgcggtggaatgcaggaaactccactaaaggtggctagccaggttttcgggcaaaaatcagttatcaacaaaactggtgaatactttgcaccaacatcacggtga

SEQ ID NO: 77920 - DNA, 1002 bp, Glycine max
  Peptide Sequence Number=SeqID_194698
atggtgattggctggtggggtcatgcttctggcaagaaatttcaggagattcttgaagaagcaatagttcgccccctccatattgaaggggagttatatgtagggattccgccaggggtggaatcacgtcttgccgctctgactgtagatactgctgatttaagcaaagtctcagcactcgctaatcgtcctgaccttccctccaccttccaaccacagcaaattgctcaacttgcaaccagtttacctgttgctttcaatacactgaatgttcgccgtgccatcataccagcagctaatggacatgtatctgcccgggcacttgcacgttattatgcagccctagctgacggtggcaagataccaccacctcattcttctgcttctaagccagtacttggtagccatccccacatccccaaattatcttcttccccgaaaccccctaaaacccgaaaatgtattggacggaggaagcaagcaacttcgacttcagttagtactactaacagttatgaaaaagtttctagttacgatgattctgaggctaataagggcagaaataccaacagcgagagtagcagtggtgatgatgccagtagtagcagaattagtaataatctgagatcccatgttgctggtaaggtctacaagaatcctaggattattgatgaattcttgggtacaggagagtacacgaatttagctttgccaggggaaggttttggcctagggtttaagaggtttacgtcgaaggatgggtcatccattgcctttggtcactcgggaatgggtggctccacaggtttttgtgatgtcaccaataacttttctattgctgtgacactgaacaaaatgtcctttggaggtgtcacgggaaaaattgtccaacttgtgtgttcagagttaaatattcctgttccagacgatttcttgagatttgcggttgagcaaagtggacccgatgagcaattatctatggggaggcccattattaattga

SEQ ID NO: 77921 - DNA, 429 bp, Glycine max
  Peptide Sequence Number=SeqID_194699
atgaggcaagagaacataatgcattaccaagtggagcctgcatggagctactacatgagggttcggaggagcatggaagaggaccagatggagagagtggcaagactggcctcacagagtgcagtggtgatattcagtgtgagtagctgttgcatgtgccatgcaatgaagaggctcttctgtggaatgggggttaaccccacagtgcatgagcttgaccaagatcccaaagggaaagacatggagagtgcacttatgagactccttggaattggaattggaaatggaatcaactccactgcttctgctgctgttcctgtggtcttcattggagggaaacttgttggctccatggacagggttttggctttccacatcagtggcacccttgttcctcttctcaaacaagctggtgccttgtggctttga

SEQ ID NO: 77922 - DNA, 2172 bp, Glycine max
  Peptide Sequence Number=SeqID_194700
atggagtccaaacaagaagcatcaagtgttattttaaacttgatgggtcttgataaagtacctacccaacatcccgttagagataaacagaaagtgctctctgagaattacctgcagaaagttgcctctattggtgtcagaaagaagcgttcatcttatcagcatcattcctctggaatgaatactaatgaaaaggatgaatcggaggatgttttgaaagtggttaaagcactaaggcgaggtaagcaacataacccatcaaagggaaatgggaaagagaatcctagttcttgcaaaaattctcatttccctgatgggctgctccaagagatgttttatcctaaaagcatgaaaccatatcctgaaatgagggagagaaagaaaatatcatatcacatgaattctgataagcagagttcaaggcctttgagtaaagtttcagaggagatttctatgccatcgggaaatgttgcaaatggagttttaggtactgcttcaagttcgtttttcagagggaatgaagcattttccaatgataatatgctgaagcctgcttcaaatatttcagttaatgagatccaatgcaattcccctttcctctgttctgataccaggaccaacactttggcacagggggatgcgactgaaaaattgcaagaacttggacggtgtggtcaagactgtatacataaccagttgcctatgatttctgaacatggaaatagagcaggaaatttgaatcgtcgaagtggttatagctatgataaaattataaggaacattagattcaaggctggtgttaactatagcttttccagaagagtggcaatacctctttgtacagcttcagttattgctgataactgtggaactatgaatcaggatatcttgtttcagagatattggggtttgagaaagaatgcatctgcaaatcgattatcatggaagtcaaagaatcaaaatgttaaccagaaagaatgtttggaagatgtgaacctcagtcctggccatgagaaattcccttctctttcctcttatttcaatagtaatcacactgaagagaattctacaggccatacatcagagaagagacgttatgggagcaatttgtctgataaggtaactatgcctcctcaattgtcaagttctagtccttcttccgccttgatagactgtcagatcttgcaagagagatgctcagcaaatgatgaagtgaggaacaaaacatatgaagacagcagtatgtctaagcaacatgttgtgtctcctgattcatcagttgaattcttggcatctgatgcaacaaatgaggttgttggcaggtcacataataatccaaccaagcgtcaatataagtcagcagccttcattttgtcacaagaaattgattctctgagtcacacatatgcttcaaagaaacaggatacatcagactttcaagaagattccgttcattcactttgctctgaggctgacccagattccataggtagctttgaggaggcatacgaacctagtccaatttcagttttggatcccttatttggtgaagacagctctaaatgtggcaatcatgtatatgattcctctgaagtggatgatgaagaatatggtttgaatgtttcaagtgatgaagattgtgagaatgaatctgtaggtgactccgaagaaaagaaagatgtagcaggattatttagagctgaagaaagtagggatttctcgtatattgttgaggtcttaaccgaggcaggtataagtaataggagcttgtttacagacttttcaacatggcactctgcagaatgtcctattagcccttctgtcttcaaaatcctggaaaaaaaatttggcgagcagcaactttggaagagatctgaaaggaaacttctctttgattgcattaacctagggctgctggagattctgcagccatatttgtacatcccagtgtgggaaaagcccatgtcaagaaggttgaatactgaaccaagccaggacatgattgaggaggagatgtgggggttgcttgttgcacaggaaaagaaagctagtaaagggttagcagacagtatgctcgaaggggagattaggtggatagaactagttgaagatgttgaagatattgttagagagatagtgaagttgttaatagaggagctcacaaacgagata

SEQ ID NO: 77923 - DNA, 332 bp, Glycine max
  Peptide Sequence Number=SeqID_194701
cccttccgttattgcattatatctgagagctaaccttcatgaaaccgaagcttttgaaaacaaaaaggaaatgagcgagaagaaaaaaggaactataaaagaattgcttaaacatcctaaagcccttctcaccgtagtgggtttaacattaggcggaacacagaataggaagaagacctttgcttctgggatttggaattttaggaactctttgcacagtacctttgcttacagcattaagcacgacgacctcaatgcagaacttttcccatcggaagtaagggcacttggtgttggcttaccttatgctttaacagtcgccatttttggag

SEQ ID NO: 77924 - DNA, 237 bp, Glycine max
  Peptide Sequence Number=SeqID_194702
atggccacagctgaagccttggaacgagaaaccaagaaggcccgaaaggaagaacacgaccaaagcaaagttgattcattgcaccaagaggcaacaatgtggacggaccgatttgctcttactttgaacaggagtcaagaacttccccgattgctagcccaaggccaaagcaatggcggacacctactccgcccccaagaagatcccacgaacttctcagctattgtcaacatatga

SEQ ID NO: 77925 - DNA, 222 bp, Glycine max
  Peptide Sequence Number=SeqID_194703
atggcttccatgatggatgccatgctgggaatgaaacaactaatggagagtaacgtggccaccgccacgcactatctcccaactgccgcgcactaccctattccaaacatgtcatatgtgatgatgcgggtcacgttcctcccctcatccttgaaggggagcctcctcgacatcctgacgaggtccacgaggatcatcgagagcttgctcagggagacataa

SEQ ID NO: 77926 - DNA, 1008 bp, Glycine max
  Peptide Sequence Number=SeqID_194704
atggggtggggagatatttacaagagacgggttagagtatttacaatggctgtaataatatacctggattataagagtgtacaacaacgagagaaatggactagcaaatcaagacaagcttcattgtgggagaaggctcatgaacgtaatgctaagcgtgttctaaatttgataatagagatggaaggcttatgggttaaacttgggcaatatatgtcaacacgtgcagatgtgcttcctgctgcctatatacgtcttttgaagcagttacaggactctcttcctcctcgacccttggaagaggtctatggcaccatacagaaagagttggggaaatcgatggatgagttatttgctgattttgtcaacaaacctctggcaacagcatcaatagcacaagtccaccgtgcaactctgctcaatggacatgaagtggtagttaaagttcaacatgatggtatcaagacaattatactggaggacttaaaaaatgcgaagtcaattgttgactggattgcatgggctgagccacaatataactttaatcctatgatcgatgaatggtgcaaagaagctcctaaggaacttgacttcaatcatgaagctgaaaacactagaacggtggctaaaaatcttggctgcagaaaccaatatgatggaaatatgagagccaatagagtggatgttttaatcccagatgtaattcagtctacagaaaaagtccttgttttggagtacatggatggcattcggttgaatgatttagaatcactagaagcttatggagtagataaacaaaagcttgttgaggagattactcgtgcctatgcccaccaaatatatattgatggatttttcaatggtgatcctcatccaggaaattttcttgtgagcaaggaatctccacatcgtcctattttacttgactttggccttacaaagaaactatcaagcaccattaagcaagcacttgcaaagatgtttttggcttctgctgagtggttataa

SEQ ID NO: 77927 - DNA, 657 bp, Glycine max
  Peptide Sequence Number=SeqID_194705
atgactgagtatttgcgtctggacataccagagcaggcaatggaagtaacagctgtattttttcgtgcgacaacacccgcaaatgaataccataaaacaatgaaatctctagccgatcaaagggacagaaatatgaaggttatacaggagaaaatgaaccttgacaaaaaagaaatgaaacgctttaatcctgttgatgcatttcctggtgatattgtaatatttggaagggttcttaatcttctaagagggctttcttccactatgaatgtacaaatagtatatatggacattatgaggccatttgcagaatcagttttgcgtgggtacattagtaaaggaccatccgtaaatgatagatggatttttgattcaccagtccattctgatgtagaatccatgctgaggcagcttttaatcgagatgggaaataatgataaaatactcggaatccaggagtgcgatttcataggctcttttatgttgcaaacccagagtgggattgcggctgctgtgctcattgactgcaacactaaaacgcgaagcgaacaacatctttgtcgcaacacatcgctgctctggcatgctccaccgctatcacaaccactctggctgctattgacaactttgatacgcagacaaatccctcaatcatag

SEQ ID NO: 77928 - DNA, 366 bp, Glycine max
  Peptide Sequence Number=SeqID_194706
atggctcctctgaaacttctgtggttcatgttcttcttgtctattattgtggttgttgttgcattgatgtcaagagccaatcaaatagctcaagtatgtgcctacaaagatggagaggtcattattgacactgctgcaggagtgcttggtaaatatgatccacgtccggttaagcctgatagcctttttccggtgttttctgttacaaagggtatcacagcaggaatgatacattggctggttgacaatggattcattaaatgtgtcatccaccgtgttatccacgcaccaagccaaaaattgttgggcgtaagggggtgtattgggaaaaaccctagtcctacatcaattagagatagtgcctag

SEQ ID NO: 77929 - DNA, 984 bp, Glycine max
  Peptide Sequence Number=SeqID_194707
atggagtttgatttttcaattgagtataagcagggacatgatattgtagctgttgatgccttgtcgcgagtggaaccagttgcttgtcaagctctcgcggttcatcagaaatgcagtgtatgtcaaaagtgtaaatatgagaccaaggcttctcctggattgctgcaaccattgcctattccggatctgatttggcagcatattaccatggattttatagaaggcatgcctagttcctttgattctatcaccagtgacagagattcaatatttctcaatcagttttggcagaaccttatggcttttcagggtgttcaggtccagctctccacagcttatcaccctcagacggatgaccaaacagagattgttaacaggtgtttggaaacatatttgatgtctactccttatgaagtggtgtatggacagccacctcctgtgaatcttccttacttagcagaagcttctaagactgagttggtggatagaagcctcttgaggagggaggagatgctgaaactcattaaatttcacatgaagagggcccaggatagaatgaaacagctggcagataaacatagatctgagaggcagttcagtgttggcgatatggtctatgttaaattgcacccttaccggaaaatttccgtagctgccagaagcaatgtgaagttgtcccccaagttttatggcccatttcagttgaagaagcatgtaggtgaagcagtaacttctttgagtcttctaagtttagtagaaggagatcctctattcaaagagcctgaagctattttggatcgcatgacagtaaagagaaggggtcgagctgttactaaggtcctagtaaagtggaagcatagcttgccagaggatacaacttgggaatttttctttgatttgaagcaaagatttggaggccgttctttcattggcatccctactcttctctgtaattctttgagtctcatcctagaattaccttaa

SEQ ID NO: 77930 - DNA, 813 bp, Glycine max
  Peptide Sequence Number=SeqID_194708
atgctgagaggattgcttgttgatgggtgctggatcgaagaacttagccgggtcaaagaggaggtcattggccagcatcaaaatgattttttggtagtgtgctttcatgagaaagaagtaaaggatgtagtatgggaatgtggaagcagcatctataagattgtggctaaactgttagcaagaaggctaaagagggtgatgccagatattatagacgagcaacaaactgcctttatagaaggcaggcacatgctgcatagtgtcgtcattgctaatgaagtagttgaggaagcaaaaagatgtaataagagttgcatggtgttcaaagttgactacaagaagggattaactggtctgatgagagtagcactgcggaataaccagttcaaagcgttgatggaaaatgtaagagcaatcaaggtgaagcggaggagtttcgagttggtctcagggattctgaagaaggtggtggataagctggtgaagttaccctggtggttcttgtggagaggtgactcaaagcagaagaagatcgactgggacttaatcaaatttaattatgcccttctcggaaaatggcggtggaatctatttcaccaccaaggagaactgtgggctagagtgttggattcaaaatatggaggatggaggaatttggatgaggaagatggtgttccattcatggaaaagtaccctagactctacctcattttgaaccaaaagaatcaatatatccagcagatgggaccatttcagatgcagcatgggagtggaacatgcattagaggagattccttttcgaaactgaaatag

SEQ ID NO: 77931 - DNA, 306 bp, Glycine max
  Peptide Sequence Number=SeqID_194709
atgaagcttcttgaggaagctacatggagcttcctcggtaaaaacgctgcccagccttcgttaaccgttggatcttctcgaaatttgggtctacagcttcacaagacacttgtccacgatttgaccgttgggatctttgcgaagatgtctggacttaggaaaatcgtcatttcttctcctttctttcttccaaagccatttctaacgtcgcaagcactttctccatcacccacagccaccattagcaaccaaaaaccatcgttgttctccattgaaaccccacaccgagaggaacccttcaactga

SEQ ID NO: 77932 - DNA, 375 bp, Glycine max
  Peptide Sequence Number=SeqID_194710
atggcggatgctacacggaatcgcgttcttgagcgtgaaattgaagatcgcgtggagaatcgtctcagttccaagattgatgaaagattcatggagatggaagcttcgatgcagcaaactcttcacgattccctgacacagttgttagccttgtcgatatcgcagcaaatgcaggaccttctacacaataacagcaagggcaaaactcattctcaaactgggggaagcccaattcgaggtgagagatcttcttattcttgcggaacacgtctagctagaattgattttccgcgtttctctggtattgatgttaaacaatggttaatccaatgtgatacattcttctctattgataatacacctgaggagtttaag

SEQ ID NO: 77933 - DNA, 393 bp, Glycine max
  Peptide Sequence Number=SeqID_194711
atgtgggggacaaaatttcagctcaaagttaagaatttggacatagaaaaatgggaacaacaactaaaagagggcaagacttatatcgcacaaaattttgaagtagagagcaacaaagaagattacaagacaacaaagcatgggtacaagttggtctttgttaagggaaccatgcttaaggagcaagatctacttgacatccctcattatgtttatgattttacaaagtttgagagtatcatcaataagaatgttgttgctgatgtgttaatagaagttattggtgagtttgttgatttggtccagtgcagccttgaaactaggcccaagaaattagtattcacaatgagagatgaagggtatattctcaatataagtttaagtcctgtttag

SEQ ID NO: 77934 - DNA, 678 bp, Glycine max
  Peptide Sequence Number=SeqID_194712
gaaggcataggtcacatcttagaccttactcccataagagagaaaaggaaagaaagccccaagaggctaacattaacctctcatacttccctgggaaggacaatgtagaggcttgcttagattgggaaataagggtagagcaacaacttaaaaggaagtctacttcaaaatcctatggctctcactcatatccaaagaaataccaaggtcaaggcatcttaggggtgacaccttctaagcccaaagatgataaagggaagacaatagaaaagcaaccccctaaggctagtatgcaagggaagactaactctataaaccaagatgacgctactacttcaccttcctctaatgaaagtgaagaagcaaaaagggaagaatctagtgaagaaatctacccccaagaagaaggacaacctttaatggttaaggaggagtgtaaggaggtaagtgtctcctccaagaggttagctaagaaggaaagtcattttgcaataaagataaaaattaaagaaacttcccctcttagacaacttctacatcttctcctttgtaaaaaaacacttgttagtactatcacacctcttggtctagaggttattcctcaagtaaaggagatgttgggtgagagtttggttcgtaagaacttaaatccttatgctttgttggtgcctaaaatag

SEQ ID NO: 77935 - DNA, 463 bp, Glycine max
  Peptide Sequence Number=SeqID_194713
atgcagatgaagaacacccctttgtacagaacaactccttgggggggtatgcctgagccttgttttcgcaaagcaccctctaaggtggtttccatccctgttcacttcgtggggtcagagcgcaccagaacaaattctgattctgccacagagatccagagggtgctgagaggatttctggtgaggaacaccttgaggaaaatcactgccatgagggtggagttggagcggattgagagcgagataagtgtggaagtgatgaaattgaagagggaacaaagggagagggtgagggtaagcgagaccatcatgaacttgcttctcaagttggattctgttagggtgttgcactactctggcctcagagagtgcagaaagtctctcatcaacaaagctattgcccttcaagaaatgctagatcaaatggctgtcactcattctgatgagatggaagagaaggaaa

SEQ ID NO: 77936 - DNA, 393 bp, Glycine max
  Peptide Sequence Number=SeqID_194714
atggagataaccaaatcacttgtctccaacaacaataataaaaagaacaactgcacaccttccaggttagtagggcctgatggtgttggattgttggtactgcctcgcaaagttgaacttaaggatgactcaagcttgctagttgcaacctatcaaccactaccagcagcattcacaaagcaaagcagctgctacaccaaagcaaatagtttctatataacatgctcaaaactaaagtactcaaatcaaaactggagaaacagtgttgggcttggttggaaaaggatgaaagagaggctgagggacaggaaaatgcagagggtacagagaccaacaaagcatgaacaggagtttggctgctggaaacttgagagagcaaagtgcagagagtga

SEQ ID NO: 77937 - DNA, 468 bp, Glycine max
  Peptide Sequence Number=SeqID_194715
atggttactgctggaaccaaaaagcctcaagtttcagtacctacaccaccaccaccaccttggaaaatcaatttgcagaaatatgctgaatcccgtgctctcgaactccatagtcttcaatctatcatagaaaatagagtaaacaatgattataggtctcaaaagaacaagagaagaaggacaattgtgtttgataaccaaattgcaagaaaagggtgcagaagaaagaggcagaaactgggaataattgataaagcccttgccaaatcaggtttggaggagaatcaccaaaagaagcttcctcgatgtgttcatcggagatatgaactaaagaaaaacctagagaatggtttttgcacttctagggatgtaaccaagaggctgagaactcatgtttggcatgcaaagtggggtaaaggttcgagggcactcttgaaaaaggctcaaacaaggggtgcttgtacatga

SEQ ID NO: 77938 - DNA, 1053 bp, Glycine max
  Peptide Sequence Number=SeqID_194716
atggcgctgaggctgactactgttgtttcaagtgttggtcattcggggaaacccaggtttaggttcagaatcagaagtgttgctgccacagttagaaacatggccttcagtgcaacctccaaggtaattgattcccatctccacgtgtgggcttcacctcaagaggctggcagattcccttattctcttggacaagaacctactttaccaggaaatgccgagtttttgctccagtgtatggaggaggcaggagtagatggtgcactcattgtgcagccaattaatcataaatttgatcatagttatgtcacaagtgttttacaatgctggaattgctacggaaggaagggaatagggtacagagagaaggatagggagagcgttttgaataaatacccaacgaaatttgttggttgttgccttgctaatccagcagatgatggaagtgggcttaggcagtttgaagatcttgttttgaaggacggttatcgtgctgttcgattcaacccatatttgtggcctcctggagaaaagatgacaaataaagttgggaaggaaattttccaaagggctggagaactcaatgtgccagtgggcttcatgtgtatgaaggggcttgatctgcatatttctgaaattgagcaattgtgcacagaattcccatcaacagttgtattgcttgatcacttgggcttttgcaaaccaccaataaatgatgaggaaggtcttgtcttttctcaacttttaaatctgtctagattcccacaagtacatgtgaaatttagtgcccttttcagagtgtcaagagcacagtttccttatctagatttgtctcctctcttttcccaagttgtctctcactttggtgctaaccgtgtaatgtggggcagcgattttccatttgttgttgctgaatgtggttacaaaggagccaaagaagcagtgcatcttattgccagtgagatctctttgcctttatcagatttagagtggatcatggggaggacagctacacaactcttccaaaaccaattgactccagtcaatagttga

SEQ ID NO: 77939 - DNA, 729 bp, Glycine max
  Peptide Sequence Number=SeqID_194717
atgggggtgattccaagctccataacagttccgcggttggaagcaaggaaaacgaatagagagatgacagtgtatatcacattctctctaaatgccactttcctgtcagcagtctcaacttctggaacaaaggggacaactaagtcaagcagcctgaatccacctcccatcttgcatgccatccaaactacaacaacacaaatgacaaatgaaattgggaaggcaattttccttgtaaatgggcttggtccatatatttctgaaatagtccagttgtgcacagaatttccatcaacagttgtattgctagatcacttggctttctgcaaaccaccatcaaatgaagaggaaggtcttgtcttttctcagtttttgaatctatctagattcccacaagtgcctgattctttcctcctaagaggagcatgcttaaatgtttttattagtaaatgcttcagcttgaggaatactaaatttcgaatttttgacaggttgtcaagagggcagttttctcatctggatttgtctcctctcttgtcccaagttgtctctagctttggtgctaaccgtcttatgtggggcactgattttccatatgttgttcctgaatgtggctacaaagaagccaatgaagcattgcatcttcttgccgaccagatctctttgacttcgactgatttagagtggatgatgggaagaacggttacacaactcttcccaaatcaatga

SEQ ID NO: 77940 - DNA, 147 bp, Glycine max
  Peptide Sequence Number=SeqID_194718
atggagaattggcgaacagcgctacgcaataacttcgcggggctcttgactcgaagagaatggagaattggcgaacagcgctacgcaataacttcgcggggctccagactcgaaggtggaggacacatgaacagcgctaggcaatga

SEQ ID NO: 77941 - DNA, 327 bp, Glycine max
  Peptide Sequence Number=SeqID_194719
atgaatcaaggacaaactaccggaatatcaaccgccaatcgtgccttaggtggaactagtggttttggccttgatgaaattatctcaaacgctccttaccctagtgcatcttcgtctaaaaggtcgcgagctatgcttgaatatgatgttgggggccctgtggttaataatgctttacaccaacaagaaagaccttcagcattagcagtaccgaaggttttccctccttttgctggagaattcgcgagagacttccaagctccagatcaatcgagtttgctcaatgtatctcaaaacacccttcaccctgaactgttctatcagtaa

SEQ ID NO: 77942 - DNA, 741 bp, Glycine max
  Peptide Sequence Number=SeqID_194720
atggaaatggaaccaaactatggagattattactttcctgttgcttcaccaactgctcaaggcactataactactggtttgggcaatggtaattaccatcttacagcacagctgcttggagagtcttcttcaactgttcaactgcccccaactcaggaatcatgtccacaagttgtcaagcttcaaaatccacttggagctgcaaatggtgcaccaccacctttcagtccgacgacacagtgggccaataatcccaatttgcagttgccacattctcaactatccactggcctggggccaaccccggagatgatgcagttcagaggattaagcagtttctcttctggtggaaggtactccaatggatctcaatcaaacactcaaaagcagcgaggacccaagggtaatattcatcttattcccaaactacgtgaaatgggagaatcatcatcaagcaggagtgctaagatgaaaatgactttgccagacaacaatcagcaatcaactgagcttcagctgggtaccttgcttaatccaactactcaacgcaatggaaaccctcagccgccaaggcttatgagaaactcactttatgatccaatattcgagcaaatgggccttcccatagatccccatctgaggatgtttgtacgtaggcaggaagcgtacacaatgatttgcgttgatcgaagcaatgacttccggttcgcaagagagcttccatatacaacatattgctga

SEQ ID NO: 77943 - DNA, 315 bp, Glycine max
  Peptide Sequence Number=SeqID_194721
atgttggtggtgaacagagcaccgaaacaggggaggggcagagcaacaacaaccaaggaagcagagagaagagtggtgggcgtgggaatgaatgaaactcaagtgttgatggatgactctatttatagacaagcgccaaacacaaacagaatgagaattcatttcattttcaatgcattggtagtgagttcaattagcaccaaattaaatctcacccttcaaacagaaccttccccatcaagtagtgttgctgattcacgctatgctatttttgctcagacagctccatctcatcatgcgcactgtttttcataa

SEQ ID NO: 77944 - DNA, 786 bp, Glycine max
  Peptide Sequence Number=SeqID_194722
atggcggcggagtctatttacaaagagagatgtgtttcggtgaatgatggtccaagttgggccaaatacatgttgatctctggttctcctgatgatgaatatgatatcatcactttgcaatatactgaggagggtttattatctgtagatgagaatagagagggtcgtgctgcagctttcggtgatgatattgcaattgaatgccttgctacagagttcaagcgagagatatatgtggtgcaagcacatggttcagatgccatggtcgatgaagaaaattgtgttttcttccttccacatcgtccaaggagccgaattactgaacctccatttttccttttcatgaaaggaacaggttggtgcggtgctggagctgaccactatgagcccctcattgctcatccttccgcctttgtttcccaagaaaaggttgctgtgaaagattggattgtgaaacgagccttggttgagatagagtgtgatggttggaattctgctcttatcgagcagttattctgtccgagggatgtacaggcaattctgaagatgcctatctttgagccaaaccttgaggatgatagagtgtggagaaaaactgttcctatggaagctttgtcgggaatgcttacctacgaggacttgataaatgatgtgagttcatgcactgattttgatcaacctattatgggagaggaagtgaaggaagcacatgcagctgagagatggagtcctccttcagttggtagccttacgtgcaatgtggacgctaacttgacaggagctggg

SEQ ID NO: 77945 - DNA, 1098 bp, Glycine max
  Peptide Sequence Number=SeqID_194723
atgaagttactaggctggatgcacaggaaacttcgccagaatagtagtgaaccattcaaggacttggtcattgggaattcttgcaattgtctttcagggcaggcaccacttgatgatgaacaagtctatcagaaaccaaaccttgggatcagactttccaaacatgctcagaaaggtcacaacaaccttagaaactcttttgctggcctagaagcagcaagagtagatgaagactatgagggagaatacttccctggcttccttgcaattggaactcttggttcagaacgagtatctgacccctcaacaacaccatcatttcccatttctgttgagagcataactgaaaaagaagatgaagtcactgagaatgatctgaagctcatcaatgatgagctagagaaagttctaggagctgaaaccaaggatgatgttagcattgactcctcaaggaggactagccatgttagcactgggagaagcagccatgtcagcactgggagaagcagccatgtcagcataataacactcagtggaaagccaatagaaggcacagaaccaaatggaaatggtgctgcaatttgtccactccagggatatctctttggaacagctattgaactgtctgaaactactgcagcagcagcaaagaaagaacataggacttcgctcggggagctgtttcagagaagcaaatcagctgaggagaatttcagcgcaaaatgtgaaaaggaggacaaaagagctgagaaggaagtggacaagtctgccatgaacctgatgaaagaaaagctgaagaaaagaatgctccatgcttattctaagaattctacttcaataaatggtgggcctattgattctgcttctgctgagacaaaactgaataagattctccatatgttccgcaagaaagttcaccctgaaagttcaacagctgcacaaaaatctgctaaacaccacaagaaccagaagaagaagaaaacaatcaatgatggaggctacaacaaaagtgacctggtgcatccagaggaagattcatctgtcaacagggagtactggatcaaaacagatgcagattacttagttctagagctgtga

SEQ ID NO: 77946 - DNA, 465 bp, Glycine max
  Peptide Sequence Number=SeqID_194724
atgacttctgacgggaaaattgatcaaactacaccccagtggattaaagtgaagagtcacgttcaaagcggaggctatgagtgtgactattatgtcatgcattggatgtggaacataatcaacagggagttgaagaatgattggaccatggtgtttggaaaggtgcggattttagaactactctctcttctctcttctctcttcgtaccccattgcccagaggctcttcgctatgcgaagcctaaatgtgtttcttcattggtactcgagtctgcaatgaaatgggaggcactagttacattaggtgatgtggagcatgagccaacaatttcggacaagcctttcataactacagatctcgtagtcactggtattaatgcaactaatggtgacccaatggccattgcttcctttcactctcaatttcaggatcatatgtgggaaatgtttgaatggacaatgtaa

SEQ ID NO: 77947 - DNA, 165 bp, Glycine max
  Peptide Sequence Number=SeqID_194725
atgcctctggtgtcatcaccggctattggagggagagatggggaaggttgtgcatcagtaggtggaggtgagatgtctggaggagggactgctagtggaggagctggtggaatgtctggagtggctcgggtcttgacctattttggccccaggaaaacaccataa

SEQ ID NO: 77948 - DNA, 1139 bp, Glycine max
  Peptide Sequence Number=SeqID_194726
tcaccggcccggccaacgatgccgaaggccgcgttgccgcgctgcgcatcccgggcggtgcggcgctcagccgcaagcagatcgacgagtacgccgcgcatgccgccaagtacggtgccaagggtctggcctacatcaagatcgccgacaacggcgaagtcagctcgccgatccagaagttcttcagcgaggaatccttcgctgcgctggtcgcgcacgtcggtgcaggcaacggcgacatcgtgttcttcggcgccggtggctacaacaaggtctccgacttcatgggcgcgctgcgcctgaaggccggcaaggacttcggcctggtcgccgacggctgggcaccgctgtgggtcaccgacttcccgatgttcgagtgggacgaggaagaacagcgctacgtcgccctgcatcaccccttcaccgcaccggccgtggacgacatcgccgacctgcgcgccaacgcccgtaccgccgtctcgcgcggctacgacatggtgctcaacggcaatgagatcggcggtggttcgatccgtatccaccgtccggacatgcagagcgcggtgttcgagctgctcggcatcggtgccgaagaagcccgcgccaagttcggcttcctgctcgacgcgctgaactacggcgcgccgccgcacggtggcatcgcgttcggcatcgaccgcatcgccgcgctgatggccggcaccgagtcgatccgcgacgtcatcccgttcccgaagaccaccggtgcacaggatctgatgaccgacgcgccgtcgccgatcgtcgacgcgcagctggccgaagtgcacatccaggcaatgaccgagttcgcgttttcgctggagtgggaaaagctgggcaatgaaggcgccgaggccaatctggtcaccgagcgtgcacgcgtgttcgggggctggctggttcgtgtgggtaccaacccggcggcgatggccctgaccttcgtcgccgacggcgaaggccgttgggacggtgaagacttcggcgtcgaggattacgaggacgacgaagaggaagagtacgacgaggacgaggaaggcgaggaagaagaggacgaggacgaagaggaatacgaggaagaggacgaggaagaagaagcggagtcgcctgaaaaggcttga

SEQ ID NO: 77949 - DNA, 294 bp, Glycine max
  Peptide Sequence Number=SeqID_194727
gcgcttgagttcgccgtcaccgggcttcacgtccgggtgcggcaagccacaggggccggcggcggcatggccgaccgcctccccgtccagctccagcagccacaccgcgtagtcggggtgggccaggatcacgcgctggcgctcgaccgtgtaggcctcctcaaggaaggcctgcaggtcctgcggcggatacagatggccgaaggtttcggtgaacgtgcgggcagccagcgccgacagggtcggcgcgtcgtccacagtggcgcggcggatcgaatacatgcaggaagttga

SEQ ID NO: 77950 - DNA, 453 bp, Glycine max
  Peptide Sequence Number=SeqID_194728
atggttgcattgcatgttgtggacatgaggaaaaggatgggagagcctttctcaaaaggtgctattggaaacttgttatggccagcattggttctattggaggatgtcaacaagaacactgaaattagagatttagttagggttttaaaagaaggattgggaaagctcactaaggaattgttcctaaaggtgcaaaatgatcctagatttttgtggagtgatgagtgtgcacaactaatgcttgaaggtatagccactaaaaacccaattacctttgtgttcacaagttgggttaatatgggattcaacgaggtggattttggaaggggaaagcctttgtggttggctcaaagaggaggtactaaagaaactatcccaaacacagtagtgttgatggaaacaaaagagggaattgaggcatgggtcagaatggcagagaaacatattgcttaa

SEQ ID NO: 77951 - DNA, 402 bp, Glycine max
  Peptide Sequence Number=SeqID_194729
atggtgttccttggagggaaaaaagaagaggcagaaatgaaatctggccatgacgatatttcttcctttgaccctttgcaaatggcaaaccaagttttcaagaaagcactacaagaatatgcatccaagaggatgtggaggttgcacattccaatagctattcctccacattggaaaagtcttcctggtagcatagttcaggtgcctggaagttccttgtattcctttggactctattacatgacgaaaactcctatggaagacaatccttcattgcatagctttgttcatggagatgatgcttacagaaactcgagatttaagctaataccatattttttaagtagaatatcacatcagggaccatggatagtgaagcaaggtgttggaatcctagtataa

SEQ ID NO: 77952 - DNA, 1023 bp, Glycine max
  Peptide Sequence Number=SeqID_194730
gtcgccttcggcgaagctgttcatttccggctccagccggtcgctgcggctgaccgcatcaccgctggcgcgcaggaacgcggtcaccgccggcgggccaccgaccacgccgaacaacaggttggcggcggtgttgtcgctggtgatgatcgtggcccggcacaggtcgcgcacggtcatatccttgccggcatgacggcgggtgaccggtgcgtgcgagagcaggtcggcctcgcgcaccggtacgcgccggtcgagcagcgcgggtgcgcgctcggcctggctgagcacggttgcggccagcatgctcttgaaggtgctgcacatcgggaagcgctcgtcctggcgatggccgacgcggcgactgcttgcggtatcgagcagggtcacgcccaagcgtcctgcgcaggccttttccagcgcggcgaaatcaccggcggcgttgatggcggtgtctgtgggtgcgttggcggcggccttgcccgctgcacgtgccagcaacggcagggcaagcgaagaagcaacagcggcaccactgaactgcaggaatcggcgacgggcgagcatgcgggggttctcctggggaccgttcgattattggaacccacggccaggacgaccagcgcgaaaattcagcaccagccattagatttattgatgtctattgcatcaattcctgcgattagcggccttccctgcccaggcgttaggatcagccatcatccaggctcacgactcgacgatgctgcatcccaccctgccactgaacgcgctgcgcgccttcgaggccgccgcccgtcaccagaacttcacccgcgccgcgctggagctgtgtgtcagccaggccgcgctgagccaccagatccgtgggctggaggaccggctcggcatccgcctgttccaccgactgcctcgcggcgtggcgctcaccgacgaaggcgcggcgctgtatccggtgctcaacgaatcgttcgagcgcatctccgccagcattgcgcgctataccggcgggccggcccgtga

SEQ ID NO: 77953 - DNA, 495 bp, Glycine max
  Peptide Sequence Number=SeqID_194731
atggatacagaggagttcagttttcctagaatcagtgatacttgtgcacacaacattgattcacctcctctatggaacctgtcaccagcagcatctcctaatccctactaccaaggaaacaaaagagtagaaaatgagtgttttggagcaaaactagtagcagctgaggctcacaggaagagtttttcatatgtggaaaatagaaagaaaagatttggtttagaggaggatgagaacagaatggacatgttgtgggaggatttcaatgaagagttgtattcaacaacagggtctgctacctcttcttcaagggaagtggttgaattaagatatgctccagcattaactgttgcaaagaccaataatagttcattgcttccaactaagaacaacaagcctggcatggtggtgattgtgaaggtcatgaaaaagttgttctccatcaacaattctcgaggtggcaattggggttttgggtgcatcaagggggtttaa

SEQ ID NO: 77954 - DNA, 408 bp, Glycine max
  Peptide Sequence Number=SeqID_194732
atgtttgaattcaatcatgatcgtgcagatataaggtgtacattgaaggttctgcttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatggtggaatcattggtcaaggttcctgcaaataccgacccttgcaccatgcctgccccttttgaccctccaactttgtatgcaacattacagagaaaggaaagctcaattcaacaagttgaatcatgggagaaaagttattgggataatcaaaccataacatcttaa

SEQ ID NO: 77955 - DNA, 255 bp, Glycine max
  Peptide Sequence Number=SeqID_194733
atggtcaacaagtcatcacttctgcacttggatcctaaatcacctgaagctcaagcttttaatcaaattggtcagaaatccaatggtggttctatcagtccttcgcccactacttctgctgaaggaagttcccagaatggtagaaaccaagggatagatgaaacggccacagctaagaatagtgcgtcttatatcgggaagagattgttagaaagtttggttgcagttgcagggcttcaaatttggctttcatga

SEQ ID NO: 77956 - DNA, 228 bp, Glycine max
  Peptide Sequence Number=SeqID_194734
atggccactagtggatgtattgtaggtgatgaggttgatggtgttcctggtatccaacatctggtccctagttttggtcggaagactgctctaaaacttattaaaaagcatggttcattggaaactttattaaatgcagctgcaataaggactgtaggcagaccatatgcgcacgatgcccttaaaaaccatgctacctacggagaaattatgaagtgcttgccttga

SEQ ID NO: 77957 - DNA, 144 bp, Glycine max
  Peptide Sequence Number=SeqID_194735
atggaaacactgaaagatcaggtcgagcatcatgacatggccgatgaggttgctgcaacgaatccctttccattggcaacaatcagcagtagtggtccaacaccccaagcatacacatacacaccatcaacatcatcattttga

SEQ ID NO: 77958 - DNA, 3597 bp, Glycine max
  Peptide Sequence Number=SeqID_194736
atgggttcagagaagcaatccaaggcggaagaagaagaaggtgaaatcccggtgctaacggtgctgaagaacaacaccatcctcaaaaacatcttcatcgtgaacaagcccccggaggaacaggcacgtgccgatcacgtggacgtgctccttgttggtcgtcacccggactgcgacctcatgcttactcaccccagcatcagccgcttccaccttcagatccgctccaaaccctcttccagaaccttctccctcctcgacctatcttccgtgcacgggacgtgggtttcggggaggaggattgagccgatggtaagcgtggcgatgaaggaaggtgaaacgctgcggattggggtatccagtaggctttaccgtctgcattggattccgattagtcgcgcctatgatttggagaacccgttcgtggcgcaattggattcggttgcggaagaggaagaggaagaagaagaggaggaggagaaaatgctgaacttgaattgctgtcctgctgaaatggaagaaattgaatcagtggattcagtacttgaggatctcagttctttattccttaatgagaatgtggaactaactgtgacagaggagattcccttggaaccttggacgctggaagacatggtttctttatgttgtgaggaagaaaggaagagcccatcaaaagaggaagcaattggaatcccaagtgacccttttggaactgaaacatcatatttgcctacgatatctgatgatgaaaacaatttgtgtgactctgtaagccaggttctatcaccaccttatgtggaatcacttgtccaatgtgatgacacacttacagaaaatttgtctgagacttcatgtttgccagctgtggaagctgttttggagacaaaaatgctgcaattccatactccacctgatacatttacttctccattgtcatctggtcatgagaattcgtttgaaaagcattatttcagcttgcctgtaaatacagctccttcatctcttgatgaggaaagtgcacctgaagctgtaatagtgcctaaagaaactgaatgtgaatctgaagatgatgaaagcattatagatatttttacagttccagaatctcttcatgcagctgaagatgtaataacacctaatgaatctgaatccgaatgtaccctcagagatgatggaagtgttacagatgcttttattgcaggagctggaattttcaattctgaggatatgtttctagcagttgaggaagttatgcctggcaccaaagttgaacaaatcaaaattgttgagaaagatatgtataggtcactgtcacagctgctgaatgataaattttgtcaagaccaagggcactcactcaatgaaatggttcaagatgttagaaacaagcacacagatagcacctcccccacactgcatcagatagaatcagtcaatttgtcagtgccagaagtagttttgaatattatgaatgaggatcagaccctgcactctgaaatggaaatccttgaaagctgcgtaaaagcagtggagaaaacttcaacaaatatttggtcaagaagaggtaaagctactattgctcctcaggttcgaactagcaagagcatactgaagaatgcagccaatgttgaagttgcaatgagcagtgagaaggatatcagaaacagaacaatctcaaagaatctttcctctgttctggatggggaaatagaagaagaagaagacgaagaaatttacactccagataaagaaaacatcagtccgaatactctccacttgcaatttttaaagaaggttaaaatagaagaaattgaacattccaagtcacaaaggtcacggcgcatttcaggggatacatttaattgcgatatccatccaaatgaaagcataaatcccactttatgcaacatgaacaagaaggatcttttctctgttttggatgggggggaagtaaaggaaaaagaaatcttcattcctgaggaggaaaacttcagtccaaatgcccttcaattgtggcttctgaaaaagaagggtaaggtagaagaaattaaaagttccaagtcacaaagatcacccctttcaaagggtacgtttaatcatgacatgtatccaaatgaaaacataggctccactttatgcaacatgaaccagaaggatagcataaatagaacaatttcaagggatcttttctctgatttggatggggaagaagaggaagaagaaatcttcactccagataaggaaaacttcagtccaaatacccttcaattgcggcttctgaaaaagaaaggcaaggtagaagaaattaaacattccaagtcacaaaggtcacccctttcaaagggtacatttaatcctgacatgtataagaatgaaagcataggcccctctttatgcaaaataaaccagaaggatatcataaacaaaacactctcaaaggatcttctctctaatttggatggggaagaagaggaagaagagatcttcactccagataaggaaaacttcagtccaaatacccttcgattgcggcttttgaaaaagaaggataatttttgtcccaacttatatccagatgaaaacatgagccacacctcaaccaaagagaatcaaactctaaaaggagtccagggtcaaaaattgaaaagaaagccattcagcagccatatcaaattcgcacaggagcaagattataaggacagagtggaaagggtacccttccaatcactgaagaactcaggagacaagagaagatcaggcactttttgtcctgtttctgcttccaaaagccttcatttcagtaattgtggacaaattttagatcagcgtattaacccttctgatattagtggggtgccaaagaagagcagctgggacatgattgtggatactacttctcttgtaaacaaggaatcaaggaaagctatgcagcttttacaaggtctcaaagggactcgttatcactctgcaatgtcagtcataggggaacttgaacgtatgaagaagcagttcacaattttcagaagaatttcagaggcttctttggcattggaatggattgaagaatgtatggtgaagtcaaactggtggattcatatccagagctcagtggatgaaggaaggctaattgctccaaccccacctgcttctcctcaggctcagtttagtgaagagagttggacttctctttcaccccagaagttctcaacggaaattgcttcaccaacagtagaagatcatatccttgattttgctcttctatacagaagaaacaaaaatgatggacaacttgtcctgcttagtgaggatgtcactttgaaaatcaaatgcatggcagaggggttgctatgtgagccagtgcaagagtttcgtgagagtctagtaaatccattctctgagaggttcttgtgggataacagcgttcctcgaggacagacttggtcttgccaagacgacgtagtcttaagggagaaatattgtcgtttaaggaagccatcaaagggtgttgcaagcggtttaaagctcattctgcttcacaactctcaatatgctctgagccagtggcattcagttgagcctgctgaacagttttga

SEQ ID NO: 77959 - DNA, 1425 bp, Glycine max
  Peptide Sequence Number=SeqID_194737
atggaagattcagaggaagaagagcttctgaatcttactctttcagttgatgccggtagggagaggagaattaagaaaggaaggacaagggataataataataacactaattctgttattattcctatgaagtccaatgacgggtatgaagggaagatcttcaggctcctccaaatgagggagctgatgctaagacaagaccacagaagaaaaggagtgctacttgaagatgtgaacaacaacaacaacaatggccttcctttgattcatttgcttctctcaacagccactgctgttgatgatgatcaaagaaactattgtgccgctcttgagaatctcattgacttataccaaacagtttccctaacaggtgactcggtccaacgtgttgtggcctatttcgctgatggtttggctgcaaggcttctcacaaaaaagtcacctttctatgacatgctcatggaggaaccaacaagtgaggaagagtttcttgcattcactgatctctatagagtctcaccctattaccaatttgctcacttcacagcaaaccaggccattttggaggcctatgaggaggaggaagagaggaacaacaaagcacttcatgtcattgactttgatatttcctatggcttccaatggccttctctcattcaatcactttcacaaaaggcaacaagtggcaagagaattttcctcaggataacaggttttgggaacaacctgaaagaacttcaagaaactgaggcaaggttggttagtttctcaaaggggtttggtaatcaccttgtgtttgaattccaagggattttaagaggttcatcaagggccttcaaccttaggaaaaggaaaaatgaaattgtggcagtgaaccttgtttcttatttgaacactttgagtagtttcatgaaggtgtctcacacattgggatttgttcattctcttagcccctccattgtggtgttggtgaaacaagaaggtagctgcaggagtctcaagaccttcttgtcaaggttcactgagtctttgcactattttgcagccatgtttgattcactggatgattgcttgccacttgagagcactgagaggttgaggattgagaagcagcttttggggaaagagatcaagagcatgcttaactatgacatggatgatggtgtggaatattattgccccaaatatgagaggatggaaacatggaaagggagaatggagaatcatgggtttgttgggagaaaaataagctcaaagtgtgtgatccaagcaaagctgcttctgaagatgaggacacattattatccactacagtttgaggaagagggtggtgggggattcagagtttctgaaagggatgaagggagagttatctctttggggtggcaaaataggtttcttctcactgtctcagcatggcaacca

SEQ ID NO: 77960 - DNA, 474 bp, Glycine max
  Peptide Sequence Number=SeqID_194738
tatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcggggtgctcgcgggaggtcagcatacaccccgcgcagcaacattgttacatgtttgcgttgggggaaacgatgtgtga

SEQ ID NO: 77961 - DNA, 304 bp, Glycine max
  Peptide Sequence Number=SeqID_194739
atgatgaaattgacagtggttatcgaagacttggatagattcctcgtagaaaaaatgataagaattggtgagtcatggatactgaaattcatggacaaggtaaaccaacacattctaagaatgacaatcgtaaccagatccattactatgaagcaaaagaatattcagaacatgaacttgagagcaaccatgactatcaaaaatgtcaaagtagtgaaagccttgggagaagcaaagtcgcaccaaaacaaaatcttctctcttctcttgcttcaaaacttgcaacgattattgttggatgaag

SEQ ID NO: 77962 - DNA, 264 bp, Glycine max
  misc_feature (10)..(10): n is a, c, g, or t
  Peptide Sequence Number=SeqID_194740
atgtcgttgncggtggaacccttgggtcgtttggttgggggagttaagtggctgtgggggatcgttaacgttattctcgccgtttgcatggcaatgacggtgcttatcacaaaggctgcagaacatgaacgcttaaacgccgtttcccttgttggatatccctcacttggtgtcaaagctgctgcattgactttcttctccgtccttggtgttcctcttgcggttgaggacccatcaataatgaggtttacaactgaccgttag

SEQ ID NO: 77963 - DNA, 165 bp, Glycine max
  Peptide Sequence Number=SeqID_194741
atggtttggtggtggcacttgccggcgtttgtgctgggtgccgtggcggccgccgtgagtgccgtgctagcggttgttctgctgccaaaaccaaagccagcagatgtggccaagtttcttccgtcactgctgggagtttccattagtattagacccatcaaataa

SEQ ID NO: 77964 - DNA, 1023 bp, Glycine max
  Peptide Sequence Number=SeqID_194742
atggaacaacctccttcgtcgtctcttcaggtggagacagcacaacaagcaggacctagtcctctcagaaaaatgatcgctgtctcgtcaatcgccgcgggaattcaattcgggtgggccctacagctctctcttttgacaccctacgtccagaccctgggcgtcccccacgcatgggcctccttcatttggctctgcggcccaatctctgggctgctggtgcagcccattgtagggtacagtagcgaccgatgtagatctcgtttcggtcgccgccgtcccttcatcttagccggggccgttgctgttgccatcgccgtcttcctaattggctatgcagccgatataggacacgcagctggcgacgacctcgcaaagaagacccgcccacgggctgttgcaatcttcgtggtcggcttctggatcctggacgtggccaacaacatgctccagggtccatgccgggcatttctcggcgacctcgccgccggggaccaccgcaagacgagaaccgccaacgcattcttctcgttcttcatggccatcggaaacgtcctcggctacgcagcaggctcctacgacaaactccaccgcgccttcaaattcacacaaaccgaagcgtgtgacgtcttctgtgcaaatctcaagagctgtttcttcttctcaattgtccttctcctcgttctttgtttcgttgtgctcacttgcgtggaagaccctcagtttacgccacgtggggatgaggacaattacgaaaacgacggcgtttcgcggtcgtggttttcgtgctttggtgaactctgcggtgcgtttaggggtctaaagaggccaatgtggctgctgatgttggtgaccgctattaactgggtggcgtggttcccttatgtgttgttcgacactgattggatggggcgagaggtgtacggtggtaaggtgggggacaaagcatacgattccggagtgcatgtgggggcattggggcttatgctgaactctgtggttttggcattgatgtcgttggcg

SEQ ID NO: 77965 - DNA, 204 bp, Glycine max
  Peptide Sequence Number=SeqID_194743
atggcaacggggcgggtcgaggtcgggttttgcttaccccacccttgcccccgactccccatttccctcctagcccccgaaaccgaatgggggtcggagcgagtttgggggcgggttcggggcgggttcaaggcgggtattaataatcccatccccgaccccaaccccgaccccggtcaactcaggttttccccgtcaaaataa

SEQ ID NO: 77966 - DNA, 414 bp, Glycine max
  Peptide Sequence Number=SeqID_194744
atgacaattgctgaagctttgaaagagggaaattctgtttctaaggagctgcaccaagttgcagagcgtcaagttgaagttgctaaaagacaagttgcagtcattgaaaaacaagttgaaattgctgaaaaacaacttactgtgatacaacaaactcgtcctcgtcattattcagaatctgatgtatgggatcttttagaggaattaagagtcacagatccatttcgcatgaaggtttataaccatttatgtgataatgagcacaaaaaacgtaagctttttggcgtaccacctcatatgagaggagaagctctcattcaaatgatgactgatgcatgtgctttcacctctagtgcaatacaagtagaagtgcagcaagcaactggagctatagtgcaaagatgtgtatactaa

SEQ ID NO: 77967 - DNA, 2263 bp, Glycine max
  Peptide Sequence Number=SeqID_194745
atggagcctcattttgtggttcgacttcccttgatgtttctaatcactctctggctttcactatctcaccatcatgccaatgctgaaactgaaagttccacgtatattgttcacatggacaagtccctcatgcctcaagtctttgcaagccatcacgattggtacgaatccaccattcattccataaacttagcaacagctgatgatccctctgagcaacaacaatcacagaaattagtgtacacttacgatgatgcgatgcatggattcagtgcagtgctatcaccagaggagttggagactctaaagaacactcaaggttttgtcacagcttaccctgatagatctgccaccatagacaccacacacacctttgagtttctctctttggattcctccaatggcctatggaatgcttcaaatttgggagaaggtgtcattgtgggtatgattgactcaggtgtctggcctgaaagtgagagtttcaaagatgatggcatgagcaggaacatcccctacaaatggaaaggaacatgcgagccaggacaagactttaacgcctccatgtgtaacttcaaattgattggagccaggtacttcaacaagggtgtgaaagcggcgaatccgaacatcacaatcagaatgaactcagcgagagacactgagggtcatggaagccacacgtcatccactgttgctggaaactatgttaatggtgcttctttctttggctacgccaaaggggtagcaagaggtattgcaccaagagctaggcttgccatgtacaaggttctttgggacgaggggcgtcaaggctctgatgttcttgcgggaatggaccaagccattgctgatggtgttgatgtcatttcaatctcaatgggttttgatagtgttccactttatgaggatccggttgcaatagctgcttttgcagcaatggaaaaaggggtgttggtttcatcttcagcgggaaacgaaggtcctacacttggtaccttgcacaatggaatcccttgggtcctaactgttgcagcaggcaccatagaccgcacatttggaagcttgacactaggaaatggtgaaaccattgtgggttggaccttgtttgctgctaactcaatagtggagaattatccactcatttacaacaagactgtatcagcatgcgactcggtcaaactattaacccaagtagccgcaaaagggattgttatatgtgatgccttggattcagtttctgtcttaacccaaatagattctattactgcggctagtgtggatggggctgtgtttatctctgaggatccagaactaattgaaacaggacgtttgttcactccaagcattgtgatcagcccaagcgatgcaaaatcggtgatcaagtacgcgaaaagtgttcaaataccttttgccagcatcaaatttcaacaaacatttgttggaataaagccagcaccagctgctgcatattacacttcaagaggtccttcaccgagttacccggggatcttgaagcctgatgtaatggcacctggctccaatgttctggctgcttttgttccaaataaaccctcagctagaattggtacaaatgtgtttctgtcaagtgactacaatttcttgtctggaacatccatggcatgtcctcatgcgtctggtgttgctgctcttttgaaagcagcacaccctgattggagtgcagctgctataagatctgcattggttacaactgctaatccacttgataatactcaaaatccaattagggataatggaaacccattgcaatatgcttctcctcttgccatgggagctggtgagattgatcctaatagagcacttgatcctggtctcatatatgatgccaccccacaggactatgttaacctcctttgtgctttgggatacacacacaaccaaatcttaaccatcacaagatcaaagtcctataactgtcctgctaataaaccatcttctgatcttaactatccttcgtttattgttttgtatagtaacaaaacaaaatcagcaacagtccgagagtttaggaggaccgtgaccaatgttggagatggtgctgctacatacaaagtcaaggtgacacaacccaagggctctgtagttaaggtgtcacctgagacattggcatttggctataagaatgagaagcagagctactctgttattataaagtacacacgaaacaagaaggaaaacatctcatttggggacattgtttgggtcggagatggtgatgcac

SEQ ID NO: 77968 - DNA, 543 bp, Glycine max
  Peptide Sequence Number=SeqID_194746
atggagggtccctatcccatacctgtactttgctgctccctcattcaattggccgcttcattcaacatcaaccaccgcaccacacttcgcaaaagaaaaagtaatcaagaatggaagggagacgaacacattccagcgtttgggaactgggatttcaccaatgagtttccaatcactcgttatttcgagtgtgccacacagtcccgtcttcataacaaacctcgtcatctccgaaatcatatcaaacaggaaacgaggaacaaggagaggaggtgccgacatgttaatggtaatgctaacaaaggaaaagtgtacgacgtaagggaacagcagaggaagccaaatagaataagcaagcatgtgcaggtgcaggtacaacaacacgacaccgttccacgaactcccaaacctgttgacgaagatctctataagatccctcccgaactcctccacaccaccaacaaacggaagaaattgctggggttcatttccaagtgtcttgtactgcttgtgtgtcatgagcattctaaactgaaacagtga

SEQ ID NO: 77969 - DNA, 420 bp, Glycine max
  Peptide Sequence Number=SeqID_194747
atgaaagatgatgcttcagcactgtccagactatgttatatgcatgaaaacaaagggagaatagtgagggaaggtgcagtgcaagttattcttaaaaagatcgttgaccatgctttagttgatgagttgttggcattgctaccacttctctctacacatcccaaggctgttgaagcattggtgaaccatgatgttgttcccttcttgttggatatcttaagggaaaaggaaaacacaacatcagaatgcgtcaaggagaactgtgttgcgattctttacataatcaatttcaataatagagaaaaaaggagggaaattagggaggatgaaatggtcactgacacatttctaagcttgcacaatgcgggaattcaagggccaaaaggaaagctcgcgctattcttggcatgctcgacatag

SEQ ID NO: 77970 - DNA, 1890 bp, Glycine max
  Peptide Sequence Number=SeqID_194748
atgaactgcttcccttgttgtggccctaaaaaaagcaatagcaagagggagcatgggtctccacccccagaacttgttacaggaaaaaatccagatatgaagaaacaaaaagctgaagagcaaaaccaagctgaccctggcaatattcaggcacaggctttcagtttccgtgagctagcaacagcaacaaagaatttccgtcaggaatgcctcattgatgaaggaggtttcggcagaatctacaaagggataattccttccaccggccagcttgtggccgtgaagcaactcgaccgaaatgggatccaaagcagtaaggaatttctggctgaggttgcggagctaagtctcttgcaccatgaaaatctggtcaatctcattggttattgtgctgatggagatcaacgtcttttggtctacgagttatttgcttcgcgtactctagaaaaccgtctttttgagaaaaaagcggatgagagcccattaaattggtttgaaagaatgaaaatagtagcggctgcttctaaaggactagagtacttgcatgagacttcgaagcccccggttatataccgggacttgaaagcgtcgagcatcttggtggacagtgatctgcttgcaaaactatgtgatgttggcatggccaagctttctggtggagacaagatgaacaatggacctccaagacttatgggtacctatggtcactgtgctcccgagtatgtaaaagctggtcaactcaccttgaaatcagatgtatacagtttcggagttgtcttgctagagctcataactggacgaagagccattgacacctcaaagccaaacgaagagcagaatcttgtttcatgggcaacacccttgttcagggaccccaagagatatcctgaaatggcagatccacttcttaataagaacttcccagaaaaagatctgaatcaagttgttgcaatagcatccatgtgcttacaggaggaagcagaagctcgtcctttgatcagtgacgttgtaactgctctaggtttcctttccgcgcctcctcctccacctgctcatgctcctgtccccaaaaagagtgatgttgctgaaagcgaaagggaaagcgatagcgagggcgaaagtgagagcggaagcgacgcaatatctagaaagggaagccgcagatcgtcgttggataaaagtcaacatgattattgtgatagcagccatcttccaccagtggtttcctctaaagcaagccgcaaaagcagcaccagatcaagtaaaggaaaacacagttcagaatcaggagatggggttagcgtttcttccatcagcagcaagagcagtaggaaatctcgcggtgatttaagccagaagagcagcagaaaatcttctgtggaagatttaagccagcagaagagcagcaaaaaatcctccgtggaagacctaagccagcataagagcagcagaaagtcttctagcaccaaagacttaagccagaagagcagcagaaaatcttccgtggaagacctaagccagcataagagcagcagaaagtcttctagcaccaaagacttaagccagaagagcagcagaaaatcttccatcagaaaaccttctagcagagttttgagccacaagagcaacgttgcatctgaggatggaagcatttcctcaagttgtcgtagcagcagtgtgggatcagaggatgaaggggttcggtcagagcgtagcagcatgaggctatcacaaggaagttatcgctcggacccctatggcagcagaaggacagaggatgagagcatgaatattttagaccgtgcaaccagcattgggtctgatgaggatagtggtcacccttttgaccaaacaagcagcagtggaggatcaagtgtttattcgcgataa

SEQ ID NO: 77971 - DNA, 1158 bp, Glycine max
  Peptide Sequence Number=SeqID_194749
atggcttcaatctctcacttcagaacctccgcgaattccttcctctcccaatacgaacctctctctctgcttctcgctcctctcctctctctcctcttcgctcacgctctccgctccttcttccacctcctctcccagaacggactcaaagccacgctcctagggtttctcattaactccctcaaattagtccctggcgtgaagggatacatagatgccgaaaaacaaaaggtcagaaattttgagatgagagaacttgaaccagtctatgctattttggttacaagacccagttatctagaattgtattattgcattacaatgagtcaatcactaaatagaagagacaaggttgtggataagttgcaatctgatggtaaatctaaaagagaaggttggaaaactgagttgccaagcacaggattagggacatctgtccttgagaaaatgagagaggagaaaataaatgatgcggtttggcaaggcaaatgctctggtacagtctacattggaggaagtgaatctgatggacatttttctctgataaatgaggcatgttcaatgttaatcatttgctttaggagctgggagcatcccaccgctgagtactattatcagatcatgtttgctcataccaatcccctgcatttggatgttttcaagagtgttgcacgctttgaggcagaagtggttgcaatgacagcagcacttcttggaagtaaggaaaagagttctggacgacaaatatgtggcaacatgacgtcaggcgggactgaaagtatattattagctgtcaagtcatctcgtgactatatgaaatctaagaaaggaattacaagacctgaaatgattattcccgagtctgggcactcggcatatgacaaggctgcacagtattttaatatcaaactatggcgtgtaccagttaacaagaatttccaagctgatgtgaaagcgatccgacgtcatattaacaaaaataccatcttgattgttggatctgctccagggtttcctcatggagtaattgaccccattgaagaacttggtcatctggcatcaagctttggtatttgtttccatgtggacctttgccttggtggctttgtattaccatttgctcgtgagcttgggtatatagttggcaacttggaatga

SEQ ID NO: 77972 - DNA, 441 bp, Glycine max
  Peptide Sequence Number=SeqID_194750
atggctgaggagtttcttattaagtcatgggaaacacatatcggaacagcatgtagaggagttaattggggctgccattctttagatgagcttcgcgctgttgtttcttgtgttgggggcacttgcttggcatctctctgcaaacttctggctcaagactatcggagctggtctagtggaatgccggatttgctgctatggcgtttccatggagaatacagtggtgaagccaagcttgttgaagtgaaaggccccagggaccgactctctgagcagcagagagcatggctattgctgcttttggattatggatttacgattgagacattgaagtttattgctctggcaaatttttcatcgcgagaggaaattcactttgatgttcgttattcatttacgagcattactcttggaaagaagaggaactgctctataccatga

SEQ ID NO: 77973 - DNA, 1003 bp, Glycine max
  Peptide Sequence Number=SeqID_194751
atggacgaagacgatttttttgacgaaattgatgaccaaaaccatggtaggggtgttggggatgctgctcttgatgaatatgagatgcttactaaggtgactgatacaacagctgctcaagcaagaaagggaaaggacattcagggaattccatgggaaagtttgaacatatctagggagaggtatagattgacaaggcttgagcaatataggaattttgagaacattcttaaatctggggatgctgtggacaaggagtgcaagcaaatcgagaagggtgggaattactatgaattcttctataatacaagaatggttaagcctactatccttcattttcagctgagaaacttagtatgggcaacttcaaaacatgatgtctaccttatctccaactactctgttaatcactggtcatcattaagtggtaatttgtctgagataatcaattttgctgggcatgtggcaccggcccctactgagagatatgcaggaaatttgttggaaggattttctcagacccagattagcacattggctgtcaaggataatcttcttgttgctggtggtttccaaggagagcttacttgtaagcacacatcaatcagtccagaccggaagcttatgactgttgttggagataacctggatggactgctagtggatcctcaaaatggaaagactgttgcaacttttgttggtcatcgagattactcttttgcttctgcatggcatcccgatggacgtacctttgcaacggggaatcaagacaagacttgcagagtatgggatgttagacacttatcatctcctactgccattctcaagaataacctaggggcaacccggtctattcggttttcttctgatggtcaatatatggtggttgctgagcctgcagattttgtgcatgtttatagcacaaaggcagactacagaaaacgtcaagaaattgatttctttggggaaatttctggggtttctctgagccctgatgatgagt

SEQ ID NO: 77974 - DNA, 699 bp, Glycine max
  Peptide Sequence Number=SeqID_194752
atgaaggttgtttacctcttcgttgtgctgatggctttggcatcatctgttgcctttgcttatgatccaagccccctgcaagacttttgtgtcgctatcaatgacaccaaagctggtggtctatacggtgtgttcgtgaatggaaaattttgcaaggatcctaagtttgcttatgctgatgatttcttctttggtggattgggacccggagacactgcaaacgcacaaggatcaaaggtgacagctgtcacagttaatgaaatattagggctcaacacacttggtatatccttggcacgcatagattttgcaccaaaaggtttgaaccctcctcacactcatcctcgagggacagagattctggtagtcttggaaggtaccctctacgttggttttgtcgcgtccaatcaaaacgacaaccggttattcaccaaggtgttgtacaagggtgatgtgtttgtgttcccaatagggctgattcacttccagcaaaacgtaggttatggaaatgccgtggccattgctgctcttagtagccaaaaccctggagttattacaattgcaaatgctgtttttggatctaaacctcctatctctgatgaagttctcgccaaagcttttcaagtggacaaaaacatagtcgactaccttcagaagcaattcggatacaacaacaaagttaacagggaacataattaa

SEQ ID NO: 77975 - DNA, 2211 bp, Glycine max
  Peptide Sequence Number=SeqID_194753
atggaatcacaattgttattaccacccattaaaattgtctataacaaaaagatagggtgtgaaagaagtttaaagaataatacaagtgagggagagggtatcgaaaaaggatataatgggaaggcgtatttagcaagagccaacaaaaataaccagtgtctctcacatatgcatgcgggtggccttcccttggttgattggattttggaggagttggtgcggcggcaatctagattccagggggttcgttcttccatgaatccatctcccagctcttctagtctttcttccaccctcacatccctcaacaacctaatcactctctcaaaccatgttctctccctcacaccatcaccgccaaccctaaactccaaccttatacaatgccctttcaatccccaccacctccttccccctccctccctcttccttcaccacctccgttgcccttcctctcctcgccctctccccgatctaaacccctctccctctctcacttaccccaaaaccctccacaattctccctccgatcaactctctttctatcttgattctctctccaacttcttctaccgcgattcccccgccgtcgttgctttctcccatgccgactccctcaccagaaccgcctccctcacccttccctcgtttttatctctccaatgcgccgacacatacactcactccatccccgagagcgcttctttccacgcgcccattcttccctctcagtacttctccatcgcgcgtgaactcgactgctggaacgattttcccgctacctactccagttccgttcttcgtgcaattttaggtctcggaattgccaacgaccgtgacttaacggactggatgatagcgaattcgcctcgatacggcgtcgttattgatacctctatgcagcaccatatatttttactatgctgtatgtgcctcaagtcaattctgagagaagcttccgtttccgtggacaaccaaaactcgctcgtggattgccccgttacgaaccaggctttgacgtggttagcgtctcaggtttcgattctttacggtgcggctaacggaaaggcttttgttcttaatttcgtgaaaaaatgcattctggttggtgcttcggttctgttgttgtttcctttaggggacaatgctgcttcaaagcaagagtcccaaaatttaggtacagagagtggagaccccaaagaagcgaaacctggtgctcagtgtggagaaaagaaaaattggatactgaatagaaagatttctgtgtcccaagttgcagcggcggttgcggcactgcacgaacgatctttgcttgaacaaaaaattaagggattttggttttctcagcagccaagtaactatcagctggttgctgagtattcttatttgtctgaaaaagcaaatgaagagcggacaaagcgtcctgattatagacctctaattgatcatgatagcattcatcttccgcaatcatccaaccaggaaacatcaagagaaaagacacgagaggagttgctagctgaagaaagggattacaaacgtcgaagaatgtcctatcgtggcaagaaaacaaatcaatcacctttgcaggtaatgaggtacatgatagaggatttcatggaccaaatcaagcaggctggggattttgagagccatgtgaaaatgtctgaaaagagtgggttgtttccatctaaacctcctgaccgtgacattcctatggaagctaataattcaagaaagatttgtaataactctcctacagttacaatcagtaacctacgttgtagtgagcaacaatcagactctaactgttgtgatcaaagcaaaagtctggaggatgcattttctagagattacaaacaacggaaacatgagcatcataggagccattattgccgagaagatcaacagaatgctgaccaaggaaaatatcatagagaccgtcattctataagccctgaaaggtactcaagttatagtcgatcgcgtgagcatagtagtcatcataacaaacaggattactacccaaatagaaagaagcacaactcatctagaatcaaggatggatggcaaaaggacactcacaggagtcatatttcagattctttccccaataatgcattttcagatcgatatgatccttcagaatcccttggtatctgtgaggatgatatctcctcggactctaaatatatcaagtcgatcagataa

SEQ ID NO: 77976 - DNA, 1290 bp, Glycine max
  Peptide Sequence Number=SeqID_194754
atgccgattgtcctagaaaatttaatcataccaatcaaaatagtgtatcaagtggggcctccaatataccaaggtcaatatgtctatgtttatgatcttgctagcaggttcaatgaggatttgctgaaggggtgtcactctctcatgaagtgggatgatatgtgcccttacatgtctaacttaggccttggaccgaaggttattgagaaatcaaaggagaaggctctgttgaaggaaagctggtatgcaactaaccaattttcacttgaggttattttccataacacaatgaagaactacaagtgcttaaccaatgattcctcactggcttctgctatatatgtaccctactatgctggccttgatgtgggtcagtacctgtggggaggcttcaatgtttcaatcagagatgcttcaccaaaagaactagtgaaatggctggcgcaacaacccgaatggaaaagaatgtggggtagagatcatttcatggttgtagggagagttggttgggacttcaggagaagaacagaaaataatgatgactggggcaccaagctaatgcttttgccagaagcaagaaacatgtcaattatgctaattgaatctggctcaaaggtcaatgagtttccaatcccatatccaacttactttcacccctccaaggataaggaggtttttcagtggcagaaaaaaatgataaaagtgaaaaggccttacttgttttcatttgcaggtgctccaaggcctaattctaattcatcatcctccatcagaaatgagataatcaaacaatgccaatcctctaggagttgcaaacttctaagttgcaatgatggtcataattattgcaatgatcctgtgcatgttacaaaggtgtttcagagctcagttttctgtttacagcctccaggggattcattcactaggagatcaacttttgactcaattttggcaggttgcattcctgttttctttcatccagaatcagcatataaccaatatttgtggcatttgcccagaaatggttctagctactctgtgtacatacaagaaagagatgtcaaagagaagagagtaatgatcaatgagaaattgtctagagttccaaaaagtgaagtgttggcaatgagaaaggagattgtaagacttattccaaggataatatatcgttatccaagttctagattagagaccattgaagatgcatttgatatagcagttaagggaattcttgggagaatagaagcagcaagaaggaacttcacaaatgtcaattataccatttcctag

SEQ ID NO: 77977 - DNA, 294 bp, Glycine max
  Peptide Sequence Number=SeqID_194755
atggacaagccctggtttggaggatttgctgattgggaagtgatggaaacggggttgaaagatgctagttggaacttggaagagtgcgttcagggatcacattttcctaatggcagcagcccttctcccttattcacggtatgggagtggtttgcttgggaaatccaagtgtttaagaggtttttaatggagatcgaagtggctgtgttggattattcatggaggtggcggaaagatcaatcaggaaactacatacatagctttgtgagatcttcaattcggttcttgtattga

SEQ ID NO: 77978 - DNA, 225 bp, Glycine max
  Peptide Sequence Number=SeqID_194756
atgacggcaaatcttacaattgcatgggaatcatgcatgcatgttgggatgatcgtagtgacaggaattgttcgagtggccatgagcaaggatggtgctggagaggaggttttgggagaggtcgaggtggttgatggtgagaggttgaaagcagcaatgcctccgattgtgacatcacacatgacaacaatccagttgcatggtgtggtgtcgtggtggttctag

SEQ ID NO: 77979 - DNA, 1968 bp, Glycine max
  Peptide Sequence Number=SeqID_194757
atgcgaatggtacttactggcagagaaagcttgattcgattaatcggtaaacggagacgcttccttcctaatcgtcacactatcctctccgatcctaaccctaaccctaaccctaaccctaaccctatccaggctgttgaagagccaccgcaatcagataataacgacgacgtacaatgccctgtttgcggccgcagccttcccggggacaacgaccacataaactctcatctcgatgcatgtctctctcaaccaaaaccaacaacaccatcaacaaaacgaaagttctcccaacgcaccctccttcagctaaacttcaccctatccaattccaaacccaaatttcagaatctcactcacgacagtaacaattctcccgtgccactgccccagaacgacgagtctgaaaaagaagaagaagaagaagtccctgaaaatcatgaggccgaatttgattctacaattgccgccacttccttatcttcctcgtccgtgaacaatgatgtgcctgatgattccaaacccgaggacgtgcttggtgccacgtttgaaacattcatcgttggcaggaaatatgctgataatccagaagaaatgtgtgctggtgccgccatctcttttttgagggaccctcaaaatgtcaaggaccccaatgccattaaggttgtttctgcggattctgtgtgcggtaagtcattaggttttctcccccgtgagctagcacaatacctatcacctctaattgacaactatggctttggatttcagggacatgttacttctgttcccaaacattctcttgatattgttccaattcagattatgtgccgcagaacatcagatggtgaaagcaaatatgccaatgagacctttaaatgcttatggaaaaatgctcaacgtgttgttgaatttgcaagcaggaatcctccttcatctgtaaatggcgttcatgggatgaagaagcagcatctgatttcatctattctttctacagataatagtgtaccatggccacaactatcaactatgattttggatagaactggttcgtgtattaggatttcttcaaaagctgaatctcttatgtggcgcactgagagacttttcttcttaaatggagaacaggatctctcgtcctttctacttgttgatatgggaaaaataaagtatccagcttacaactgcataatatcagaaccaattttctcaaatcgcaataatctgctctcatacgaagaggccattgaagttgcacaaattacggatgaagctcttgatgcaaacaaaattgacgtggtattaaggtgcataaatatagctgaatcctgtgtatctactgattttcccatccagtgctcaacttctgaatcagtatcttcaattcgtcatgtatttacatcatcatgggtatactccaaagtggtcacagtagggatttccttccttgagcgggagcacaggtacattgatgctattaacttactccaatggttgctaaatgttttcacttgcgatgtaagaagaggatattggacactgaggttatcagttgacttggagcaccttggctacattgatgagagccttcaagtagctgaaaatgggttgctggatccatggatacgtgctggttcaagaatggcactgcaaaggcgggttcttcgcctagggaaaccaccaaggcgctggaaagttcctagtttttctaggtctgcgttgcggaagatccctgaggtttttgttcaagggagaccattgaattctgaattgggagaaaagaataggtactacaatgaagcggggaaacaatgtggagtggaagagattgctttgcattactatgccggggatggaggtggatggcaaggtgtccatgcagagagtggcatatggttaaccatttttgggcttcttatgtgggatgtcatatatgctgatgtgccaaatgtcttctatactagatttcag

SEQ ID NO: 77980 - DNA, 276 bp, Glycine max
  Peptide Sequence Number=SeqID_194758
atgtatcagctaagcaacacacaagtggtggatccatatatgaataaggagcgacctgagcttgggttaagacatgacgcgagctacagtgatggcacgataggagccaacacacgactcgaggcggtgttgcaatacccgtcgtcgaagaagtcatttgaagacgggtttgaagtaacaccgtcttcgtatagcagcaataacaaaaattgtggtgatcacgatttggtaattggtgcatacatcggcaacaagccaacttgtggccgtgaatga

SEQ ID NO: 77981 - DNA, 1011 bp, Glycine max
  Peptide Sequence Number=SeqID_194759
atggctctttcactcggcaagctcttcattctcgtcggcgcaggtatagctggttcagtaattgcaaaagaagggcgtctgccagatgtctctggtctcgcctctggtgcttttaaggagagggtttatggtatggggggtgcaatttctagacctaaggttgttttgaggcaacttaaaagcgatgatcctgctccaactgttaaaaagcagccgcataatgatgctttgttggctcaggttaacagtcttcggcaggaactacaacttcttgctagagatagatcaatcactattgtaaatgcaagtggaacaggtgggagaaaatatgcaacagtgattgttattgttgtggtaggatatggatacgtttggtggaagggatggaagcttcctgatctgatgtttgcaacaaggcgtggtttgtctgatgcttgcacatcaattggtaatcagatgggaaagctttatgaatcaattggggataccaagaagaaattatctgcaagaatcaacggtctggataaaaatttagaagaatgtgctgccattactgaaagtaccagggaggatatatatgtaattcaacggaaagcagatacaataagtgaagattcgaagtcttttcatgttgcagtccatgttctggaatctaaaattaaagaaatagaagagaagcaggcatcttcttccagttcttccaggccagcccttgagcttccaccagtttcaccctcttccaggggttcacagtcaggttccgctaggctatctcttgagccaccatcagttacgccatcatcaaggactgcatccttgccaccgacattgtctacggatccaccatctccatcaatttctggtggatctttccaggaacctaaagtagacaaaagcaatggatctagttctggcttgtttgggttgatatctggcgtctatggtccattgctgacaagaactcgcagtgcgacagatgcagtagtccaaaaaactcgttcgactagttaa

SEQ ID NO: 77982 - DNA, 609 bp, Glycine max
  Peptide Sequence Number=SeqID_194760
atgacaccttcgaccgaagatgtgaagaaagcaatgcaaggattgtttgctgtactccagctctctaggtggggctggtttcacacctttttctccaagaaggcaggcccgtctatccgctacaaggaaggaagaatcaagattccatcttcatgcgaaggatgtccaaatgttcccttgatgggaacaaggggttgtattaattataatcccgtcctcgccataagacagcttggctaccccatgagaggagcgccattagacgaaagcatcacgcctttcatcgcacgaggtttcagtgaccataacgcgagggacagagagcttaggggaagcagtaatgggatcatcggcggctatcataagtggctgagagtccgaaaacaaggattggattggctcccaaatctaaagactgtgagagacgatgaggttaaagcttcggaagaaagtgatgaggtacaagcccaaaaggcagagcttgaaagagcctgggtagtcgaagagaagttcaaggcagcaatagtgagctcaaactccgaagaggtgaaaggaatcatcacgggtcaaaggcatgatctggaaggacgagctaaaggcttgccttag

SEQ ID NO: 77983 - DNA, 1593 bp, Glycine max
  Peptide Sequence Number=SeqID_194761
atgggcaagcctccgttgaggaagtactttgataaaatccggtttgtgtttttcacctcctttatcttatgtttgtcattgcttctcttggactattacatggctgtgagtggtcatggcattacctttttatttttcaacatgaatgatgcaaaacaagcacacatgcctaaaccctcaaattcttctttcaatcttaatgacactgccgattgtcctagaaaatctaatcataccaatcaaaatggtgtaacaagtggtgcctccaatataccaaggcgcattgtagagaatcacacagagaccatagttcctgcagcacatggtgaagtggataagagagtccacatgaattcccctcctttggatagagacaatgttggagttgttacaaatgttcccacaagaaatttggattcttgttctggtcaatatatctatgtttatgatcttgctagcaggttcaatgaagatttgctgaaagggtgtcactctctcaggaagtcgatagatatgtgtctttacatgtctaacttaggccttggacctaaggttattgagaaatcaaaggagaaggttttgttgaaggaaagctggtatgcaaccaaccaattttcacttgaagttattttccataacacactgaagaactacaagtgcttaaccaatgattcctcacaggcttctgctatatatgtaccctactatgctggccttgatgtgggtcagtacctctggggaggcttcaatgtttcaatcagagatgcttcaccaaaagaactagtgaaatggctggcacgacaacccgagtggaaaagaatgtggggtagggatcatttcatggttgtagggagaattggttgggacttcaggagaagaacagaaaataataatgactggggcaccaagctaatgcttttgccagaagcaagaaacatgtcaattttgctaattgaatctggttcaaaggacaatgagtttccaatcccatatccaacttactttcacccctccaaggataaagagttttttcagtggcagaaaaaaatgataaaagtttcaaggccttacttgttttcatttgcaggtgcttcaaggcattcatcatcctccatcagaaatgaaataatcaaacaatgtcaatcctctaggagctgcaaacttctaagttgcaatgatggtcataattattgcaatgatcctgtgcatgttacaaaggtgtttcagagctcagttttctgtttacagcctccaggggattcattcactaggagatcaacttttgactcaattttggcaggttgcattcccgttttctttcatccagaatcagcatataaccaatatttgtggcatttgcccagaaatggttctagctactctgtgtacataccagaaagagatgtcagagagaagagagtaatgatcaatgagaagttgtctaaggttccaaaaagtgaagtgttggaaatgagaaaggagataataagtcttattccaagaataatatatcgttatccaagttctagatcagtgaccgttgaagatgcatttggtatagcagttaagggaattcttgggagaatagaagca

SEQ ID NO: 77984 - DNA, 252 bp, Glycine max
  Peptide Sequence Number=SeqID_194762
atggaccctcatataggctttactttccttgttactacagctagcagtctagcactgttgctctctgcacagcagtttgcacttcaaatttttcttttctcgggttgtgtgtggtgtggtttaggtctcctatatgcctatttgggtatgttgtacgtgtttcttttttactattcccatgtaaaatatggggagtctgaaatcaaagaaggagaaaggaaaggtggtgttgagaagggaagggttgtttag

SEQ ID NO: 77985 - DNA, 1124 bp, Glycine max
  Peptide Sequence Number=SeqID_194763
gatgtgcggaaaaaaacacaagccatccagaagcaaaacactgccccccatgtgttgtctcatcggggttatgaatatttacaaaagaagctgatggatgagaagacaaagaaaaaactggaggaagctgctcaatccggaagcactgacaccctgattgatcctctttctcccatcagacgacacgtcaaatggaagatggcccgcacgaagaaaactggccagatgacgtctaaggcaacaaagcaaattgctaacaagattgatgtactgactgctgccattgggcgaccagaacaccccggtcatttgcgtgctactggagctggtggaggagtcgatcacagaaaaagtgactcggcagctaatgttatgcttcagctagatgcagtcccagtttcagtcacagatgcaatcatagggacttacactgcctctcgtgttagcacaaaggagagttgtgttgatccctcaaggaatgatccagacatgggtgacttaaacaaatgcaggttgtacatcgaagaaaatcatccccgcctagttgccctaggaagagtttatgagggatccacaaccgttcacaacatccctttgttgcatgatcaagtgaaggttgctgttgaggaggttaaagatgtagatgctcccattcctgtacccactgaagaggttaagttagtggggcagacacttaacaccttcattgcttggccgacacatctcgtcaagcccgtgggaccagtaaaacctacagataggccgaatcatgaggtcgatgatcccctatatctgatgacattgaccatcccacagctttttctgaagccattgcaggttatgtgggatgctaccgtgttcagggtgtttaatgaagacttctccttgtacataaagcatgaagatctatctgaaatatcacatgatgataatttactttgtcttaacaacaataggcatatgagtgagccaagtatgcgagtggggaattcttatgtatatggattcctcgagccacagtccatccagagatctgggcaatcgcaatttgaatcagaaagttacatgaagaactggatgcagaattcaaaacaggatgtctacctaggaacctacctgaatgg

SEQ ID NO: 77986 - DNA, 276 bp, Glycine max
  Peptide Sequence Number=SeqID_194764
atgtctggtagcaaattccaccatacttacgtgaacaacctgcaaatactttattttgaagcacattgtaggattcaaggccctatttatggatgtgctgggattatctttaaattatatgaacaaatcaacagtgccgaaattgcacttgcgtatatcgatatccaaactcaaactgcttgtcacaagcttcaagctgaatcaaactttgatgtcttgccagcacaaagtagcatcacagcaaagtttcaatggaaaagactggatttaggatga

SEQ ID NO: 77987 - DNA, 468 bp, Glycine max
  Peptide Sequence Number=SeqID_194765
atggagacgacggcgaagcgaaacgctgtcgttgcgccaatcgcggcgttgttgttggtggtgctactcgcggcgagtgtggtggtggaggctcaggagaactcggacgtgaagacgctggtgaagcacatgcacgggaagaagtactgcgacaaaggatgggaatgtaagggctggtcaatttactgttgtaacctcactattactgattatttccagacctaccagttcgagaatctcttctccaagcggaactcgccggtggcgcacgccgtcggattttgggactaccactcgttcatcgccgctgccgcgcttttcgagccgcaagggttcggcaccaccgggaacaagacgatgcagatgatggagattgcggcgttcctcggacacgtcggcagcaagacctcttttttgtcaacttcgttgagattgcgcgcgcgtgagagagaagtttgtttaggttga

SEQ ID NO: 77988 - DNA, 228 bp, Glycine max
  Peptide Sequence Number=SeqID_194766
atggtgttttcaaagatgaactcctgcgcaaacataagcttctccagggacaaatccatggtggtggaactcccaacagaggccttcatggaggtgtggcggcaattgtcaacggtgttccgatcatatgacaaacatactgtcgtgagcgacaaatcagagtggcgttccactgtgggccaatgtggcttgcacgactataggcccaaaggctgtatctgttcataa

SEQ ID NO: 77989 - DNA, 909 bp, Glycine max
  Peptide Sequence Number=SeqID_194767
atgggccccagcccgctggcttgccagaagagccactgcagggtagagcagaatttcaccggattcaaacaggctcaacggcctgcccccgtccgtcggctggttatcaataatggccggaattttattgttcggcgaaatagccagaaagagagggctgaactgatcgcctttgctgatatccacgcgaatgatcctgtaatccagttcggcctcctcgagaaaaagggtgatcttgtggccgtttgggccaatgaggatgttatgaaccagcccgtaatcacgttgtggtccgatgcgaatttcttttctccctatgtcatgagcgtatacgttgcgctggccgaaaaaggactcacttttacgctgaagaccgttgatcttgacggtggtgaacatcttaaaccgcagtggcagggatacgacctgacccgacgcgtgccggtgctggaaatagaggggtttgccctgagcgaatcgtcggcgatcgatgaatatctggaagatcggttttcgccgccagagtgggagcggatctatcctcacgatctgcaaaagcgcgcccgggcgcggcagattcaggcgtggctgcgcagcgatctggtgccgattcgcgtggaacgcccgacggatgtcgtgtttgccggggtaaaaaagcccgccctgagcgcagaaggccaggaaagtgcccaaaaactgattgataccgccaccttactgctcgctcatggcaacccgaacctgttcggtgagtggtgtattgctgacgccgatctggcgttaatgctaaaccgtttgatcctcaacggtgatgcggtaccgcagctgctggtcgattatgccgcgtttcagtggcagcgagcctccgtgcagcgctatgtggcactctccgctaagcatgcgggctga

SEQ ID NO: 77990 - DNA, 1002 bp, Glycine max
  Peptide Sequence Number=SeqID_194768
atgattggaaacttcatcgacgacattgactgcggcagcttcttcgaccacatcgacgacctcctcgaattccccgacgacaacgccgcgccggtcgctcctccggcgaacttctggtccgccgagtccgactcgctccccgcctcctacacggtgttttccgacaactccgtgacggacctctcggcggagctctctgtttcgtatgacgacatagtgcaattagaatggctgtccaattttgtcgaggactctttctctggtgggagcatcaccatgaagaaagaggaggagccacaatgcaccaccaccaccaaagaggacatagctcatgcccaatttcagacagcaagcccggtctcagtccttgaaagcagcagtttctgctccggcgagaaggctgcatctcgcggcccggagatttacatccccgtgccatgtgggcgtgtgcgcagcaagcgcccacgccctgcaaccttcaacccccatccagtgatgcagctaatctcccctgcatcctccactggcgagaacgtgcagcacaacgccaccaccacttccaaggcggcctcatcagattccgagaattttgccgagtcagtgatcaaggggccaaagcaggcctctggggagcacaagaacaaaaggaagatcaaggtgactttctcatcaggtcaagagcagcagaatgcaccatcacaggcagttaggaaatgcttgcactgtgagataaccaagacaccacagtggagggcagggccaatggggccgaaaacactctgcaatgcttgtggcgtgcgctacaagtcaggccggcttttccccgaataccgccctgcagcaagcccaacattttgcgcggccgtgcactccaactcccacaagaaggttattgaaatgagaaacaagacaggcaccaaatctggctttgcaactgattctgctgcctcaccagaactcattccaaacactaacaacagccttacccttgaatacatgtga

SEQ ID NO: 77991 - DNA, 425 bp, Glycine max
  Peptide Sequence Number=SeqID_194769
agcaattcattgagaaggtggtttggcctggagcccgaccttcttttgtgggggataatgaaagttttacaacccaggcacctcaacagcatgagacagaaccagaaaatgatgactcatctaaagccaccatctctggagctattgattttaaaaaaagaagattagagacaagatccaatgaggctgcttatcctggaccagtgccagcatcagctgatgcaccatttccaggagtggatccatcttcacctcagcatgcagcagactcttccactcctgtcttagagatacatgagggccagaccataccagtcctgcctttggacacttctcctctagctactcccgtatggcatctaacagatgagaggatgttcagatacaggacaatcaggaccagtcacagtcattttaattcctga

SEQ ID NO: 77992 - DNA, 330 bp, Glycine max
  Peptide Sequence Number=SeqID_194770
atgagggggtgcaagtgcatcccctcatttgaacgtaggactggaattgcatacatatcaaatgtggcggtccgggaaaattttcggagaaaggggatagctaagaaattgatagcaaaggcagagtgtcatgccagaagttggggctgtcgtgccattgcattgcactgtgacttgaacaatcctgtggccacaatgttatacaaaggacaaggttacaaatgtatcatggttccagaaggagcaaattggcctcagccaagaacctcaccagacatcagattcaacttcatgatgaaacttctcaaaaattcacttgggaggaagtaa

SEQ ID NO: 77993 - DNA, 331 bp, Glycine max
  Peptide Sequence Number=SeqID_194771
atgttgatgcaattcatggaaacaactaaatcaactcaacaagcactccaaagtgtagaaattcaggttagtgagctggcagaagcagttactcaatttatgtccagacgagaaaaatcctttgtagaggctgaagctcaagagaaaagccctgtaaaagagcatgagtcaagagaaaaagatgaggagaaagatgaggaacaagcacaacaacaatgggagaagtactcaacagtagaaaaccaacaagaaaatattctccaaagcaataaccttcctcatcaactgattgacaagaaaggaaggcaaggacagcatgaggaaaccttaa

SEQ ID NO: 77994 - DNA, 417 bp, Glycine max
  Peptide Sequence Number=SeqID_194772
atggagattaacttggactacgagatagcttggaaccatgtaataggaatttgcagggctagtcaagttgttgatttgttcccaaccgtgtcccccgaaattattgtccgcgaggcaaggttggaggactactggggagtggcagagacgcactgcaagtgcttcttccctgaatattccttcccattagattttgtgctgaggatagacagattggtggtggctatgttagcagctatgttagccggattctttaggcctagagattgcagaaggatctgtttggtggctgttattgacagctcacttgatgagtcattttcatttgaaagtgagggtctcaagattggtggttttgatgggaaattcagcctcaacaagggctatgtggctggtatattaaacagtagacaataa

SEQ ID NO: 77995 - DNA, 162 bp, Glycine max
  Peptide Sequence Number=SeqID_194773
aaacatcgtttaagctcagttcacgaagcatcgatcgggtgtaggcataaagggacacgtagaactgcaccgccaatcaggggagcagtcgtcgctgtctatcaagcggcggaggtgtttgctggcacggagggtctgaccatgtcttatggcgttaactga

SEQ ID NO: 77996 - DNA, 381 bp, Glycine max
  Peptide Sequence Number=SeqID_194774
atgcctgctgtggacactggacagtgcttgctagtgaagggatggaaaggttcaagctggagcttccctcgtggaaaaaagagcaaagacgaagaagatcatgcatgtgccattagagaagtcatggaagaaacaggttttgatgtttcaaaacttctgaacaaggatgaataccttgaagttatttttggacaacagagagttaggctttacattattgctggagtgaaagatgatacagcatttgctcctcttaccaaaaaggaaatcagtgaaatagcatggcaccggcttgatgaacttcaaccagcaagtgatgaagtgatatcgcgtagcatcaccggccttaagctttatatggtggccccttttctagcgtga

SEQ ID NO: 77997 - DNA, 225 bp, Glycine max
  Peptide Sequence Number=SeqID_194775
atgagtgagatacgaagatttggaggtttgggaatggaggaacgtcgtgagagaaaaggggctgcgcagggatttctggaaaatgtgatatttatagagcaggacgcgtggaggaggcagcctactggtaatcgattacatgaatactgtaatcgattacaggctatctgttctagtgtaatcgattacagtattcatgtaatcgattaccagaacaaagaatag

SEQ ID NO: 77998 - DNA, 303 bp, Glycine max
  Peptide Sequence Number=SeqID_194776
aaccttctatcgaagaaaagtcgaagaaaactttacattgctgttggaactgtgggtcgaagaaaaccctacactgctcttggaatagtcgtgggtgctcaaagctcaaagctttctacgctgccagttaacaagttgattgtgctttatgtggttttcaagcttgacgagagttacacgccgagcaaagtttccatccttgcttgtggtggttttcacaacttgaaggagattaagaccgtggaactcgtgaggccaactgggtggatatatctatccttgtctggagcttatcctaggtaa

SEQ ID NO: 77999 - DNA, 270 bp, Glycine max
  Peptide Sequence Number=SeqID_194777
atggctacagccaggtgggcactcaagcatcctgtttatggcattgtgatactacggttgggaatttacacagacatacccaacgtttccaagacgacgttcctaaatgagaaattctacgcgattccagaatttcaacagacactattgacaacaacaaaacgtaacgactcaaacgatatcacttcgtttctaaacgaccatttagaggaaacattgggtccaacaaagataggagaaaatcactcaaagtgtatcaatctcacacag

SEQ ID NO: 78000 - DNA, 631 bp, Glycine max
  Peptide Sequence Number=SeqID_194778
ggctcctaattctaagaggctgaatttagaagctgttggtgttgagcttgacaacactggagcaataaaggtggatgagtattcctgcacaagcatacctagcatatgggctgtgggtgatgtcacaaaccgaatgaatcttactccggtggccttgatggaagcatcgtactttgctaaaactgtatttggtgggcaaaaaatcaagccagactacaataatattccctatgcagtgttcagcattccgccactttctgtagttggtctcagtgaggagcaggcaatagagcaaaccaatggcgatctgttggttttcacatcaatcttcaatcctatgaaaaataccatctctgggcgacaagaaaaaactgttatgaagcttgttgttgatgctgagacagataaggttcttggagcctcgatgtgtggacctgatgcgcctgaaattatacagggtattgctattgcattacagtgtggagctaccaaggcacagtttgatagcacgggaaatgatataatgacatctggaattagcttcacttatctgaaatatttgcgcaagaatgtcaacatttgtgtgctggaaaatgcagtgtgctggaaaatgcagtgtgcaaagtatatg

SEQ ID NO: 78001 - DNA, 228 bp, Glycine max
  Peptide Sequence Number=SeqID_194779
atgaatgctatttataatagagcctattatagatgcattgttgggccacctgcatttggcatgctcaaggatggaagtcccaggcgtgagggtgagtgttggaaaagctgccttaattgtggacacccattagcccgctatagttgtggcctctttgggggttgcctgaagtgtaaccttaagggtggtggtttagtctcatatcgactagagatagaaacaagttaa

SEQ ID NO: 78002 - DNA, 3099 bp, Glycine max
  Peptide Sequence Number=SeqID_194780
atgccacaccagataatccccggtgcgtttgcgcgccagcagcggcgcaatctgcgcccactgttcgtcactgaagcgtggccgcagcacctcgtcactctccgccgccagcagcgcgacgccaatcaccgactgccacgcgggcagcatgcggaatccggccagcgcctggctggtactggtgcgctcgccgggctccgagtgccagatgtagatgacctggtcctcccacagtacaccaagcgccaccacgatatcgcgcggcgcatgcgcctccagctgcggcagtgccgaagcaaacagcgacgatccacgaatggcctgcgccgccagcgcatgaatgcccgggcccggcagatagcgccggtgttcatcctgaatcgtcaggccgatggacgccatggtcatcagcagacggtttacccgcgtgctgttcatccccatctggcgcgccagttcacggccgccgaccgctttgtcactggagaccagatattgcaggcagcgaattccgtcaatcaggctctgccttcaggcgggagtaacctcatgatgcaaactttctcttctcaggccgcgcgtgcctttccgctgcagtcgttacacgccgatgtgctggtcgccggtggcggtctggcgggcgtgtgcgccgcgctggctgcggcacgcgcgggccagcaggtggtgctgattcaggatcgcccggtccccggcggcaacgcctccagcgaagtgcggctgtgggccaacggcgcgacgtcgcatatgggtaataacaaccgctgggcgcgtgaaggcggcatcatgggcgagatcatggaggagaacctctggcgcaacaaagagggcaacccggtgctgttcgacatggtgctgctggacatcgtgcaggcgcagccgcgtctgacgctgctgctcaataccatagtcagcgacatcgaaaaatccgcgcagcgcctgcaggcggttcaggctttcaacgccatcaatcagacccgctatcgcgtgacggccgaccagtttattgatgccagcggcgacggcgtgctcggctatctggccggggccgcgcaccgtgtgggcgcagaatcaccgcaggagtttggcgaaaaaatggcgccgggcgagcagtttggccacaagctcggccactcaatttatttttataccaaacgcagcgcgcagccggtgcgctttgtaccgccctccttcgcgctgaaagagatcaccgctattccgcgctataaacgtttgagctccgatctcaacggctgcgatctgtggtggcttgagtggggcggccggctggataccgtgcatgaaagcgaaaccatcaagtgggagctgtggaagattgtctggggcgtgtgggattacatcaaaaactccggcgagtttgccgatgccgacacgctgaccattgaatgggttgggctgattcccggcaagcgcgagagccgacgctttctcggcgatactctgctgtgtcagcaggatatcatcgcgcagcgcgaccactacgatgcggtggcctacggcggctggtcgattgacctgcatccggccgacggcgtgtacagcgctcacgacggctgccgccagttccacagcaaaggcacttacaccattccgtttcgggcgctgtacagccagtcgctggataatctgctgctgaccggccggcttatctctgccacgcacgtagcctttggcagcgcgcgcgtgatgtgcacctgtggcgtgctgggcgaagtggtgggccgcgcggcggcgctgtgtcagcagcataaccagacaccgcgtcagctggcgcagccggagcatattggtcagctgcagcaacagctgctgcgccacggcgcgtacattccgcgtcagcagctggcgcatccggccggtgccgctcaggtcagcgccagcagcaccttcgcgctgcacgccctgcccgcggatggcggctggcacgcccttacctcacgctgcgccctgctgctgccgcttaaagccggagaacgcctgccggcgctgacggtgcggctgcgggcgtcatccgcgcagacgctgcaggtttcactgctgaccagcgacaatccggccaatacctgcggcgatcggctgctggccacacacagcctgcagattagcggtgaagaggcgtattcgctgccgtttgactaccgtgcggagtgcgatcgttacctgtttatcgcctttgaagaaaatccggcggttgaagtggcgctcacccgccagcgcctgccgggcattatgatggtcttcaacagcctcaatccgcgcgtcgcgaaacgcacccggcagataaacgacggcgattacggcgtggatgaatttgatttctggctgccgcgccgcgcgcctaatcagattctgatcgcgtttagtctggcaacaccgctgcggctgtggcactgcgactatttgctcaacggtaaactgcggccggaaagtcacactaatggctggctgccggcggcggacgatcgccagccgtgggtgtgctggcagtggccggacgcgcagcgcgccagccagattacgctgctgttcgataacgatttcgaccatgcgatggaaacggtgcagatgggccatgcgcaggcggtaacgccgcactgcactacccactatcgcctgtggctggatgacaggctgctggccgaggtcagcgataatcatcactcgctgtgccatcatgcgctgcccccggataccgcgttccgccagattcggctggagctgctggccagcgcaggcgccctgcccgcgctttacggcctgcatctgcagggcgataaaccacattacgccgcccaccagcagattaatgatgcgctgcgcccgtacggtgcgcaggcgcggcgacagccaggcggccagcagcgccagaccgaaaaaccacagcagcgaggcgctggcggtgccgaaagcaaaccagcggcgcgcctccgccgacggcagctgactgccgaggctgccgagcaccacgaaggtgtcgagatagacatgcggattgagccaggtcaccgccagcatagtggcgacaatgcgccagcgcccctgcttcagcgccgcctctga

SEQ ID NO: 78003 - DNA, 177 bp, Glycine max
  Peptide Sequence Number=SeqID_194781
atggtgggaaatgcaaattgtgaggaaggacgtgtgattattcgatggggtagcatgttggaggagcgtggacaaatcacttttctggaattgacgtttgatacattctttgagtttgaggtcttctttcttcctatgcgatgtgtaacctttggattcaggaggattgggatttga

SEQ ID NO: 78004 - DNA, 213 bp, Glycine max
  Peptide Sequence Number=SeqID_194782
atgcagggagatgcttcctctaagaccaccattccagagccattcactcttcatcctgaggcaggggaagaacaggtgagaccagagactactgctactcctgagagatcccttgagggcacatcagagcctctaacaccagtggtagacctctcctcaccccagcctttaggtgacccttccactcctttacttgacataccagaggactag

SEQ ID NO: 78005 - DNA, 716 bp, Glycine max
  Peptide Sequence Number=SeqID_194783
tagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactggatacggctatacaattacaaccggtctttgctcaatggatacaaatacccatgctttagcaccaaggcacaacagccccag

SEQ ID NO: 78006 - DNA, 918 bp, Glycine max
  Peptide Sequence Number=SeqID_194784
atgttttcattattcaaaaagaccctgccttttatcgtcgccggtggaatgttggcggccagccatggggcgctggccaagcaaatcactatcggtatgtcgttccaggaaatgaacaacgactacttcgtcaccatgaagcaggcgctggatcaggcggcggcggatatcggcgccaaggtgtacgtggccgatgcgcgccatgacgtcgccaagcagatcggcgacgtggaagacatgctgcagaagaaggtggacatcctgctgatcaacccgaccgattcggtgggggtgcagtcggcggtgatctccgcccacaaggccggcgcggtggtggtggcgatcgacgcgcaggcggaagggccgctggactcgttcgtcggctcggagaactacgacgccggcttccaggcgggcgagtacctggcgaaagcactgggcggcaaaggcaaggtggcgatcctcgacggcatcccggtggtgccgatcctggagcgcgtgcgcggctttgaagcggcgatgaagaaataccctgacatcaagatcgtcaccaagcaaaacggcaagcaggagcgcgacaccgcgctgaccgtgaccgaaaacatgctgcagtcggcgccggatctggcgggcatcttcagcgtcaacgacgtcggcgcgctcggcgccctggcggcgatcgaaagcaacggcgccaaggtcaagctggtgagcgtcgacggccagccggaagccatcaaagagatcctcaagccgaactcgccgttcatcgccacctcggcgcagttcccgcgcgaccaactgcgcatcgcgctcggcattgcgctggcccgctactggggcgccacggtgccgaaaaccgtgccggtgaaagtgaagctgatcgaccgcagcaatgcggccggctttagctggtaa

SEQ ID NO: 78007 - DNA, 330 bp, Glycine max
  Peptide Sequence Number=SeqID_194785
atggagcatacactattagaagcacttattatagtatcatggaagaaattcttgacacatgcgatctcaaggttgctggaagttggcttcacatttggaagctccaagttcctccaaggatcaagcattttatttggagactccaaagatgctgtgtgccaacccgccaacgtttgcaggagaaaggtattcaatgttcctctgaatgcatcttttgtaccaatgaaattgaaaacacttggcacctttttgtcacttgccataaagcacaagaaatctggaaacatgttggacttttggagcagagagcttccatggtctagtgtttaa

SEQ ID NO: 78008 - DNA, 2935 bp, Glycine max
  Peptide Sequence Number=SeqID_194786
tctttctgtcacaatgaatgaaacttttaatcaaacacttgatgtgcataatccttactatttgcatccgagtgagaatccagcaactgctttggtttctcctgttctagatccaacaaattacaattcatggagttgttctatgctcactgctttgaatgcgaagaacaaactggagttcgttgatggaaccatttccgagccacaacgaaacaattcgttgcattttgcttggtgcagcattttgtggatggataaagttgttgatgtttggaaagatctgaaatcacgatattcacaaggagatttgatgcgaatctcaaatctgcaacacgaagctgcttcaatcaaacaaggtgacatttctgtaacggatttcttcaccaaattacgaataatttgggatgaacttgagagttttaggccaaatcctttatgtttttgttcgattcaatgttcttctggagcacttttgattcattctcttaatggatctgttacctccaacaagaacgacaaactcttggtagtgctggtgtccttggtagtctcaatcatgaatccagagattattcttcagttaatactgctagcagcaagcagtccacaaattgcagattttgtggttgtctcggtcacactgaaaatgactggccacactatagatgtttgctaccgccaacatggttatccactagggcataaattccataacatcaacagctcagtgacaggtgatatgcaagtcactgcaattgatcaacaaaatcaggacactcatgctccaagcttcacatctcagcaatatcaagcattgctagccttattacaacaagcaagtcatggtgcttcctcatccacacctcgtgttaaccaaattggtacattctctccatgtcttgatactagtacgtcaaccaatttaggtaatctcccacatctcttttgcaattctgtttcaaattctactgcaccttggatcttagattcaggagctacagaccatgtgtcttcatccctagccaatttttcttcatatgtctcaatcaatcctatagtggttaagttgccaacaggtcaagaagtcttagcaactcatttgagtgttgacacgatcaccaagagaatgattggtacagttgatgtggttgctggtctttacaagctcaatgcctctcccatcctccattttgtcaacaacattgtatctcgtaatgtgacattttatgagaatttcttcccttacgttcagcccaataatgacttctctcactcttcaaacacatcattctcaaatacttttatcctttctccccttgcttgtgttgatgtcccttttccttcacatgacatatcttcatcctctagtattgcacctcataatccaacttctcaaccatcttcctcacaacccctcattcctcttcgacgttccactcgtcctacacaacgacccgcttttcttagagactatcatactgcattcacatcaattggcactgttccctctccagaaccaacttcttataaagaatcatcacagcatgattgttggcttaaggtcatgcaagaggagatatcttccctagaagctaacgagacatgggtgcttactcatcttccccctcataaatcagccattgggtgtcgctgggtttataagattaagcatcgtgctgacggttccatcgagcgctacaaagctcgcttaatagcaaaaggctacactctgatggaaggtcttgactacttagatacttattcacctattgctaaattgaccatcgttcgacttctcctttctcttgctgcaatgcacaattggcatttgaaacaattagatttcaacaatgctttcttacttggtactcttgatgaagagatctatatgcagctgccttcgggtttaaaatctgccaaagctagccagagatcttcagattctgctttcacaactttgttggtatatgctgatgatattgttctttcacaaaattgcattaatgagatcacttccatcattgctcagcttgatgcagctttcagaatcaaagatttaggtgatttacgcttctttattggtttagaagtggcccgtatcacaaaaggcattaatgtatgccaacgtaagtatgctcttgatctcttccatgatactggtttacttggtgccaaactagctagtaccccctttgattattgcaccaagctctcccaagactctggtgaccctcttcttaatccattttcctatcgtcgtttgattggtaggttgatttacattaccactactcgcccagatattgcatttgttttccaacatttaagccaatttgtcaactcacccacaattgttcatcatcaagctacttttcgcatcattcattatttgaagcatgcccccggctcgggtttattcttcccctccaccaaccatgctaaactcctcgcatttagcgattctaactgggctggatgtacatacactcgccgttatgggactggtttttctgtatatcttggttcttttcttgtttcttggaagtcgaagaagcaagctactgtctctcacagctctattgagtatgaatatcgtgctcttgcctcaactacctgtgaaattcaatggctcgcctatcttttagaagacttcaaagtttcattcaccaaacctgcacttctctattgtgacaataaatttgctatggatgttgctgctaaccccatgtttcatgaacgcaccaagcacattgacatcgactgtcatattgtcagagaaaagatcgttactggactgcttaaacttcttcctatttcttcaacattacatctagctgtcatctacacaaaagctttgccacctgcttcattccacaccttcctctccaagttgggaatgtctaacatccactcccaacttgcggggggatcttag

SEQ ID NO: 78009 - DNA, 1335 bp, Glycine max
  Peptide Sequence Number=SeqID_194787
ggtaaaaaccagattctgttctttgacccggcgctgaccgagcgggcgcagaagcgcttaacccaggagcacgacatcctgcagggcctgcaggatggccagtttgcgctttatctgcagccgcaaatcaatatggccaccggcgagctggccggcgcagaagcgctgctgcgcatgcgaatgccggacggcagctacgggttatccgaagagttcatcgccagcgccgaagagattggcgtcatctccgcactcggccgctgggtgtttgaagaggcgtgccgcattatcgctggctggcagcgccacggcatcaatctgccgctcagcgtgaatatctccgcagtacagctgcgcgatgccagcgtggtgagccacctgcaggggctgctggagcgccaccgcattgcgccgggtaacttcgtactggagatcaccgaaaccgcgcagattggcgatgctgaacaggcgatggcgctgctgcgctcgctgcagcaaaccggggtggcggtcgcgctggatgatttcggcatgggctactccaacctcaactacctgcatcagttcaaagcgctgccggtcaataagctaaaaatggatcgcagctttgtcgccgcgctgccggatgatgacaccatggtgcgcatcgtggcggcgattgccgacatcatccacctcgacgtaattgccgaaggcgtcgaaaccgccgagcagcgcgactggctgctggcgcgcggaattactataggacagggctacttatatgctgaagccctgccaattgcaccgttatggggtgctgaagcgtttcagttcatagcggcttgccgcatgcgtttctccataacaatggcggtgaatgccgtctatacctggacacctgttatgaaactgttcaaaagcctctactttcaggtactggttgccatcggcatcggcgtcctgttaggccactactaccctgagttaggcgcgcaaatgaagccgcttggcgatggcttcgttaagctgatcaagatgatcatcgcccccgtgattttctgtacggtggtgaccggtattgccggcatggagagcatgaaagcagttggacggaccggcgcagtggcgctgctctatttcgaaattgtcagcaccatcgcgctgattatcggtctggtggtggtcaacgtgatccagccgggcgcgggaatgaacgtcgatccggcgacgctggatgccaaagcggttgcggtctacgcgcagcaggctgagcagcagggcgtgattgccttcctgctggacgtgatcccgaacagcgtggtcggtgccttcgccagcggtaacatcctgcag

SEQ ID NO: 78010 - DNA, 291 bp, Glycine max
  Peptide Sequence Number=SeqID_194788
atggacataatagaaagagataaaccacttgaaggatattctggacatctatggaaggatttcttgtcaaacaatcaactactagaagtcataaatcttcttcagcagcaacactcccaccatttcagagacatgatttctacaacaacggggatcactcaaaccataggctcaagaaagtatttgggactgccttcaatcattggcaaaagttgtttttggttttctcaaggaccatctatggaagcatatcaatcactagtcatcctagcaactctcaaaagcgggtaa

SEQ ID NO: 78011 - DNA, 408 bp, Glycine max
  Peptide Sequence Number=SeqID_194789
atggaggaggataagaagaaggagaaaatgttggaggatgacaaacaacagttggcaattgaaccagcacctgaaccagtgcaacccttttatgaacttatagaggaacaagaagaggaggatgaacagatgagagaaacaccaataattttgagtgaaaaagaaataaatgaaaaaagaaagaaaaagaatgaagaaaatgagaaagaaaaagagagaaaagaagagaagagaaaaaacaagagtgagtgtgctagagagaaaaagaaagaaccatctttagctaaagggacagaagtaccatatcctttggtaccttctaggaaggacaaagaaagacatctagctagatttgtggatattttcaagaagctagcaattaccatgccctttggagaagctctatag

SEQ ID NO: 78012 - DNA, 1239 bp, Glycine max
  Peptide Sequence Number=SeqID_194790
atggctatagttttaatggttcagtattctgaacttcctagtagtaaattcttatcttctgttaccaccaagattaccatggagggtaataatttgcacctagatggttctaattcaaactctactcatgcattggaagagaaagcaattagtcctcaggtaccccaatttcacaatgacagagattcaattacttcccctgcaccagagaaagctaaaggacttgatgaaacggattcaagaagtcctgtggcatctgtcacttcagcagcaacttcagtgaaatcggatataaccggttcagtttctaaggatggaaagtcgggttctttgcaaggtagtagtaacttgacatccaataatggtaagcctgtgactgcaaagaattccaaaaagagaccatctaaagtagtttcaatatctaagatgaacttgccgttgcagcataatcatgcttcttccaagctagtgaaaccagcaagggcttcagctgtcgatctggaaatattgcatgctaaatcagagattttaaatgcacccgtcattatgaatgatccaagactttacccacctttatacaggaatgcctccatgttcagaaggagttatgaactaatggaaaatatgctcaaagtttgcatctaccaggatgaagacagaccaatctttcatgagccgttactggatggaatatatgcatctgaaggatgcaccatttctcaggctcctgcagaaacaagagggcgcatgcttagtagcatcagagccctctgcaatgcagacattgaagtaggattcaagataggcaaggatgtttctcttccagaaacatatataaggaggtttgcacgtttatgttcgcctattctgttgaagcactgggaaaacaaagaacctgacatgaaaatttctggtcccttgccgcatgtcaggggtaatgtaaactacatccaattcatgaagagcagcaaattctgcatccatgcaaggggtcatgaagttaatagcccgcgagtggtagaggctatatttcacgagtgcattccagttatcatatctgacaattttattcctcctttctttgagattttgaactgggaatcttttgctgtgtttgtcacagaggaagaaatccctaatttgaggaacatactgctgtccatctctgaagaaagatacttagagatgcataagagggtgaaaaaggtgcaagagcattttccctggcatgctgaacct

SEQ ID NO: 78013 - DNA, 1887 bp, Glycine max
  Peptide Sequence Number=SeqID_194791
atggatcaagagttgtcttccatatttcagctggaaacaaggagattgttatggcttatcggcattacggttgctatggttttagcattccaatatttggaacttccttatggtggcattcaacgcattgtattctctgccaacaagataccaacatctgatagcattagatttcaagctgcagatctaccatctgagtctgaaaggtttaacaatatgacatttttgaatcaagctaattctactggtgaaagtgccactgttaatgaaactaggacttctgaggaaaaagacaatgtttcaggaactggtttaatctcagaactaggaagggaatcaagcagatctttaggatttaatgaaactgaggaaagttccactgtgcaaagtactaggatatcaaatgaatcaacgcatgcaggaaatctaggactgagcagttacaacgataccatttctcattccccttctcgtgcaataataccaactaatttagctccacctctaagtccaacaaaagtgagtccaaatattactcctccaatgtcatcaaatgatcatgaggaaactgattttgcagaggatgagaagttaagaccagtacaagatgatgtcaatatactacgacataattcgcctatcaacagtgtagcacctaagaagactaaaggttctcaaaaaccacttccagaagtaacaacaatctctgaaatgaatgagttactgcttcagaaccgtgcctcatttcattctgagaggccaaggtggtcttcgattgttgatcaagagctactgcaggccagatcagagatcgaaaatgcacaaattgtaaatgatgatgtaaatctttatgctcccctatttcgaaacgtttccaggttcaagaggagctatgaattaatggaaagaactcttaaagtgtatgtgtatagagaaggagataaggccataatgcattcaccgatactttccggactttatgcttccgaggggtggttcatgaagcacatggaagctagtaaacaatttgtcactacagacccaaagaatgcccacctattttacttgcctttcagttctcagaggctagtggatgctttgtgggtaccgaaatcaagttatgggaacctgattcagtatctcagtaattatgtagacatgattgccgggaaacatcatttctggaacagaacaggaggtgccgatcattttcttgttgcttgccatgactgggcacctgcagaaacaaagcaacacatggctaagtgcttaagagccctatgcaatgctgatgtcaaacaaggctttgtcttcgggaaggacatgtctcttcctgaaactgttgtccgtagtcctcggaatccgacaaggagcattggcggaaatcaagtttcaaagaggaaaactctggcgttttttgcagggcaaatgcatggttatgttaggccaattttgttgcagcactgggaaaataaagaccctgacatgaaaatctttgggagactgccaaagtctaagggcaacaggaactacatccagtacatgaagagcagcaagtactgtatttgcgcaaagggctatgaagtcaatagtccaagagttgtggaggccatcttatatgaatgtgtcccagttattttatcggataactttgtgcctccattttttgagatgttgaattgggaatcctttgctgtttttgtcttggagaaggatattccaaatctgaagaatatactcctttccatccctcgaaagaggtatcttcaaatgcagatgatggtgagaaaggtgcagcagcatttcctttggcacaacaagagccctgtcaatcttcacagcaacagctgcatagttcattttggagatgtggcaaaagtagattga

SEQ ID NO: 78014 - DNA, 1920 bp, Glycine max
  Peptide Sequence Number=SeqID_194792
atgggtcaagaattgtggtcaatatttcagctggaaagaaagagattgttttggctaatcggcattacagttgcaatcatattagcattccaatatttggaacttccttatggtggcgttcaacccattgtattctctgccgaaaacacaccaacatcggatagcattagattccaagctgcagatctaccatctgagtctgaaacgttcaacaacatgacattttttaacaaagcaaattctactgatgaaaatgcctttgagattgctaatgaaactaggacttctgaggaaaagggtactgtttcaaacactggtttaatcacagaaccgggaagggaatcaagcagatctttaggatttgatgaaactaatgaaagttccactgtggaaagtattgagatatcaaataatggttctgcaactgagcagacaggaaagtttggactgagcatttacaacaatactatttctagttccccttctcatgcaataataccaactaatttagctccacctctaagtccaacagaagttagcccaaatattacatctccaatgtcatcaaatgattatgatgaaactgatttcgccgaggaagagcggttcaagccatcaaaagatgaattcaatatagtaggcaataattcttctatcaacagtgtgcctaaggagactaaaggttctcaaataccacttccagaagtaacaacaatttctgaaatgaatgagttattacttcaaaaccgtgcctcatatcgttctatgaggcctaggtggtcttcggctgttgatcaagagctactgcaggccagattagagattgaaaatgcaccaatcgtaaataatgttgaaaatctttatgctcccctttttcgaaacatttcgaggttcaagaggagctatgaattaatggaaaaaactcttaaagtgtatgtgtatagagaaggagacaagcccataatgcattcaccatatcttttgggaatttatgcttcagagggatggttcatgaggctgatggaagctagtaagcaatttgtgactaaggacccaaagaaggcccacctattttacctacctttcagttctcggatgctagaggaaactttgtacgtacccaattcccatagttctaggaacctgattcagtatctgaaaaattatgtagacatgattgccgggaaacatcgtttctggaacagaacaggaggtgctgatcattttcttgttgcttgccatgactgggcccctacagaaacaaggcaacacatggctaggtgcttaagagccctatgcaatgctgatgtgaaagaaggctttgtcttggggaaggacatttctcttcctgaaacttatgtccgcaatgctcagaaacccacaagaaacattggcggaaaccgggtttcaaagaggaaaactctggcattttttgcagggggaatgcatggctatgttaggccaatcctattgcagcactgggaaaataaagaccctgccatgaaaatcttcgggatactgccaaagtctaagggcaacaggaactacatccagtacatgaagagcagcaagtactgtatttgcgcaaagggctatgaagtcaatagtccaagagttgtggaggccatcttatatgaatgtgtcccagttattttatcagataactttgtgcctccattttttgagatgttgaattgggaatcctttgctgtttttgtcttggagaaggatattccaaatctgaagaatatactcctttccatacctcaaaagaggtatcttcaaatgcagatgatggtgagaaaggtgcagcagcatttcctttggcataggagccctgtcaagtatgatatattccacatggggaacaacattcgttggggacagacacagaataagactgaagttggtaatcaataa

SEQ ID NO: 78015 - DNA, 399 bp, Glycine max
  Peptide Sequence Number=SeqID_194793
atggccactttatataaaacattcatagtgaattgctccattcagaaaagaccctcccatgtctcggacaattctcgccactacaaccttccactcttccctgcctttaagccactcaagaaagttctgcctgaagtccccttgcaaattgatgatgttaagaaaaccatgtcaaaaactgcagctatattacttgatgcctttgtagattcgttctttgaatttattgaccaaccactgcttccatctcagagtaactttgctccggtggtggagttaggtgaagccatagttgtgacaagcatccaaggacaaattccagatgattttcccgagggtgtctacattagaaacggtgggattcctttcaactttgtgttaacgcagcatcatttctag

SEQ ID NO: 78016 - DNA, 1143 bp, Glycine max
  Peptide Sequence Number=SeqID_194794
atggagcatactaagatcccatcccaattaccatcaggtccaaatccactttttggaggactgcaatcaacaaattctatctttgggaggtcaagttacatatgggtggaaggagagggaatgcttcacgcaatttattttaaaaggtggagtccagggatttggactgtcctctacaacaacaagtacgttgaaaccgatacatacaaggttgaaaagcaacgaagtaaaccattgtttctaccggccatagaaggcgattcaccagccattttgtctgcttatctgctaaattggttgcgatttggcaaagtaaacaagtacatcagcaacaccaatgtctttgagcactcagggaagttttactccgttgctgaaaatcacattccacaagagattgatatctttacactgaaaactttaaggaattggaatgtcaatggtgcctgggatcgtccttttactagtcatccaaagaaagttccaggtacaggggaactagttacatttggggttgcagcaaccaaaccttttgccgtagttggaattatttctgctgatggcaagaaattggttcacaaagttgacctcaaactaaacaggtacaatgtgatcatggatttcccactaaccattgatctaaacagacttcttagaggaggcccattaatgaagtataataaggaggaatatgcaaggattggagtaatgccacactatggtgatgccaactcaatcaaatggtttgaggtggaacctaattgcacttttcacattatcaattcttttgaggatggtcacgaggcaagttacctagaactagaagttgtagtgaggggttgcagatctcttgattcattaattcctggacctgacccgagtttgaaggaatttgagtggttatctcgttgtcacgagtggcgattgaatatgcaaacgggagaagttaaggagagaggtctctgtggagccaacatagtttatatggattttcctatgatcaatggaaacttcataggtattaggaatagatatgcatacactcaagtagttgatcccattgcaagctctactcaagacgtgccaaaatacggaggtttagcgaagctctactttgaagaatcatgtgcaaagttttccatg

SEQ ID NO: 78017 - DNA, 357 bp, Glycine max
  Peptide Sequence Number=SeqID_194795
atggatttcacggagctttcatgccaatttcatttgagacacagtaggactacagagtgtaaaacaacaaacgcctcaagatctatattggtcatattgctcccctctggtaaatgtaaatgtatatttggaactgaagtgttaacgcctaaaaatcacagaaatcagaactgtgatggatccagacacatgatttctggtcaagctgctgctgctggagttctccgagattattgtggaaacattttgtatgcttatgctgcagatatagggaaccatgaggttgctcatgctaagtttggtatttttattgcctgtcaacgtggcttcaaggagattagtgtgggatcagattaa

SEQ ID NO: 78018 - DNA, 1716 bp, Glycine max
  Peptide Sequence Number=SeqID_194796
atggcattggcaacttcatacatgactcttgcacctaaatattgctgcgttcagaaacgatccttcatcgtaacttcaggactttcctccgccttcaagccgatcttaagagcgttgcctcaaattccgcggcaaattgatgcttccaaaaccttcacagacatcaaatcgaaatttcttaacgctgttgtggattcagcatttgagtttgtcgaccagcttgtgcttccatctcagaataactttgctccggtggaggaattaggggaacccgtggctatcacttatattgaaggtgacataccagatcactttccagagggaccaaacccactctttggaggattgaaatcatcgaagtctatcttggggaggacaaatagcgtttgggtggaaggagaaggaatgcttcatgctttatatttcaaaagggaaagtgacaacgggtgctgcaccatcgtctacaacaacagatacgttgaaactgaaacatacaagcttgagaaacaaagtatcaagcctttgtttctccctgctgtaaaaggagatacattcgccgttttgtcttctatgcttcttaacgggctgagatttggacaactgaataaagattatagcaacaccaatgtgtttgagcattcaggcaagttctactcggtttcggagaatcacatcccgcaagaaatagacatcttcacactaaatactttgaaatactgggatgtcaatggagcatggaatcgtcctttcgccagtcaccccaagaaagttccaggcacaggagagcttgttatttttggggtagatgcaactaaaccttatcttgaaattggaatagtttctgctgatggaaaggaattggttcataaagaagacataaaactagacagatgctctttatgccatgatataggtatcacaagcaggtatatagtgatattggatcttccactgattgtagattcaaacagactacttaaaagaggcccattaatcaagtatgagaaggaggaatatgccaggattgggataatgccactctatggtgatgaaaactcaatccagtggtttgaggtggaacctaatagcacatttcatatcatcaattcctttgaggatggtcatgaggttgtgttgtggggttgtagagcattagattcaataattccaggaccagaagatggtctaaatgaatctaaattgttctctcggtgttatgaatggcgattaaacatgaaaagtggggaggttaaggaaaaatatctcactggaccagaaaagtttatggattttccagtaatcaatgcaagttttacaggaataaagaatagatacggatacacccaagtggttgatcccgctgcaagttattctgcagatattcctaaatatggagctttagcgaagctatactttggagaaccatgttcagaattccctgtgggagagacacaacaagaagagcttataagggtggaataccatacgtttgaaaggaatgtattttgcactggatctgcctttgtccctaaagaaggtggtattgaagaagatgatggttggataatcacttttgttcacaatgaagataccggcatatctcaagttcatataattgacacaaagaagttttctggcgaggcagttgccaaaattaccatgcctttcagagttccatatggatttcacggagctttcatgccaatctccttttag

SEQ ID NO: 78019 - DNA, 564 bp, Glycine max
  Peptide Sequence Number=SeqID_194797
atggcgagacctctcaagccacactcatcttcccacgaagcgctctccaatgcttccagttcgtccgaggaagaggagcaagtcaacgagcagatcagcgaagaggaagacgaggaggaactcgaggcggtggtgcgccccgccagttccgactatgacgaagacgatgacaaagttgccggcgacaatccaccgaactccgatgaatattccgctgccgccgatgacctggatggggatagtgttgatcccgaaattagcaagcaagagaagactagattaaaagaaataatgcagaaagtgaagaaacagaagattcaggagatactggatgcacagaatgcggccattgacactgacatgttacgtagaccgagctttgctcattttgcaaaaggggatcaatcttcgtctcagaagaagtcaaggggaaggggtcgccattcatccaatttcactgaggaagaagatgaagaataccgaaaaggagaagaagatggtctagcaaacacacgtctggtgacacaaccatcatccactgatattatttctgattctgactga

SEQ ID NO: 78020 - DNA, 309 bp, Glycine max
  Peptide Sequence Number=SeqID_194798
atgcttcagtcccatcatatcaagaagcctatcccgccagctccaatggcgggacacgtggcaatcccgccagcaccaatggcggtaccctcgcctctctcctactcagcctgtcccgccattgctgctggcggtaccccctctctccccctctctcctagtcagcctgtcccgctgctacgaatggcggcaccccctatcccgccattgtcgttggcggttcaagcttcccgccagtgtcaatggcggcacccacgtccagaagagaccccccttgcaatttgttttaaaagagaccctgttccgtaa

SEQ ID NO: 78021 - DNA, 1374 bp, Glycine max
  Peptide Sequence Number=SeqID_194799
atggatcatttctatggcaagagaaccctcctcagcctaatggacaccgaaaaaccagaaccgccacaatcccccgttcaccttcgcgtccaaacccacagagagataaacgaacaagacgttcagtttagtcctccaagaccttcaactacttccgatggcatgttccctatgatgatgccagattcaccatggacactttcccctctcccaaccccttcaccttctcttctttaccactgcattgcttctctccaccgccacgaaggtaacatctacgcaatcgcagcttctacaaagggcttggtcttcaccggctccaacagcagtagaatccgcgtgtggaagcagccagattgcatggacagagggtacctcaaagcaagctctggtgaggtgagagccattttggcttacagcaacatgcttttctcaacgcacaaggatcacaaaatcagaatatggaccttcaccgtttcagatagcttcaagtccaagaaagtaggtacactccctagaaaaacctctattcttatgttcccttcgagagggaaaaacacgccaaagcacaaagattctgtttcttgcatggcttattaccactccgagggtctcttgtacactggctcccacgacagaacagtgaaggcgtggcgtgtctccgacagaaaatgcgttgactcgttcgtggcacacgaggataacgtcaacgccatattggtgaaccaagacgatggttgtcttttcaccggttcctctgacgggtcggtgaagatatggagaagggtttacactgaagactcgcacactctcaccatgactctcaagttccaaccttcacccgttaacgctcttgcattgagttgctcgttcaaccactgtttcctctattcaggttcctcggatgggatgataaatttttgggagaaggagagattgtgttataggtttaaccacggagggttcttgcagggtcaccgttttgcggttctttgtttagcaacggttgggaacatgttattcagtgggtcagaggataccacaattagggtttggaggagagaggaagggagttgctaccacgagtgtttgacggttttggatgggcatagagggccagtgagatgcttggctgcgtgccttgagatggaaaaggttgtaatggggttcttggtgtatagtgctagtttggaccagacatttaaggtatggaggattaaggttttgcccgatgaaaagatgtgcatggactatagtcagtatagtgaccagtgtgaagctgccactagggttaagattagggactacgacatgagcccggttttgtctccttcctgggtcgagaagaagcttcaaggtagctattttcagtag

SEQ ID NO: 78022 - DNA, 435 bp, Glycine max
  Peptide Sequence Number=SeqID_194800
atggataagctcacactaacccgtcaatttgggatccaattcggttccttaggaggtatcgggaaggaattttggaataatgggacaaaaaggattgatcgcgaaaaagatttcttgttcttattagaagatcgtgattggatccacatatgtttgagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 78023 - DNA, 183 bp, Glycine max
  Peptide Sequence Number=SeqID_194801
atgtttgaacagtacttcctgaaagtacaacagtctagtattttagttgaatggtactgtagcagtaagacccgtgatggacaaagggcagtaaggctaagaaattcaaacttattaagtgaacaagataaccagacccaaaaggtcacccctaaacacaatctcttcgatgaggaagtctga

SEQ ID NO: 78024 - DNA, 393 bp, Glycine max
  Peptide Sequence Number=SeqID_194802
atgtattgtcggaagatgggggcatatgcaaaagatgagaaactgctgatacatttcttccaagaaagtcttactgggatagctgttacctggtacactaacttggaaccttcccgagtccattcttggaaagacctaatggttgccttcattgggcagtatcagtacaattctgatatggctccgaataggatgcaactacagaacatgtgcaaaaaggggcacgaatctttcaaagaacacgcccaaaggtggagagacctggcaacccaagtggttccctcaatgacggagaaagaaatgataagaatgatagtagacacattaccaatgttctattatgaaaaatggtgggtacacaccttcaagctttccggatttggtcttcgctag

SEQ ID NO: 78025 - DNA, 309 bp, Glycine max
  Peptide Sequence Number=SeqID_194803
atgggtccgaaatctacgctaaggattgcatcagttgtcaccgttgtcgccatcaaagtcgaggcggtggtgtcttctcattggcataagcagtacattcaccggcatagattggcagaactcgagggaggaggaggaggagggagtccgctccgacggggttttagcatcgttggaataaggcgcgcgtcaaaggaggaggatgaggacaaggaatgcgagatggagacggagacagaaactgagggttattggtggaagaagtatgattcgttcggggaggtgtggtcttctccagcaacgcgatga

SEQ ID NO: 78026 - DNA, 480 bp, Glycine max
  Peptide Sequence Number=SeqID_194804
atgccgatctcccccgcggaagtatcagttggtctgtgccgtcccgacataggtagggatcgcgtccgcaagacacccagtggactcggagaagtccaacagggccctggggtttccagctctggttacgggcctctattagtcctgcagggtgctcgtacccctcggcaagggatcgcgcccgcaggacacccagtggacccaaagaagttcaagagggtcctggggtttccagctctgattacgggcctctgtcagttctacggagtgcccgtcacctccagcaaggtcatcaggcctcctaataaccgagctttcatcaagaagtattgcgcccccaggcatgcagagggcgagacaccacaacagcctgggggtggccagcaacaggcaacaaatgcaccgccaccacctcaagagcccctcagctcatccacaaaaaggttagagtattgcctacgacacacggccgaccaatag

SEQ ID NO: 78027 - DNA, 240 bp, Glycine max
  Peptide Sequence Number=SeqID_194805
atgtcatatgacgcagcgattgaggtgaggaaccatgtttccccagagccagaggtggaggacgccggagttgcttcgttgtggaatccaaagtatgaagtctacctccagcttttctacttttgctttatggtcctcaggaagcaggcggacctcatcaatcaattggatacactaggagacattctcaggggacacaaattccaattcctaataataaccttgcatatttatgtttga

SEQ ID NO: 78028 - DNA, 423 bp, Glycine max
  Peptide Sequence Number=SeqID_194806
atggtgcagaagacgacgtttgtcattgcatgctatcagctgttgagtcttacagctaccaaaagaatgtttatacggataaccagttggggtatttccgtctgccccataacctcacggggtgcggaacacgacgttagtctctacatgctatcaggcgttgagtcttatagacagcaaaagaatttttatacggataaccagttggggtatttccgcctgctccctaacctcatgggtagtctgcaccgaagacgacgtaaatctccgcgtgtgaacgggctcgcttgcgtctggttgacaaagggtgcagaacacgacgtagtctgcgtggaagacaacgcgttgagtcttagagatagcaaaataatgtttatacggataaccacttggggtatttccgcctgccccctaacctcacgg

SEQ ID NO: 78029 - DNA, 288 bp, Glycine max
  Peptide Sequence Number=SeqID_194807
atgtttataccggataaccacttggggtatttccgcctgcctcctaacctcacgagaggtagtctgcgcggaagacgtcgtaaatctccgcgtgccaatgggctcgcttgcctcaggttgacaaagggtgtagaagacgacgttagtctctacatgaagacgatgttagtctttgcaagctatcaggcgttgtgtctaacagatagcaaaagaatgtttatatggataaccagttggggtatttccgactacccgctatcctcacgggttagtggttgccagaggtag

SEQ ID NO: 78030 - DNA, 639 bp, Glycine max
  Peptide Sequence Number=SeqID_194808
atgatgagagctagctggagattttgtggggaaagtcctcctatttgggcaagcatgattcataataaatatggttgtggatctgaagcttttcccatgaatatcatttggagagtgagagatgggagcagatcgattgtgaatataatgccaccttcgagagaacccgagaaggatagtctggcttggagcaagcccagtgatggaaaattttccatgaaaactgcatatgaggccgtggcaagtttatctttgtctcatcatcaaggtattttcaaatgtctacataaatggaagggccctgaaaggagtagaagttttctatggaaacttttccatgagaaggagctttcatctgcggttttggagctagctaagtttggaagatgctcggtagttggagctgggttaagagattgcatatatccttgctttaaccttgtcaaagagatccatgcgcgtcaagggaatgtcacatggaatcatattttccgtgaagcgaatcaagtagcagacgttttggcaaagcaagccgtgactcctttcaatacttttcaagtgtttgaggtgcctcctgagtgtagtattaatcctattcgatctgatgaaggtcatgtttgtttccctagaggcttttaa

SEQ ID NO: 78031 - DNA, 258 bp, Glycine max
  Peptide Sequence Number=SeqID_194809
atggagagattctccttagtctcaattcatattcgggacctgagtctgaacgtagccctaacgtcaatgatcatgggcttaaagtcaggacctttctcggacaacctttgcaaaagatttcttgtaacactagaggaattaagggcgaaggttgttgggttcatatacatggaagacgtgaccacattcagggagcaaatgcacgaagaatcctctaaaaggcatccagaaaagaaggagaaaattgataatggatga

SEQ ID NO: 78032 - DNA, 363 bp, Glycine max
  Peptide Sequence Number=SeqID_194810
atggagatttacgtcgtcttccgcgcagacttcctctgtcaagcactaacccgtgaggttagggggcaagcagaaataccccaagtggttatccgtataaacattctttggctatctatttacgtcgtcttccgcgcagactacctctggcaagcactaactcatgaggttagggggcaggcggaaataccccaagtgatatacgtcgttttctacgcaaactacctctttcaagcactaacccgtgagagtctaacgacgtcttctgcaccctttgtcaacatgaggcaagcgagcccgttgacacgcggagatttacgtcgtcttcagcgcagactacctctaggaagcactaactcgtga

SEQ ID NO: 78033 - DNA, 255 bp, Glycine max
  Peptide Sequence Number=SeqID_194811
atgttagtctctgcgcatcaatgggctcgtttgcccctggttaacgaaaggtgcagacgacgtaagtctccgcgtgttaacgggctcggaccacaattgacaaagggtgtagaagacgacgttagtctctatgtgctatcgtgctctaggtctgatggacagcaaaagcatgtttatacagataaccacttgggtatttccgcctgccccctaactatacgggttaggacaaaagagattgatggtgcgcggtag

SEQ ID NO: 78034 - DNA, 768 bp, Glycine max
  Peptide Sequence Number=SeqID_194812
atggttttggcaaggacattttcaacggagaccgaaaaggttgactttgaggttcaaggggattcgtcttctattggcagtgaggagtcgagtgacttctctacctatttgaatcaacttctagagagggtggccgataacataggaaagaggcctccttcttcggaagccgcaaagacaactgtggattcccctaacccttccatgaaggtgatgcgacaaaaatgccaacacgtgttgacagagaagaagcacacgagattgccttttgatgacttcaccatggatgtcctctgtgctttgaacgtggccttatttgagctacatccgaataagtgggctgccatacaagcattccaagccttgtgtttgtatacttttgttaaggctaccttgggcatgttcctccattatttttgtcgtctgtctcacaagaaggcacgatggggaaaccggtgttcccttttcattaacaacagtgtccctatcgatatggcaagtcgggatgaaggtgttggagaaaaggcacttaatgttgaggcttcaaacaagcttaataaggaggaaatggcaaggttggaagttgctttggacattgtcgagagggagataaatgctagaaaaaaggaaaggctttggattgaacataaagcatataacgatgtttatgaagctcatgagtttgacttcaaccactgcctccgacaagtactcttccactatgaagccccagatgaatccatttttgacatcaacaaagatgtctaa

SEQ ID NO: 78035 - DNA, 594 bp, Glycine max
  Peptide Sequence Number=SeqID_194813
atggcctcggctcaaaaaaggaatctacaacagattcagtcagatgatgcggttgtgataagcgtagaaatcaccaactgcatagtgagaaagacacttgtcgaccaagggagtttggtcgacatcctattttggaacacttttaggcagttagatataccggactcagagctccttccccatgacgacccactattcgacttcaccagagaaatagttggaaccaaagagtgtacatggttgtacactaagttcaatcatgagcaaccccaacaaagaggtttgaaaacccaatatgtgatagtgcacgcctacacctcctacaacatacttctcggttgtctgtctttaaatgctttgggtgtcatagtgtccaccccccacttggccatgaagttcccctcaaacactaggtccatcatcacaatccatgccgaccaaagaataaccagagaatgctatatggaaagtcttaagctgagccccctaatgaacgatgagtcgtgtcaagccatgcattatgtagagattatggcaggagttgaaaggtctgaggagttaaagcaagacctaagaaccaatgacgacaattga

SEQ ID NO: 78036 - DNA, 444 bp, Glycine max
  Peptide Sequence Number=SeqID_194814
atggatattttaggacccttccctaaggctccggggcaaagaaattttctaccggtatccattgattattttaccaagttggtagaggccaaacccctcgcaagaatcacgactcaaaatgtacaaagtttatggttaactaacaaaaagctaaacgagtttatggatggtctcgacatcaagtatagagtgatttccatagagcacactcaagcaaacgaccatgccaaaatggctaacaagataccatttcggctcatgtacgggacgaatgctatggtcccaacagaagtaggggaaatatcactaaggcgacaaaatttcatagaggtcgagaacaatgaagcattacaggaagatctagacctcgtagaacaagtgcgagaaaatacaatcatcatagtcaaagcttgcaagcagtacatggcttggcgttttaactaa

SEQ ID NO: 78037 - DNA, 246 bp, Glycine max
  Peptide Sequence Number=SeqID_194815
atgcaaaggaaatcaaaagctgagcgagtaggaagcaaaacaaaaacccaaaccgaaaaaggaaaacagagaatgagcaatgttcaaatcgataactctgaagccattctccgagtcgtttcaataatttttgttaaaggaatgaacatggaatatttgccaaagaagtggtttgtggagaataaatgttgcagtgacacagtggttagtgaaaatgttgaagtggcggaatacggaggggtttga

SEQ ID NO: 78038 - DNA, 132 bp, Glycine max
  Peptide Sequence Number=SeqID_194816
atggaaaaaagcaaaacacgtggaaagcgagaaggctcgagaacgcttccagactccacgggagctagaaaagaggggagaatgaaagattggagagtgctgacactaaggaagagagaagtggtctgttaa

SEQ ID NO: 78039 - DNA, 231 bp, Glycine max
  Peptide Sequence Number=SeqID_194817
atggcacttcctgatggagtagagagggatgcagtgctaggagaggaaagcaaagtaggcattcgaagggtcattgacgagcgtgatgggaaggaggcagtgaatggcaaagataagggttggggaggcacgaaaggtggaaagagggcatctgaggttgttgaaggggtctgtgtggatgtaaatgttgaggaggttgggaggggtggaagagaagaatttgtcccataa

SEQ ID NO: 78040 - DNA, 1842 bp, Glycine max
  Peptide Sequence Number=SeqID_194818
atggacctgctttttccaatggggcagctaaagggagggccaagccattcaatccaaattcatgctttgttccaaatggatacccatctgcgtattattatggaggtaagatatatgaaccttgatggagggatggctcaaggtgtttatggggatagctgctcttacatgtaccatcaaggttatggttatacaccatatggaacatatgcaccgcccaattcgtcttctccaatgattcaacaagatggccagcattatgggctgcaacagtaccagtatccttgttcttattacaaatctccagcttctgctgatgtgtcatttactccaaacaaaatcagtgttccacaaggagaaatatcaactgctgttgatgctgatcgtgttgcttcatcaaatgttatgaataaaggacacactgttaacatggccaatagtgattttactaataaaaatgggtttaatccatttttaactagttcccagcacacatctttgaatacaaatgattcttatcaagggactagcttgccagcttatgcttctttgtcaggctatcagggtccaagaagcacccatggtacacagctgccagtcccttcagatgtgtccttagtatctgatagacagtccaaacatggagccaaggttggcttatcttcatcagtagtgcctgtgaaagattttacatctcaaaggaatcaaagacttcctcagccacttccacaatacgtgagcatgagtggttccagacatccatctggacttgacctggtttctggattcatgaatgggatgtatccaagcaacaggatgtacagccaatatggaaacacatttaggcctgattctcgttttggatctgctgggtatggatctagaatgggttctttcgatagcaaatttaatggcacagggtatggctgcggtttaaaaaaaagcatggatggtttcagcgagctaaataagggacccagagctgccaagagttctgataataaaaatatcaaaagtcttggacctgtcacattattactcaaaggacagaaccttccagtgaagagtgataacaaagaagttcctccagttcctgacaaggaacagtacaatgggaaagattttgctgagaattattctgatgcaaagttttttgtcatcaaatcctatagtgaggatgatattcataaaagcataaaatatagcgcatgggcaagcacccctaacggcaataaaaagctggatgcagcatatcaggaagccaaggagaagcccggtggctgtcccatatttttgttattttcggtcaacactagtgggcagtttgttggtttagcagagatgttgggtcctgttgattttggtaaaactgtagattattggcagcaggacaggtggactggttgtttttctgtgaagtggcacgtcataaaggatattccaaatagcgtgttgaggcacataacgcttgaaaacaatgaaaacaaacctgtaacaaatagcagggatactcaggaggttaagtttgagaagggtgttcaaattgccaaaattttcaaggagcattcaagccaaacatgcatcttggatgattttgggttctatgaggctcgtgaaaaggcgactcaggagaaaaagtccaaggaacagcagttaccaaaacaggtcagcaagcccagtgatttcacatttgggacagttacatttccaaagtctcttgatgcaaccttgatgaatgaagctgctactgcaaatgcagcagagggaagaatgaatgcagaagggctggtagaagggaatggatcgaccccaacacttggagattcttccaagagctgttaa

SEQ ID NO: 78041 - DNA, 324 bp, Glycine max
  Peptide Sequence Number=SeqID_194819
atgccatttacgacttatgataaaggttgggttgtgctagagagaaaaacaaatgaccaaagtgaacaaagagccatttctaggagttttctgcctttgccctgttttcttggctgtgatggtttgtgttgtttgaatgtgtattacttggatgttggggaagcttgggaggatgatggggaccaggtgttgagagaaacgaggatatgggctacgtgggagtacgtgagctcagttggaggtgggcaacaggggatggtgggtttatgcgcgatttgtggatgtggaaaacttgttgtgcaccatcgcctgaccgccacctag

SEQ ID NO: 78042 - DNA, 165 bp, Glycine max
  Peptide Sequence Number=SeqID_194820
atgtacggagggagtttggagaagggggaaatgtcggggtccttggaggttcagagggcgaggacgatgatgttggtgtcgctaacgagagaaagttgtgatttggatcttaacgtcctcaccgctgcaacgattcgactaaaactaagagcatctccaatgtaa

SEQ ID NO: 78043 - DNA, 1767 bp, Glycine max
  Peptide Sequence Number=SeqID_194821
atgggtaggagtctcagccctttggtgaggcaagagctggcaaatcttgagaaagatgaagatagccgcaaatccgccatgaaggcgttgaaatcctatgtgaaagatttggattataaggccattcctttctttcttgcaaaggtttctgagagcaaggaaaattgttcaggggagttcacaatttcaatctatgaagttcttgcacgggttcacggtgtcaaaattgttcccttgatagacagcatcatgagaactatagtcaagactttggcttcaagtgcagggtccttccctctccaacaggcttgctcaaaggtggttcctgcaattgcaagatatggaattgacccctcaaccccagaagataaaaagaggcacattattcagtccctttgcacgcctctttctgattccctttcgagttctcaggagagtcttacttcgggtgctgctctttgcttgaaggctctggtggattctgaaaattggaggtttgcttcagatgagttggtcaatagggtttgccagaatgttgctgtggcattagatggaaagtctggtcaaaccaactcacacatgggcctagttatgtcgttggccaagcgcaatgctttgatcattgaagcgtatgcaaggttgctagtacaatctggaataagaatactgaatgctggccttgtggaggggaattctcagaaaaggctttcatccattcagatgatcaactacttgatgagaagtttggactctagaagcatattctcagagattgaattgataattgaggagatggacaagtgccaatctgataaaatggcatttgtgcaaggtgcggcacttgaggctttgcaaactgccaagagaattgcaagtgataaaaaaccaagatatgctaaaagtcctgcttcagtgacaggatcaaactttagtaggagagaagaagactatatggagggagagaatacttcttctggtgaaggagaacatactccttcctctcttacaccagaatcgagtacattcgactttttctctggatatgaatctgttgggtctcctatttcaagcaacttagactatggacaaagaagcgtgactaggaagctttggagtaatgaaaacggaggggttgatgtttctctgaaggatggcttgttttcacaagtaggaaaagaaggtgctttgttagagcattcattgattcacgagttttctaatggagagggagactatacagaggagtttgctggtttcatgggcagaaataccaggcatggagtatccaaaagtaccaccacaagtccactaaggtcacacactcaggcaactgttgacagcataaaaatctttgagacccctaggaagctcatccactctcttcaagattcaagtgatgtgtctttgggttgctctaggaagcagaatagaaggtatagaagtctatcctcagacaacattgagtggagtccagcttctaaatacgaccaaaacggttttgcagatgacacgaacaagtgtgacagtgaagtaattgaaggttgtgctgaggttgagttccaaggtagctcagagtcagtctcatcaacagatgacattcctgcagatgccgataagcagatgcataccgaagtggttcctgtaaacagaaatgctaagactacatataaattggtttgtggtctttcatgtgttctacttgcagtggccactccattgctttggatcaatagtcaggatgaaggtcattatcttgtgccaacataa

SEQ ID NO: 78044 - DNA, 525 bp, Glycine max
  Peptide Sequence Number=SeqID_194822
atgtatgttagacaacctcctagctttgaggatcatacacttccagaccatgcttttgaaatttccaaaggctatgtatggtctaaaacaggcaccccatgcttgttttatgagaggcaaagtagacacaactcttttcagaagagaagttgtcaaggatgcgttatagttcaaatatatgttgatgatattatctttggagctactaatgaatcttcgtgcaaagatttctctgatcttatgaagagtgagtttgaagtgagcatgatgagagaacttaagttctttttagggcttcaaatcaagcaagacaataagggtatctatatccaccaacaaaaatacactaaggaacttctaaagaagtttaaaatggaaaatgctaagcctatgaaaactccatcgcatgcttccaatcctctaagcaaagatgaatcaggagatagagtagaaaggaagagcacaagtggaggatgtcactatattggaccatgtcgggttgttgttcacaactgttatgggtaa

SEQ ID NO: 78045 - DNA, 567 bp, Glycine max
  Peptide Sequence Number=SeqID_194823
atgaatggtagcaaaagagaatttctaaggtatattagaggtacaattaactatggtatttctactgccaaataccatcacgagttcaaacatgggaactgggttggctatactgactcagcctggaaaagagacaatgatgatagaaagagcactgctggatatattttcctacttggagatgcactggtgtcatggagttcaaagaagcaagattcggttgccttatcaacttgtgaagctgaatacatagcagcatcaatgtgctcgtgtcaaggcttatggctaagaaaattgttgaaagaaatgaagatccagaagactgaagttataaacatactggtggacaacaaatctgcaatcagccttgctaaaaatccaattcatcatggtggaagcaaacacatagaaactaggtaccattttattcgggacaaggtgagcaaagggaaggtaaaactgctatactgcaagtcagaagataatcttgcagatttactgaccaaacctttgaagaagaacagatttgaagacttgagaaacaagatgatgatcatgattgaatga

SEQ ID NO: 78046 - DNA, 156 bp, Glycine max
  Peptide Sequence Number=SeqID_194824
atgaaggtaaaggtagcggtgttcagtgttgcggtgatcgtcatcggcatacgagttgatcgtgcggatcaagtagctttacgaatcaacttgatccgcagaagatttgcggagaagaagaagcggctgggtgttgggtgtagagtttttaaataa

SEQ ID NO: 78047 - DNA, 732 bp, Glycine max
  Peptide Sequence Number=SeqID_194825
atggtgaaggacatagaaactgcacaccacctgtttgaggaaattccaaatgaagatttagtggcttggaactctatcatagactgtcatatgcattgtggaaactataaacaagctcaccatctgttttgcagaatggtgcagaatggattgcagcccaatgacgccactctggtggtgaccctctcggctgtggtgcaggggaagaagcctaccattagcagtatgaaagggaagaatctgatttcgtggaatgtcatgattatcaggctggcatcgcatggtaatggagaagaggcgttagcgatttttgcaaagatgttacagcagaatgtggagagaccgaatgatgttacattcttggggatgttaagtgcttgtagccatggaggattggttgataaaagtagacgatgtattgatattatgggcattgactataacatccaatccacaataaagcactatgggtgcgtggtggaccttttgggtcgagctggtttaattgaagatgcatataatttgataatgaacatgccagttgagtgcaatgcagttgtgaggaaatatctgttggaattagaaccggagcataacagtaactatgttcttgttgcaaacatgtatgcaagtaccggtcaatggaaagaaatgagcaaagaaagaagatcaatgcagcaaaggagagttcagaaaccagagcctgcaaatagcttcatcggagttacttaa

SEQ ID NO: 78048 - DNA, 1353 bp, Glycine max
  Peptide Sequence Number=SeqID_194826
atggcttccaatggtccttttccctcaaatcttccaattctaaccggcaagaacttcaacagatggagtgtgcaaatgaaagccttgcttggatttcaagatttgaccgatgtgattgagaatggaatagaaattcctaaagaaggagcctcagattcacagaagactgaattcaaggatctgaagaagaaagactgcaaagccttggtgatcttgcatcaatgtgtcgatgattctcactttgagaaaatcgcaaatgctaaatccgcaaaggaagcatgggacattctgaacaaggcttatgcaggagctgataagatcaagaaggtgagacttcagactcttcaaaggcaatttgaattgctgcagatagaagagactgagagcattggagataactttggaagattgcaggttcttgcaaattcaatcactagttgtggtgatacaattactaatctgacgttagttgagaaagttctgaggaccctgaatccaagattcaatcacattatggttgcaattgaggaatcaaaggacttggaatcattatctgttgatgaattacaaggatcacttgaggcacatgaacaaagattgcaagaaagagcaaatgataaggctacagaacaagccctgcaagcacaccatcattcaagaaatggtggttctgataatcacagaggcaagaaaggaagagggagattccagaacacaagaggtagaggaggttactccaaagataaaggtaaacctcaacctgatcaaagaagtggagataactgtagtaaaagaagtggtggttctggtacttgtggaagaggaggcaaaaagaaatgggataaaagaaatgttgaatgcttcaattgtggaaaaagaggtcactatgcagaagaatgctggtataaggagaaaaatgttgatgatgaagcacaattagccacaggagttgtttctgacactaaaccaatgttgttgatggtcacaacaaagactagagctgatgcagaagatcaatggtacttgggcacaggatgttcaacacatatgactagtcacaaggactggtttgttagccttgatgagtcaataaatcacaaggtcaaatttgcatatgaaaacactataagagttgaaggtcatggcaaggttgtgattaaaagaagggatggtacagtgtcatacattgaggatgtgctctatgttccaaacatgagatgcaatcttctgagtcttggccaactacttgaaaagaaatatagaatggtgatggaggacaaagaaatgaagatctatgacaaggacagaaggttgatcatcaaagctccattgaacaggaatagaacttttaag

SEQ ID NO: 78049 - DNA, 459 bp, Glycine max
  Peptide Sequence Number=SeqID_194827
atggagccggaattttgggacaaaaatcccttcaaggcgactgctaaggcattcccacaaggtttccatttcagacctacgtccataagtaaaacaagaaaattttacgaatttatattgatagacacaaactcagtgtctattaaacacttcaaagaccccaaggatccaaatctgaacacacattcaactatccaaattatgaaggttttacaaccccgacattttgggtcaaatttgaatcaacccaagaaattttctgctccatttgacccagtaggttacacctattgggactacaatgatgcttggaccaatatatgggaagaccgaatgcaacaagcatttcccactattacagagacatgcattcatcaaatggtggaatcaattttgacacctctaaagcagcgccagaccaagttaaaatctggttctaagctcacccataatttttga

SEQ ID NO: 78050 - DNA, 762 bp, Glycine max
  Peptide Sequence Number=SeqID_194828
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcggtgctcgcgggaggtcagcatacaccccgcgcagcaacattgttacatgtttgcgttgggaaacgatgtgtgacacccaggcaggcgtgccctccgcctaa

SEQ ID NO: 78051 - DNA, 114 bp, Glycine max
  Peptide Sequence Number=SeqID_194829
atgctagatacactagtcctattggcgaaacccatgctgaatgatggatatgagctacacagcttgaaaggcgaggattctggcaaaatagatatcattgttaatactgtgtga

SEQ ID NO: 78052 - DNA, 201 bp, Glycine max
  Peptide Sequence Number=SeqID_194830
atgtttatttctgttgcgattaaacagtacagatccgacgatgagtccggtgaagcaagtcaagccgaggatggagaagatgaagatatggggtattcccctgagctagaaaggatggtcgctcaggaagatcgagagatgaagtcgcaccgagaagaaacgaaaatcataaacttgggtgttggcaaggaaaggaaacag

SEQ ID NO: 78053 - DNA, 201 bp, Glycine max
  Peptide Sequence Number=SeqID_194831
atgtgggatcggtacaggcttaaaggagcactcaaatcgggtgtatttacccctaaggcctacactccgaagattccatcaaggcctctccctcctgattcagcgcttgtgattaaactcatcgggtcccctcaacggatcccatcacaatacttgtcgcgcaaaaattcatcacccttaaagggtcttacaattgtgtga

SEQ ID NO: 78054 - DNA, 718 bp, Glycine max
  Peptide Sequence Number=SeqID_194832
atggcaattgcacgcactggagtctacgtcgacgactatttggagtacgcgagcacattacccgctgaacttcagagactgctcaacactgtccgggaacttgatgatcgatcccaatctatgataacgcagaccaggcagcagacgaagtacactatggggttctcatcacatggctccaagaagggtaatcacagttataataacaattatgggaatgaggacgatgatgcagctattgagaaaatgcggaaagaaatcgaggtgaatcaggatagtgcattgagtctttgtactgagaaggttttgttggcaagacaagcatatgacttgggtaaaatagcaccagatgaaccagcaattctgcccccattgcctatagtccctaaagctgaaaagcgcaagcccatatatataactcctcaatcaaagagaattgattacagggaaagagattgggatagggagcgtgatagggacttcgagctaatgcctccaccaggaagtcataaaaaggagtatgctaccccgatggatgttgatcaacccattgatccaaatgaacctacatactgtgtttgtcatcagtggaatgatggttgtggcaacaacaatgtggtggggtggaataatggtaacaatgacgacaataacgatggaggcagagacaacggtggtggtatagcaacaatggggtgtggtggcaatggcgatggag

SEQ ID NO: 78055 - DNA, 342 bp, Glycine max
  Peptide Sequence Number=SeqID_194833
atggtggaaatcggtgcaggaaaaatgaagcccgaagatctgagaaaagttattgaaaataaaaaccgtaattcggccggcacttctgctccggcacaaggattatttctcgtagatgttgcgtttttattttgctatggtttctatatcgcacttactaacccaggttctttacaggataacgattataccggatatagccttgtgaatgtaataagctggctatgtgcaatagttgttgtgtggggaatttaccagtttcttgaaaaaaagtttacaaaagaaaccatccataaaccaagcctggaaattgaagagatagggagtaaggaaaatgcataa

SEQ ID NO: 78056 - DNA, 894 bp, Glycine max
  Peptide Sequence Number=SeqID_194834
atggcacagttcaccacgcagggtcgcctgaagctgctcttgaatggggagggtgtgtcttctgttttggagcacaaggacccttttctctacaagtgcagatcagttcagacccacaagagaagaacaaggtacgcaggttcttctgccagaatttactatgcatcaacatcatctctgagtagcaaaagccaccgttgtaatgcggaggcacgtcacacttctggcaatgggagtgttcatgatgaatatgatgacattgatgatgatgaggatgaggatgatgaggaggaggaggaggaggatgtgtttgaccgagatggcttgtcttgtttccggggtttggtgttggacatagcttacagactggctgactgggttaatcccatcactcctgcggatccagtctttgccaaggctgaatctcagtcccacgttcattgttcctcggacttggccttatttgctgtttctcctgggaatttatggccaacctttgaagtctcatcaccagaattcatctttgttgttttctttgttccaaaaagttttgtggaagcactgttcacagtacttgcttttgatcacattgctagtaatccttctgttttctcaaatttttcatccaccaaatctcctcatttcattacccttggtgatggttcaaaggctaaagccattggaattgatcaagctgtgactgcttgtgccaaatgcaactgcaaaaagggtagaaaaactttagaggaagcaaaaatgaagttgattaagcccccaaaggttccaaaggactatgacattcttgccatacctctaactgctgcagctctaaggatgctgacaataagaaagggaacacctgaagaatggcgtcagtatctaaggtctccttga

SEQ ID NO: 78057 - DNA, 562 bp, Glycine max
  Peptide Sequence Number=SeqID_194835
atggaggctggatctttgagcttcaatgaggaagaaggagcttcaccaccaagaattgccttggataagaagcttgaagaggatgctttaatggaggaaaagaaagagagaaggggggagcacgaaattgaaggaataaaagagggagagaagtggaactttaaagtagcttccttgagaagctttcttgagaaaacttccttgagaagcttctttgagaaaacttccttgagaagcttcttggacactcacgacactcttgttgttagttctaatgccaagagcattaataaagaatcaaatgaccctaaaatgcctatttcgacactagaggtgaggaaggcaacaaagaagaatgatgaagaagagaaagatgatgctcaaagccataatgaatcatctccatcgaaacaacaatctcaacaagaaccaattattgaagaaaataatgctctaaccatatgggatgaacataggcttaaaggagcactcaaatcgggtgtatttaaccccaaggcctacactccgaagagtccgtcaagacctctccctcctgattcag

SEQ ID NO: 78058 - DNA, 768 bp, Glycine max
  Peptide Sequence Number=SeqID_194836
atggaagggaatctatactctattgtcaatggtgcagagatgatcattgacactgaagtttggaaaaaagttgcagggataaacatggatggagtctgcaaatttgaggaatcaatggatggctacaacaagatgaagactaatagaggtatgctccttgacctattaaggattttaagaaaccaactaggtgttggtggtctgatagctgaagatagaatattggtatatagcatacatatattctatcaccaaggtccagcaatcatgctcaggttgaaaccaggtattcaaaggaattggatactattgattaaagatattatgttgaaaagtcatcaactagtggattatgaattcccatatgctatcttagcttctagattcattaattacttcaatatcgatgttgataatgagatagaaaaatttaccaaagcctctaatgagataaccgaaaggcatctcaagaaccttggcatgacatatgttgatcatgaacagatcatagccagaaagccaccaacagaagcaaatgaaaatcaaatggaagaagaagctaaaggagaagctcaacgaaatccagctcatcaatggaacccttttgagtctcttatgattcataagttgaatgttatccttcatcaacatcaagaacaccaagccgaagttcatagctccttagaaaacattacaactaggtctgggaacatagaaactaggctatcccttagtaacctcctgaacccggatgaggatgaagcatag

SEQ ID NO: 78059 - DNA, 240 bp, Glycine max
  Peptide Sequence Number=SeqID_194837
atggcttcctatggtggtgagcttgttcttaactcatcttctccttcaagtggtgtctccaatcatctttcttccttctctatttcgctgccaataatcttcaagaagcaaaggactccattgatgaagaagatccaaggcctacaagctctacttggagctacatcatgtggtatcagagcatcttcatctaggttctatcatttttttagtcataatcttcttgtgcttaacctttag

SEQ ID NO: 78060 - DNA, 213 bp, Glycine max
  Peptide Sequence Number=SeqID_194838
atgattatgcagaatccctctttcagaaaatggtgcggggcagaaagagatgagcttgattttgagtttttggggaacaaaacaggagagccttatttgattcagactaatgtatacaagaatggaactcgtgggcgtaatatgaggcacatgctttggtttgaccccgcagaggactaccacacctattccattcagcaagaattagaatga

SEQ ID NO: 78061 - DNA, 324 bp, Glycine max
  Peptide Sequence Number=SeqID_194839
atggtgggtgaggtgcggctacgcagaccaccggaagcacttcgatgctggttagccaacttttcctcctgtgggagtgggagggttttggtggctggtttccaacgccgtgatgcgttggaggagttcatccagttttgtggtggtgtgaagctgattggaggcaagcttggatatggcttcctccatatgttccagctcagcagccttgtccctagttggttacgaaatcctttaggtgttgaggacgagtgctctaccttttgctcctcaggtgagtgttcattccctcttggtttggctggtctggtagctgattcataa

SEQ ID NO: 78062 - DNA, 1266 bp, Glycine max
  Peptide Sequence Number=SeqID_194840
atgaagctcccaaacaagattaagttggatgacttcctagagagatacaaccaccaatcaagagagcagggacatatctcacaacgttctcagcggaaacctccaatatctcgcgggcctgcaaaatctcgtggtgctgaacatctcgtacaacaaattcacgggacgcgttccggacatgccgttcttcgtgaagctaccgctgagcgtgctggcggggaacccggagctgtgcttcttcggcaacaagtgcggcggcagagggaagtcggagcggtaggcgagggtggcgcgcgtggcaatggtggttctgctttgcatagtgttcatgctgctaatggcgacgctgtatatggtggtggcaacaaaactacgaggggaccgccaaaacgacgtggaggtggatggaaaggacaacaacgcggacatggctccaccttgggaaaaaatcctcccgaagctagggttacatatagaggggaatgcagttcagagagaaaacggaagacgaagaatagtgcgatgtggtctaagagaacgagaacgcgagagatagtgtgtcataaatgggctgaaaacaatgacgtttttacttataaacccgtcgtggctttgaagttgagctttagggcttgctctagagtgatagagcctttgaggatgattcatgccctgcttcctttcacgttggacgtcgtcaatgtagaggctccaccagtctgggggcttcttggggtcatggagtatgcgactagtgaagtagatggggagctgaactacctagacattggtaggattgtgaatcttgagtatggttgtgcatttgtcggggagcatgttgtattttcggatttctctgaatacttctttcaggtctacaacatgttgggctatgctatgagggtatgtatccttggggcacaccctgttcaaatcgatgtagtcgatgcatatttgccattttccattggccttttttaccatgacgacattggcaagtcaggtgtaatacctaacttctttgatgaagttggctttgaggagcttgacatcagctatgcgtctgtgctcatggctggtgaggtccttgctgagctacgtgcactgctcggatttgggttcgagctgcaacttgacgagttcttcaataggctttgggcctctattagaagtgtcgttgcatggatctacatcgaatatgttgtccaggcttgcttggtagacaatcaaggcacgaatctatcttttcttctgtctgcgttgtga

SEQ ID NO: 78063 - DNA, 432 bp, Glycine max
  Peptide Sequence Number=SeqID_194841
atgcattcttctatgcctggatcattagtgatatggtatgacagtgttacacttgatggtaaattgaattggcaagatcaagtaaatgaacataataagccgttctttgatatatgtgatggaatatttgtgaactatacatggaaggaagactatccaaggctctctgttgctgttgctggtgattggaagtttgatgtgtacatgggcattgattattctagacattttaatcatcagaacattggtttcattctggttattgcagaacatatatgcactttaatgttcaaatggccttcagagaagtttcttactacatgtagaacccgttcccttggtgaagcatccaacttgcctgtaactagatatactttcactaaaaagataattatcacttggtctcgtaaactttgtagtaccagccagtag

SEQ ID NO: 78064 - DNA, 579 bp, Glycine max
  Peptide Sequence Number=SeqID_194842
atgaacatttaccccttcttaagtctttatggtaacgatgattttcctttcaactacgccttcttcgatggtgtagacaatccggaaaacgataacgttgggtttggggacctgcctattttggtgggagaagtaggatggcctactgaaggggacaagaatgccaacacaggcaatgctttgagattctataatggtcttctgccgaggcttgcagcaaatcgaggcaccccgcgccgccctggatacattgaagtttatctattcggattcatcgatgaggatgccaagagcattgctccgggaaacttagaacgccattgggggacattcagatacgatggacaacctaagtttccaatggacctttctggtcagaaccaaaacaaatttctcgtaggtacacagaatgtgaattatcttgctcataggtggtgcatgtttaatcctgatgccaaggatctcagcaaacttccagataacactaactatgcttgcacctttggattgcacggcgcttggatacggttgttcttgcaacaatttggatttgaatgggaacgcctcttatgcgtttaa

SEQ ID NO: 78065 - DNA, 456 bp, Glycine max
  Peptide Sequence Number=SeqID_194843
atgacacgtcgtagggatttcgtaaaggatatcgataactcaaacgataccttgaagcttgccgttagaatcatagacctgtggtttgttgaaactaaagataaatctgaacaagatgccactggtgttgttcatgagttgacatcacaacatgttttaagtagtcccaagagggtcctctttaccatgaaagatctgaggtataagctagaagtgatggtgtatcgcaaggaacaaagttccaattttgtactctgggaccatgagtgcatagaacttttagggaaatctgcacaagaattaaacaacatgatgtttgttggtggtgataaaagtgttaatgtgttcctagatccactcgacaatcttttgggttgtactcttgcatttaaaatcaaggtccagtccaaatacaaagttcatctgtggaaaaaatatctgatgatcctacactaa

SEQ ID NO: 78066 - DNA, 615 bp, Glycine max
  Peptide Sequence Number=SeqID_194844
atggagcgacgccataaggaggagctcagaaagctaaaggctgaccacaatcagctcgaggctcatgtgaaatgcccccaaggcgacgaacactccactcacacattacttgagcgcactcaaggggaatcacacccccgacgcaaacgtttcaatgcgcaatatacaaccagccggtcacaccgtatgacatttgtcgcactagccaatttgcgacaaaaagatgatgaatctcttttgaaattcatggataggtttggacgcattattgtacaaatccaaaatctcgacctaaaggtaacattacactctatgctcctcacactacgacatgaacgagccaaaaactacatccagatggaagagatgtctagatttaggaacgaggtctggctagccgaacaaaagcttgacaagcgagaaggaaataccaagaacgactcatacaagtcagacaagacgcataaaccgtataagcaccagctctcccgaaagggcccagttacgagcgttacataccctcaacgaccaatcgcactacaatccttgagaaggctttcaagttggaggtacctatcaagctacctccgccgcttcctcctaggccagggttag

SEQ ID NO: 78067 - DNA, 324 bp, Glycine max
  Peptide Sequence Number=SeqID_194845
atgttcaaatccttaaagacaagcactaaccggatggagaatgaagaacaactgaagaatggacgtagaatggtgaagaacgatcacagaatcgatcacgaaaatgtctcggaagcgccttggcctcgttttttcttcatttttctccttcatctcactaatttcactgaaaatctcttaatatatgatgctgaccctttctcctcagccccctcacgcctatttataggaaatgaggaagggaggtggcacaacagctcacccaggcgagctggttacttcagccctaagctttctggtggcctaggcgagctaggggcctga

SEQ ID NO: 78068 - DNA, 795 bp, Glycine max
  Peptide Sequence Number=SeqID_194846
atggaaggagcgccgtcagaggaaagcatcacgcctttcatcgcccagggttttagtgaccccaatgcgagagtacttcaaggagtccgcatggcatggggtgcagtgcaaagtaaagataaggagcttaggggaagcagcaacgggatcgtcggcggctatcataagtggctgagagtccgaacgcaagagttggattggctcccaaagctaaaagctgcaagagaggaagaggctgaaacttcgaaggagagtgaggaagtgcaaaccctaaatgcggaacttgaaagagcccaagtagtaaaagagaagttcaagtcaacagccatcaaagttcgaaaagagtacaatgaactaagggacatcaatatgaccacaaccgaagccttggaacgagaaaccaagagaggatcagtcgcgggtcgaaggcatgatcttgaaagaagagttaaaggcttgccaaaggttgaaaagaagcttgtccaagcatacaaggaaaagctaagcctagcagcgactcatgagcaaaggctagaggacgagtacgccaaggtatcagtcctgcaagcggagagggaagcaagggaaagggtgatcgattcattgcacagagaagcaatgatgtggatggacaggttcacctttactttgaatgggagtcaagagcttccccgactgctagccgaggtcaaggcaatggcggatgtgtactcagctcccgaggaggttcacgggctcctcgattattaccaacacatgattgatctgatggcccacataattaggagccgctaa

SEQ ID NO: 78069 - DNA, 219 bp, Glycine max
  Peptide Sequence Number=SeqID_194847
atgtttgggataactctctttggtaaaagagcgatcggccagtttcagcaaataaatattgtcgtagcgattgagcagctgccacaccagttttatttttttcatcaaaccggagcgatgatcttcgatataccagatgtgctccagcgtggcgtcacgttcagccagcggggcgacactatagctcagcagggcatcgctttttcccaggtgggataa

SEQ ID NO: 78070 - DNA, 796 bp, Glycine max
  Peptide Sequence Number=SeqID_194848
atgccgttggccacgacggtccacagcagcgagaccagcggcagcagcgcgatcaggaaagcggtggccacgagagccgtcatgagccggtcgacggccttgcggcggctctccgcgatcgaggagatcacggtgacgatcaccatgtacagcaggatgccgacgatgacggtgcccgcgatgttgaagtcggcgagcggcgtgtcggagcccgcggcggcgacgccgaagaccgctgcggagaccacgaaggagacaccgagcagagcccagggcgcccatttcggcaggcggccggaagtgagggccgtggtgctcgcgctggacggagcggtggtgagggcggtcatgtcagttcgctcccgagaactcggcgcggcgggcgacgatccagcgcgccagcgcgttgaccgcgaaggtcacgacgaagaggatgaggccggtcgcgatgagggtgttcacgccggtgccgtgcgcctcggggaaggcgagggcgatgttcgcggggatgggggtcgggttcgtggccgtgaggacgaggaagctgaccaccgccgagggggagagcaccatcgtcacggccatcgtctcgccgagcgcgcggcccagggccagcatcgctgccgacaccatgccgccgcgcgcgaaggggagcacggccatgcggaccatctcccagcgcgtcgaaccgagtgccagggcggcctcctcgtggagcttcggcgtctgcaggaagacctcgcggcagatggcggtcatgatcgggatgcacatgacggcgaggacgagcgccgcg

SEQ ID NO: 78071 - DNA, 285 bp, Glycine max
  Peptide Sequence Number=SeqID_194849
atgaagtctttgaatggttttgatgggtctgtggggtcttctcaaggctgtatgttagagcgtgagatccagctaattggggattcttcatcttcaatgtcttcctctaaaagtttgtcatcttcaaaggtcagggtacttgacaaggtaacttatgttgtagaggatgaagatggcatcaaggccaaggttgtagcagtaagagaaagatgtgaaatcctcccaagtattgtgttaagtaattgtcgtagcctatctcacgatgggacggcgaaaacaaaataa

SEQ ID NO: 78072 - DNA, 742 bp, Glycine max
  Peptide Sequence Number=SeqID_194850
ccttcttttggctcatgaagcttgcctgaacaagttcaacaagcaatcactctcttattctccttcgattaactatatgcaagcgcacaacaaatccttctcatcgcatggatctgatggttatatggtgccaaacaagtcctttttgcattcagatcctgagagtttttctaattctcgtggtggtggttttaacaaccgcggtggtggctggtgcgacggcaccggcggaggaggccggggtcgtggttggtttgctaactttcagtgccaagtctgcctgaagtatggtcacactacctcagtctgtcattatcgacacgagcaacattatcaaccaaattcaactttggtgcttcaggatcctactactatgcgagtccgtctcagaattctggttatcggcaaattaattctaattctgggtagcagaatggtgataatcgtcttgctaatgttcgaggcttcttttcatgttactggagaatctcagaacattcagcagatagaaccttttgaaggtcttgatcagatcttcattggcaatggtcaaggtctgaagattacttcctcaaattcttcttccttcatttccccttacacaagtccaaaggacaatgcagttttctttgagttttactctaattattgtgttgtgaaatctcagtttaccaatgaggtcttactacaaggcactgttggtcctgatggtctctacagtttctccaacattcagttttag

SEQ ID NO: 78073 - DNA, 207 bp, Glycine max
  Peptide Sequence Number=SeqID_194851
atgggattgtcacgtggcatcacctcatacaataaagatgatttggtagcagtggcgggtgataaatgcatgaaggtggtggagaatcaaaaggaagcaataggttatgaacatgcatttgttcgagcaaaagcaattaaagggttgattgaacttgttgatggaaatgttgactcatgttgtactaaaggtctatttgttcattaa

SEQ ID NO: 78074 - DNA, 618 bp, Glycine max
  Peptide Sequence Number=SeqID_194852
atgaattggattttagatctcatcagtgtcttttcctgggatattctacctctcataagggatataaatgtttgtctccttctggcagaatttatatttctaaaggtgttctttttaatgagtcttaagtttccatgtgctgacttatttgagtcatctccttctcttagtcagtcttcttcatcccctactaattttaatttctcctcaattcctatcattgctactaatcagccccctgtgtctcctttgcacacaaaaacatctattggcagttcttcctcctcatttcaatctgctacccttgttcagtctcctattcctccgattcagtctcctattccttctgttcagtcagattctgacctacctcaatctgatcctgttcagctctcaaattctgttcagtcagacttacctcagtctgtttctgttccgtcctctaattctgaacagacaaatcaacctattgtctcaaatacagaatcctcatcctcaaccactaactcctctcctcctcctagatcatatccaatatttaccctatgcaaaccagatctaaatctggtattcacttacccaggattaatccttcacttctgctggcagctgtcataa

SEQ ID NO: 78075 - DNA, 435 bp, Glycine max
  Peptide Sequence Number=SeqID_194853
atggtggcacaaagcaacgcgtctcttactccttttcctcattcaattgctcataagcttgatgatttgactttccttttatggtgtcaacaagctgagccagttaccaaatcacatcgccttcaacgtttcgttgtcaatcctcaaattcctctccatttcctttctaaagaagatcgtgaagctggaatagagaaccctgcatataaagcatgggaacagctagatcaagtgctgcttacttggctccaagcatgtcaactgcaaactcagctacgagctacgaatcttgtcggaaaatcgatgggcgagtttttgtcgcagatcaaagctctttctgatgctcttgcctccatcggaagtctgattatgcttcaggaacacattgactccatttttgaaggccatccatcagacatcactccatcattgtga

SEQ ID NO: 78076 - DNA, 228 bp, Glycine max
  Peptide Sequence Number=SeqID_194854
atggcgatggtggtgatgctagtaccagcaacagcagtagagataccagtggtagttgagatggtagtggcgatgccgatggtggtagctagtggtggcagcagtgatagtgatagtaatgtcgatggtgatggcagtagcaatgctggtggtggcagcaacaagtggtggcggtgtggtgttgttggtggtggtggttgcgacgacactggtggtggttatggttga

SEQ ID NO: 78077 - DNA, 549 bp, Glycine max
  Peptide Sequence Number=SeqID_194855
atgggtgttgaactcaataatagtgacgtcgatggaggtggtattgttgttgttggtggtggtagcaatgtcaatggcggcggtgatgttgatggaaatgatggtggcagcgacaatggtggtttttgtagtggcgattatgaaggtagtggtgttggtggtgaaaatgatggcggtagtggcattggcattggtggtaacaatgttgatggtgatcttgttagcgatggtggtggtggtagaagtggtggtggtgataatgacgataacattgatggttgtgatggcaatcttgttggcgatggtggtggtgcaatgttggtggcgatggtggtggtggtagaaacaactaattatgatggtggcaacaacaatggtgatggtgatggtgctgtagtggtgacgatgacggaggtggtggtggtggtggtagcaaaaagtgtcattatcaaatatggaaaatgtgtttttttaactaaaaaccaaattcacaaaacattttttcttggttttgaaaacgagtgtaaaattgtttcaaaaatgatttaa

SEQ ID NO: 78078 - DNA, 366 bp, Glycine max
  Peptide Sequence Number=SeqID_194856
atggtagaaatagcggaggccatgagggagagtgtagaggccaagagggtgaatcaggtcgcgaatttgaggcgattagaaagggagaccacaaacaaactgccacacgatttccaaccatcctcgaaggccatagaggttgagccttttcaaccatactttttggtgcctaagatagaggatttccatggctccaaagatcaacgccgacgagtacctgaccctttcaacaatgccataatacaagttgaggatctgaacaactacatgtttgtagcaaccttcacaaaaggtctacgtccaggggagttcaacgagtcattgatatacaagaaaattaccaacatggacaaaatccaatcatga

SEQ ID NO: 78079 - DNA, 228 bp, Glycine max
  Peptide Sequence Number=SeqID_194857
atgtgggctatgtttggatgtgagagaagtgatagggagaacccatggaaggtgggtagcttagagagattctctgagatggttatctctatgccaagatcaggtgtggtgttgtgttgtggttatggagatgttgtgaagtccatcaaggggttgaccgttgtaaaaatccaacatgttggttgtgttagtgaaaatctcatgaatttgggtgagaactggacataa

SEQ ID NO: 78080 - DNA, 405 bp, Glycine max
  Peptide Sequence Number=SeqID_194858
atgacgccatcattgtttcgtcttctcgatacctcgcgacaaagaagccatatttggtttcgtggcctgttccctcacgacttcctccccagatttattggtgttttggttgattgcatggttctggttttggttgttttcgacaatgaaggcctcattattgtttgtttgcatggctatggttcttcattgttgtttgacaaaatgtcatttgctgtaagatggaaggatgaactagagcctacttggcatctgctacactttagtggcaacatgcactctgtcacatataaccaaaatttggtgagtcaagctctacttgttggatggataaaacttagagagttctatgggctcactgaaaatcatcaggtgacctttgaaccaaaagcttaccctaaatga

SEQ ID NO: 78081 - DNA, 740 bp, Glycine max
  Peptide Sequence Number=SeqID_194859
atggcttctttgtcgcgaggtggtgacgacgtcacagtagaacgcgggggatggcaacgagttagagttgtgagggagaggaccattgtgaggacgaacgatcctaacattgctaatgagattgagaacatgttcattcctttgtttgaggaagaagatcgtccagtttgggaaggtacattcataggaaccttgaaactgaaggaagattattctttcttgaacgggccatctcatgacatctcttgggctaagatgatttggataggaactgcagtctgttggctaaaaccttggtgtgatctttggtattgctctattgggaatgctgatcaccttatgcttcaatgtagttttgcttctaaagttagagactggttggagatcaaattgcagcataagttggaccaaaattccatgttgaacatattgggtgtcttaaattttgattattctcctcagctgcatgatgtgagactggtgaccattaactacatagtttggagtatatgggactatcgtcatcagcaagttagatggcaaccccctataatgggatgggtcaaatgtaatacagatgaagctactaaaggatctctaggcatagcgggttgtggtgaaatttctgctgtgattacaacaatagaaattgctcatgagaagggttggagaaacttgtggttggaatgtgattcattgatggtggtgcaagattttaaagatgtgaatcttgtgccatg

SEQ ID NO: 78082 - DNA, 276 bp, Glycine max
  Peptide Sequence Number=SeqID_194860
atgatgcttgtaccagcaccagctgacaggttgctggttacatcaccttgttacaggtgttggatatacgagcactttctgtcaattgcggagtgcaatgctgatctagaatacgacgaggcttcaccacgtgtgtcgcaacccacccttcggcgggagggcgacgcggggctcatgggtgcgtcttccatgggaggaaaatgcgcggagtcgccaccaacgtttattcgaggaaaacgtcggaaaaatcggaaaggtgtggtctacgaactttaa

SEQ ID NO: 78083 - DNA, 255 bp, Glycine max
  Peptide Sequence Number=SeqID_194861
atgggtgccaaacacctcgaagtggtcaaacgagggtcacatcccaacaacggatggtccccgaacgaaattaggaatgaccataatttgtctttgcgttttgttggacacgatcgagcctgggcggcgagacacagaatgaccataatttgtctctgcgtgccaccagacacgatcgcctctggatggcaaaaaggtgcacggaatgaccataatttttctccgctcacctctcgacttactgtccccgaatga

SEQ ID NO: 78084 - DNA, 234 bp, Glycine max
  Peptide Sequence Number=SeqID_194862
atggatgacctacaaaatcattgcatcactgtaggtctcaataatctcagccatgccacttcctttgaggctgcaaaaagcattggaaaaccaatagaggtcgtttgctttcgtatgatttactgtataataagatcgactaggcaaaaacatacaaaaggaggttgggagacaaatattagatcaaaatacatactggtaaaggaggttcctgaaaatgcaaggattcagtaa

SEQ ID NO: 78085 - DNA, 382 bp, Glycine max
  Peptide Sequence Number=SeqID_194863
atgggaaaattggatcatctagaggaaaggcttagggccattgaaggaggcaaagattatgcgtatgctaacctagaagagttgttcctagtacccaatatcatcacccctcccaagttcaaggtgtcgaactttgacaaggataaggggactactttccccaagaaccatctaaagatgtattgtcggaagatgggggcatacgcaaaagatgagaaactgctgatacatttcttccaagaaagtcttactgggggtcaaagcggcctgaaaagaggcaaatttaatcatcatgcttggacgaatgagaaacctggggcaaatgaagagggtgaggatgagggagaaacccatgctgtgactgccattactatacggccaa

SEQ ID NO: 78086 - DNA, 714 bp, Glycine max
  Peptide Sequence Number=SeqID_194864
atgtctaagatgaataatgtaaattacgtatacgaggagtgctatgacagtggagtagttttcatggctctagaatctttgatccttgtggagctgccaagcctaataaggttgtcaagggaggatgggaaaacatgttctgaatgtgctgaattttcagcaggcttgcatgaggctttacaacacacgacagccccgaagcctagcaaaaaaaagaaacatgacaaccctgaagcctaccaagaaaaaacattgacagccccgaagttgttaaaattacaagatcttccaaacctagaatctgaattttcagcgagctcgcatgaggctttgcagcacatgacaaccttgaagttgttaaaattacaagatcttccaaacctagaatctgaattttcagcaggttcgcatgaggctttacaacacataaccacctttaagtcattaaaattacaagatgttccaaacgtagaatctaaatgttcagcaggtttccatgaggttttacaacagataacagcactggagtcgttaacatcacaaggtctatcaatcctagaatccttgcctgactactttggaaaccttcccttgcttcaccaattgactattgttggctgttccaagttgaggtgtcttccaaagagtctaatccatagcaaagttgaaattcagattattactttgagaaggaaacgagagaggactttctaa

SEQ ID NO: 78087 - DNA, 1218 bp, Glycine max
  Peptide Sequence Number=SeqID_194865
atggaagagcctattgtggtgaacaaaggtgaggagcctctagatttgcctccaggtttcaggttccaccctacagatgaagagataatcacttattatctcactgagaaggtgaggaatagcagtttcagtgcaattgctattggagaggctgatttgaacaagtgtgaaccttgggatttaccaaagaaagccaagataggggagaaagagtggtacttcttctgccaaaaggataggaagtacccaactgggatgaggaccaatagagcaacagaatctgggtactggaaggccacaggaaaagataaggagatttacaaagggaaagggaaccttgtggggatgaagaagacccttgtgttctatagagggagagctccaaagggggagaagaccaattgggtcatgcatgagttcagattggagggcaaatttgcaagttacaaccttcctaaggcagcaaaggatgaatgggttgtctcaagggtttttcacaagaacacagatgtcaaaaagtcctcaactcctggccttttgaggataaactctattggggatgatcttcttgattattcttcactaccacctctcatggatcctccttatggcaacaccaacaccaccaacaacactaacccactttcttcatcaactaaatcacaatcagagggctattatcttcccagtttctccatcaacaaccaccagcagcagcttctcatcaagccagaagatcaccaccaccacagaagctataatgagattcccacaattaactacacctcaaaccaagccaatctcagcaacaacgttaacgcaatgggcaacaacactctctcacagcccttaaacatgttctcagctgattactatgtgcaccaaaacaggatcaaaagttccatcatgccaagtgttgcaggctcagattttgttaacaacaacaataaccatcatgaagctatcctaagagcatttgcagccaagaacaacgagcacatacagtgcaagatggagcaattttcttctaatcactcacaagacacgggcttgagcaacgacagaaacactactgacacatcctctgtggtttcgaagcagcaagacaacaacatgggaagaaataataatagggcattgtacgaggatcttgaaggcccttcttcagttgcacctctctcagatttggaatgcctgcagtgggatgatgactactga

SEQ ID NO: 78088 - DNA, 1272 bp, Glycine max
  Peptide Sequence Number=SeqID_194866
atggctagcaatccttcccctcacgggcacatgcatcagcatcagtttgcgttacagggcacagagtcaaagccttgtgacgcagaatcactggtgccggcgacccttttgattaagcacttgccagaagccattcctgacgtcaccctctctcggatcttggccaatttcggcgcttcctcagttcgcccttgctctactggcaggttgagatttcttggtaaagtcttgtcagcagagagagctagtaacccaactgagaatggtgaaaaaagtagcggagaccagttgggaaaggactctaaaacatcaatgctgaagaatgcaaatgtaaccaaacctattgatggagatacaaaatcaggagccctccctattcctgaacctattgctgatagacttggtgtcaattatccatttcctccacatcttgagtatgctgcttcttctcactttgcagttgttctacacttgatgaacaaaatgaacatcccggctccgtttcgtatggcactgcccacacctccattacctccagaggtaccagcaccgccaccacctctacctgcacctactgtaactgtgaatccttggtctgcagatctgtctagtggcgaatctgagatggaatcttcagatgaggatgaagcaagaataagaaagtctggacaaaagcgtgccaggcgtgagaccattgttggccctgctattgataagggtgtggctcatgagtctgttggagtaaaaccagccaccttggttccaaaggaaatccctgtgataaaaaagaaccatgtcttaaagataaacattgttcccaaagcaacagtgaaagaacataaagatgatgacacaacacaagagttacaagagccagaaaaagatgttccggatcctaacaaatttttgactccagatgaattggagagaggaaagttgcctcctgaggaaatcttatcccttccaatgtttaagaactatacagctggaaatcctgctcctgtgttgtatattaagaatttggcaaaagatgtgattgctgatgatttctattttatatttggctccttgtttggaagtattgatgctgctaagtctggtcttcaagtcaaactgatgcaggaaggacggatgaggggtcaagcgtttataacgtttccctccattgagttggcccatcatgctttgaccactgccaccaccacattctggaatgtcagtgatatggatgctggcatgtacattctccttggatttatggatgaaaaatga

SEQ ID NO: 78089 - DNA, 810 bp, Glycine max
  Peptide Sequence Number=SeqID_194867
atgccttgtcatgaattatcaaagttatcccacaatgattgttgggaattgtttaaacatccagcctttggaccaaatgaggaagaacaaccagagcttgtggccatagggaaagagatagtaaagtgtgggggtgtgcctctggcagcaataacagtaggagatcttttgcgcttgaaaagagaggaaagagagtggctctacattaaggaaagcaacctttggagtttaccaccaagtgaaaactccataatgcctgccctgaggttaagttacttgaacttgccaatgaaactcaaacaatgttttgcttattgtgcaatatttcccaaagatgacagaatagaaaaagaacatttaattgaactttggatggctaatggatttatttcttctaatgaagatgttgaagatgttggtgatggtgtgtggcgtgaattatattggagatcattctttcaagatcttgattcggatgaatttgacaaagttacaagtttcaagatgcatgaccttattcatggtctagcacaatttgttgtagaagagacattgaaattagactactgtgaaagtctccaaaagttgctccaaaagttgcctaacagtttggtacgcttaaaagctctacaacagctatctttgaacaaatgcttctctctatcaagcttgcctcctcagatggggaagttgacttccctaaggagtttaaccatgtatattgttggcaaagaaagaggattccttttggaagaattgggaccactgaagcttaaaggagattttcacatcaagcattggagtgagtaa

SEQ ID NO: 78090 - DNA, 144 bp, Glycine max
  Peptide Sequence Number=SeqID_194868
atgaaagtttggttacctattggaggctctcaacacacttccaatgaaaggcgtttttgttacaaaaacttgaaagcaatgaagatgtctagaaatgtcagtaaaaatttcagctcaaaatttgtagtgaccaattcccagtaa

SEQ ID NO: 78091 - DNA, 342 bp, Glycine max
  Peptide Sequence Number=SeqID_194869
atggagttcatgtcacccccagcaaggtatagggtgacgcacatcaagacgcgggcgcaccgccaccacctcggcagtccgattcggatgggccactgggcgtggagtggtatctatagcatttggttcgccagcaggcggccaaccaccatggacagcctcagtcagcaagggcagggtttcgccccttttgtatgccctaccccagagcagtttggggctgaggtcgcatggcctggagactggcctgatgcccaggcaggggaggagcctgcagaatcccccggtgaggcggaggaatcccgtatggacgaggatatgattgacctgctcgtttcttag

SEQ ID NO: 78092 - DNA, 228 bp, Glycine max
  Peptide Sequence Number=SeqID_194870
atgtcgccacacgggggcgacatggatgggggtggaaaaaggaaagagagggatggggtttctcttgcttttggcatagtgagcctcggcgggaggctcgcacgatgggctattagctctgtggtagaggctcttagccatatggatagtttaatatgctcattggcgcctgaccctgagatgtggatcatccaaggcacattagcatggtgtacttctcctgtttga

SEQ ID NO: 78093 - DNA, 327 bp, Glycine max
  Peptide Sequence Number=SeqID_194871
atgcctccatttgatttccggtgtgtcacggaaacttacggattgtgcatcaatatttttttggtttttcggcatgtcctggaatttcataaattgcctaatgatgggtgccaagcacctcacaaggaccaaagaatggtcgcatgtcatcaagcaaagaggcctaattcccttctgtcataccctaatttcgtccggggactattgtttgatggcatgcaacctttggttgaccgcttcgaggtacttggcaccctttgttgcacaatacgtgaagttccgagacgtgccggaaatcaaaaggaagcattgttacgcattccgtga

SEQ ID NO: 78094 - DNA, 486 bp, Glycine max
  Peptide Sequence Number=SeqID_194872
atggtggaaagacctggtggatcgttcggtcctgccgaccacccttttctagagcccatgaattgcgctttcgttcatgtgtcctccaccttcgagtttggagccatgcgtagtgattgcttagtgcaattctccattctcacccttttccggagccccatgaattgcgttttcgttcatgtgtcctccaccttcgagtttggagctatgcgtagtgattgcttagtgcaattctccattctcaacctttttcggagccccatgaattgcattttcgttcatgtgtcctccaccttcgagtttggagctaggcgtagtgattgcttagtgcaattctccattctcaacctttttcggagccccatgaattgcgttttcgttcatgtgtcctccaccttcgagtttggagctatgcgtagtgattgcttagtgcaattctccattctcaacctttttcacagccccatgaattgcatttctgttcat

SEQ ID NO: 78095 - DNA, 777 bp, Glycine max
  Peptide Sequence Number=SeqID_194873
atgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacacgttacaccacgattttgaatcagaagagatatttcaagaaatggcagatctattcactctatcaataaccgagccggatctggtgtatcataagggatttgctttttctattgattcctccggattgggtcaaaaacatttcttgaatgagttattcaactccagggatgaatcgaaaaatcactctttattggttctacctcctcttttttatgaagagaatgaatctttttatcgaaggatcataaaaaaatgggtccagacctcttgcgggaataatttggaagatccaaaacctaaaatagttgtatttactagcaacaacataatggaaggcagtcaatcaatatag

SEQ ID NO: 78096 - DNA, 132 bp, Glycine max
  Peptide Sequence Number=SeqID_194874
atggcattaaagtccccaatgtacaacaaaggaccctggtggttgaggaaaggaatcaagaagggtccaaggcttggccaagaagagcaggtcgattttgttggatacataactcctttaagacacgcctag

SEQ ID NO: 78097 - DNA, 714 bp, Glycine max
  Peptide Sequence Number=SeqID_194875
atgggaggaaagattcagttccgtaaccaagaggaatctgtcatgagactttcaccctctattagccaggctctcaggagcgaattttcctctatatcaagtgatattagtgcccaatttgttttaacagtacaaaagatgatagttatcaacagtatggtgagcaattatcaacacgacggaggaaacgccggcggaggcgtaggaaaccttgacggatttcgcgcggttgcgatcgagggcgaggtcgaggagaatgatgccgatgccaccgaggacgaacatgaatccggaggagaggccctcgatgatgtactggccgttgacgcggccggacatgaagacgacggggcggacggcgccggtgtaggggtcctgagtggagccgatgccggggggctcgacgatgatgtcgtaaacaatgccggagacgaccatgaagtaggtgaggaggaggagggcgaagacggcgttcggggaggggagggtgaaggagggaagcttgaggcggaggcgaggggggcggaggaagctgaaggggaggacgcggaggaggtggaagatcggatcgatggatgcgccggaggaggggtcgcttccgccggaggaggagggagggggcaccgggggatccgatttggatcgcattttcgggtcgggtttcggaggggtagagagaagagcagtgagtttattatgtgtgtgaattggtga

SEQ ID NO: 78098 - DNA, 858 bp, Glycine max
  Peptide Sequence Number=SeqID_194876
gaaattccggaatccttaacggcaagacttctaaacgtggaagtgttggacgtgcgttccaaccagctaaagtcccttcctaattccattggctgcctttctaagctcaaggttttgaatgtctcaggcaacttcatcgaatccctccccaaaaccattgagaattgcagagccttagaagaactgaatgcaaacttcaacaagctgagcaagcttccagacacaatagggtttgagctcgtaaacctaaagaagctctcagtgaactccaacaagcttgtgtttcttccaagctccacttcacacttaacagctttgaaggttcttgatgcacgcttgaattgcctaagggcacttccagaggaccttgagaaccttatcaacctagaaactctaaatgtgagccagaacttccagtatttggacaccctcccttactccatagggcttctcttgtcactcattgaacttgatgttagttacaacaacatcaagaccttgcctgagtcaattgggtgcctcaagaatcttcagaagctgagtgttgaagggaaccctcttacttgcccccctatggaggtggtggagcaaggacttcatgtggtgatggagtacatgcatcataagatgaactcaagtgatcaaaacaaaactaagaaaaggtggtggattgggaagattgtgaagtgtggaaccttcaataaacaaatgagaggtgggaaacgaccagaaaatgagggttacaacatgcttaagcaccagaatatcaatggccttgcttccccgggtctcatgggaatgctctcacctctgcgcctcttctctccccgtcattcaccccgtcgttccttcggttga

SEQ ID NO: 78099 - DNA, 216 bp, Glycine max
  Peptide Sequence Number=SeqID_194877
atggagcatactgaaaatgaggacgcgcagccctctaaaggcgagggcgtgcagccctctgcaggcgagggtgtgcagtcctctgatggcgaggacatatggtcctctaaaggtgatagattgactgtgataattcatgcaacctcatcctatcttcttgtaaatctctccgggaacttcctcagagtgtatgttctgtttgatttagtcacttga

SEQ ID NO: 78100 - DNA, 1341 bp, Glycine max
  Peptide Sequence Number=SeqID_194878
atgaaagtcactgtatttggtatcggctatgtcggtctggttcaggctgcggtgttggccgaagtcggacatgacgttctctgtattgatgtcgacgaaaagaaagtcgaaagcctgaaaaagggcatcatcccaatttttgaaccgggcctgacgccgctggttatgtctaactatgaagcggggcgtctgaaattcagcaccaacgcagaagagggcgtaaaccatggcgtaatgcagtttattgctgtgggcacgccgccggatgaggatggctctgccgacctgaaatatgtgactgcggttgcgcgtactattgcgcagcacatgaacgatcacaaagtcgtcatcgacaaatctaccgtaccggtaggcaccgctgaccgcgtgcgcgcggtgatgagcgaaacgctgaagcagcgtgatgccaatattgcgttcgatgtggtctccaacccggagttcctgaaagagggtgccgcagttaacgattgcatgcgtccggaacgtatcgtggtgggcaccgacaatgatgaagtggtcgaactgctgcgtgaactgtacgagccgtttaaccgtaatcacgatcgcatgattctgatggatatccgcagtgcagagctgaccaaatatgcagctaactgcatgctggcaaccaaaatcagcttcatgaacgagatttccaaccttgcggaacgcctgggtgctgacgtggaaaaagtacgtcagggcatcggttctgattcacgcatcggttatcactttatttatccgggctgtggttacggcggttcctgcttcccgaaagacgtgcaggcgctgattcgcactgcagagtcaatcggctacaccccgcgcctgttgcaggcggtagaagacgtcaacgattcgcagaagaacaagctgccgacgtttattaaacgtcactttggcgacgatctgcgtggcaagacgtttgcgctgtggggtctggcgttcaaaccgaacaccgacgatatgcgtgaagcctcaagccgcgtgctgatggaagcactgtggcaggcgggcgcaacggtgcaggcgtttgatccggaagcgatggaagaagcccagcgcatctacggccatcgtgacgatctgaagctgtgcggcactaaagaagctgcgctgcagggcgctgatggtctggtgatctgcaccgagtggcagaacttccgtgctccggatttcgacgtgattaaatcctcgttaaaacaacccgtgatttttgatggtcgtaacctgtatgatccggagcgtatcagcaaacgcggtttcgtttattatgcaatcggccgcggagcgtctattcaaattgtgtaa

SEQ ID NO: 78101 - DNA, 192 bp, Glycine max
  Peptide Sequence Number=SeqID_194879
atgggaggaaaatgtgcggagtcgccttcaacgtttattcgaggaaaacgtcgaaaaaaccggaaaaggcgtggtctacaaactataagtgtgaaaggttcaggagttgtatttacgcacggggaaggctttcaaaagtgcacgtttaaccaaataaaagcaaagaggaccattcaaggcgttggaccttaa

SEQ ID NO: 78102 - DNA, 984 bp, Glycine max
  Peptide Sequence Number=SeqID_194880
atgtctgtggagtctaaagtcccacaaggatactctttaaatatcaagagctttgtatccctcaatgttctcaatttggttggcttgaagtctcatgattgtcatgtgttaatgcaacaactattggctatagcgatttgcggtatcttgcctgacaaagttagggttgccataacttgtttgtgctttgtttctaatgctatctgtagcaaagtcattgaccctcgacaattggatgatttggagaatgaggctgtcattgttctttttgagcgatacatgaaggtcttaaagggttataccaagaatcaataccgactagaagcttccaatgttgaaagggtcatgggaacaccaccaaggttccctccgcattcagatggtcagtcagaggctacgtttaggaggagtagacaacccacacggctaagaaggttgactttaagaaccttggataagcccagaccatctgttaacatcaatcctataactgggagaggaccatacccacataaagagaagttccacagctatctgggggccaaaattgatatcccagaagcacctaatgcgaagaataaggtcatgtctataatggccactagatgcagacaatttaagtcttccctcaccatgaaatttgtgtatggtaacactgagggccaagataaacaggacccttctataaaatatgatctagatccacaaacttgggaggaatttgctgcaacccacaagacccctaattggcaagactcgttacaagaacaaaaaacacagggtagctttgtttcccatggtcataaggacatactaaacactagcattgggcaaccggagcatggaggtcgtgttcgtgcagtggggtctggtgtgacaattagtcaatactatggaaggacatcacatggctccaacaactcctccacatccatcacccaacaacagttggctgagataattggaagccttaaggaagagtag

SEQ ID NO: 78103 - DNA, 199 bp, Glycine max
  Peptide Sequence Number=SeqID_194881
atgaaacagaagcttaaggaggccataaaaattgagttatccctaaggggatcgcagtactcacccccgattgaggtagaaatacaagtattgagtgcacatgtgagcacaaaggggagcaatgctgaaactgctgtcaccccatcaggagaagaacatgttgctcatgtgataccgattatgggggtgtatgtgcaag

SEQ ID NO: 78104 - DNA, 504 bp, Glycine max
  Peptide Sequence Number=SeqID_194882
atggtggaggtagcagtgttgttgttggtagctagtgacggtggtggtgatagtgacaatagtggaatggtggtggtagccagtggcagtggtagtgatagtaacagtagtggggtggtggtggtaacaacgttggtgctgacagcaagtggtgatgacattggtggtggttgtggtgctggtgacaatgacgaaggtggtattggtagtagtgacaatgacagtgacagtaacattgatgatggtggtggtggtgatagcaatgccgatggtaatggtaatgtcaatggcgacgatgatgacattgatggtggttgcgacgatgttggtggtagtgatagggacaatgacaatggtgatggtgatgatagtgacattgatgatagtgatggtagcaatggtgatggtgatggtgatgtcattgacaatagtgatagtagcaatgccgatagtcaagatggtgctattggtggtgcagtggtgatggtggtggcagcgacatga

SEQ ID NO: 78105 - DNA, 1161 bp, Glycine max
  Peptide Sequence Number=SeqID_194883
atggcgaaagattcgactttgtcagatttagggatgttagagacgatggattatagaagaaacaccttcatgggaccaaggtggcgttgttgcaaagagatgttagaagaagaccaagaggaaccatctgaggactcagtggatgaggctgaggaagtaataatggaggtgtcaattgaaaaagggaaagaaccatttgatgaagttgcagtgatggatgggcgtcatgatgttatcgcaacatatagcagggatcatgagaatggagttgttattggaggtagctttctaaattttaatggtcctaaaccaaagtataattgtaaaggtaagaagcgagagaaggttgttaccggggctaagaagcaacaaattcatgcagtaaataccaaagcccatgttgctaatgatgaattgttttcatgggtactagaagttgtccgcgaaggtatcaacgtacaagggttaaggagtaaggtgaagttgaaggagttgaggaaatttatattgaaagaaaatccagattttgtatgtttacaagaaagaaaatggaggatatcaatgacaagctttgtagagaaatttggggggatgttcatgtggaatggaggggaaggaaatttggcgagtgacttcaatgtcgtgagaaaaaaggaggaaaggatggtatatggaggtgttagccaacaaaggggtagaaagatagaagaattcaattccttcattgatgggatggaattggtggagacatctatagtgggtaaaaggtttacttgggttcatatcggcgataaattgtcaagagtggtgggagacggaaaccatgtgagcttttggaaagctaaatgggtgggggaagagaacttatgcaaaagcttcaatcatgtgtatctaaattcgcaagaagtggtgtgtcacatgtggaatgccattgagtgtcacggaccaaaattgactgcacttgatggttgggattggtctacaaactcagggaagagcaagtggaaacttctcgacactaatttttcgaatgcaagttctcgcatcacatatggaattattgctactcatggtatggtgacacaagggtgctgccaaatgaaggcattactcacttttggcaacaccaaggggcactcaaagggaagcatgcgaggttga

SEQ ID NO: 78106 - DNA, 324 bp, Glycine max
  Peptide Sequence Number=SeqID_194884
atggatgagtttagtccaggcaaagtgctttacttacatggcagcacattgcatccttaccccctagcctattggttgtgtcctgtagaggtttcaatacacaaaaggaatcaactattggacgctttcttcttggaagatcaaggtaaattggggtttgtagagcctgggactcctgtaagcatacagacaccacccaaatcatatggaaatactgatcagggtttaatgaagaaattgaaagactttgatggacttgcaatgtcaataggcaatggccatgctgaaagtgcagagcgtagaggtgaaaataggctgtcatag

SEQ ID NO: 78107 - DNA, 960 bp, Glycine max
  Peptide Sequence Number=SeqID_194885
atgtccttgttgcatcagaattacaaatctcaatgggagggtggagccgagattatggctaacaaaacggaagaaggacaatctgtgatgtttgagaatcatgtgtatgagccagacaaacagcaggtgacttacaaaaatggaagcacggaatattttcaaaggcttatatgtaaagtggctttctgtcaaagtaaaggtgtttcccatggaaacttaaagccacaaaatttgttgttggatgccaagggggtgcttaaactatcagattttggaatgaggccactgtctgaacaagtttcagtggcaagcattactggctatgagggtgcacacgctgatatattgtcatgtggtgttattctttttgttctattggctagttatttacccttcaatgataaagacattaagactttatatataaagtacaaaaatgccaacctcatttcacttgtccttcaatttttttctccaagtgtaacgagactaattaagacaatccttgatccctgtcctgctacaattgatgagatgttggaggatgaatggttcaagaatgaacatcaaccttttagatctttccagcaaaatattagttctgataaagatttaaaaaatgttattggggaggggcaacatgcggggccttcaacatctgtgactaggaatgcattcaaaaaatctcttcgcttgaggcttgtttgtaatcttttcaggaaggttatgatcacttttggatatcacaaaaagggctcgaagacactactgacgagcactgcattatcttctatgataaggaaaagaactaattggtttaccgaagttttttcccctaaagtaaaggtcgagcttgtagaaggtggaaccttttggttgtttaagtctccctctttacctggaagcatgtcatgggggtctgaagttctttgcattgcaacatgggctatatccttatga

SEQ ID NO: 78108 - DNA, 351 bp, Glycine max
  Peptide Sequence Number=SeqID_194886
atgcacgtgatagttgagcgagactacattctgagcacgatgcaaaaagtccagctgagcgcacaccatgcgttgaacgcacatgcacgtgatagttggcttcccatgtggcttctggcgctaagcgaggctatcgtgttgagcagtcctcatgcgctgaatcaaggggcgatgatggtggttatgggagggagggtccacgatggtggctcaagggccggcggtggttgcacatggaaggggttgcaatgttggtggcatgaaggaggggtcatgacaatggttgcgcaagggaggggccacaatggtggcttgaggggcaacaatggttgtgcgagggaaagtccatga

SEQ ID NO: 78109 - DNA, 246 bp, Glycine max
  Peptide Sequence Number=SeqID_194887
atgagggaagtgaaaagtgagggagatcgagtagagaaaagaaaagaaagaggggtgtggagaagtggagaactggtgtgggaaagagggattctgaatgtagggaagtgggggaaggctctagaaatttgtagagaagtggtgtatcgggaagatcaaccaaaattcaatgtagacacaactgaaaaaagacccttctacgacgatggaaacaggccttctacaatggttttgagccatctttga

SEQ ID NO: 78110 - DNA, 150 bp, Glycine max
  Peptide Sequence Number=SeqID_194888
atggaattcatgaaatcacacccaacagttcattgtgacacagttacatcaaaaagcataagaaaccctgctgaaaatggacctttgtgcttaaaccacgtccaagacaaaagcttcattgcttctaaagcaatgtcaggacttacatga

SEQ ID NO: 78111 - DNA, 528 bp, Glycine max
  Peptide Sequence Number=SeqID_194889
atggtgaagagagataatatgttgaagatgggtggtgctctaagaaaaatgggcgacgagtctacaaagcaacttggtggctatgcagaactttgtggtgctaccaaggccaccaacggcaaacatgattttggcgccattaacaagacccacctcttggtggctatagctgctctcgtcaggccacgagccaaatgcatcggcgtaggcaccttcaccttcgtgagcctggataggtcttcacatgtgcccgagtcaatgatgacgccatcgtttcccactgcattgaggcaaaagtgcaaggcggggaggccatgcatcgacatgccactgacgctaattcaagcggcgacagagagggcccctatagaggattctgatgtagcttcgagatttggtggaggtgaaatgagagagcttcttctgggtcaggttctgaaaagggtttggattcgggccatgaaagcatgggtgggtggaggagggagtggaggggcaagctttgggtttggagttggaatgcaatga

SEQ ID NO: 78112 - DNA, 960 bp, Glycine max
  Peptide Sequence Number=SeqID_194890
atggtgaagattgcgggggttccagaagatgccattcgcctctatttttttcctttttacttggccggtgaagcaaaaaaattgcttcatttgttcaagggaaacagtttgagaacttgggaggaggtggttgagaagtttttgaataagtatttcccagagtccaaaattttcgaggggaaggcagagatttgctcatttcaccaatttcacaatgagtcattgcatgaagctttggaccacttccgtggtctacttcgaagaactcctactcatgggtttagtgagccaattcagctaaacatattcattgatgacttgcaaccccattctaagcaacttcttgatgcctttgccagtggaaaaattaaattgaagacctctaatgaagctatagagctaatagagaatatggtagctagtgatcatgtcattctccgttatagagcttatacacctacgaagaagagtcttcttgagctcatatgtaacctgtgtggtggaactcatgagttaggtatgtgcacggctcaagaagatgcatctaaagaggtcaactacatggctaatccaaactgtcaggggatgaccgtccaatcaggccctaacttctatgagagaaccaccaagttggaggacaccctgactcaattcatacaggtctttatttccaatcacaagagcatcgggtcaaccatcaagaatctggaggtacaggtgggccaacttgctaagcaattggctgaaaaatccattgggaacttcatggcaaactcaaagaagaaccccaaagaggaatgcacgatggttctcacaaggagaaagaggaaggagaaccttgaaaaaacaagagttgagggaaaaatggaggatgtgagtgaagaggaagtggaggatgagaggagagagaaagaggctgacaataaagagacagaattgagagatgaaaaaagtgaataa

SEQ ID NO: 78113 - DNA, 237 bp, Glycine max
  Peptide Sequence Number=SeqID_194891
atgaaggaggaagtgcgaaaagaagtcctcaagttgcttaaagcaaggcttatctatccgaactttgtcagtgcttgggtgagtccaacccaagtggtgcccaagaaaggagagcattgtgtcccgacgtccttcagcacaaggttccttaaagcacttaacctagccatatgctcttccgaatacaaagttcaagatcatcacaggatccaaacacaaacaacacacaggaagtga

SEQ ID NO: 78114 - DNA, 714 bp, Glycine max
  Peptide Sequence Number=SeqID_194892
atgaactcacaagacattccctcaggaagatcaccaaaaagagaactccaaggccctcgtcccacacctcttaggattaacaaggactcccacaagatcaagaggaccccggtggcgctgccacaaccgcaaccaccaccgcgccaaccagtgatcatctacacggtctctccgaaagtaatccacaccacaccaagtgatttcatgagcctcgttcaacgcctcactggctcttcatcttcctcttcatcgtcctctactaataaggtctcaaccgaacctttaaatggcaacaaaggctgtaatggtggcagtggtagtgacgcgatattgcctgtggctcattttgccacaatagagatggctagaacagcaactcaaagcactaaacaacacccaattgagaatagtgatgatgttgttggagggatagatgatgtagtaggtcatggtgcgttggagagaccaaacatgtttcatggaattttgtccccgggaccatcttctttatctcccatcccttcaaatttcttctctccaccgtcgattgatccaagcatggttagcttgtttcatgatttaagcccggttcttcgtagtagcagaaattttatggagggtactactgctactttcatcatgcctagcccttcaagctttgtttcacctcgtactccttccattgacctattcaataatttctccgataattaa

SEQ ID NO: 78115 - DNA, 731 bp, Glycine max
  Peptide Sequence Number=SeqID_194893
atggaaggaaaaagctctttcaaaagccggaagagaggttctcataaagtctgtggttcaggcgattccctcatacatcatgggatgtttcattggatggagtggaggagattgacgagaagtaagaagaaagggggtcttcgcttccgggtgggatatggtagatgcatcttggtgttcaaagacaaacgtgtttcgactctgtcgggagctagaatagcaagagggaaggatgtgggggtgaatgaggagatgcaggacgattgcgtatactggagtttcagcactaatcgggtatactcagttatatctgggtatcagttggccaaaaataagttccatgttgcaggaacttcatcaaattcaaattccaatggattctggaaaagagtatggtttggtgctacacttccaaagtgcaagaaccatatatggagggcgtgttctgatactctactaagggtgtggtttgcttcaccattgtcgttaagggccactgaaggtgtgctcacagatttttggaggctccatcgctggaaaaggagagataagggtacgagtttgggctttatagctcaagaacctgagggtaaagtgttggcatctgcaacaaaattgattgagacaaatctacaaccccgagaggctgaagcttttgcattaagatgggctattattttatgtgcaagactgcttctacccgaagtagcctttgagacagactgtctcaa

SEQ ID NO: 78116 - DNA, 821 bp, Glycine max
  Peptide Sequence Number=SeqID_194894
gagcttcgtgaggaagggaacaggctcttccagaagaaggaccacgaaggcgccatgttaaagtacgaaaaagccctcaagctcttaccgaagagccacatcgacgtggcgcatcttcacaccagcatggccgtgcgttacatgcagctgggggtcggcgagtacccacgcgccatcagcgagtgcaacatggcgctgcaggtctcgccgaggtacaccaaagcgcttttaaagcgcgtgaaatgctacgaggcgctgaaccgcgtggatttggcgatgcgggacgtgcgcgtggttttgaacttggagccgaacaattcgatggcgttggaggttttggatagcttgaggatgacgatggaggagaaggggattgtcgtcgatgagacagagatcgccctcgccgccctggagaagattaagaataagaaggaacacacgggaggagaggatgaagggaaagcaaaaaaggttataattgaggagaaggttaaggttgagaatgttgaaaagaaggataattataaggataaggatcataagtttcataaggatcataaggataaggagaagaaggtggtgaagaaagtgaaagagaacgagaaattgggggagaaagacaaggaaaaaggggttgttactaggactgtgaagttgatacatggagaggatattagatgggcgcaattgccggtgaattgtgggatgaggctggtgagggatgtgataagagataggtttcccgggttgaagggtgttcttgtgaagtatagggatagggagggtgatttggttactatcactaatattgctgagttgag

SEQ ID NO: 78117 - DNA, 159 bp, Glycine max
  Peptide Sequence Number=SeqID_194895
atggagatgagaaaccaatcttgtatgaagagagtgtgtgatctaaatcaagagagaacggaggttgtagccattgtgagagtatgcaatctgaacgaggtttattcaaaggatgaatctcccctacctcctattgcaccacaatggaatacattttga

SEQ ID NO: 78118 - DNA, 477 bp, Glycine max
  Peptide Sequence Number=SeqID_194896
atgatgagagaaacttgcctccaaatagcaaggcaccggaacattcagggagcgaaattttcgaaaggaacgaacgacgccgttcttggtcctcggaaatcggcgttgaccggtcaacgagagaagaaattgagctcttcagcagagacgagtcgaactcggaattgtgcgaagaagagtagccgtagagaagaagccctgatacgctcgcgccggcgaggacggtcgagagtgcgtttcgaccgaaccaggttcgaaccgggttcgcggtgttgtggagtgaggaggaggaggaggaggaggttgacgcgtggcggatctgggaccgttgggttgagaagcgtcgggcgaggaagggggatcgctatttgctattctcaccccacactttttgaaaaaaccttttacacccctgacctagattccccaataggagggtgttggagaggagtttctccgaggctgaaaccgaaatag

SEQ ID NO: 78119 - DNA, 805 bp, Glycine max
  Peptide Sequence Number=SeqID_194897
atgtctactactcttttgattaaggtttttgagtactttgcatctgatcgtagttcagaaggagaagttttgatgaaaccagcagacctaatgcgagcagtggttcctgttttccctccttctgaatcccaccttgttagagatggatacttggaagttgcaaaggacatctacgacctgttatgggaagggggggataagggtgttcaccacagggatggactgcgaactggcctaaaggcgagtgattctgtggaagatggagggctggtggaatacttttttgataaagatggaaatggatgcctccaacatgataaatttgtaaattttttgagaggcttgcatgatgagattctgaggctggagtttgctcattatgactaccaatcttgccaaaccatatcagccaaggactttgcgctctccatggttgcttctgccgacatgagtcatctaggcaggttgcttgaaagggttgatggactgaatgatgatccacgccttaaggatgcacgaatcacatttgaggacttcaaaaactttgcagagctacggaaaaagttactgccattttcattggcccttttcagttttggagaagtaaatggcctgttgacaagagatgattttcagagagcagcatcacatgtatgtggcatatctctctcggacactgtggttgaaattgttttccatttgtttgatgcaaatcgggatggaaacctaagttttgacgagtttgtcagagtgctacacaagcgcgaaagggacattgcacaacccgtggagacaggaatacggg

SEQ ID NO: 78120 - DNA, 129 bp, Glycine max
  Peptide Sequence Number=SeqID_194898
atgaacttgctaagcgcgcctgctgtgctaaaagaactcgctaagcgcgcataccgtgctaagcgagtgcttctttcaaagatgaacactcatccccctattgagaaacctgtggctaagcgaggctga

SEQ ID NO: 78121 - DNA, 1017 bp, Glycine max
  Peptide Sequence Number=SeqID_194899
atgggattcaatgcaaagtcaaccatgcctatgaagacaacttctccaaacatgggtgcctggggtcaaagctctatgcgtcaagtctgcgatattgttaatttgcattatccttccctcttcttagtctttgaatctcatggcctcttttctagggttgaagatttttggaacaggttaggatacattcctttgtttgttcaagaagttgtgggccactctgggcatttgggtcttgtcctttacagtgaatattacatgttcgttgattcattccatgaaccaagcaataaccttttcaatcaaaagaaggaatatattgtttggtattgcactacagtttatgtttcacttgtaccttccaaccgtcatcacttatgggatcacttgggagatataaggaatcaaattagaggttcgtggctactgattagggattttgatgatattattctcccctcaaaagtttcaggagggcaattcaactcttctcgtgcttgtctcatggcggatatgatgaatgcttgtggtgttatggatttggaaaagataaggggctggtttacttggcagaaaaatattcaggccgatggtcataagcgtcagattgaggctagggttaagggaatgcataagcaacttgatactttcccttattctcattttattattttggagaaacaacttcaggtccagtatgatcaggtatccatggaagatgttagacatgttatcttttctgagttcatacaaagctcctggactattgcctttgctacagggacttttgacactagcttgacaaaaactataattgtttctatccttaaagtatatgttcctatgacttttaaagattttagacacataagcttgtgtaacgtcctcttcaaagctatacccaaggtgttaataactcaagaaatagttcatcaaatgcataagaagaagaaagggaaaaaagggtttgtcatgttcaaaattgattttgaaaaagcttatgataaagtagattga

SEQ ID NO: 78122 - DNA, 609 bp, Glycine max
  Peptide Sequence Number=SeqID_194900
atggatgaagagggataccctgctttttctttagtgaacaaggccacgaagcattccatcgctgactatcaccctctcacccagttcggttggtgccgtacaattcagattatttggatgagtccattatgtgggccgagggcagggacctcggtgattgctatagggctattaggatggcaaacaaaagcatctggaatagggagtttatattgggttccttcacttagatacagtttcgtgaaaaaattgtccagtgtagagcgtttccatggcaaaacgggttccttaagaagaaatgcattttatataagaaacattgttatcaggacaatgtttatctctgaaacattcttccaaagaggaatgtggagttggcttacatacaatacgacgagttcctggaggagcttgagaagaggtaatggcacacgaggctcaccaaactgtcggagaaaaaatattgatatggcactagtgaaagaattctatgcaaacatctacgaccaaaaagacgactctcctaaacagtttaaagaccacgggaagctcatccagtttgacgtccagatgttgaatgcctttctggagacaccgatcatcctttag

SEQ ID NO: 78123 - DNA, 351 bp, Glycine max
  Peptide Sequence Number=SeqID_194901
atggggattccgacaaagaggctccgaatgacgaatgagaaaataaatagacttctttctaagatctcatgttggagaacaagatgtcagagtgggaaatttgcaagagtttgtgtgcaaattgacttggacaagcctgtagtgggtaaggtttggttgaaggggcactggttttatggtcacctggctcataattatcctaaggttgtccttgtagatgatcataatattgctcagtcacatgttccgatcaataaagggaaggagaaacaatttgcaactacttcaacgatggttcgcgtgggctccacatctcatgcagttactaatttaaatatttatatccaataa

SEQ ID NO: 78124 - DNA, 261 bp, Glycine max
  Peptide Sequence Number=SeqID_194902
atgggtgccaagcacctcacaaggaccaaagaaaagtcacatgtcatcaagcaaaggtccccggacgaaattaggatctcgcttagcaagcttgtctcacttagcgagctcgtctcgctaagcaagagtccactttttgtgcttagcgcgacaattcgcgctccgtctgcactaagtctcgctcagcgggctaattctcgctcagcgcaattccctctcgagttggaattgcgcttagcgcgcccttcgcgcttagtgtga

SEQ ID NO: 78125 - DNA, 854 bp, Glycine max
  Peptide Sequence Number=SeqID_194903
atggcgagttcttcaagaacgaaatctagtggaccagtgcttcgttcttcttcttcttcttcttctctctcacattctaacagcttctgttcgtactcaacatcaaacgcaccgtttcactcaccttcgtcgagtttcttcagaaaacctcactcgcacgtgcctccccgctccacttccccgacacgtgtgaacctattcagcgccgcgccgcttccctcgcactcggtccggttcgctctcgaccggtccatctccccgaaccggaccgtctcgagccacgtcatcgcgaagcaccgccacgtcacggctcagaagaaatcgtgcatgtgttcccctacgacgcatcccggttcgttccgatgcagcctccacaaaaacagccacagcgcgcaaaccggttcgtttccgtcgaaccggctcaacatgcgccggtccgcaatgaagaactcgctcgtgagaatcggtggcgtcgaaggcgagtgggtgaaacgtgctctcaccgcgctgattcgtccttcatcgcatcaacagcggagaagaacggcgtttgaaccgcgacagagtcgtctttcaatcatgttgtttttgaatcgccggaatattcggatctccgccgccggtgacggattctctccgattgcgtcgccggagaatttggaagattttgttggcgtagacctaagaggctggaccctggactcggagaattctttttttagcgagtatgcattcatgagtttgttgttcttgccgttagcgttccgtcattcgttcgtcacgttgtgtggtggttttgtcgccgccgttgaacctccgttatctttcgttcattgctttgcgtttggtgcaag

SEQ ID NO: 78126 - DNA, 126 bp, Glycine max
  Peptide Sequence Number=SeqID_194904
atggaagcgcaatccttgacaccacaaggtcatgatgatggtagtggtgacataacggcgcaacgtgacatcgtagagttggccaaaagaaaagagtatagcgggaaggagaaagataacgattga

SEQ ID NO: 78127 - DNA, 534 bp, Glycine max
  Peptide Sequence Number=SeqID_194905
ggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcaggtcttctttccccgctgattccgccaagcccgttcccttggctgtggtttcgctggatagtagacagggacagtgggaatctcgttaa

SEQ ID NO: 78128 - DNA, 296 bp, Glycine max
  Peptide Sequence Number=SeqID_194906
actgcctcctgccattgtgaaaaaggagaaacttgattatatagaggaaaggttgagggctattgaaggaggcaaacattatgcctttgctgacatggtagaactatgcctagtgcccgacgtcgttatccctccgaagttcaaggtgccggatttcgataagcacaaggggactacttgtcccaagaatcacctgaagatgtacaacaggaaaatgggggcatactcaagaaatgaaaaattgttgatgcattttttccaggaaagtcttaccggggcagccgttgttggatcaa

SEQ ID NO: 78129 - DNA, 1380 bp, Glycine max
  Peptide Sequence Number=SeqID_194907
atgactcaacaaccagactttagttggatggttcccattgaagtgatgctgggctcactctaccacggacaagtccaagcctgcagcatctcaagcgtcacagacgagcttcgaggcccaaacaaagcagctttcaagccaaaggaagtctccataggacccttacacagagcaaccacgaggcacgtgcaactaatggaagagaccaaatggcgttacatgcgtgagtttctcgacagaaaaggcacgcaggagcagaacagaagatcggagcagaggctcagagagtgcggcactgatatcctcaagctggataagataatcatggcaagctatggaggtaacatcgaatcggaaccgcgagagttggctaaaataatgattgtagatggttgttttctgttggagcttcttattaggcttggtgattttatatgtaacagtagcaatagtactaatagttatgcaaacgaccctatactaaaaaataaagagaaggtggtgtctgttctgaatgatatcacaatgcttgagaaccaaattccattcattgttctcaagaagttgtataggaaggtctttcccgattccagtgacatcaacaacgaccaccgggttgctgatatcgttcgcaaggccttcggttacgacgaggtgaaaaaccctgtccacatacttcacttgatgcacttgtccacggtgcaacagagccagcaagagggtaaacgcgtgaagcaagagctattgcgctgtgccaagaggcttcaagctgcaggagtaacaattgaagctgtaaacaccacttctggtcatgagttggtggattggttcaactttgagttaaatttcagtgacagtgtgctgcggatcccacggctgtatgttaaggacactacagaagtgaggtggaggaatttgatcgcgtgggagcagagcagaatttggataacatgtaaatacacttcgtatgctcttttcttccaaggtttggtttgttgtaagcatgacattgagctgcttgagaagaatggggttatagtgaacaaggccgggaagagcaaggatgaacttctgaatttgtttcacacgattacgaagggagcagaacacatggattcgagctatagcgaaatttgtgaaaggttgaatgagtacaaagggggaaaagtcacaactgcatttcaaggattgcctgtggtcacttggcacaagtgcaggcatgtttttcagatcattgcatactattggggaaactggtacaaaattttgaaacgcgatcatttccccacggtgtggaaatccataggagtgttagcggctgctgcacttcttgttctcactattatgcagacctattactcatcccgcaacaatgactaa

SEQ ID NO: 78130 - DNA, 618 bp, Glycine max
  misc_feature (6)..(6): n is a, c, g, or t
  Peptide Sequence Number=SeqID_194908
aggcgncgggcccgatgacatgcggagacaaaatttggtcattccgcacccctttgccattcagacacggtcgtgtccgatggcacgcagagacaaattatggtcattctgcacccttttgtcatcaagaggcggcgggcccgatgacatgcggagacaaaatttggtcattccgcacccctttgccattcagacacagtcgtgtccgatggcacgcagagacaaattatggtcattctgcacccttttgtcatccagaggcggcggacccgatgacatgcggagacaaaatttggtcattccgcacccctttgccattcagacacagtcgtgtccgatggcacgcagagacaaattatggtcattctgcacccttttgtcatccagaggcggcgagcccgatgacatgcggagacaaaatttggtcattccgcacccctttgccattcagacacagtcgtgtccgatggaacgcagagacaaattatggtcattctgcacccttttgtcatccagaggcggcggacctgatgacatgcggagacaaaatttggtcattccgcacccctttgccattcagacacagtcgtgtccgatggcacgcagagacaaattatg

SEQ ID NO: 78131 - DNA, 298 bp, Glycine max
  Peptide Sequence Number=SeqID_194909
atgtggaaaactacacctattactttgattttcctggctgctatgttaccctgcctagaccctccaggtgttctctccttcgattggaacttcagcaatagtatggtgatttttgcttcagctattcttggattcttgcttcagtggtctggtgctttagcactaggagctacctcagcaatctcccatgtcgtccttgggcagtttaagacatgcgtcctccttcttggaaactattatctcttcggatccaatcctggcaaaatcagtatctgtggcgcattcacagctattgccg

SEQ ID NO: 78132 - DNA, 567 bp, Glycine max
  Peptide Sequence Number=SeqID_194910
atgttgaataacaacaagcatgagaaaagtttttcaaggagcaagagtgttagtgatgatttggtaatttttccgtctctaaaaccaagtaataatgataaggggttacacatgtttgtttggagctcaacttcatcaccaacttctgatgttaatatgaaacatagagtgaacacagttggttctgctgactttgagatcattggatcttccaagtttgttgatttttcacatgaaactgttgcctcaaaagctgtgcatgagcgtgaaattgaggaaggagacaaacttcctgtaaaggaggttagcattgaagaaggcaatgcaaataaaaagcaaaaaatgcaacgtgctagtgtgatgataaagcttattctcaccatggtttatttatggcattataacccaagatcattacttgtggaaaaaacacgagctggaatttccatggtaattaagttcttggtgggtccagcagtaattcttgcaacctccaaagccatgggtatccatggagttcttttacatgtcacaattattcaggtgaaacaaattatccccttgtaa

SEQ ID NO: 78133 - DNA, 513 bp, Glycine max
  Peptide Sequence Number=SeqID_194911
atggaagttaccaatataagatattatggtctcatttgtagagaggagcaacacacttacagtttcgcttctctcttctctttatccgaaaagtcagagagaaaaaaggactttatacatttggaagatcataaaatcaatcttgatcctcatctacctttcatcattccattatggttaatcgaggtgctaagctactcatttcagaccaattccctgagacttgcaggcgcaatttccaccctaagtgttgattcaaacgttggttctctcaatggtagagagccattgcaaactgatgtagaaattggagaaaatggacaacttcacgtgttggtgaggaccatgcagtcacgttccatgtccatggcttcacctagagcatcaaatcttactagggttgagatctattcggtcccttcatctagagattcagggtcaagtttcagaggcacaaatttgcagccaccaactagtactactctccaaggtggtggcggttttgaagaatag

SEQ ID NO: 78134 - DNA, 1611 bp, Glycine max
  Peptide Sequence Number=SeqID_194912
atgatcaaaggaaaagacatttatgaagttgtggcggcgcttgtgcctctctaccttgctttgttcttagcctacggctccgtccgttggttgaagatcttcacccaggaacagtgctccggcataagccgtttcgtgtcggtgttcgctgtccccttcctctccttcgacttcatctcatccaacaacccttacaccatgaacttgaggttcctagccgcggactctctccaaaaaatcgtggttttgcttgcacttttcctattcaacactttcacaaaatggggcagcattgactggtccatcaccttgttctcactcatcacactccccaacacactcgtcatgggggaccctcttttgaaggccatgtatggagaattcacacacgccctcatgacacaaatcgtggtcttgcaaagtgtcatttggtacactcttttgttggtactttttgagtatagaggcgccaagcttctcatttcagagcaatttcccgagactgcaggttccattgcaacccttagggttgattcaagtgttagctctctcaatggtagagagcctttgcatgctgatgcagaagttggagaaaatggacaacttcatgtggtggtgaggagcatgtcacgttctgtgtccatggcttcttcgttccacaaatcctattcaactggggttgagatctacccttttccttcatctagagaacaaactagtctccaaagttttggggtacatgagagtaggttttggaggagcaagagtgatggtgatgcggtttttaacagtggtttggtttcttcatttccgtctataaaaccagtgtttcaagggtctcgtagtggtggccaaacaaacagagatatgagtagtagtgatggtgcaactagtaatatggggttacacatgtttggttggagccggagagaatcgtcaacttctgaagttaacatgaaacatgcagtgaatagggttgcgccttctgatcaattggccgtgcatgagcttgaagaaattagggaaggaattgaacatcctgtaatggggagacggagggagttgagcattgaagaagacgatggaaacaaaagacaacaaatgcctcgtgttagtgtcatgataaagcttattctcactatggtttggaggaatctcttaagaaaccctaatgcctgggcaagtgttttcggcctcgtttggtctctcatatttttcaggtggaacattgcaatgccaaaaattgtaagaaaatgcattgatataatatctcataccggactgggaatggccatgttcagtctaggtttgttcatggcattacaacccaagatcattacttgtggaaaaactcgggctacaatttcattggtaattaggttcttgattggtccagcagtgattcttgcaacctccaaagctatgagtatccatggagttcttttaaatgttgcaatagttcaggctgctcttccccagggtattgttccatttgtattcgccaaagagtataatctccacccggacatactcagcacagcggttatctttggaatggtggttgcgttgcccgtaacaataatctactacgtggttcttggagtgttataa

SEQ ID NO: 78135 - DNA, 3088 bp, Glycine max
  Peptide Sequence Number=SeqID_194913
gactgtgtcgtttcaaatggaggatagtgttctttccatcagagcaaagattgtagaatatattgtgggtccaattttacaccatgcaaaatacttgtgttgtttcaacaactttgctgtgaatctcccaaatgccaaaagagaattggaattgaccctagagcaagtgaaattacgagtaagagaagccactattaggattgaaaaaattgaaccaactgttgaagaatggctagaagaagttgagaaagttttagcagaagtgcagattctcgaaggaagagttttgaaagtgacaaagagtagtttcataaggcaatgtcgatattttcttgcaaaagaaatggtaagaaaaataggacaaatgaatcagctcaaatgtaacaagttagagcccttttctaggagtattaaccttccagacatgaagtactattcttccaaagattttgttctttccaattcaacagaatcaacttacaacaagcttttggaaacattaaaggataaaaatgttagcataattggactagttggaatagaaggctcgggaagaactactttggcaaatgaggtgggtaagaaagctgagaagttaaaactttttgagaaggttgtcatgacaacagtctctcaaaatctcaatatcataagcatccaagaacaaattgctgataagttgggtttcaaattagaggaagaatctgaggaaagtagagcaaaaacattatcacagagtttaagggagggcacaacacttctaatcttggatgatgtatgggaaaagctaaactttgaagatgtaggtattcctctcaatgaaaacaacaagagttgtgtaatactcctaacaactcaaagtagagaaatatgcacttctatgcaatgccaaagtataattgagctcaatcgtttaaccaacgaggaatcttggattttgttcaaattgtatgccaacataactgatgactctgcagatgctttgaaaagtgtggcaaaaaatattgttgatgaatgcgaaggattcctaatttcaattgtgactttgggaagcacactgaagaagaaaagtttaggagattggaagtcagcattgaaaagactacaagattccaaaccattggttattacaaaaggcctaaaaattcctcatgaccatgaaattgatttggaagatttatttcgatttggaaggggactgggactaactaagacttctgaaacaatggaaaaatcaaggagggagattgaaatagccgttaacatcctaaaggattcttgtttgttgttgaaagttagtaataaagaaagggtgaaaatgcatgacatggttcgtgatgtagccttgttgatggcatctgaaaggggtcaagcaatgttggcaagtactgcaatggatctaagaatgttggtagaggatgaaacactaaaagataagagagcaatatccttatgggatttgaaaaatggtcaacttcctagtgataatcaattgaattgtccaacactagaaattctcttgcttcattctccaaaggctggctttgaagtatctaatttgtgtcttgaaaggttgaaagttcttaaaatactgtcattcttaacatgtggctatacgtggaagttgcctcaatttagtccatcacagtacattttatcattgccacaatcaattgagtcattaaaaaatcttcatactctgtgcttgagaggctataagctaggtgacatctcaattttggaaagtctacaagcactcgagattcttgacttgcgtggttcttatcttgaagaattgcctaatggaattgtagagttgaagaaattgaagcttttggatttgtacaattgttggattgagaaaaataatgcttacgaggttgtaggacgtttgcaactagaggaattgtattttcatttattctcgtataaagaagacattccacataatgtttctttctcaagattgcagaggtatgttattgtactagatcatagaccatattccttccacctaaagacagaaattatggaagagcatagaccatctagagctttgtacataaatggtttgaatgcatctactcaaaggtttatatcattaccaatcatggatctatttttaagagcagagtaccttcatttgaagcatctgaagggaggttacaaaaatcttatcccatccatggatcaacaaggcatgaatcagttgattgccttagtcctcgaatattctttagatatagaatacctctttgatagtactatgattaccaccaaagatgtttttttgtccaaacttgttactttaaggctaaatggcatgcatggccttcaagaacatatcctttccaaggtactcaaatctatgcagtatcaaggtcttaagaatatacaattgcccagtcctaacttctctcttcatgccatccattgtcaaaactctagtgctgctggagagctagttagtttgcaaaggatgagcattcgaaaatgtagcgagttgatgtatgtatttggaaatgaaaaggagcatgatctttcagcgtaccaacaccagagtacataccattgcttgtatccaaatttgcttaatttggatactttcaagttggattccttaccaaatcttgttgacttttggcctgattactatcgtccgcgtttactaaatttgaaagagggtcgatgcactgagtgtcccggactgtccaattcagcgcgtaaggtggataaggtgggtaaagtctcctctcataggacacaacaggataccactataggcaagaccatcagacgtcttaagggaattttagatcgtgctgagatgacttcatcgactcaagaatcaattgctccttcttcatccaacaatgcctatgaggatatagctagagctcaacaacaagttgcagaagctcaaagggatgcatcaattgctcgacaagaaactactgttgtaagtcatctgcttgagcaaatgatggaaaagttggcagtaaatgagcagataggattacaaaagagggcccatgagcacgtgggactacagaggggaacccagcaagagccaggtgctgagagtaag

SEQ ID NO: 78136 - DNA, 99 bp, Glycine max
  Peptide Sequence Number=SeqID_194914
atgactgacaggaaactagttaaggacaagccaagtgcggatagtggaagcaagtctaggggaagtgtcaagcaacactcttttaaatacacttattag

SEQ ID NO: 78137 - DNA, 261 bp, Glycine max
  Peptide Sequence Number=SeqID_194915
atgggcaactatgtggtagctcaaaaagggaccgatacccctaggaagtatacgcaagaccctaaatgcaagagactaagaaaggactctactaaggttatttttgtgggtcccaagattcagaccaaataccccaatcctcaagggaagaacctagatatagcccgtaaagatgacaagtcaaaagccatccctcccaatggctttttattggtgtccactacaaaaccagaaaaggacatttctatgcttcctaaatag

SEQ ID NO: 78138 - DNA, 252 bp, Glycine max
  Peptide Sequence Number=SeqID_194916
atgaaattttcggattctaattttccagcaccaagttcttcaaactctacgttatctctctcacagatagtttccggaaatctcactacgggagaaaaagaggtgagaagggttatagatggagaagacgcgaggatagatagggaatataattttaaagaaagggagatgcatttagtaaataatgtgagtgtaaatagaaacaacctttacccaaataaacatcggcctacagctgcatcttgggtataa

SEQ ID NO: 78139 - DNA, 102 bp, Glycine max
  Peptide Sequence Number=SeqID_194917
atgccgatggacagtccgccctattggacaatgcatgtgggagacactcagatcatctacagtgttgcctgcaaggtgtgggcggatttctcgtcaccttag

SEQ ID NO: 78140 - DNA, 267 bp, Glycine max
  Peptide Sequence Number=SeqID_194918
atgaagtccactaagctggacataagcacgaaggaaacaccaaggccgacttccacaagtcagataagaggcacatgccagaaaagtgctagcctctctccaaagggcccaggagtagacccagagaacatcaagaagatcaacacaggaaccaagaagcagacaaaagaaaagcagaagaccgaggcagacaaagacaacagcaacaacggtgtgagcgacctcctccaccagaacaggaacccgcctagcacattagaggtgtaa

SEQ ID NO: 78141 - DNA, 285 bp, Glycine max
  Peptide Sequence Number=SeqID_194919
atgaaagaggaagtgccaggtcacataaagcatagggacccaatattgagccagatatttaggacagttgtttacgaaggtgggtcccacttacactgtacacctgtcaacccgagagacccctgcgccctgaggaagattcgcgggcttttaaaatttttctcctccgcgggacccacagtccaatcaagagcgagaggagaggcgtgtgaaaagaagggtcccacgtgcgacgcaaaggtcaagagaggaaccaatgggaaagagagatgggtctatgggtaa

SEQ ID NO: 78142 - DNA, 222 bp, Glycine max
  Peptide Sequence Number=SeqID_194920
atggttatctgccaacacacttttgctatccagcgacccgagagtccgatagcatgcagagacgccttacggttatccacacctcatcatgcaaagaccccaagtccgattgacaagcaacatctgctgatcctaacccacgggtcaggtggcaggcgaacatacccagcggttgtccgtacaaacacaacatctgctgatcctgacccacgggtcaggtag

SEQ ID NO: 78143 - DNA, 426 bp, Glycine max
  Peptide Sequence Number=SeqID_194921
atgctggaggtatttgggctcttaaaagtcgtgggctaccttgcaccttctccacttttgaagtccatcaacaagctatttccctccaactccgatatggggaggaagtctggatgtgtacgagattatatggattttgatgagatcatttatcctactgagcaatgtgggggcttctttcctaatgctagagctaatgtctttggtagcatgattgatgatgaagtgttttctcctcgtgttgttgctatggctactagctcccttgtaaaggatattcattgtgcatatcatatcccaagaaaatgggttttgctggtatggttagggatcatttcagtaattgaatctatggctttgctggtcatgttcatggggaagaagttattttgggtgagcttatgggaatcttcaggggtcttctag

SEQ ID NO: 78144 - DNA, 522 bp, Glycine max
  Peptide Sequence Number=SeqID_194922
atggtatgggtaaggtttccaaacctaaacattgtctactatgatgaaagtttcttgttggcacttagatctgtgattgggagtcccattatggttgatactaataccctaactgttactagagggaggtttgctagggtttgtgtggagatcgatcttaacaaacctgtgataggaaaggttcaagtggatggtttatggatgaagatggtttatgaaggtttacatatcatatcctccaaatgtgggtgttatgggcatgctaccagagattataaacaaccagatgtgtcttcccctcaaaagcaaaccctattaaggaggtggaataaaagaaagatgcagctcgaacaagaggacaagattgggtccacagtgatagagactcctcaaagtaatagcaagactagatcccaagacgctaaagtttggactaagaagaaaagaccaagagttaatgaccagaagggaaaagcagcatacatcctctctttggctaatgtcactaaagaagccatatga

SEQ ID NO: 78145 - DNA, 768 bp, Glycine max
  Peptide Sequence Number=SeqID_194923
atggctccaaagaagctttctacaaagaggtctagaaaggatgccactgaagaaggccccagcaccgccccagagcgagtccagctgagggatgatgaataccctgacttccaggaggaggtagctcacaggcgttgggcaccactcatgacccctatggctaaatttgaccaagaaatagtcatggaattctatgccaacgcctggcccaccgaagaaggagtctgctacatgcgctcgtggataaggggtcggaaggaccaggctgatggtttcgacaaggaggccatatcccaattactgtgcacactggggcaggacttcgcccgaacccacatgaccaccctgacccagatatggatgacgttgctactcagcaacgtcctacctagcgaccacaactctgaccttaccctgccgaagtgtcaactggtgtatgccatcttgacacggatgaacgttcatgtggctcagctaattgttgacaccgtctatatgtttgcagcaatggctcctacgaggcaccccttggacccggagaagtcaaacagggctctgggattcccagctttgatcacaggcctctgccagttctacggagtgcccgtcgcccccagcaaggtcatcaggcctcccatcaccaaagccttcgtcgagaaatactacacccctaagcaggcacagggcgaggcaccccagcagcagccaatcaccgaggactggtactgctgcatgagtacttctaccagtagaccctcagccagcagg

SEQ ID NO: 78146 - DNA, 561 bp, Glycine max
  Peptide Sequence Number=SeqID_194924
atgtggcaaagacaacgaccaacctgtactaaggtcattgattcactgcttaattggtatgaccttcatcaactactttttcttatactggtatatacattggcagagttaattggtcaatcggcggatgaagtcaacagactcaaaatagaagatggcgatgttgatttaaatgcctctcttcaagtactagataggctattggattgtttccttgcattcaaagtcaaggtacaaccaaggttcaggaatgctgttgttcttagatattcagatgaatcaaacttgatcaatgttgtgctggatatgcttcccgatactgagcaatctatgtttattacctccgatgatgatcgttcaatgcttgactcgactgagcctacagagcttgaatctcaatttgtctctgttactgctgataatgaccctcttctcaggattccattgacaccaactaagcgtgcatcttttgatgagttggatgatggacccaaaaactttgagatttcacatgccaaagtttcctcaaataaattagcgaagctttgtcaacctgaatga

SEQ ID NO: 78147 - DNA, 447 bp, Glycine max
  Peptide Sequence Number=SeqID_194925
atgaaggaaatatgcgaggagctcaagatccagcaccacaattccacaccttataggcccaagatgaatggggcagtagaggcggccaacaaggatgtcaagaagattattcagaaaatgaccgtgtcatatgaagattggcatgaaatgctcccttttgcgttgcatggttatcaaacatcgatacgcacgtcgaccggggcaacaccattttcattggtgtacggaatggaatttgtgctaccgtttgaggtggaagttccttctttgaggatcatggtggagtccggtccaccttatagagggcaagcgattgacggctatgagccatggacgtttctactagagatgggtgaagaatgctttcgacaaaaaggtgcacctgcgcaggttcaacgagggagacctggtgttgaagaaggtgtcccaggccctaatggacaatag

SEQ ID NO: 78148 - DNA, 252 bp, Glycine max
  Peptide Sequence Number=SeqID_194926
atgttggatactcctgaacccctgaaactcccgcgtttcttaaggcgatctggtcctccattggaatggaaagttgaaaccctgaatcctgctattggtggaaaaggcgttgttcaaccatggtatgattttcttgaagaaatggactttgacgatggagatgaagtctctatttactatagatattatgaaaaaaattgggatattataattagaaggcgggaggattgggaggataatgacaacaattaa

SEQ ID NO: 78149 - DNA, 216 bp, Glycine max
  Peptide Sequence Number=SeqID_194927
atgcagtcccagtttcaatcccagatgcagtctcagggacttgcattgcctccagagcctatggctggtccctcaggaagattttacgagggatcaacagttcacaatattcctttgttgcctggccaagtgaaggttggtgttgaggaggttaaagatgcactggctcccgttcctgtacccactgatgagttacattactggggcagacactaa

SEQ ID NO: 78150 - DNA, 375 bp, Glycine max
  Peptide Sequence Number=SeqID_194928
atggatttcttttctgatgagagtttcgaatgcattcaagcatttcaaaactcaaatctcattccctttatgtctataaaattgcctgtgtattctgaattggtaaaagctttttattctaatcttgaaattcaagaaagtaccttgatttcagaagtttatgggataaatatggtcattgaccaatccctcttctatgatttgacccaattgactagtgacggtgatgcaatcccacccccaagggcattggatagaagactccaagaagattgggccaaagatgcaagagaaggccctagggttctcatgagccttagggtagctttgggcccatgggctaagtatgtgcccacttatctttgtacatattag

SEQ ID NO: 78151 - DNA, 444 bp, Glycine max
  Peptide Sequence Number=SeqID_194929
atggatgatcagaccaaaagcatacaaacattaagcattgaaggaagcattgaatatagaaaacataatcaattagatattaagtatttacatcagttgttcattagaaatccccaactagggtgtttagccagccattacagaagaaagcctaacaataataataagcttacaaaacctaggcactgtggtgtgctctggaatctgtgcaaatcatctacttaccctaattctgcacaaaacaggctttatataggctctaaattcatgacgttgtgcttagcgccaccctcgcacttagcgcgactgaagacaactgcgacgcttagtgcactgatcttgtgcttagcgcgcggccttgatattgatgacctgccagattcttctgtcgcgctaagcgcgttgaagctgcacttagcggtggatgcgtgcttagcctactga

SEQ ID NO: 78152 - DNA, 336 bp, Glycine max
  Peptide Sequence Number=SeqID_194930
atgtactctactgttcttttaataggtactaaacaagaatggaagcttgctcaatgcactgttgaagttgcttccaatggattatatactgcaactaatgagctctgcattgcctgtctaaaagcaaagtcagcttcaggtgatttacaaagcacggttctttcaatgagggattgtgcatatgaggctagtgttgcactgtctacttttgctcaggtttcaaggatccatactgctctaacttctaaaagtggttctatgcttgaagagagctgtccttcatcttacaatcccaagcactatcatgaactctacaatttccgaactagaggctaa

SEQ ID NO: 78153 - DNA, 255 bp, Glycine max
  Peptide Sequence Number=SeqID_194931
atgatgacaattaccatattaacctacactatcttcaatcttcttatcttgtgtaacacatggataagtgcaagtgaatgtcctccaatccacaagaataattcatccaacctagaagccatgaaggtgaggttgattccacacacaggattcatgtatcatgaacatggggatcttccagaaagcaaggattggaggaaggaaggagaagtaactgacatcaaggatcaaggcaattgtggtaaagtttcttga

SEQ ID NO: 78154 - DNA, 108 bp, Glycine max
  Peptide Sequence Number=SeqID_194932
atggtggagctaaaaagtgtttggttcaggagtttaattcaaaagtcgaagcgggccagtagtgtgcgcctccccgaggggcgcgttccccgtaaaggtgacacgtga

SEQ ID NO: 78155 - DNA, 129 bp, Glycine max
  Peptide Sequence Number=SeqID_194933
gcttcctttgatgccaatgttattcctcctcatgttcaaattcttcaacatgctgagtttgacatcaggaaggaggctgcctgggtcatctactactatgtgacttctagaggatctaggaccatataa

SEQ ID NO: 78156 - DNA, 128 bp, Glycine max
  Peptide Sequence Number=SeqID_194934
atggcgataatggtcagtgtgttgattactgcaaatgaactcaagtctgaaaagtggattttttgcctggcgagaaggattgaggaagcaggtattgaaatgatgatgagttgtgtttccaatgcatg

SEQ ID NO: 78157 - DNA, 222 bp, Glycine max
  Peptide Sequence Number=SeqID_194935
atgaaagggaaatcacaacatttgcacaaaagattaataggcctaactcgcaaaacacagtccccagtggagtcgccaactgtcgcaacctacccttcggtgggagggcgatgcgaggctcacgggtgcgtcttccaagggaggaaggcacgcagagtcgccaccaatgtttattcgaggaaaacattggagaaaccgaaatgtgtggtctacaaactttaa

SEQ ID NO: 78158 - DNA, 462 bp, Glycine max
  Peptide Sequence Number=SeqID_194936
atgatgataactaaagatgatgacaaaggtgatgacaaaaagctcaaaggtcgatcaaagaatgagttcaagatgttcaagatggaatcaagaacaattcaagactcaagaggaaaagttgaagaacacttcaagattcaagagatcaagattcaagattcaagaatcaagagaaggcttaatcaagataagtatgaaaagatcaagagcctagaagtcagccgcctacgggaattaggacagttgatgggtcaactccaacggcaagccttccgcaaagcctatagtaagatctgggacctaactacggcggagctagtagatgattacgccaaggcatatgcgaaaaaggaagcgaggggggagggtggtcgattcattgcacaaagaggcggtgatatggatggaccatttcgcccttactttggatgggagtcaagagcttccttgactactagctaa

SEQ ID NO: 78159 - DNA, 108 bp, Glycine max
  Peptide Sequence Number=SeqID_194937
atgtaccggttctttaaggattgttcgattcacattccttgtgggcagttttggatgcttcaatgggtgtggaaaatctaccctcttgaaggtgatgcaagtttttag

SEQ ID NO: 78160 - DNA, 2004 bp, Glycine max
  Peptide Sequence Number=SeqID_194938
atggagagggatttgatggaacctatatttatagtagttgagcgtgactactggtccttgtttatagggattgttgtagcctttgcagataattctcggcttagggtgacaagtttattgagccctcaagtatggatgagtgttgtccggtgtcctaggcagtacataagccccccaagctctgagccggcttgtaggcaaaaaaggttgtccagtgctgagggagtttgtcccgtgtcgaggggtgacaagtttatcaagcccttaattatggacgagtgttgtccagtgtcgggtgtggtaacctcaatgagtgtaagagatttacaagacgatgtgccagttgtccgtgatggatgtgtctttagtgtgtcaggcgtgtgcggtgcatgcataatactcttgcatgcgtgtcactcccgtagtatgcacatattggagttatggatgtcttcttttttgtttgattatgccatcggtctgggtgacagtgactctaagggcttgattgagcaacccatcatagatcgggaggtaatctcgataggcggttcctcgtctgaggatactcgtcgaggtgcatttgatagcgagtcctcatcttcggagagggcactaccttctgctcctaccggggagcctgtcccggttactgtgatcctccccccttgtgcttacgagggtgtgagaagaggtaatggtggcagagattctaggacgtctccccacgtcttggatctcattctacccttcacaacttttcaatgtgctctcttggagcacttgaatgtggccccttcccaactccacacaaaaaattgggcgatgatccaggcctttgagagtctgtgtcctttcttcaacatccagcctagtgtgtcggactattgtttcaaggtcctggctattggtgtcatgattgatggtatgccattgatgttcaacaaggacagggagtcctgcttcccgttctactggcaatctgaccccatcaagttcaagtcatatgacgaggatttgctgacctttgtggagagggtcgacaaagcaattttggagcagctgtcggcctcgttggatgcacgggccattttggctcttcctttggcaagcgatcctctcactgtcttggatagtgggattgtgccaccgtctattgttgctccgtctgttggagaagtgggtcaacctgtcggtaaggttggccctgttgctgttgttgctgaggtcacccctagtgctccttcttctgttttggcaaagaggatgatggatgatgttgctaggtcgtctagtcgtaagaagtcgaaggcccatctgagtctccatgccttgagactagctgtagggttgatggctagtgtgggttgcttttcaactatgcaagatatgccttcggctccacaggaggttactcctgctatagttgaagttactgtgccagccactcaggctgactttgtcatggccccgtcgtccactgttgcgacacctttgttgagtgtcggtgtggcaaccacgggtgcttccacagtgctgcttcctttctctacgactccagtggcttctccctttgttgttttagcaatggtggcgtcaccttttttgtcgtctcaccctctcgtctcccttgatcacttgtacacctctagtgatactgattcattaatgctactgattctaccaaagtttttctccaaaggagtttgccaattcaaaaggagtatggatgcagaggccgtaaggttgaaccaccaactgtctttcaaagcagagaagaaggacctaggtggcaaagtagaaagcatggaggctgagaaggatgggttttccaaggtgattgatgatttagaggtccgacttaaggattcgaagtccaagttgcaggttggcaaggagaaagagaccagcatggagcttgaggaccttgacctgggtctctttgatcccttcaaggatgtgaaggatgatgtcctacttgatgaggaagacattgctgcttag

SEQ ID NO: 78161 - DNA, 285 bp, Glycine max
  Peptide Sequence Number=SeqID_194939
atggcgtgcttcatatggatcacttctctcaattcctatgttgttgtcgtatgccagatgtaccaggggataggattcatattattgatttttgcttttaatggacccagcctatgtcatcctactatcactttacgatgcccatggctgaggtgcttattccatccgagtcgcttttgtcgtctagtgaagttgcaatgtcttctgttgattcctgctcctcatccaagcaaaagcttaggtaccacctggggtagatatggtggatcttgtgttggaggatga

SEQ ID NO: 78162 - DNA, 363 bp, Glycine max
  Peptide Sequence Number=SeqID_194940
atgcgtagtgattgcttagtgcaattctccattctcaatctttttcggagccccatgaattgcgttttcgttcatgtgtcctccaccttcgtgtttggagctatgcgtagtgattgcttagtgcaattctccattctcaccctttttcggagccccatgaattgcgttttcgttcctgggtcctccaccttcgagtttgaagctatgcgtagtgattgcttagtgcaattctccattctcaatctttttcggagccccttgattggcgtttccgtccatgtgtcctccagcttcgagttgggagctatgcgtagtgatggcttagtgcaattctccattctcaatcttttcggagccccatga

SEQ ID NO: 78163 - DNA, 3195 bp, Glycine max
  Peptide Sequence Number=SeqID_194941
atgaatgaagcatcaatcaataacacagagagttatctatacctccatccaagcgagaacccgactattgcccttgtttccccagtcttagactcaactaattaccactcatggagtagatccatggtcactgcgttgagtgccaagaacaaggtggagttcatagatggaagcgcacctgaatcgttgaagacggatagaatgtatggagcgtggcgccggtgcaacaatatggttgtatcgtggatagtccactcagtggctacctccatacgacaaagtatactctggatggacaaagctgaggaaatttggcgcgacttgaaatcaagatattcacagggatatcttttgcgaatctccgatctccatcaagaagcatcgacgatgaagcaagggtcactctcagtcactgagtatttcactcgtttacgcatgatttgggacgagatcgagaactttagacccaatccaatctgctcctgcaatattagatgctcctgcactgctttcaccatcatcgcgcaacgcaagctcgaagatagagctatgcagttccagcgaggtttgaatgaacaatacgctaacattcgttctcacgtgcttctcatggatcccatacccgccatatccaaaatattctcctatgtagcccaacaagaaaggcaattactaggtaacactagacaaagcatcaacttcgagcccaaagacatctccattaacgccgcgaagaccatttgtgatttctgcgaacgcactggtcatgtggaaagcgtgtgttataagaagcatgggctaccctccagttatgatgcaagaaataagagtaacaatggaagaaagacgtgcacccactgcggcaagttaggacatacagtggacgtttgttaccggaaacatgggtatccgccaggatacaaaccctacgatggaagaaccaccgtgaacaacgtggtggcagtagaaagcaaagccacagatgatcaagctcagcctcatgagtcccatgagttcgttcgcttctcacctgagcagtacaaggcactactcaccttaattcaggagccatccgccgggaacacgacacccaatcaacccaaacaggttgcgtcaatttcttcatgcaccgccaatacaccattgaacccaggtatgtcaccttctaccagcactcacctcacttcttggatactagattcaggagctacggaccacgtaacttgctccttgcataaccttcactcccataaacaaatcaacccgatcacggtaaagcttccgaacggccatcacgttcatgccacttattcaggaacaatgcaactctcgcccaacataatcttacacaatgttctttatatacccactttcacgttcaatcttatctcaatatcaaagcttgtatcttccactaattgtgaattaatcttttcttccacattgtgtgtattgcaggaaacgaacaatcatatgaagattggtatagttgaagcaaagcacggtctctaccacttgataccaaaccagataatcaccaaagctgtaaactccaccatcacccatcctcgatgcaatgtaatccccatagacctttggcattttagaatgggtcacccatcaacagaaagattacaatgtatgaaaacctattatcctcttttgagaaatgacaaaaactttatgtgcaacacatgtcattatgcaaagcacaagaaaatgccattttcctctagcaattcgcatgcatctcatgtttttgatttacttcatatggacatatggggcccgtgttcgaaactatccatgcatggtcacaagtattttctaacgattgttgacgattgctcgcgttttacatggatacacctcatgaaaactaaagtcgaaacacgacatatcatcatgaacttcattgcattcattgagacacaatataatggcaaggttaaaatcataagaagtgataacggggttgagttcttcatgcatcattattatgcatcgaaagggattattcaccaaaccacgtgtgtcgaaaccccagagcaaaatggcgtagcagaacgaaagcatcaacacctgctcaacatcacacgagcactcttatttcaggcgagcttaccacccaatttctggtgttatgccttgccacatgccgcatacttaatcaattgcattcctacaccatacttacatggcatttcaccttatgaaaaattacataaacatccatgcgatatatctaatcttcgcgttttcggatgtttgtgttacatcaacacacttaaagcgaatcggcaaaagcttgatgccagggcacacccatgcatcttcattggttttaaaacacatacaaaaggatatcttgtgtatgatttgcattctcatgatattacagtatctaggaatgtcacgttttatgaagaccacttcccatacttatctgaaatccaacaaccaaacccagataactcagatccgtcttcgggatctttttccgggaagaaccttgacccaccaatagaaagctacccatcacgacccatgatgacaataccttcctgtaatgaaccttcaaatgagcaatctccttcacaccttagatgttccacacgagcgagacatgccccgacatatcttcaagattatcacagagaccttgcttcatctacatcaaatgcttcaacgattgttcgttatcctctaagttcagtgctttcatactcacgcctttcacctgcgcacaggaacttcttcataaccatctcgtctacaaaagaaccctcctcatatgccgaagcttctcgccatgactgctggattaaggtgatgaaggtcgagttacaggctctacagtcgaacaacacttggagactcacacctcttcctcctcacaaaacagctatcagatgcagatggatatataaaatcaagtattgcgctgatggttccatagaaagacacaaagcgcgtttggttgcaaagggttacacccaaatggaaggattagactatctcgatacattttcttcggtagcaaagctcaccacaatccgtgtttttcttgcattagctgcgctcaaccaatggcatctacgacaactagatgtcaacaacgcgttcctccatggggaacttgaagaagaagtatatatgcagattccaccaggccttttggttgagaatccatag

SEQ ID NO: 78164 - DNA, 291 bp, Glycine max
  Peptide Sequence Number=SeqID_194942
atgcttccaccttccttggccgcatcgcacctccgacatcatgactctaccattgcacctccgactgatccgcgataccattgtgcgcaaatttggggcggagaaggtggcggcgcgattgatgggtcgtggttaggtggcacgtgcatcaatcttggggacagaggtggcggctccacaaggcggaaagaagtggtgagtgttggtggtggtggtggtggccatgcagatggagttgccggcatgatagatggaagtggtgggagagaagaagaagaagaactagggtaa

SEQ ID NO: 78165 - DNA, 1521 bp, Glycine max
  Peptide Sequence Number=SeqID_194943
atggctgataatgttgttatcaatagcgcaacttttgtcaacctgttgaattcctattatactcatcccaatgagcatcctggtgttgctattgttgctcaggttctcaatggtgtcaattatcactcatggtcacatgctatgctccttgccctgaaaaccaagaagaaggtccagtttgttgatggttctttgcctcgtcctgctctcaatgatcataatttcactatttgggatcattgtaataccttggtggtttcatggcttcatcattcgctggatccagaaatccttgacttacaagaagagttgtatcttcttaaacaaggtgatgctactatcactacctactttacaaaattgaaaggtttaatccaagaattagacaatttttgccctattccttcctacacatgtgttgttgtttgtgcttgtgatcttattcctgttattaagagttacagagaagttgattatgtgattagattcttaaggggcctcaatgaacaatactccatatctgatgattctcgagtttttgctcaagtggataccagtcatggtccttatggcagaggccaaatggataccagccatgcttcttatggcagaggccgaggtcgtggaggccattcattaggtggaagagggggtgctatcaaccaatactccttggatgatcaagaaattgaagatgatttgcaatcccttggacagaaagaggtggttgcagatccttcatctacagcttttacaccagagcaacataaggctttcctttctttattgcaacaaacttcacaagcctcttcctctcaccccactaatcagttgattggttctcataagaatggaaattcaggtatattttgtgccactcttcatgcttatagttccaacataaactcttgggttcttgatagtggagctactaatcatttcaaagctaatggatccattgacaagcacaaggctagattaatagccaagggatttacccaaactgctggtttggactacattgaaacttttagtctagttataaaaatgaccacagtcagacttgtgttatccctaactgcttctcagggttggcatctccatcaacttgatgttaacactgcctttttgcatggtaatttacatgaggagatttatataaaggtaccaccaggcctgacagttgataatccagctctagtttgcaagctacaaagatctctgtatggtttaaaacaagccagcaggcagtggaatgtcaagcttacttccaccttacttgatttaggattccaacaatccaaggcagattattctcttttcactaaaaggtctcctactggtctcactattgtgcttgtttatgttgatgatttggtgcttactggcactgatcttgctgaaatccaacaactcaagcactccctggatgccaaattcagtattaaggatcttggaatgctcaagtacttccttggttttgaagtagctcgatttgcatcaaagaatatactgttttga

SEQ ID NO: 78166 - DNA, 339 bp, Glycine max
  Peptide Sequence Number=SeqID_194944
atgacggacaaaattctttcaaacctgcagatctttaatgaatttaatgctcgaaagccagatgaattcaacatattcaaaggagtcacaagaaactacctctttatgggtatcattggattaactgttgtgcttcagattgtcatcattttatttcttggcaaatttacaacaacagtgaggcttaattggaagcagtggctcatctctgtcgttattggattgattggttggcctcttgctgtgattgggaaattgataccagtgccaacaactcccatcaacaatgttttttcaaaatttcgaatttctagaaaggatcatgaggaatctcaatag

SEQ ID NO: 78167 - DNA, 306 bp, Glycine max
  Peptide Sequence Number=SeqID_194945
atgggaagaagatcctttagcaggaacaacaatcattgtgcttcacaagatgcttgggcaagggcccgatatgcagcttctgaagaagatttggacacaatggattgcttcttactcttccaagaaattagggaggttcctaagaagaagcatatacatgtgatggaccttcgagtgtcaagacaagctccccaatctgagtcattgaatcttgttaaagaagtggaagatgaggaggaaaagaacaagcctctgctagtagtgcctttgggatatcttagaacatggtgggcagcttgcatgtga

SEQ ID NO: 78168 - DNA, 186 bp, Glycine max
  Peptide Sequence Number=SeqID_194946
atgttcgggcgacgcaggtttctttcctttcctatggtcatcggggcagtcatcattggtgttgtttctgggaaggcaatatttggacccccacttgatgagtattggaaaaagaagcaacaggaagaggtagctgcagctgctgctaaggagaatgactctacctcaacctcaacttcaacttag

SEQ ID NO: 78169 - DNA, 243 bp, Glycine max
  Peptide Sequence Number=SeqID_194947
atggcttacacccacattccggtgaaagttgaaaatcctgacctcgcaccctacacttcagagccctacaatgctcaatggaacgccccggggcttctccgtgacaagcacacgttgcgttcgagtcgtattctcggagaaatggaggttgatgaaccttggctagggttatggctaccattgaatttatcaagtggtcttcgtcattggaagtgcggtagacagactttgtggttgatttag

SEQ ID NO: 78170 - DNA, 819 bp, Glycine max
  Peptide Sequence Number=SeqID_194948
atgggatgtggatctggaatttctctaccaggaatgttccgtgtggtaactgataaaactgttttttctcacccagaagctcaaataggtttccacccagatgcaggagcttcttatgttttgtctcgtctacctggctacttaggggaatacttggcccttacaggagataagcttaatggtgttgaaatgattgcctgccgccttgctactcattattcactaaatgcaaggctctctttgcttgaagaacgtcttggtaaactaatcacagacgaaccttctgttgtggagtcatccctcgcacagtatggtgatcttgtttatccagataggagcagtgtccttcacaggattgatactattgatagatgtttcagtcacgaaactgtggaggaaattattgaagctttggagaaagaggctgctgagtctaatgacgaatggtactcgactactctaaggagaataagagaagcctccccgttgagtttgaaagttactttacaatctatacgtgaaggtagatttgaaacacttgataaatgtcttgtacgtgagtatcgcatgtccctacgtggtatttcaaagcatgtctcctctgatttctttgagggtgttcgggcacgaatggttgatagagattttgcaccaaaggcatatctattttgtccaagaatctgtacatttatgaatccatgggacccacctagattaaaagatatatcagaggacatggttgaatactatttctctcctttaagtgaagttcaatctgaattagtgctgccaacagctttgcgagaaccttacatgtga

SEQ ID NO: 78171 - DNA, 369 bp, Glycine max
  Peptide Sequence Number=SeqID_194949
atggcaacctgcataaatgcccataaaatcttcatacaggtcctgaatgaagaatctctcaaagttcagaaaaacacaaaaaagtcatcaaatacagaagagagctattgtaactcattatgctgcgataatattcataaattacaaagatttcatttgtgccattgctatagaagattactcttgtctatgcagaaagcgttagaccctggtttcaccacttcaagtggcaggaaaggtgtaagagaggacgtgagagtgctgagatctaaaagtaaaatcctaaccatgcaagagaccagcacagatcaatgtcattttgctctaaaatggctacggaagtggactcgccaacttggctttgaatga

SEQ ID NO: 78172 - DNA, 780 bp, Glycine max
  Peptide Sequence Number=SeqID_194950
atggctgatcacggaaccaggaagacaaccacaagccgtctggaagaagcaatcgcacgcctctctaacagccaagcaaacctcacagaacgttacacggacctctccggtagggtggattcgatcttggaccacctcaggatgcgtgatgcacaccagaaccaaccttcctcaaacagctcgagaaaccaccgtaactccgttaagctcgatatcccgcgctttgacgaggaagagagaatcaccgtagcctcactttaccttgacgacgccgccctcagctggtaccagtggatgttcagcaatggcttcataacatcatggcaagggtttcttcaagccttggaatcgcggtttgctccaacattctatgacgatcccaagggagctctattcaagcttgtgcaacgcggttctgttaatgactacttaacagaattcgagagattggctaaccgtgtgctttttcatctctggattaaatctcgaactccgacgcgaggtgcacgcctcaccatcctcatagacagtgggagtacccacaacttccttcaaccacgggttgcgcaattccttcaccttcccgtcaaaaccacacgacctttaagggtcctcgtcgggaacgggtatgtcctggactgcaaccaacgttgccctgatacacagctttcgatccagggccactcctttccggtcaccttccacttacttcagatcagtgggggcagacacaatgcttggcatagattggttaaaacaatttgggcccatcacgactga

SEQ ID NO: 78173 - DNA, 306 bp, Glycine max
  Peptide Sequence Number=SeqID_194951
atgcagagattcaaagctctgctacctcaacaaactaggtcctcacttcgcactctctgttctcaccgtcgagctttctccgctcaaccgaattacgcaaagcaccacgacgacgattctcaggaacagattttagtcgaaggaagagcgaaatcacgagcagctattctcaacaggccgtcttcgctgaactcgctcaatgcttcaatggttgctcggttgaagaggctgtatgattcctgggaagaaaactctgatattggctttgttttgatgaaggtatcacagtcgttttcacgccaatga

SEQ ID NO: 78174 - DNA, 1937 bp, Glycine max
  Peptide Sequence Number=SeqID_194952
cttcctccgtaagtcatcttcctcctgtggctgcacccgtggcaaggctcctccgtcgatatgagaagctcttccagcccccgatgcatctacctccttcacgcgaggtgaaccaccgtatcaccctacttccttccaccgcgccggccgagtacgagcccatactcttctccagtccttctggtgaagaagaaggacggcacatggcgaatctaggccacgcatcatggttttccaagctcgatctccggcaaggtttccatcaaatactcatgaacaaagctgacatagagaagacaacctttcgcacacaccatgggcactacgaatacctcgtcatgcccttcggcttgtgtaacgcaccttcaaccttccaagcagccatgaatcacctccttgcgccgttccagcgtcgtattgcaacagtgttctttgacgacatactcgtctacagcgattcattatcctcccatctagaatgccttgggcacgtcatctccggcaaaggtgtagctcccgagccgtccaagattcaggccatcgtccaatggcccactccaacatcagccaaggatcttcgagcatttcttgggctcacggggttttattggaaattcattcagcagtatgcagctatcgcaaccccactcacccatctgctatgcaaggatgcattcgagtggtcacaagagtcgcaaaatgcctttgacaaactcaaaaccgccataaccagtgcgctggtgttggctctccctaacttcaatgagccttttacggtggaaacagatgcgtctggtaccaccatgagggctatgctcatgcagcaaggacacccattagtgttttttagcaagaatttcagcccacgtttgtcacacgcttccacatacgtgaaggagcttcatgctatcatcgcggcgaccccgaagcaacattactacctctccaaattgcttggcttcgactatactatacagtataaggctggtgcagctaacgttgtcgtggatgcactctcgcgacggccacctgcttcagttcaactgcttctcctctctgtgccttcattcgagagtgcaaggtttgtcagtagaacaaggccagtaccaggcgcatggcaggtctactgcaacctctaccagctccgacaggggttctccaagggggtgcatctcggagctttacccacagggttctcagccttcaaagttgccacggtattcctcgatatcatctgcaagcaccatggtttccctagaagcatcatttctgatagggatcccgtattttttagtgccttctggagagaattgtttcgactctgcggcactcgtcttcggctcagcacgacgtatcatccacaatcagacagccagactgaggtcatgtatggcaaacctccaccaacaatcccccattacattcctagcttaaccaacaatgaagttgttgagtccctagttgcaactcgtcaggttatgcatgataagttgcagaagagactgaaaaaggctcaagactccatgaagaaatatgcagatgctcgacgcgaagacgtaaccttttttgtgggtcaatgggtctacgtaaagctccgcccaacccgccagcgctcggttgctggagtcaaccattcgaaactatcaaaatgttacttcggacccttcaagatcctggctcgaataggggaggtcgcgtaccgattggaacttccggcgagagcacgcattcaccctgttttccactgctccttattgcgccagtatcacggagctccgccctcaacaacggagcctaggcctctggaaatcataggccataagcccttgcaacgccccctttgcatcttggatagcaagcttgattcttctacatcccctccaactcaactggtcctaacccaatgggccgagcaacctcccgaagacacctcctag

SEQ ID NO: 78175 - DNA, 210 bp, Glycine max
  Peptide Sequence Number=SeqID_194953
atggatggagttaggcataagacagatatcaaggaaagtagcttaaaccacagtctcatggctactgtttcactcaagcaacaaaatcagaagggctttctcaggcttgtagtgaggcttggctacaaaaattcattggtttttctaggattcaagggtttagattctcagagagcacaaatcccagacttatcccaatggtctttttaa

SEQ ID NO: 78176 - DNA, 184 bp, Glycine max
  Peptide Sequence Number=SeqID_194954
ggtctgtatagacaacgattccagcagagactgcacagtggtgaagattgatagcgcgaacaggcatgggatattattggagatggtccaggtgttgacagatcttgatcccgtcatttccaaatcatacatttcttccgacggtggatggttaatggatggtcagtatatatgcctcccttaa

SEQ ID NO: 78177 - DNA, 294 bp, Glycine max
  Peptide Sequence Number=SeqID_194955
atggagtttgatagtgagggtgagaatgatggaaataatgtaaggggtagtgaagctaggaatgaagcggggtcacaagaaaatgtgattcaagggagagaaatgaggcagccgacttggataggagaatatgtgagtggtgaggggttgaatgaagaaaaagaagtagaggcctacatggtgcaagatgttgtaggtgacgatccaactcagtttgaggaagctgtgaagcatgagaaatggagaaaggctatggatagtgaaatcaactcaattgaaaagaatcagacttag

SEQ ID NO: 78178 - DNA, 471 bp, Glycine max
  Peptide Sequence Number=SeqID_194956
atggatgaggttgaggctacaacagaatacgaacaggattatgtggtggttttccttcctgtggcggaattgattatggatttgaatgcttgtaataccaaggcagatgctgctcccactcagcacatgccttacaacatttcccatatgcagcaagacacttgggtgggtccaagggaatcctctggtgatggtcatctcttaaacttgaaggtggaaggaagaggtctcactatgccatctcttgataaaggcattgattatgcctttattcatggacataggcacatgtggggaggaatgcgagagtggaagagaaaaagacgtatgagaggaagtgaaaagggtgggggtgagaagaagagggttgggcatatggagaagggaaggggaaaaggtgggtcccctgatacaaatactatgtttgagaacgaagataatgcatacactactatattcaatgaactttag

SEQ ID NO: 78179 - DNA, 471 bp, Glycine max
  Peptide Sequence Number=SeqID_194957
atgtggtcatctgcacccttcccggagatgtcagcgtcttccggccgagaccgcgaaaaagtctcacttctgctgtcgtggctcgagaatctgatagcatgcggagacactttacgattatctgcacctttgtcatccagagacaacaagttcgatgacacgcggagacaacatatggttgcccgcacccttcctgtccaaagactattgaagtcccttttatcatctggagacgaacaagtttacctttgtcatccagagacgttcaagtccaatgacgcgcaaggctcttctctgttaaccagagacgatcaagtcagtcattgcatgccttcaaaggcgacaatgaccctcacacatttcgaagacaaaaatgtcttcagtcattacatgccttcaaaggcgacaatgaccctcatttacattttgaagacgacaatgtcttcagtcattgcatgccttcaaaggtga

SEQ ID NO: 78180 - DNA, 829 bp, Glycine max
  Peptide Sequence Number=SeqID_194958
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctatctgaaggggattatttgccttcacgacaacgaataaatgattgtagaggtgaagttatctacaatgatggttttgaagtattcacggagcaatgtagacggttggggatatcacttgatagtgatctggcatttggttatcaatcaatgaataataattatggtggatatattgctccactgccacctgggtgggaaaagcgttctgatgccgtgactggaaaaacatattatattgatcataatacaagaaccaccacatggatgcatccatgtcctgataaaccatggaagagatttgatatgacatttgaggagttcaagagatcaacaattttgtctcctgtatctcaactagctgacctttttctacttgctggggatattcatgctactctttacactggatccaaagcaatgcacagccaaatacttagcatattcaatgaagatacaggaggaaagtttaaacagttttctgctgcacggggatcctctagagtcgacctgcaggcatgcaagcttggcactggccgtcgcccgcaccgatcgcccttcccaacagttgcgcagcctgaatggcgaatggcgcctgatgcggtattttctccttacgcatctgtgcggtatttcacaccgcatatggtgcactctcagtacaatctgctctga

SEQ ID NO: 78181 - DNA, 1335 bp, Glycine max
  Peptide Sequence Number=SeqID_194959
atgccaatgtttgagcctcattgtaagaggggtggggtggagggccagattctagatctggacacggcggtgaaagatggggttttgggtggtggtgtggatactggggttgtgggaactggggttggtgaaaaattggatcttgggaaaatgattgaagagttggacctgtgtgaagttccctctgtgttcatttgcccaatttcccttgagccaatgcaggaccctgtgaccctttgcactggccagacctatgagaggtgcaacattctcaaatggttcagtttggggcacttcacttgccccaccacaatgcaagagctttgggacggttccctcactccaaacactaccctccaccgtttgatatccacttggttttctcagaagtaccttgtgatgaagaagagatcagaagacgtgctggggagggtgttggagatcgttgaaactctcaagaaagttaagggtcaagctcgtgtttcagccctcaaggagctccatcaagtggtggctgctcacgctactgcccgaaaggcgttggttgacggtggcggagtctctgtggtgtcgtcgttgctcagtcctttcacctcgcacaccgttggggccgaggtcattggtgttcttgtgagtttgagccttgattgtgagtccaagaggagtctagtacagcctgcaaaggtttcactgatggtggacattttgaatgagggttcaattgagacgaagatcaattgcacgtggctgattgagacactgattgaagagaaggattttcagatggtgattttcaggagccatagccttttggttggattgatgaggcttgtgaaggacaagaggcacacaaatggaatctgctctggactgaggctcctcagaacactgtgcttgcattcagaagttaagagtctgctagtgagcattggggctgtttctcaattggttcaattgttgcctggtttggagcatgaatgtttggaattggctctttcaattttggatgcattggcatcagtccctgaaggcatattagctttgaaggattgttctaataccatacctgttatggtgaaactgttgatgagggtctcagagaactgcactcaatatgcattgtcgatactatggtctgtgtgcaatgttgcacctgatgagtgctctttgattgctgtggaagcaggacttgctgcaaagctcctccttgtgattcaaagcggttgcaatcctatattgaaacaacaatccaccgagcttttgaagttgtgtagtttgaattattcagatacaatcttcatttccaagtgcaagcttactagaacaatccaatga

SEQ ID NO: 78182 - DNA, 1668 bp, Glycine max
  Peptide Sequence Number=SeqID_194960
atggatgttgtgcaacatcaaccttttagcaaggtatatggaaagatctgggatctggcaatgatagaaatgttagtcgaggccattgcagctctcacccaatactatgaccaacctctaagatgtttcactttttgggactttcagctagcactgaccataaaggagttccaggggatcttaggatggccaatgggaggaaggaagccatacctcttttctgggtactactcttctatggaaaaggaagtgtttggaggaaaaggcggaagcttaagcaaaccaagggaagtgagcatcattcatggatgtattagcactgctggtgtttggggtgacggacttgtggatttggctgcgattgacgcctttcttgtctatcaccgtagtaaggaaagcccaattgttgttgtgttggcaaatgtgtatgatacgttcgacctgagatatgagaagagtagtgatcatcacatgtgcttggggaaagacaaagtaaattgggaagagctgttgacaagcgcaacgggatttttcattagttggttcccacgatggaaagaaggggtagcaggggtattgtgttcaggcgaaggatttctgaatgtccctttgatgatgacaaggggattcaatgaagctaatatgaggatatttcagaagatttgtagggtgtggaatcaattggaaaggatagataagaagcttaggggaagaaggaacggtgccataggcggttatcacaaatggctgaaagttagagtgaaagggattgcttggctaaaaaagttggagggtccgaataaggtagagacggaggtgctcgaggagagcaaagaggtacgagtcttgaaagccaaattggaaaggacaaaagtggcgaaggacaagctgaaaggggtgatcacctgggttaggcaaaaatgtgacaggctaaaggatatcaacatgtccacagttgaagcgctagagcaggaaatgaaaaagcccgaggggaagattcgagcagaaaaagaaattgtcgggagtcaaaggaaaagcttgaaggagcagttgagcatgacagagaagaatatgttgataatcattgaccagtataaggagaagctgatgaaagagagacataatctagctactattcatgagcagacgttgagatatgagcagatgaaggtgttcactctcacactaaatgaaagtcaagagctcccaaaactactagctaaagccaaggcgatggccgcgtatgctctactcccgatgaatgacatagaacaagtacaagagcaaatgaaggccgatatggaggccatgaaggggcaaatgacaatgatgatggaagcaatgatgagcatgaacaagatgatgaaggacttatgtaagaatttcaagatccaacaccatgattcgacaccttatcagcccaagatgaacgttgcagttgaggccaccaataagaaaatcaagaagatcatccaaaagatgacagtgacatacaaagattggcatggggtgctgccattcggattgcatggttatcgaacttctgtgcgtacttctattggggcaaccccgttttcattggtatataggatgaaagttgtcctcccttttgaagtagagattccttcttgttggacaagtggcctcaataacttaagaggggggtga

SEQ ID NO: 78183 - DNA, 324 bp, Glycine max
  Peptide Sequence Number=SeqID_194961
atgaggaatcctgcaaagctttgcttttgtggcagaataatagtggtcgagatagcaccgatgccaatcaacaacccaaaaagcattgacgtgaacgaggttattgttcaccagttaggaatcctacagagcttcatcttctgtggtagaaaagcagtggtcaagataacatggatgccaatcaacaacccaaaatgcattgacgtaaatgaggttactattcgtccgttaggaatcttgcagagccttgtcttttgtgacataaaagtagtggctgagatagcacaaacaacaaccaacaaccaacaacccaaaatgcattga

SEQ ID NO: 78184 - DNA, 201 bp, Glycine max
  Peptide Sequence Number=SeqID_194962
atgaagaatattttcgacaaaagggtgagcccgcgtagattcattgagggagatcttgttttgaagaaggcccaaaactatgaaggaccttttatggtgaagaaggcattcttgggtggaacactgatactcacaaatatggatggtgaagagctgccttcgcctgtgaattctgacgttgtcaagcgatactatgcatga

SEQ ID NO: 78185 - DNA, 1062 bp, Glycine max
  Peptide Sequence Number=SeqID_194963
ggtagaatgatttcaccagagattcatctaataggggaaagttctaatgatgatccctctcaccattacagtggcttcaacactgccagtgatcatgtttccagctctcccgctgataacactgcccctattgatggcatggctcctcctaacactggtgtcgttgcccctattggtggcactgctactgctgaaggaggactccgctctaactccaacgtgtgtgagaatcctggggaggatgaggtcgagtctcctttgcctaatcctcctcctatgcaagtcatagtgccttgtccttttattcctcccccacctcctccactcagaaaacctagtaaggccaagaaggtgtttcctcttgttgtccttctaggttacacctgggttcatagggaggatgggtgtgtctttatgtgtgcctctccaaatgataccccttttatgtatatgtattccactcttttctctcatcttcacctcattgtccctttcaacaggctcacatcgagaaggatgaaagggctaaggctaccaagactaaagctgagaaagataaggggaagcggaaataaaaccctgaaagatgaatgggttcctcctccttctcctatcaacccgggtgtcgccaacagggtggagctgatgccaattgctacttctttcaccatcgagagtcatcctacctttctttcaatgaaggaagggactacttctctttggagtaaagatttcaattatggtgccctcatccaatcttccatgctcaatcagtcgaaccgtgacatgctaagggaggctggcccccgagttgaatcccaagatgaggctttaaagaccaagttggctattgctaaggacttggccaaagcactccaagacatgatcgaccgcctcaatgagaagttttctctcttcatggtgaatgctaagaaggttgagggaaatcttaagagtgatctctcaacaaggttgaagccagtttcttcaaggccactcgccaagccaagtaattcttcaaagaagtcgatgtcttcctcttcgatactgataaggacatga

SEQ ID NO: 78186 - DNA, 186 bp, Glycine max
  Peptide Sequence Number=SeqID_194964
atgagagactctgcacctaccagcaatgtaattgagcctttaaatgctgccagagaagttgttggggatgttgattcaataaaggatgaacttgttttatggcttataaatgatgataatagaacttgcggtgtaacctgtgaacaatattggtttagatgcctgactttagccatgagagcatga

SEQ ID NO: 78187 - DNA, 474 bp, Glycine max
  Peptide Sequence Number=SeqID_194965
atggcactcaagagatttggacatgtaaaagacaaaacttcttcaagcttcttcaagctccaaggcttagtcttcatgttgctccccctatctctaacaataatcatgtggttgatgcctatactactcggacttgacgagccttcatactcaatggtcccccgagtaggctactcaaatctaaagaatctagtagatataattaagaaggaaaccaattgtaatctgacctactttctgatacctgtatacctctacacctttaacttgagcatcgaagtgtcttcccagagtcaaagccaagtattggaggaagcttgcagtgtcgagttgatccaattgcgactaagaatcgacctccacctgatctctagtcataacactgaagattgcactacccttaaggataaaattgaaaacttgatccaaaaagggcacttgccaaagtttttcaaagacccattacatgattag

SEQ ID NO: 78188 - DNA, 864 bp, Glycine max
  Peptide Sequence Number=SeqID_194966
gagagcgcagatgccatccgcgctgccgccgctcagcagggcttcgacgaacatttttccgtcagcgttgatgcgcagactgactgggaggcgattttcgccagctgtcagtcgctgagcctgttcacacagcgccagacgctgacgctgcaactgccggaaaacggccccaatgccgccatcgccgaacagctggtgaaactggccgcgctgctgcacagcgacattatgctggtgctgcggatggcgaagctgaccaaagcgcaggaaaacagcgcctggttcaaagcgctcagcgccagtgcggtgctggtgccgtgccagacgccggaacaggcgcagctgccgcgctgggtggccgcccgcgcgaaagccctgcagctgagtattgatgacgcggcaattcagctgctctgctactgttatgaaggtaatctgctggcgctggcccaggcgctggagcggctgtcgctgctgtggccggacggcaaactgacgctgccccgcgtggaagaagcggtgaacgatgccgcgcatttcacgccatttcactgggttgatgcgctgctggccggcaagagcaaacgcgcgctgcacattttgcgtcagctgcaaaaagaggacagcgaagtggtgattctgctgcgcacgctgcagcgcgatctgctgacgctactgcagctgcaacgccagcaggcgaagcagccgctgcgcacgctgatggatcaacaaccgactggatgcgcaacggctgcagcaagcggtgcatctgctggctcaactcgaactgaccatgaagcaggactacggtcagaatctgtggccgcagctggagacgctgtcgttgctgctgtgccatcgtga

SEQ ID NO: 78189 - DNA, 522 bp, Glycine max
  Peptide Sequence Number=SeqID_194967
atggtagccacaacctaccaaacatcccatgagtgttcagaagaaacaattattgatatcctagtggcaggattttccggacaattaaaaggttgcacagtcaaaacagatctcaatggaaaagtcattactaatgacgacaataaagagattcttgatgctgttaataccctcgttttcacaatagctcaacattttattggagacccatcattttggaaagatagaactttagcagattttagatggtatagagataccttcctaactagagtctaccccagagaagatagtcaacaacctttctggaaagaaaaatgtctagccagacttccaagatcattaggagataaggttagagacaaaatatgtagccaatctgttaatggagacattccatatgagaatttaagttacggtcaattaatttcttatgtccagaaagtggccctaaaaatctgtcaagatgacaaaattcaaagacaattagccaaagagaagcccaaacaaagagagatttag

SEQ ID NO: 78190 - DNA, 540 bp, Glycine max
  Peptide Sequence Number=SeqID_194968
atgtcttcaaggaaaagaaagagcgtcggttcaaggccaactgctcaatatgatacacggagattccattcctttgaggcctggaccagatatactgacaatgtgatgggaagacacatattagctgagaggaaagtggaaatctatcacacagagttggatgaattcaagggtgagcaggagaggcgtaactttcacaagcgcctcaccaacttagctgataggagcattgacctcgtgttggtgaaggagttctacgccagcctctacagtcctgaggggccttcacctaaacaagtcagaatccggggccacttaataaggattgatgcagacagcctcaatgcctttctagaaacacctgtggtgcttgctgaaggtgaatctttgcccgcctactcaagatattgcaggatgcctactaacattagagaaattgaggttgcattgtgcatacccagccgagggtttattctaaatgttgaaggtcacccagggaagatcctcagaaaagatctaacctcccttgctcaagtctag

SEQ ID NO: 78191 - DNA, 252 bp, Glycine max
  Peptide Sequence Number=SeqID_194969
atgagtgctccaaaattctcagtgtttttcttgctcctcgttgttttgttgtcttcaatgcaagaatcaacctctcatttagacaaccatgtagaattggaaagaaaatcatcagaagaaaaagtttcttccatgtttgttcagaattattctgctattctatcctctttgaagaattcaaggaagaataggaagttcaagcaaactcttggcttgaaagttccttctggtccaaaccgtcttcataattga

SEQ ID NO: 78192 - DNA, 846 bp, Glycine max
  Peptide Sequence Number=SeqID_194970
atggatcaaagctcaagtttgaatgcatttgtcaatgacaataagatcccaaatcctgcaactgaaaagactcaaaatggaaagcgcaaatacaagaagaaagagtacaatttgcctcgccgtgcttcaaaacgtcttgctggaatcaaggttgatccagctatagaacttaaaacaagcagattcaagcgagttgctattaatcaatcatgtgagagcaaaatgatcacaaacatggatgaacaccctagttgcttgcctgttggtatagtaaatcaacagtttgatgcagtagaaggtgggacagaaagtaagagcaaatttgactgcacttttgaagagtatatgagactccttgaaaatggagaaaaggttgatggaatgtcagattactcccgtgactttcccattgcagaaatactaaaagacccatgtattgcatttgcagtacaagttctcactggagatacatttgaaacctattacaaaaagtcccaaatgccttctgaatctttggcagctgttgaagggcagaatataatagacgttgaacaagaagagtgcaaaacagtgttatcacccccagaaaaacttattattccaaaagagtgtgttgctgctgatgaaattggtcatactgaccaagggaatgagaatttaggaacttcttctgaaatgccacttgaaatttctcggatggattcgttgctagaatatgcaaaatctctctttgatagtggcaacgctatccctttagacactgactcaaaagaacttccttcagcgacaacccagctcatcaaatgctcaaaagttgttatcatacccctttttgctggtcattaa

SEQ ID NO: 78193 - DNA, 459 bp, Glycine max
  Peptide Sequence Number=SeqID_194971
atggcgttttcttcaattatgagttcaggaaacgacgttgccttcgagggccttctgcctctccagcattgtgggcattacttgtcaaaactgtggtatgctcctcccaatgttagcagaagcatcttctatggtgttggtgcatggagaggaagctaccattgtttaaggaagataaaagagaaaaaagtagtcacgagaggaacaaaagctcaactcttcatttccctcagattctactccgatctccactgtcagattctgctccattcatctccaccttcttcttctttatcttcccgccccatgcctactgtatcctgcacctctaacgttgctcaccaaaacttaaatgcacacccttctttcacagcgttgcagctcctagatgggaagatcttgacctttgattccaccgcttctaataagacaccaaggacataccattaccattactga

SEQ ID NO: 78194 - DNA, 405 bp, Glycine max
  Peptide Sequence Number=SeqID_194972
atggagtccacccccgacacccaaacggcgtcgctttggacagatgagaagcatcttcactacctcaacaccatggaagcctccttcgtccgcacaatgctccaccactacgccgtcgtttcacccctccgcctcgaccgttaccttcccgacacctccgaatccaccttggattccaagcccaagaaacaagcaaccgcagattcaatgggtggtagtaggggcagaagaacgaagaggagatcatcatcaaaaaataaggtgcagaattcatcaccagcggaggagcagggagtaacgggtgatttacatatgtccccacaggacggctcaaaactagaaaagggaatagaaagtgctgcttgcggtcaaggaggggatgataaagaaccgattgagaactga

SEQ ID NO: 78195 - DNA, 3804 bp, Glycine max
  Peptide Sequence Number=SeqID_194973
atggctctacccttaaacctcgtactctcgtacctcgtcctgttccagattttattttgtgccattgcagcagaccaaagcaacgacaagctttccctcctttccttcaaagagggtctccaaaaccctcacgtgctcaactcatggcacccttcaacgccgcactgcgactggctcggcgtcacgtgccagctcggccgagtcacctcgctctctcttcccagtcgcagcctcagaggaacgctctctccgtcgctgttttctctctcttcgctctctctcctcaacctccacgacaaccagctctccggcgagatccccggcgaactcggccggttgcctcagctcgaaactctccgactcggttccaactcgctcgccggaaaaataccgccggaggtgagactcttgacgagcctccgcaccctcgacctctccggcaacgccctcgccggagaagtgctggagagtgtcgggaacttgacaaggcttgagtttctcgacctgagtaacaattttttctccggttctcttcctgcgagtctgttcaccggagcgaggtctttgatttccgttgatatctcgaacaactcgttttccggcgtaatcccgccggaaatcggaaactggcggaacatcagtgccctttacgtggggattaacaatttgtctgggactttgccgagggaaattgggttgctttcaaaacttgaaattttctactccccttcctgttccatcgaaggtcccttgcccgaggaaatggccaacctcaaatccttgacaaaactcgacctttcttacaaccccctgaggtgttccattcccaacttcattggggagttggagagtttgaagattctagaccttgtgttcgcccagcttaatgggtcggttccggctgaggtggggaaatgtaagaatttaaggtctctcatgctctctttcaattcactttctgggtcactgcctgaggagctttctgatcttcccatgttagccttttctgccgagaagaaccagcttcatggacctttgccttcttggcttggaaagtggaacaatgttgattctcttttgctctctgctaaccgtttttctggggtgattccacctgagcttgggaattgttctgcgttggagcatctcagtttgagcagtaatttgttgacaggtcccattcctgaggagctttgtaatgctgcctcacttttggaggttgatcttgatgacaactttctttctggtactattgaggaagtgtttgttaagtgtaagaaccttactcagttggttttgatgaacaatcgaattgttggttctatacctgagtatctttctgagcttcccttgatggtgctggaccttgattctaacaattttagtgggaagataccttctggtctgtggaattcatcaaccctgatggaattctctgctgctaataaccgtttggagggttctcttcctgtggagattgggagtgctgttatgctggagaggcttgttcttagcaataatcgactgacaggtactatacctaaggaaattgggagtctcacgagtctttcagttcttaatttgaatgggaatatgcttgaagggagtattccaactgagcttggtgattgtacttccctcactacactggaccttggaaacaatcagctgaatgggtctattcctgagaaactggtggaactgagccaattgcagtgcctggtattttctcacaataatctgtctgggtctattcctgccaagaaatcttcctattttcgacaacttagcattcctgatttgagctttgttcagcaccttggtgtgtttgatctttctcacaatagattgtctggccccatacctgatgaacttgggagctgtgtggtagttgtggatctcttagtcagcaacaacatgctttctggtagcattcctagatcactctcgctcttgacgaatcttacaaccttggatttgtctggcaacttgttgtcaggttccattccccaagagtttggtggtgtcctcaaactccagggtctgtatctgggacagaatcagctatcaggtaccatccctgaaagctttggaaagttgagtagtttggtgaagttgaatttgacaggaaataagttgtctggtccaattccagttagttttcagaacatgaaggggctgactcacttggacttgagctctaatgagctcagtggcgagcttccatcctctctttcaggagtgcaaagccttgttgggatttatgtgcagaataacaggctttctggccaaatagggaatctcttctcaaactccatgacatggagaattgagatagtgaatttaagtaacaattgcttcaaagggaacttgccgcaatctttggcaaatctctcttacttaacaaatttggatcttcatggaaatatgttgactggagagattcctttagaccttggggatctaatgcaactggaatactttgatgtttcaggtaatcaactatctggaaggattccagacaagttatgcagcctagttaatctgaatcacctagatttgtctcaaaacaggttggaagggccgataccaagaaatggaatttgccagaacctatccagagttagacttgcggggaacaaaaacctgtgtggccagatgttgggtatagattctcaggataaaagcattggcagatcaatattgtataatgcatggcgtcttgctgtaattgcggttacaatcatattgctaagtctaagcgttgcttttcttctgcataaatggattagcaggaggcaaaatgatcctgaggagcttaaggagcgcaaactaaacagttatgttgatcacaatctctatttcttgagcagtagcagatcaaaggaacctttgagtatcaatgttgcaatgtttgaacagcctctcctgaagttaactttggtggatatccttgaagcaactgataatttcagcaaggcaaatataattggagatggaggttttggaactgtctacaaggccactttacctaatggaaaaacagttgctgtgaagaagcttagtgaggctaaaacgcagggtcatcgcgagttcatggctgaaatggaaactttgggcaaggtgaagcatcataatcttgttgcattgctcggatattgctcaatcggcgaggagaagctccttgtttatgaatacatggtaaatgggagcttagatctttggttgagaaataggactggggcccttgaaatccttgactggaacaaacgttacaaaatcgcaaccggtgcagctagaggattagctttccttcaccacggtttcatacctcacatcattcacagggatgttaaagctagcaacatcttactcaatgaagattttgagccaaaggttgcagactttggactggcaagacttatcagtgcctgtgagactcatatcaccactgatattgctggaacatttggctacattccaccagagtatgggcagagtgggagatccacaacaagaggagatgtctacagttttggtgtcatcttgcttgaactagtgaccggaaaagagccaacaggaccagattttaaagagatcgaaggcgggaacttggttggatgggcttgtcagaagatcaagaaggggcaagctgttgatgttcttgatccaacagttcttgatgctgactcgaagcagatgatgcttcaaatgctgcaaattgcttgtgtgtgcatatctgacaatcctgcaaacaggcctaccatgcttcaacaacaattaactgcaaactttagaagctag

SEQ ID NO: 78196 - DNA, 150 bp, Glycine max
  Peptide Sequence Number=SeqID_194974
atggatggttgcgtggtgggatttgagagaactggagaagtattttgtaactggcaagttgttgcgtgcgaaaaaattgcttgtgaaagatctttacataatttcaatattcttgtggatacttcttgcgttctcggtttcaaagattaa

SEQ ID NO: 78197 - DNA, 234 bp, Glycine max
  Peptide Sequence Number=SeqID_194975
atggaggagcccctgggcattccattgagcattgaatttcaagtgcaagccattggtcagtttgctcaagcgacctgtgctcctgagtttggacttccaagactgttcaataagagattactcgtcttgcacgttggtggggttgccgtaaaacaacgaagaagtgagttatcaagaataggatgttggacaaatggcctcagttaccttgagaagaagaggggattgaattaa

SEQ ID NO: 78198 - DNA, 609 bp, Glycine max
  Peptide Sequence Number=SeqID_194976
atgaaaaagtatgctgacgtgaagcgccgagatgtcacctaccaacccaatgattgggttttggtaaaactgcgtccacgtagacagttgactgctaaagattcttccacacgtggggacaaactctccaaacgttattatggtcccttcaggattgttgaacgcattggagccgcagcatattgtttacaattgccagaaggagccaaggtccactccgttttccattgctctgttctcaaacccttcacagggcctatcgatctggctaccagttccacattacccctgcaattcgaagctggtcaaccgctggtgactcccctcagcattctgaatcgccgtcagattcctggatcctctcctttggtctgggaagtcctggttcagtgggatgggctatctcctgatgagacatcttgggagaattgggagcagttgtgtcacgattaccaccttgaggacaaggtggatttccaaggggccaaggatgttacacatgaatcagagatgccacaaacacaggaaacaccagcatccatggtgcagaagaaaggagagaccaagagaaggatagtgaaacctgcttacctagcggattacgtgtag

SEQ ID NO: 78199 - DNA, 249 bp, Glycine max
  Peptide Sequence Number=SeqID_194977
atgggttctcccgccgttgacgaggagcaccacttgccggtaaagcacaaccctcgttctctccgggaggctatctcatcaggggttaaacgcttcatggtaggtgggtttgggcggggaggaagagtgaggagaggaacggacggaggcacagagggtggaggtggtcgttgtaaggaaggggggttgcgggaaggtgtgggtgaaggtgggtacgggggtcgtggacaaaacaacaaaagaaattga

SEQ ID NO: 78200 - DNA, 1030 bp, Glycine max
  Peptide Sequence Number=SeqID_194978
atgaaggattgtgatgaaccattgcttggagaaggtccagatcccgagtctagatggggtttgatttttgatggagccgtgaatgtctttggcaatggaattggggcagttattagcactcctgaaggtaatcatctccctttcgctgcaaggttacagtttgattgcaccaacaatgtggcagagtatgaagcatgtatcctgggcattgaaaaagccattgacttgaaaagcaagaaccttgacatttacggggattcagctctcgtaatcaaccaaatcaaaggagaatgggaaactcgccaccccggcttgattccatacaaagattatgcgaagcatttgctaaccttcttcaacaaagtggagcttcaccacatccctcgtgatgagaaccagatggcagatgcgttagcaactttatcctccatgtacgaagtgagtcaccggaacaatttgccaacaatcagaattcagcgcctcgagaggcccgcccacgtgtttgcagtcgaagaggttgttgatgataagccctggttccatgatatcaagtgtttccttcaaagccaggaatatccacccgaagtatccaacaaagacaggagaactttgagaagattgtctgataagaaagaagcagaatttttgatgcatgagatacatgaaggctcctttggtactcactccaatggacatgcaatggcaaggaagttgttgagagcaggttactactggatgtcgatggagacagattgttgcaaacacgcaaggaaatgccacaaatgccagatttatgctgacagaattcatgtaccaccaactacacttaatgttctttcttctccgtggcccttctctatgtggggcatcgatatgattggtagaatcgaaccgaaggcttcaaacgggcatcgtttcattctagtggctattgattacttcaccaagtgggttgaagcagcatcttatgcaaatgtgactaagcaagttgtggtccgctttatcaagaatcagatcatctgccgttatg

SEQ ID NO: 78201 - DNA, 219 bp, Glycine max
  Peptide Sequence Number=SeqID_194979
atgggtaaaggattctgctgcctcaaagctttgaaaaccgatggagaattcaactatttcaagttagggaatggtgaacaaatgaaggttgaaggcatagggagcatgaagatgaagcttcatgatgatgacatcacaagagtacaagtatattggttcaaagtggggatgcaaggtctacaaggggagacatttggtgttgcgaggacagaaaaataa

SEQ ID NO: 78202 - DNA, 702 bp, Glycine max
  Peptide Sequence Number=SeqID_194980
atgaatcttctaaagaccggagcttcgaaggaaggaggttgctcgccacagagtggaccaccattgcggtggtggccaccgaggccgccgacgagagcaccgtctttgtggtggccaattggacttcgtcgcggaggaggaactactattcagacaaatgaagaggttgtagttaagcttgaaagtgtcaaaaccaagcatcctcaattgttgtctcaaggtaaagtagaagtttcttctattgtttacaaagttggcgaaagcatgcaagaactgataaagttgtggaaggaacatgaatcatctcaatctaaaatggaggaaaatggtgaaagctctagtaatggtcccactctagaaattcggatactatctgagcatgtcacagctacaaaccaccaaaaagcacctgagtgggatcaatcctccagtcatggccagttttgcatcatgtatgggagcatcaagaaagaaattctgcagaaaggagttgattggcttgcttcaatgactaaagttgttgcacctggtgaaccaacaacttctgagcttatgtgcacacttgctcaagttgaatctttggttgactctaaaatcaaagttcatcttgaaagacaaaatgctcaaatatccgaacaagtggcattttctcctacaaccaccactaccaccaccaaaaaatcaaaaccaagagcattttaa

SEQ ID NO: 78203 - DNA, 1738 bp, Glycine max
  Peptide Sequence Number=SeqID_194981
atggacaagtgtttgtccggtgtcggcagtggtaaccttgacaaatgtgagaattacagtttgtccatggtggacatgctttcaattttgcaggcgaggtctaacatgtcagcatatgcagtgcaagtgttgtactcttgcatacgtgtcacttgtggtgtgggcaggtactggagacgtggtgtatgggtgagtggggttgtgtcgaatggacgtttgatttgtgaccacggtcacttcaaatttctaccttctttctctcaaaatctctttgcttgcatgcttgcttcttgcgattccctttctccttcattcatcttcttcaaccttcgaggtattccttctctaacaatgtcttcctttctacccgattccgccatcggcatgggtggcagtgattttggaggtttgattcaacaaccctttatggaccgagaggtcatttccgttggcggttcttcctcggaggatactcgccatgatgcctctaacaacgaatcctcttccttaaagaggttgagggtttcacaccgtattggtggaggcacctctcgcatccacgggagggtgcaatcttccgctgcttcctcgattggggagcctatcccggtcactaatggtggcagggacgttaaggcatttccttgtgtgcgacgtagccatagtgattggtcatcatcgtccttccctgccgttattggctttgagtgggtgagggacgacgtcctgaagtacaagacctccaccacctttacgatgaagctaacaggtaaaattggttgggtctccttgaatagcatatccaagaagctgtttgagtttggcttaaatgtttttcactgtttcaaggaccatttcttcaagtctggccccaccaagttcaagttatttgacaaggatctgttgacccttgtggagagggttgacaaggccatgttggagcagttgtcggcctcactgaacgtgcaaatcattttgtctcttccctcagcatgcgatcccctcattgccttggatggtaaatgtttgccttgtcttccttctttgtgtctaaactgcattatggtcggacctactggtgggaatgtgccatcgtctactgttgctcctactgctggagaaaggggtcaacctgctgttgaggttgaccctattaaggatcatggcactgggtcatcggtccacaagaagtcgagggctccttttagcctttgtgccctgaggcaagttgcagggttgatgcctagttcgagtcgtccttcaagtttgcaacatatacctccggctacactatgcgtcaaggcttctgcttccactattgttgttgttgtcactcctactactgaagttagtgcgctagctgtttcagttggttcttttgtggctcctttgtccaccatcgatgcacccttgctaagtgcaggtgtggagaccacgagcgcctctgtgatgtcgcctcctccttctttagctccatcgggtccaacatgccacaaattctaccaaggtctttcttcaaagaagtttggtaatccttcaagaatatgggaaaaggcaacaagaggcactaaggctattactcataagatccggagagtggagtgccctgaggtagctagtgccacagtcaccttccctgaagctgtgaagtcaaaccacaaactgtcttccaaggttggcagtgttttggctaagttgttgcgcaccacgttagacggtgatgaactgtttaaatgct

SEQ ID NO: 78204 - DNA, 270 bp, Glycine max
  Peptide Sequence Number=SeqID_194982
atggttaggtggaggttgttgggacacaatgctctgatagaatggtgtcacaaaaaggacttggttggcaaggtagagggctttgcggcagagaaggatgagcttgccaaggtggtggcggacctccaggtctggctgaaggagtcagagtccaggctagaggatgtgaagaacgatgttatgcatgatgaggaagatattgccactgaagaggaagctactgaggagaaggatggcgaggaggagcaagatgttagggctagtgtttag

SEQ ID NO: 78205 - DNA, 240 bp, Glycine max
  Peptide Sequence Number=SeqID_194983
atggacgcgtctctagttggttctccaaaggttcgtcaaacccaaggtccacccttgcttaataggataagacgacctatcaccagactgggtgacaagacctttaatcaggttgaaatcaaacctgagataatttcatattatccacttctctacttcacaagagaccaccaaggcctttcctcctacatcgccaaggtcttgcttcctacaccgtcaaagacttcattttcaccatga

SEQ ID NO: 78206 - DNA, 299 bp, Glycine max
  Peptide Sequence Number=SeqID_194984
atgcagtggcgagtattcgggttagttcttgctatgattgcaggcggatttggcgctatgctgccaggtgcgttggaagtcaatgtgaacaaaaccattaaagcggcaggtgcagccggttttttcgtaatcgtctattttttcaatccggctgttcttgtatccgaggatccttttaaattccccccgccaccacctagtgctgacgcacagaaggttgcagaaaaaatgctcagcgaagttaacaatggacaatatgtagagctttatgaaagcatgcatccagaatttaaggctat

SEQ ID NO: 78207 - DNA, 201 bp, Glycine max
  Peptide Sequence Number=SeqID_194985
atgacaattaaagaagatgagatacaagaagaattccctgataaaatacttctagtagtgcaagaaagaccttggtttgctgatatcgcaaacttcaagagtaatgatatcatagccatgaggcgagttgttacaatacttagggaagaaaaactgaagattaagccagggatgcaggagaaggccctagggttctcatga

SEQ ID NO: 78208 - DNA, 921 bp, Glycine max
  Peptide Sequence Number=SeqID_194986
atggtgcttgctgagggtgaatctttacccgcttactcaagatactacaggatgcctactgacatcagggaaattgaggctgctctgtgcatacccggccaaggagctaggttaatctttggcctagttactcagctggacatgaatgtcagagctctcatctctaggcaaatcacttcaatggcccagtctaactcctctagactcgggttccctgctcttatcacaactttatgtaagtccagaggagttgtttctgacagcttagcctttgaacgtttgagctcagtcattaatttggcttacataaggaaaaactgttggaacccagatgacccaacagttattattagagggggcagaagaccaagggcaaggccagctgaggttctttctacatcagcagctcctcatccaacttctacattagcagctccttctaccctacctcctgcagatttccaacgtttcgaggccatgcttcggagcatacatcaggggcagattattttactgcaaagcctacaactggtagcgcctccagactccatcccgacagtagagcaatttaatgaatgggtagcctggccagggactcagcctcctcttcacagggaagacgaagatcccgccgctcaggtaccccatcagtcgaaggatgagtcatcaaagtcttccactcctgagcccttgatcaggaaaaggagggtagttgtaacccaggaagctgcagccacctctgaaaagtctcttgaagctactctggagcttccaacaccagtggcagataccacttctccacaacaggcaacagacccttccacgcctgaggatcaaaccacctcagtcctgtcttcgaacatctctcctgtagctactcttgtacttcatttgtcggaagaggaggagggtcagacatag

SEQ ID NO: 78209 - DNA, 348 bp, Glycine max
  Peptide Sequence Number=SeqID_194987
atggatctgggttgtaccgtctcagttgagagacatgaaacacaggatgcaaattcgataagctcgggggtaaagcgatttgataagctacaggcccaaccttcttcaaaatttgatacggacctagatacttggggcgtaaacttcctagatttgagagctcttccgactctggtgtcgcaacgtgcccttcgcgggcgagtgagggcgaggctcacgggtgcgctttccaaaggaggaaagatgcgtggagtcgccaccaacgtttatttgtggaaaacgtcggaaaaaccgaaggaaaccggtcaaaatgaaaattctaagttcaggagttgtatttacgcttga

SEQ ID NO: 78210 - DNA, 957 bp, Glycine max
  Peptide Sequence Number=SeqID_194988
atgtctttcgactcctcaaaccacccaattagtcctgacttgtattgcagtgaagtaactagcgaagtgattcacttggattccgatgatgaggctctgaagttcaatgttctatggggagactctgatcatgatgatagtgatgatgaaagcattctattgaacttgttagaatccgaacacaaccaagtgcaagaacaaacaaagttcctaggacaacaacttcgcaaaaaaacatggctgattaatgctcgagaagaggccataaattggatcctaaaggtgcatgcatactacagttttaaacccgagacagcgtatctttccgtagattacttcaatcgtttcctcttgtcacacacctttacgcaagataaagcatggcctctgcagctgctatcagtgacttgtctttcactagcagcaaaaatggaagaaagcaaagtgccacttcttttggacctgcaagtgatcgagtcaaggttcctgtttaagcccaaaacagttcagaggatggagcttttggttatggccagtctcaagtggcgattgcgcactataaccccttttgattttgtgcatcttttcatttccaagcttttgtgctctgcttccacatggggagatttaagttacattgtttctcttgtctcggatgttatcatcagaacatgtctagtcatggatttcttggagttttcaccatccacaatagcagcagcagcactgttatgggtaaccaatcaatgtgtagatgacaagaaatcatattgcctccacaagaatataagcattgaaatggtgaagaaatgttacaaactaatgaagcagaaactcatcattcgccgatcagaactttattggccaaagatttcacaattattgccccgaagtcccacctgtgtgcttgatcatgcagcagctatgcaagaaagcagtgatgctcacaagctctga

SEQ ID NO: 78211 - DNA, 219 bp, Glycine max
  Peptide Sequence Number=SeqID_194989
atgaagaatttccacagaatcgcttacggaaacatctcagaagctttacggaagcaccttggcttggattttcttcacgaaaacacatttttccacccaaaacagctgaaatgcatagccaaggggtttgggatccttgaaactcagcctcctccccctatttataggaaaaatggggaggtgtttgccgcccagaggcttcttgaggaagatttctga

SEQ ID NO: 78212 - DNA, 543 bp, Glycine max
  Peptide Sequence Number=SeqID_194990
atggggaattgccaagctgcggaagcggctacggttgtgattcagcatcctgggaacaagatcgagagggtttattggtcgcttagcgcacacgaggttatgaactcgaatcctgggcactatgttgcgcttgtcgtgtcctcgcccacgctcaaggccgagaatggcgctccgatgaagcagcttaagcttctccgacccgacgatactttgcatattggccaggtttatcggttgatcagcttcgaagatgtgttgaaggagtttgcttccaagaaatgtggtaaacttgggaaattgctcaaggagacgggtagtcatgggattcagatgaagcacaaggactctagagctacaaatcctagcccaaattccaaaaccgaattcggttccattaaggtcgaacaggagattcaacgaatggggaaccatggcagcagcagcagcaacaacaacaataacaaaggtgttggaaggcatttcgttggtagtggtgggcaatggaggccagccttacagagcattgcagaaattggaacttga

SEQ ID NO: 78213 - DNA, 246 bp, Glycine max
  Peptide Sequence Number=SeqID_194991
atggcgactagtatgtacttgatagctcttaaggcctttggcagtggtcctaatatgtccattcctcacatggcgaagggccaaggatcccccaaattaggaattcttgtagggggtcatccagtttggttccttctcttctccggccataatttcctcagcatctatggtggcagtttggagcgtctcctggatgatagtcttgagatgcctgaccttcttggtgttggccaactcggagagtag

SEQ ID NO: 78214 - DNA, 983 bp, Glycine max
  Peptide Sequence Number=SeqID_194992
ggttgacacatgtctccaagtgccaagtaggatgccacgtagattttgtggttcctggacagtacataagccccccaagctctgagttggcttgcaagcaaaagaggttgtccagtgtcgaagtagattgtcccgcgttgagggatgtcgagcgtggaagccttgacgaatgtgagagttgcaagtcgatatggacatgtgttgtctgggttgcttctatcaagttgttcgtgatggacgtatctttggcatgcacgtgcgatactcttgcatacttgtcacacacggagtgggcacgtactagagtaacggtcatgcgtgagtcagggaatgttatgtcatatgagaatactcaccgaggtgcctttgataaagattccttctcctcggagagggtgaggacttcacgccgaactaatgggggcacttcttgcccgcgtggaagggcacgaccttctgcagttgaggagccagtatcggttactatgatcctccctccttctacttccacgggtgcgaggagagctggcagtggcggagatgtgagacttgcaggagtgatgacttcccaaagtgtttcttcaaaagagtttggcaattctggaggagaatggactgcgacaccaagagactatgtagaaggtggcatccttggaggcggagtggaacgccctaaggtggccaatgccaccattgcttttgttgaggccgtaagacgctggaaagacttacaggctgagaagatggacttgggtggaaaagtagagagcatagcggttgagaagaatggtcttgccaataggattgctgaggagtcagagtctagattggaggagtctgagctgaaggctgcccaggagagggagaccagcaaggagctcaaggaaaagctgattttgtacaagaaggaggatgtgaaggagggcatcttgcttgatgaggaagagattgatgtggaggaggaggttgttgatgaagggtag

SEQ ID NO: 78215 - DNA, 210 bp, Glycine max
  Peptide Sequence Number=SeqID_194993
atgtttgcaattgtagaaatagcagggcttcaatacaaagttgagcaagaccagaagttgtttgtacaccgtttaaaaggagataaaggaggaaaagtttctttcgataaagttcttcttactgtaaacggtacaatcactgtaggcgccccagctgtaagcgggatcactgtagaagcagagatcttagaccatgttaaagctgataaa

SEQ ID NO: 78216 - DNA, 468 bp, Glycine max
  Peptide Sequence Number=SeqID_194994
atggaagacaacgttttaccaaattcatccactgaaaatgctaaaattgaacaacccggagaccttcagagaagctgctcttatgttgatcaaaactggagttctacagcagtacttttaaccggcttacaaacgagcgccgacaccaacttcatgaacgggcaaatgacaaaaattgccagtaaaatctattatggttatgcgatctacgctgatgcaaaaaataaaggcggagatatcgtgaatgctatgatcctggcacatgaatatggccaccaactacaatatgcgtttaacctgccttctgtaaatgaatctacagcaagacctaatgagcttgaagccgatggttttgcagggtattatttaagaagaccgaacgggtataacaaaactcaattctctgaaattgcagcagcctatgaatttgcacaaagcatcggaagattatcagacctcaagttataa

SEQ ID NO: 78217 - DNA, 174 bp, Glycine max
  Peptide Sequence Number=SeqID_194995
atggccctcatatttgcaaaaaacatggccattctaacagccttgaataacaccgtctcaaagattcttgtggacaaagtggctcttgacgacacactcctctctctcgatgatgtgttagagcaacaaggatttgatagtctacttaatgatctctttcatgagagaagctaa

SEQ ID NO: 78218 - DNA, 762 bp, Glycine max
  Peptide Sequence Number=SeqID_194996
atgaagagtcgtggctctgaaactaacattatgcgagatgcacatgcgatttatttgcaagatgtgaaacaaagtttcaaattagaaactgtatggcttatcgttgggaaggaatcaaaatggttggcacaatttgaacgatttagtaagagaaccaaggttttttcttatggagattattcatcttcttctaatctagatgcaccatcaagttatgagccaacatcacctaccatggagcatccagtgggggcaaaagcaacaaagaggaaggctaaagaaaaagatatagataaagaaaaatcttctgatgttgttgatctcacaactatgggagacataatcaagaccaaagtaaaagctatagaagatctggcatgtgccaggcagcaccacaacaagttgaaggaaaaaagagatgttgataaaggaaagagagatcgactttcaaatcctctacgaggatactgctatgatgttttgcttcacattgtacaagcccttggcaatcaagatccgtattttcagcaacaagttgatgcaatgggaaggatgggcctttctccattgcagaaaggcacgattgttattcgcatattggcatatggatcacctactaatagtatcgatgattatgttcgaattagagaaaccatgactttactatgcttggataagtttgtaaagggtgtctacgatgtttttggagctgagtacttaaaagacccaacaataatggcatccaatacctattgcaaatag

SEQ ID NO: 78219 - DNA, 141 bp, Glycine max
  Peptide Sequence Number=SeqID_194997
atgcctaaatgtgtgtatcaaaaagatgcgaagggtctaacaggggggtcattgacggggaagttgaagaggccaaggtggcgggacttggggaaaaccaccgcttcatcttcttctttggatttctatctatatatttaa

SEQ ID NO: 78220 - DNA, 159 bp, Glycine max
  Peptide Sequence Number=SeqID_194998
atgaggtggtccacggtcatcttgcggccgaaggagccagtggggttgaaggttgtggcttttcttctccttcagatcagaatcgccagtggatggtggtggcgcaatggaaaagggaagagagagagagaaagggatgacgtggcaatgacatgttag

SEQ ID NO: 78221 - DNA, 486 bp, Glycine max
  Peptide Sequence Number=SeqID_194999
atgtgcaccacgcgccaggagaatccacactgcgagctcgtctcctttgaccgggactacgccaacgccttccagctctgtgtcaacgacactctcgcctttgccgtcaagcacgatgaattcatgtatgaaatcgtcttaaaggtgagaaaggtcaaggtggacttcatctacaagcctcatcagcagggttcgaaggataatctcgtctttttcagggatcccaaagaggaaaagtttgttgaggctattatgacgataactcaagataagaaggattacactttgtcgaatagggaggtgcttcaggctgtggagtaccattcagatagtaggttgaaggagtgggttactattgtgattaagcttaaggaagggtggttccagacagagatcaaggaagacgatgatcccaagctgtcaattggttacgactcttcttcttctctagatcagaatcaacagtgggtggtggtggcgtggtag

SEQ ID NO: 78222 - DNA, 202 bp, Glycine max
  Peptide Sequence Number=SeqID_195000
ttgaagacattagatctcagtatcaataatctcaacgagagcataatggaatttgttggtgctctccgatccatcaagaatttaagtcttgccggtaactttatagctagaccttttccgataaaagaattgtcacttctaccaaacttggaagtgttagatttgagtatgaatcatcttgttagttctgtcacaactcaag

SEQ ID NO: 78223 - DNA, 417 bp, Glycine max
  Peptide Sequence Number=SeqID_195001
atggcgaatgacggtgcggatggcgtgctgatgccagtagtcaacgttgaaactggggcgacgcgcgctttcctgcaggcgaatcaggcaggccgagactggccgccaccattcccaacaggagatgaggccagaaatagcgtctgccgagttgtcgccagcgtgagaaaatcccgatcacctttcgtccatcatgccaggattaaagggcttacggcggatttcacgttttttgcgcagggtttgatcactgacaacagggttttgcgagcgggattacagcgccagcggcgggcaataaaaaacggcgggccagtggcagttcagcttcgtcttcgaaggtcgcccattcccaggcttcctgcttcgccagtaccgcctgcaacagtttgttgttcagcgcatggccggacttga

SEQ ID NO: 78224 - DNA, 369 bp, Glycine max
  Peptide Sequence Number=SeqID_195002
atggaagacgcacccttggcccttgatgttggccttttcgtgcccccgctgaagggcagtggttcagcgtcaagcaatgacatctcatggtggccaccaatggtcgtgggtggtggaagaggaggtgttggggcttgggtggggtttgcactgagcacaatggaattgcgctcaacgcaacaattcacgttcagcgcatttccctctcaggaacctgtggaagcaaagcttcatgatgaatcaacaatgattcaaagaatgcagaagaattcaagactcaagaagaaagtctacaatcaagaatcaagattcaagattcaagatctcaagaatcaagatcaagatttaagactcaagattcaagaatga

SEQ ID NO: 78225 - DNA, 303 bp, Glycine max
  Peptide Sequence Number=SeqID_195003
atgtcacaccctaatttcgtccggggaccattgtttggtggcatgcaacctttgcttgaccgcctcgagcaaccaggtccacttgggccttctagggggttccaacagaaggcagtgccttctggtggaagcaaccagctcgcttgggcgagctgggcggcaaccacctccctcttttctcctataaataggggaaatagggttgagcaaaaatgctcagcccttctggtatttaggattctctcaaaattagtgaggaaaattgtttccgtggaaaaaatccaagctgaggtgcttctgtaa

SEQ ID NO: 78226 - DNA, 387 bp, Glycine max
  Peptide Sequence Number=SeqID_195004
atgccagacaccaatgcattgtattctgctaatgaggctggtggtgctaaattgcacttgtcaagcaatgcagaatacatggtatggctgatgcggcggaaagagtgtatcatatggcaacaccacaacattggcaaccaaatgcagagcttgaatgaaatggatcgcataaccgtgccgacacagcaagctcctctacctaaccaacatttttcgcaacagctagataatgttgatattggcgtcgacagtagggaaggacatagactacatcgacagagaagagttgttgagcaccacacttgggagttccctcctccaccaactcaacccattgatgagacttactttgtgactctatctcagtcctttggcaatttcacttag

SEQ ID NO: 78227 - DNA, 3330 bp, Glycine max
  Peptide Sequence Number=SeqID_195005
atggtgacatactatggaaagctgaaaagcttatgggatgaattggcaaattatcagcagattcctctctgcacatgtggaggatgcaagtgtgacgttgggagcaaaatggagaaacaacaagaagaagagaaatttcatcaattcttgatgggtctagatgatgttttgtacggtacggtccgctctaaccttcttgcaactgatcccttgcctacattaaatagagtgtatgccactttggtgcaagaagaaagagtgagaaccatatctcggggaaaggaggaacggggagaggttgttgggttctctgcacatgctcgtggaagaaccaaaggactcgctgaatcaaaagatagaaatatggtatgttcgaactgtaatcgaacaggacatgaagctgaaagttgcttccagttgatcggttatcctgaatggtggggagatcggtcacgaggtgaagtgaaagccaatgggagaggaaaaggacggcaacgaggaggagctgcacctagcagaggcagaaacgggggtgttcgagccaatgcaacactcactaatggagaaaccagtgctgcaccaactaatgcaaacaatgcactgaccgggctgagtactgaacagtggcaaacactagtggattttttaaatagccaaaaagggaacataaatgacaagatgtcaggagcttccagtcacatgactgggaacttgaaattcttgcatgggctgagagaaatagcaggatgtccagttggacttccagatggaaaacaagtgttagccaccaaagaagggacaacaatacttgatggaggattgaaaattaagaatgaccgcacttcaaagatgctgattggaacgggtgaacgaagagatgggctttattttttcaaaggtatccgaagtgagaaggcacacaaggctagtggaatttgtcagtttaatctatggcatcaacgcatgggacatccatctttgaggactactcaattagtttccaatataaggtgtgaagaaagtgagttgaagaataaagcatgtgataatggaagagtagaaagaaaacataggcacattcttaatgttgctcgtgctctacgttttcaaggtagccttcctatttctttttggggtgagtgtgtcttgactgctggatatctaattaatcgcacacctactccagtgctgcatggaaaaacaccgtatgagatgttgcatgggcaagctcccttatatagtcatttgaaggtttttggatgtttgtgttacgcacataacctaggaaaaacaaatgataagtttgcaagtcgaagccaaaaatgtgtttttgttggataccccaatggtaaaaagggttggaaattatttgacttagatactcaacgttattttgtgtcacgtgatgttgatttttttgagacagaatttccttttgctcatacaagcaaggaaaggaacatttcatctgtggattctcctgtagtgttccccttgttggttggtgacaatgatagcaggtcccatgatcaaattgacatagaagaagaagtaagcccagacaatggtgttgatatgggtcctaccgagttgggaagaggtcaccgcattaagatgccttcagtcaagttgcatgactatgtcactcacactgtacagaagttaagcccatctcccagctcgccctctccacagcataattcaggtgcgccttatcccttaatacattatgtgaattgtgacaaattctctgtaaagcatcgcaggttcattgctgctctcactatggaacatgaacccgtccatttttttgaggcagtgaaagatgctaagtggagagttgcaatgcaacaagaactcgaagcactggaaagtaatgggacctggactctacaaaccttgccggatgggaagaaacctcttggttgtaaatgggtgtataagattaagcataactccgatggcaccatcgaaagatacaaggcaaggttggtcattcttgggaatcatcaggtagaagggattgactatactgagacatttgctcctgttgttaaaatggtcactgttcgtcttgttcttgccatagcagcagcaaagaagtgggaaattcatcaaatggacgtccataatgctttcctccatggtgatcttcatgaagatgtttacatgaagttgcccccaggctttcgcacatctcaaccaggattagtttgcaagttgcgcaaatcattgtatggcttgaagcaagcccctcgatgttggtttgccaaactatcatttgccttgacgaattttgggtttcaacaatcatcctctgaccactcgctctttactcttcttaatcatggagtgcaactagtagttttggtgtatgtggatgatttgatcgtgtgtgggaatgactccactgcaatccaaaaatttaaagtatatctcaacaagtgctttcacatgaaagatttggggaccctgaagtattttcttggtgtagaagttgcaaggaatccaagtgggatattcttatgccaacgtaaatatgctttggacataattcaagaaacgagtttacttggtgccaagcccgtgtccacaccccttgagcataaccatcagcttagtctcgctactggacgtcttcttgatcaacctgaacgttatcgacgtctagttggtcgtctcatctatttgtgtttcaccagaccagagctatcttattgtgttcacctcttgtcacaattcatgcaacaacctcgtgaggaacactggaatgcagctcttcgaattgttaaatacctaaaaggaagtcctggtcaaggcatacttcttagcagtacggctaaatttcagctgcatggatggtgcgattctgattgggcaggctgccctttaacccgacgctcaaccaccggctggtttgtgttcttgggtcactctcctatctcttggaaaaccaagaaacaacacactgtttctcgttcctcggctgaagctgaataccgctctatggctaccaccacctgcgaacttaagtggcttaagagtttactatctgaacttggcatcttccataaaggtcccatgcgccttcattgtgacaatcaagcagctttgcacatagcccaaaatccagtttttcatgaacgcacgaagcatattgaagtggattgtcactttattcgcaatgaggtacttcaaggcaatgttcagccatcttatgtccctacgtccgaacaattggcagacatttttaccaaagcattaggaaggcatcaatttcagattttgcttggcaagctaggcattcgtaatcctcaagcaccaccttga

SEQ ID NO: 78228 - DNA, 924 bp, Glycine max
  Peptide Sequence Number=SeqID_195006
atgtttgagattaatcttcaacctgatgtgttcccttacaactccatcataatatgtgcagagaagaatcaagggaaatgggaggcgggttttgaattgatgtctgacatggttgcaaaaggttgtgaggctaacgttgtgacgtacagtgttttgattagttcactctgtcgcgatgggaaggttgaggagggggtgggtttgttgaaggatatgaagaaaaaaggtttggaacctgatggttattgctatgaccctttgattgctgttttgtgcaaagagggtagagtggatttggctattgaggtgttggatgttatgatctcggacggttgcgtgccggatattgtgaactataacaccatattggcttgtttgtgtaagcaaaaaagagctgatgaggctttgagcatttttgagaagttgggtgaagtggggtgttctcccaatgctagttcctacaacacagtgttcagcgctctagggagtagtgggcataaagttagagcattggggatgattttggagatggatgggatggtggatgaggccattgagttgttggtggacatggagatggagagtagtgagtgtaagccaagtgttgttagttacaacattgttcttcttgggttgtgcagagtgggtagagttagtgatgctactgaagtgttggctgcgatggtggacaaagggtgtctgccaaatgaaactacttacacttttttgatcgaagggattggttttggggggtggctgaatgatgctagggacttggctacaacccttgttaatatggatgctatttctgaacattcatttgaacgattgacggatgatgtccacagtccaccagtctttgtcatctctctgtgcttgtcctttttgacggcaaagaaagttgtatatgactctgaatgctag

SEQ ID NO: 78229 - DNA, 705 bp, Glycine max
  Peptide Sequence Number=SeqID_195007
atggaaaaatttcatgctcaagatactataatcagtcatgatgggtccaaaggtcttgagccactgcacgcccaggaccatgttggcaccacaccggggcaagacatggaggtccatgacaaattgattacgctggatagtgatggtgactgcttcacagaggtggtcacagtgaagggtctcaagcgccaaatgacccgagagagagtggagtatgatctggacctgagtcgggttagtggtatcagggagagtcgcttcagaggcaccgatgatggggttttcgctgggactagaagcaatggggtcgcgactgacgacaggggtcgcgggggtggcacgacgagggtgggtggtcgcgcttggctcagggaattcaaccccgagataaagcaactcaagagaaacagcggaggtaatctgacaatacggttcacaagatcttcaaactccgaaaggtacatggaaacttggccaggatgtgaattgaccattattggtcatccactgaaaccaggccaaggcgcgcccctccatgtagaaggaggtgatggtcagtctatcatgctcgggcgtggcatggtattcgaagaatttgttgatcttaaagatccaaccaagggtttcggtaccatcaaaccggggagcatcgagtttcaagcggtgaggggtggaggtggccatgggtggagtggtattggatga

SEQ ID NO: 78230 - DNA, 414 bp, Glycine max
  Peptide Sequence Number=SeqID_195008
atgtttatggtgcaagctcttccgactgacctttgggtgagagtagtctttacgaaataccattgtggcctagatggtattcttgttattgataaggaaaagggcaggtcaaatttttgggaaaaagtggttagctattgggaagatgtagctaaaagtgtgttttggaaggagaataaatgggttcccaatgttggaagtctaagtgatcacaactctagtgatattagtgctttccatgagctcaaggacttctatgggtatttgataattttgggtgtttttgaaaaatattttactgataagactttaagatggcatgttctcgaggtgggaagtacaggtggcaccggccaacccattggggcatttagggatgcgtcacacgactacatgaggcgctttcatgtataa

SEQ ID NO: 78231 - DNA, 510 bp, Glycine max
  Peptide Sequence Number=SeqID_195009
atggaggtcgttggcgatacggcgtcgttggaggtcgatttgttacagctccctgaggtctccgctctcgcactcaaatctaacctaaccttcgtcgagacgctcttcgagcagtggctttcgcttcccgaaagcaatcgattggtgacatcattgctaaatgaagcaaagtcaggtgctcccttgaatgtcccagggaatcgctctagtccaaatgctgcaagcaattctttgccttccatgtttcctgctggcactgcaccacctctttcaccaaggagtacatctggctcccctcgcatagtgaaacagagagttggcccatctaatttgggttctcctttgaaggttgtcagtgagccggttaaagaagtgatacctcagttctactttcaatttgggcgtcctcctccaaatgatctgaaagaacaatgcctgattagaattgaccatttattccatgatcacatggatgggctgcagatacatggtgagatattgggtatataa

SEQ ID NO: 78232 - DNA, 840 bp, Glycine max
  Peptide Sequence Number=SeqID_195010
atgaagtacaagccaaagctggaaattgaagacaagttagaattggaccaatctagttggagtcgaggaagtgatggaaaacaagccatacattggtatttggtggccatggatgaaaggttaagctgctatgctcttattgcaagagcatctgttaatgttacaattcctttgctcattagagtattttcagagcgggttggatgccttaatcagatagaaactaaaggcggttcgctggagacgcgtaatgcgtcgtgtgtgaacttcacgcgccagggtcctgtgtggggccacgtgcagtggtgttttgagttagctacgcacgtggacaacatgacggtattcagcgatggcaacgggtattgttcacccgtgaaaaaagcaaaaagatccactggggatgccttgaggcagaagaagagaagatcagtgagacactggccagagatgcatcatgtgtcgatcatccgacggagaggttattgtcggctgccggaaaaggagaaaaaatttccagaaagagggacaacgagcataaaagtccactggaatgtggaaacaggtcaccaaaagacaggagaaaagcagaatggtccactagaatgtggaaataggtcactggaaataggacggcaagcagaaaggtccactgggacagtagaccaccgaataagtgacggcggacggtggttgctggaaaagttctcgggaaaggagaaaaggtcgccaaaaggcaaccaaagcagaaagaggtccatcggggacagtaggtccctggtggagaacaactttcgttattcccgtgtcaagaataacctaagctctgataccatataa

SEQ ID NO: 78233 - DNA, 267 bp, Glycine max
  Peptide Sequence Number=SeqID_195011
atggaaaatgtgtctgcttcaacacgttctcaccagcaccgtgatggctctggtaccataacaagaatatggtggaaagaatgtgtgtatcattccattgaacagataccagatatatacaagttacatgagttaacccatggagtgatgccatcctaccccgcaagggcattggatagaaaactccaagtagattgggccagagatgcaagagaaggccctagggttcttatgagccttatggtagatttcgggcccatgggctaa

SEQ ID NO: 78234 - DNA, 225 bp, Glycine max
  Peptide Sequence Number=SeqID_195012
atgaatttgaatcggaatgcaagaaatgcgcttgagagagctgtggattcagcaggaggaaccctagatctttcttctactgttgggaaattaggatcaattaccgatgctgatagaggaaatggaacggacccgactgatctcattcatgttcttgccacattgattcgtgtggtagtaaaccaaaagagttctcgtagacgtgcaagatgtgttgtaaaatga

SEQ ID NO: 78235 - DNA, 1278 bp, Glycine max
  Peptide Sequence Number=SeqID_195013
atggagaaccatgagagaagagggaactggagaaggcttgagtttgtacctgcagagaaggaggctcttttttatcaggtgaaccaggctattgtgggcattcatggtatagatgtgcagtttgctggaatcaaattcctcgaatcattggtatcagaattttctccatctacttcaagtgctatgggacttccaagggaatttcatgagcagtgtaggaggtcacttgagcaggactacctaaagacattctaccactggacacaagaagctgcttcaagtgtcacaaacaggattattgaatctgactctgttgtaccagaggttaaagtttgcagtgctgcactggatctcatgcttcaaattctgaattgggatttttgtagcaatactattgaaacaaaaataaatgtaaatgtcttctctgctggagttagacaagatggggattctctcaaaaagtctgaatgtcacctagtgcagcctggttcagattggcgtgatgtgttaatattaagcggtcatgttggatggcttttgagtttatatgcagcattgaggctgaaattttcatgtgaaggatactggcttgactgccctattgcagtctctgctcgaaagctacttgtacaattttgttctttaacaggagctgtatttctttctggtatgagtattcctcgtcttcctttatgccaattgtatgttcattttcgtagaatgacaatcttcaggttgagatgtcaagcaattttcactgataatgatggaaaaatgcatgagcagcatcttctgcagctcctatctgggataatagagtgggtagatcctccagatgccatttcgaaagctattgaaaatgggaaaagtgacagcgagatgcttgatggttgtcgcgcattattggccattgcaaatgtaacaaccccctatgtgtttgatggtttgctaaaatctatgaggcccatcggtactcttacttttttgtcaatgttgatgtctgaagtaattaaagtcctcatgactagtaacacagaagaggagacttggagctgggaagcacgtgatgtcttattggatacttggactgccattctaacgccaataaatactatcaatgtgaatgctttgcttccatccgaagggataaaagctgctgccaatctctttggtttcattgtagaatgcgagctacgattggcctctgcgacagcgtttaatgatgagggcgattcagaccatcttcatgcttctgtatctggtatggacagattataa

SEQ ID NO: 78236 - DNA, 201 bp, Glycine max
  Peptide Sequence Number=SeqID_195014
atgcatgcggaatcgattcggttggctttgcagatgggtgagggatttgaggagatgggtgtctttgaaattggaaacggaagaaagagtgcggttggaattagaaggggaaatggtgcggttggggtggggaggaagtcggtggaaactgttgttgtcattgatgttgttgtggcttcatggacaaacggggagaactga

SEQ ID NO: 78237 - DNA, 393 bp, Glycine max
  Peptide Sequence Number=SeqID_195015
atgagattgaatgccataactcttatttgtagtttacttcttattggtgctgttgggaaatctgcacagataggatcgcatacagagagtggcttacccttaaagacatccatgaaaacccctgaaaagtcggtggctctcctaggtttcctcatttgggatcccgggaaagaggatcaagctgtccatcttcttgttactcgaattgttcaccttggtcggaaatcagggtggttgttctacactttctattttaagcaagaagcttcatccttgatgatggcatatggtgttctcgaccatgcaagctctgctacattcgttggaagttcacttgtaggcatggggatcaagcttaaggaagtgaggaggttcaatgtctctgaggagtga

SEQ ID NO: 78238 - DNA, 273 bp, Glycine max
  Peptide Sequence Number=SeqID_195016
atggctccgaatagaatgcagctacagaacatgtgtaagagggagcatgaatctttcaaagaatacacccaaaggtggagggatctaacagctcaagtagtgcccccaatgatggagagggagatgataacaatgatagtggacacattaccggtgttctactataagaagatggtgtttgctggcaagaggatcaaagtgggtctaagaagaggaaaatttgattatgttgctttgatgaataggaaacttggcgtaaatggagagaattag

SEQ ID NO: 78239 - DNA, 261 bp, Glycine max
  Peptide Sequence Number=SeqID_195017
atggactggccattgttcagagacacgactcaggttcagcttggaatgccaactttactttgccccagaaagggggaaattccaagctcagatatggaatgcggtttcaatggggggcaagcagcaacaacgatattcagacatgcatcaactgatgccatgcggatgtatccatctacacttgagaagctcacagttaggaaaatataccagctattggtgcacaacgaagacaaggagattatggctctccatccttga

SEQ ID NO: 78240 - DNA, 201 bp, Glycine max
  Peptide Sequence Number=SeqID_195018
atgggctcagaaatctatcttgagattcatgagaatcttagggccttcttcagcagctctagcccaatcctcttgaaacctcttgctcatggctctggtgattggtcccttcctagggaggattgcatcagcaaaagtcataaaaagcataagaatttgcaacaaatagtcatggttgcgcttggggaccaactagattga

SEQ ID NO: 78241 - DNA, 99 bp, Glycine max
  Peptide Sequence Number=SeqID_195019
atgtaccacaattgcttcattttcctccgtcacacttacttcgtcttccctaaggcatgggtcacccttcgtttatctacgtcaaagaaattgtttgag

SEQ ID NO: 78242 - DNA, 660 bp, Glycine max
  Peptide Sequence Number=SeqID_195020
atgagttcctcaaactttgaatccccttacgagtactcttgttcttcttcatcctcacgtcataatcagtattcccttcctttcaaccacaatgactcgcaagaaatgctcctttaccaagtgctgacacaggctggtgcaacttcctcggtgtctcatggttcaggtagtgttgtggaagcagaggtttcggtttcgtacagaggggttcgaaggaggccctgggggaagtttgcggcggagataagggactctacgaggaacggagtgagggtttggttgggaaccttcgacactgccgaggctgctgcgttggcttacgaccaggccgcgctggtcatgagagggtccatggcagtgttgaacttcccagctgagattgttcgccaatcgcttcggaacatggagcagtacggtagtttccaagaaggctcttctccagttctggagttgaagaagaggcactccatgaagagaaaatcagagaccaagaagcaccaactccacgatgtgatggtgttggaggacttaggggcagagtatttggaacaccttcttactctctcccaggatatggatatggatgcttgcagtgggatcaggtctgttcaagaatgtcctcttttacgtggaatttgtggaccattttcagtgcaatga

SEQ ID NO: 78243 - DNA, 144 bp, Glycine max
  Peptide Sequence Number=SeqID_195021
atggcaaggaataatggccatggcagtgatggatggggattgaggagggtcaaagtgatcatctggattctggagtgttgggaactgggcatggaggaggagagacaaaaagctaaacatgaaaaggttaaaaacacgctttaa

SEQ ID NO: 78244 - DNA, 280 bp, Glycine max
  Peptide Sequence Number=SeqID_195022
atgaagtgtcttgctttcactttgaccatacccacaagcctagttaatgaagcttcagtcttttcaactgtgatctttgttgctccgtttgccgttttggtctcctcatcttccgctggtgttggatcttcttgtggggcatcaattgttgctgcttctatcggttcttgtgctgtttcttcctttggtttttcgattgctgctggttctggggctggaacatcaatgcctgattgttctgtttctgggattagtcttggtcgttacctcgttgttactt

SEQ ID NO: 78245 - DNA, 225 bp, Glycine max
  Peptide Sequence Number=SeqID_195023
atggaacaatcggttttggatgatataatcaatcgcctcctcgaagttcgtacccgaccggggaagcaggttcagctatcggagtccgagatccgtcaactctgcgtagtttccagagagattttcttgcaacaacctaatttattagagcttgaagcacctattaagatttgtgggattacttactggcttattcagtgtgttgttctgaactgcatgtactga

SEQ ID NO: 78246 - DNA, 294 bp, Glycine max
  Peptide Sequence Number=SeqID_195024
ttcaaagggcttgaaaattatgaacttaggagatgcctaacctactgttggtataaagaaggctcattgtttgaggatgatgatgttgttgatccacatcttgagcgcataaagaatgaagctggtggagatgaaagtgatgaagagaagcctgccaaaaaggaatcaaagaaggatatgccttctaaggcatctacttctaaaaggaaatcaaaagatgatgaagatggaaagaagaaaaaaagactcaaatgcacccaagaggacaatgtctggtttcatgttcatttctga

SEQ ID NO: 78247 - DNA, 975 bp, Glycine max
  Peptide Sequence Number=SeqID_195025
atggcaaggaaggctaggagctcgtttgagaaagttatgagtcatggaatgcggagacctatgcattcaatcctgggcttgctttcaatgtttcaagaggataatataagacctgaacagaagattgttattgactcaattttgaaagttagcaatgcactatcgcgattgattaatgatgtgatggagattgcagaaaatgacaatggaagcttccagttagagatgaaacctttccatctacattcaatgatgagggaagcttcttgcactgccaagtgtttgtgtatatataaaggctttggtcttgaagttgatgttgacaagtctttgcctgatctggtcataggtgatgaggcaaggactttccaaataaatggtattagtttccattcagatgaatcagtttcaacaagaaattatactggtagaaatcactgcaacaatgaacttaaggaaggcctgagcttcagcatgtgcaaaacgctggtgcagatgatgcaaggtaatatttggatatcaactaactctctgggtttagcacaaggaatgacacttcttctcaagtttcagataggatcatctcatggaagattcattcttgctcccaaagagttttcaaactctcagtttagggggcttaaggttgttttggctgatgatgatgatgtaaacaggactgtgaccaagaagctgctcgagaaactggggtgtcaagtaactgctgtttcatcaggatttgaatgtcttggtgctataagtgcctctggtaactcattcaaaattattatgttggatcttcacatgccagaaatggatggttttgaagttgcaagaaggattcggaagttccaaagccataatttttttctttgttcattgcttttactgcaagtgcagaataatgggggggaggagagatgtctacaggtgggaatgaatggattgattcgaaaacctatcctccttcattga

SEQ ID NO: 78248 - DNA, 522 bp, Glycine max
  Peptide Sequence Number=SeqID_195026
atggacgaagatcagtggatgtatgacaatataatgactgaagaagttgatatgaatgaccaaaatgaaggcgaagttggtgtgaatgaagagcatgttgattgttttgatgcgttcaatgcgtgtttgctacccgtgatgatgttctgcattaggcttgatctattgcttatgaaattggatttgtggcgatgtgatgcactccctgaagttattgttactgatagagatctagcattgatgaatgtagttaaaactatattccatgaggctaccaatttgttgtgtcggtttcacattgataagaatgtgaaggcaaagtgtaaaaccctggttggtaaaaaaaaggaatgtgatgatgtcatggaagcctgggggagtttggtggattgtcattctgagcaacagtttgatgagtgccttaagaagtttgaaattgcttgctcaccatggccaatgtttgttggctatggcaaccaaacatggttgattcctcacaaaaaaagatttgttaaagtctag

SEQ ID NO: 78249 - DNA, 272 bp, Glycine max
  Peptide Sequence Number=SeqID_195027
atgggcccaatttttgtcagagccacagagacccctcgtgggaggtatgatgtgcggaaaaaggcacaggccatccagaagcaaaacactgccccccacgtgttgtctcgcggggatttgttggaggagcaggcgtcacatgtcggtgtgaccatcaagcaatactttggaccggctccacggacctcccgcactttgttagtcgcgtccgctaagcgcaacactcctgggctaagcgcgaggaagactctggaagaagatgagttgtacag

SEQ ID NO: 78250 - DNA, 156 bp, Glycine max
  Peptide Sequence Number=SeqID_195028
atggagaatgaaggatctccaccggactccggagctcagtcttcatcgtcagtaacggtggcagtgtcgccaccggattatttccggcagaggccataccaaagcacaaacaacccttcatcgatttcaagctcactgtttttctcaagcgggtag

SEQ ID NO: 78251 - DNA, 765 bp, Glycine max
  Peptide Sequence Number=SeqID_195029
atgggtttggagatgggtatttgttttaaatgttggtgtaggaatggatactatagtgccctttttcaaatcttatccatttccttccctattaggaggcttattcataatagtttaccaccattgagaggatcatttactataattggactgaagtgtaacataattctggagtggatggagaatttagctcttgcaccctcttacaagaaaattgatcttcattcttcagttacctgccagagcacagacactaagggtcggtttgagattatttcacttactggttcttatgtccgtaatgaacttggaactcgaactggtggtctcagtgtatgcttatctaatactgacgggcaaatcataggtggtggagttggtgggccacttaaagcagctggtccagttcaggtcatcgttggaacattctttattgacaacaagaaagataatggtgctggtttaaaaggtgatgcctctgccagcaagttgccatctccagttagtgaaccggtatcaagtttaggtttccgccaatcagttgactcttccagtggtaatccaatccgcggaaatgatgagcatcaagctatggatggaagtcatttcatgattcaacagcttggtttgcatggaacacctccccgatccacagactggggtcgtccggattcaagaaataccggttttgagttgacaggaaggacaggtcatggggcgcaccagtctcctgagaatggaggctatgaccaaattcccgattga

SEQ ID NO: 78252 - DNA, 120 bp, Glycine max
  Peptide Sequence Number=SeqID_195030
atgtgtggatatacactcatactggctattggtttcagcacggccaagacacttgaacggtatcacagatgcagttatggagccttggaagtccagcaccaacctgaaatagagacacag

SEQ ID NO: 78253 - DNA, 195 bp, Glycine max
  Peptide Sequence Number=SeqID_195031
atgtctccccatgcgcttgtgcagaggcgctaccaagagtacctaaagctaaaatccagagttgaggcactacagcaaacacaaagaaacctccttggggaagaattggagcacttagacgttaacgaccttgagcagcttgaacgtcagctggactcttccttgaagcaaatcaggtctaacaagattgagtga

SEQ ID NO: 78254 - DNA, 279 bp, Glycine max
  Peptide Sequence Number=SeqID_195032
atgcctctcttcgccagccagcaacctcaggaggcagcattacctatgagctattcttcaaacaatctttctataaaaggaaaaggaactgttgaaacttgcaactttggtcaaaatctagtttattttccagtgacactaaaagttgcagagaggaaaaatattcctgggagagatgacgatcgtatttggacccaatgcgtaccaaaaactaaccatgacaaggagggaaagtatccactaaatgggtttgggaccagaattaatttcagtatttaa

SEQ ID NO: 78255 - DNA, 153 bp, Glycine max
  Peptide Sequence Number=SeqID_195033
atgtccaatgacaagctcagaatgaggatttcaaacagccaagataataatttgggaatgaggagaagaaatgccttgagggggatgttgatcgaaggtagctgggtagaaaaccctactgtgattaaggctgaaattcttcagcatttttaa

SEQ ID NO: 78256 - DNA, 486 bp, Glycine max
  Peptide Sequence Number=SeqID_195034
atggaacctattgacaaccatctcacctctttcttccaccaccaccagcaacaacaacaacaccaccagcaccagcaccagcatccgccgccgccgccgccgaccacggcgtcgccgaccaacggtctcttgccgaacgcggatgggtcccacatgctgtaccctcactcggtcgcgtccgcggtgtcgtcgcagcttgaaccggcgaagcggaagcgggggcggccgaggaagtacggcacgccggagcaagctctggccgcgaagaaagccgctacgacgtcgtctcagtcgttctctgcggacaagaagccccactctccgaccttcccttcctcttctttcacttcctccaagaaatccctttccttcgctctaggcaatgcagggcaagggttcactccgcatgtgatttctgttgccgctggtgagatttctgcatctgcttgcttgctgcaccgggcaactagagtgacttacctgtaa

SEQ ID NO: 78257 - DNA, 495 bp, Glycine max
  Peptide Sequence Number=SeqID_195035
atgaggttgggctgggccagacagcacacaagtgaagagaaagagccttccaaaatgttcaagctatctcgcatgctccctctcacttccacttccaggcataggctgttggaagtgctgtcctctaggaaagttgaagtcggagaccgtcttagccattcagctggcatttctactgctacaaataactatgctgccaaaggcattgctttatacaagtgtttatatttttgctacctgtttttggctgacattccactaggcattagctttacttctgttttcctgccattaaaaataacaggatatgcttccgatcgaatatttgctccttatactgtttacaagggcaaagctgcattctcgttgatcccttgtcttccaactttcactaagttgaattctgggactgttgtagttgatcgacgtggttcaatcatgatgactttcatgcattctattggagagcgcaaatatgactgggagaaaagccaa

SEQ ID NO: 78258 - DNA, 177 bp, Glycine max
  Peptide Sequence Number=SeqID_195036
atgccttggcagcggcatctacgaaggaaacaactgatagtgaatctcctaaagatgggctctaaagcttctgcattgaaacttgcaattcttggaggtccatacagtttcttcacttgcgcaaaaactaggcagaagaaagtgcgaaccaccagtttatggtctaagcggtcataa

SEQ ID NO: 78259 - DNA, 186 bp, Glycine max
  Peptide Sequence Number=SeqID_195037
atgaagagttctcagccagatgaagcaatttcaacaatacattatactggtaggaggcagtactacaacaatgaacctaaggaggggttgagcttcagcatgtgcaaaaaagttggtacagaattatccaatgtggaattgtttatgatgtttgaaatgggtggtgaaactatcataacaagttag

SEQ ID NO: 78260 - DNA, 264 bp, Glycine max
  Peptide Sequence Number=SeqID_195038
atgtcggttgaaagcaaacctacagagctaaggttattagagttgggtgttatttcgtggacaaaatggggaagagctccaggacagtacgagtcacacacagaggcacaagagacatattttttgttgagagggagagtgaagtttatcccgaaagactcaacatatgaccctatagaatttggtgctggcgatctatgttaccataccaaaaggactcacatgcacatgggacatctctgttgcagtcgacgcacattacaa

SEQ ID NO: 78261 - DNA, 1254 bp, Glycine max
  Peptide Sequence Number=SeqID_195039
atgggtactgttggatgttcttgttctactactcctcatcctagtcatcaccatcatcatcttctccttgttattggtttcttcttgacccttcttcttcaaacggttgaggttgaacccagcgccctaaattgcacaaggtacaggaaagtcagcagcttgagactccaaaggattcagagacacttggacaacattaacaagccccctgtcctcaccatagagagtccagatggtgatctcatagattgtgtccataaaagaaaacaaccagctttagatcacccccttttaaaggatcacaagatccagaaagtaccaacgaagatgccaaggggtatgaagaaggtgaagaggatggaaattaggagtgcacggcaaatgtggcataaaaatggaacgcggtgtccaaagggaacgattccggtacggcggagcacggtgcatgacgtgttgagagcaaagtctttgtttgactttggaaagaaacaacgacggtttcctcttactcgtcgccggagtgacgcccccgatgtagtcagcggcaatgggcacgagcatgcgatcgcatacactggatcatcacaggaggtgtacggtgcaaaggcaacaataaatgtgtgggaaccttcgatccaagtagtcaacgagttcagtctctctcaaatttggattctttctggctcctttgatggttcagatctcaacagcattgaagctggatggcagagtgactcatatcaagcaaccggatgctacaaccttctttgtgcgggttttgtgcaaacaaatggcaggatagccattggagctgccatttcccccatctcatcttatgaatccaaccaatatgacatcaccatcctcatttggaaggacccaaaagtagggaattggtggatgagttttggtgatggcacattggtagggtattggccagaagagttattcacacacttggccacacacgccaccatggtggagtggggtggcgaagtggtcaacacacgtgccaatgggcaacacacgtccacccaaatgggctcgggccactttgctgatgatggctttggaaaggcaagctattttcgtaatcttgagattgtagacaccgacaatagtcttagctcggtgcacaatatcttaacactggctgagaacaccaattgttatgacatcaagagctcctatagtaacgaatggggcacatatttctactatggtgggccaggcaacaatcctcagtgcccataa

SEQ ID NO: 78262 - DNA, 2076 bp, Glycine max
  Peptide Sequence Number=SeqID_195040
atggcaagtgctgctaagagccagttgttgactttcatgaatgaactcatcccaactattcggactgccctctgtgatagtgtttctgaggttcgtgaatcagctggcttagcattcagcactttgtataagagtgccggaatgctagctattgatgagattgttccaactcttctacatgcattggaggatgatgaaacttctgatactgcacttgatggccttaagcaaattttgagtgccttcaatgcacacgctttaggtgctttagcagtggttgctgggcctggccttgactttcatctttgtactgtgcttcctcctttgctatcagcaatgggtgatgatgataaggaggttcaaactttggctaaggaagccgctgaaacagtggtcttggttattgatgaggaaggtattgagccactcatatcagagcttgtcaaaggtgttaatgatagtcaggctgctgtcagaagatctagttcatatctgataggatatttcttcaaaaatagcaagttatatctggttgatgaagctccaaacatgatatctactctaatcattttgctaagtgattctgattcatctacggttactgttgcatgggaagctttgtcaagggtcattatttcagtacctaaggaggtgctgccttcttatataaaacttgtccgtgatgccgtgtcaacatcccgagataaggaacgaaggaagaagaagggaggaccagttctcatacctggattttgtcttccaaaagcacttcagcctatattgccaatttttctccaaggtctcattagtgggtctgctgaattgagggagcaggcggctctgggacttggcgaactgatagaagtgaccagtgaacaatcactcaaggagtttgtcatcccgataacagggcctcttatccgtataataggtgatcgattcccatggcaagtgaagagtgccatcttgtctactctaactacaatgataaaaaagggtggaatctccctgaagccttttcttcctcagctgcaaacaacatttgtcaagtgtctacaggatagtacaagatgtgactgcagaactgttcgttctagtgctgccctggcgcttgggaagctcagcggactcagtaccagggttgaccctttagttagtgatttgctgtcaagtttgcagggatcagatggtggtgttcgtgacgctattctgactgctttgaaaggtgtcttgaagcatgctgggaagaatttgagctctgctgttagaactcgtttttacagtattctcaaggatttaattcatgatgatgatgatagagttcgaacatatgcttctagcatattgggtatcttgacacagtaccttgaagatgttcagctaacagagctgattcaagaactgtcaagtctagctaattcatcaagctggccacctaggcatggttccatccttacaatttcttccttacttcattacaacccagcaacaatttgttcgtcttccttgttcccaactattgtagattgcctcagagacaccctgaaggatgagaagttccctcttcgcgaaacttcaaccaaggcattgggaaggctccttctttatagatctcaggtggatccttctgacacactgctttacaaagatgttctttcattgctagtttcatccacacatgatgactccagtgaagttagaagaagggcattatctgccataaaagctgttgccaaggccaatccttcagccattatgtcactaggcactattgttggtcctgcattagcggagtgtatgaaagatggaaatactccggttagacttgctgcagaacgatgcgctctacatgcctttcaactaacaaaggcatatagtacttctgacaagttgaatgatagtcttgtgaatgaaagagattggtgttttttcatgactttgagaagttctgttcagaaaatgttcaagcagcacagaagtatatcactggcttggatgctaggcgcctatccaagtttcctgaatatagtgatgatagtgacgacagtgacgaagatacctcaagtagctaagtag

SEQ ID NO: 78263 - DNA, 345 bp, Glycine max
  Peptide Sequence Number=SeqID_195041
ggcaaaggaactcgcagaagaggtggagatagagaaatgaccaaaaacatgcagagtggagagtggtcaagtgatcggcacgtccttgaccgtgaaaccgcaaagttggatggtggctgcccagatggaggaggtcatggttggtctcacaagcaagtgggtgtcgccgaagaagtgccacgtgctggaaaggagggtgggcatgaacttcacgtgccgaagaagaagcatacatgggagcatggagacgatgttgccactaaacagtggcaaagaacggaggcactattctccgtgaagctacatacacgaagtggaagggatcaaagaaccctaatctactga

SEQ ID NO: 78264 - DNA, 642 bp, Glycine max
  Peptide Sequence Number=SeqID_195042
atggtcattaaggttgacttagggaaagcttatgaccgagttaattgggattatttgagattgactcttattgatttttgctttcctagtattattactgatcttattatgtggggagtggcttttggtcttaaagtgaatctagataattatattttcaattgctctcttgcagttcctcaaaggattcaagatgagatttcaaacattcttgagattagttgcactaatcacttgggaaaaaactcagtcttggcttccactccaatttatcctatgcaagcttgtggttccttacctcaatgggcaccaagcttgaccagtgtagtgcaaattttgagttctaagtacttacaaaatgacgcgatcttgactgctaaattgaagccaagggattcttatgtgtggtggagtgttattaaggcaaaagatgttcttcttgatgggtttagctcacagcttggcgatggtcaatctttttggtattctaatcagttggctgatggaaagttatgtatgaaaattgttgttccctctaatccagtaagggatgatatcattttttggaaaggtcatagctcgtgtgtttattcatcaaaatcaaactacaacaaggtctcaaaatttgatgatgttccctag

SEQ ID NO: 78265 - DNA, 777 bp, Glycine max
  Peptide Sequence Number=SeqID_195043
atggcaaccctaaacggagagaaaagcaatcaagtgagtggagagagcggcatccctgaaaagtcaccagatggcgaaggaggagaggttgttcagatattgtcgtacaaggatcgagttctaggaaaagtgagtgtgctgaaagagccaacaaacttgttgcatgaaggggtaatgatactagaatatgaaggaggaaactggatgctactaaagtttatcactaaacaagcaaagtttgagcaattatatatgccatggaagaattgtttgatcatgaaattattgggcaaaaatgttggattcctcacaatgagggagaagctaaagtttgtttggaagcttgagggggaagcaacaatagacaaaaccttggtttggatccgttttccaagtctttggatggtctattatgatgagactgtattactgaccttggcatcaactattgcaacacccatcaaggttgatctaaacatcttgaatatgcataggggaaagtttgtgcgaggggatggggacacacctccattggcagctgaaactaaccctaacactaaggagattgtgacaatgcaatttgaagattctacaaatattacaacacatggtgagtggatggttgttaaatggaaagaacggaagagtgccaatcacttgaaagttgcaaatactcattcgcaaagccaagggcacgtgggtaaaagaatgagaaaaagagaatcagattggatcaaggtaatggtgctcaaaaaccacatgttggtaaacccataa

SEQ ID NO: 78266 - DNA, 594 bp, Glycine max
  Peptide Sequence Number=SeqID_195044
atggctgacgccaaagattcctccatagtagactccaaatcttccccaacctcaaccttaacatcctcagcctcacaacaacaacataggattatacgaactttcttgatggctcaggacatcctcagaatcctaccaactctcctctccgcagcatcaatcgccgtcatggtcaccaacaaccaaaccgttctcatcttcgctatccgcttccaagcccacttttattactcaccctccttcaagttttttgtagccgcaaatggtgttgtcgtggccatgtctttgctgaccatcatactgaactttcttatgaaacatcaagcgtcaccaatataccatttctttcttttcttgcatgacatagtgatgacggtgttgttgatagctggatgtgcagcggcaacagccatagggtacgtgggaaagtttggagaggagcatgtgggttggcagccaatatgcgaccatgtgcgcaagttctgcacaacaaatttggtttccctcttgctctcttattttgctttcattgcctatttcggaatcactattctatcagcctacaaaatcgtctcttcttctcccaagaactaa

SEQ ID NO: 78267 - DNA, 285 bp, Glycine max
  Peptide Sequence Number=SeqID_195045
gtactttaccatgtacttggtgttgttccagcttatcaagcattgataggacctgcactaaatgagctgagtcttggtttgcaacctgctgaagttgcttctgcacttaatggagtttatgcaaaagatgttcatgtaagaatggcttgcttgaatgcggtcaaatgtatccctgctgttgctaatcgttctctacctgaaaacgttgaggttgcaacaagtatatggatagcattacatgaccctgagaagttatctgtcattgagagacagcttgtattttaa

SEQ ID NO: 78268 - DNA, 465 bp, Glycine max
  Peptide Sequence Number=SeqID_195046
atgttcaaatttggagaaaacatagtgagctggaaatgcaatatgcacaatgtggtatcgttgtccactacagaggttggatttattgttgtgctagaggcaataaaagaggcaatatggatgaagggaaagggcacaaagttgggagcaaaagaagttggtgtaaggatttatagtgacagtcagagtggtactcactgggccaaaaatcaattataccatgaacggactacatacatagatcactgccttagaattcttcaagtgatgaacagtaaagtcaagccaaggggtcttcaatcattgccagaccttcctgagttccaattatcattacgtccagatgactatgaattgcctgaaattgatccggcatgggatagtgaaaactgggaatctcttgggcagccattgaaggagcaccttagagatagtgatgagcatgatgagaatccaactgattga

SEQ ID NO: 78269 - DNA, 282 bp, Glycine max
  Peptide Sequence Number=SeqID_195047
atggcaaccaaaagcaaaacttaccaagacacagtagacacaacagacacgagaagaggagcaaaaagtgctttggtgccaatggctgcaaggaaagcaacgtcagcagacacagcagacatagtagacacaaagcaagaaaacttaccagagcgcaatgaagagggtggctttgcgaccagagcacgactagggtggctttgcgagactccgcgtggtgggtcaaggacaatggcaattagagggtggctttgcaaggtgggtcaagagcaatggcagtga

SEQ ID NO: 78270 - DNA, 195 bp, Glycine max
  Peptide Sequence Number=SeqID_195048
atggaatctatgatgctttcaggtcttccatatcttggagcaactgatattatttactactgcatctgttataaaattagtaatgatatggtaagggaagacatctttgagcttaatggtgatgggaatccagaaaacaaaaatctgaataagatgaattttattgaattgaaacgagctcaagaactattatag

SEQ ID NO: 78271 - DNA, 327 bp, Glycine max
  Peptide Sequence Number=SeqID_195049
ggtaacatcaaggtggctcacaaaacactcaagtcccaaaactcacaaaataactcttcaatctcggacttggtggaaaactcgtgcagccttcatgtttatatagcagtgtgcgtatctgggctgcaacaacttgcgctggataagatctatcattctcctgaaaaatctgcacttaaagatctaaaagataagatttatgtgtccagtattttcgggcaggatgtcctggacatcgtatccgacatcgtggatcctgcagcttcaattcttcatttgacattttatcttgccttgtgcattgtgcagcccaatctgattccttga

SEQ ID NO: 78272 - DNA, 1474 bp, Glycine max
  Peptide Sequence Number=SeqID_195050
atggatcgggaggtcatcttgataggtggtttctcatctgaggatacttgccgaggtgcctttcacaacaagtcatccccgtctaagaggttgtctggcaaaattggatgggtctccttgaacaacatgtccaagaagctgtttgagtttgatttaaacatttttcacccttttaaggacccatttttcaaggtcctggttactgatgtagtggctgatggcatgccattgatgcttaacggggatagggagccccacttcatcgatcttcttactgccttggatgatattatgagtgacttcgattggaggccactcgtgaagcgggttggacctgcaggtgggactgtgctaccgtctgttgctaccccgtctgctggcgaggttggtcctgttgttgttgttgttactgaggttgcccccaatgctctttcctctattttgttaaagaggaagagtgatgatgttgttggactgtcaggtcgcctcatgactgcacaagatgggcctccggctccactggccgtcgaggctcctgctactactgctgctgttgaagtttctcctgctgctattgaaattgttgtgccagccactcaggctgagtctgttgtggtgttgtcgtccactattgcagcccctttactaagtgtcgttgtggagaccattggtactcccacggtgctgcctccttctttgtcagcttcgatggtcctccctgctgatgttctaatggctatggtgttgccttcttcgtcctcgtgcccttgcgtctccctcgatcatttatacacctactatgatgttgaatcactatggagtgtgacttacaagtcggagcaaaagacctcggagaacaaactgcggcaccaagaggtagtgcaaaaggttgcatccttggaggcgaaggttgccaagtgcagggctactgctcggactctatggcgagcggagcgccctaagagtgaaccgctaactgtcttccaaggttggtggtgcattggccaagttgtcgtgcacccagagatggcgatgacttgcttagacgttgcccggcttagggaattggagtcaagatttgaggagtccgagctacgggctaccaaggaaagggaggccaacaaggatcttgaagaagagctgatcttatataagaaggaagttgttagtttctttgcgagtgaccttgacttgggtctcttcgatcccttcaaggatgtaagggatggtgtccttcttggtgaggaggagattgatgcggaggaggaggctacagatgaagggaggggtgtgtcgcaacctacccttcggcaggagggcgacgcgagactcgcgggtgaatcttccaaggaaggaaaacgcgtggagtcgccaccaacgtttattcgaggaaaacgtcggaaaaacccgaaaagacatggtctacgaactttaagtgtgaaaggttcgggagttgtatttacgcacggggaag

SEQ ID NO: 78273 - DNA, 297 bp, Glycine max
  Peptide Sequence Number=SeqID_195051
atggcatgcgtgtccagcaaggccggcaactactttagaattgctttgttaatcctctcgacaaaggcacctcggcaagtatcctcagatgagaaaccacctatcaagatgacctcccgatccatgatgggttactcaatcgagccctcagagtcactgccacccataccgatggtagaatcagatagaaaagaagacattgtggtggacgtaagtaccttcagaagttggaggaagaagaaagggaaaccaaaagctagaaagcaagcaaggaaacaggaagacaacaaacagtga

SEQ ID NO: 78274 - DNA, 473 bp, Glycine max
  Peptide Sequence Number=SeqID_195052
agggtacatctacttgggttgttgtaactgaaaacaagagagggtacatctcttgtggatcagttcaagtggagggtttttacaatgttgaaaagaaatctcaaggaccgcaggttgcttggggactggatgtaggcgcggaactaaagctgatggttgagaaaacaaagaaaaaactagaggaagctgctcagtccggaagcactgagggtgtcattaaccctccatctcccacaagacgacatgtgaagtggaagatggcctgcaccaagaaaactaggcagatgacgtctgaggccgcaaaggatattgttgagaagtttgcatcacagggttcatttgtcccccatggacatcaggaagtcctgactgctgcaattgggcaattagaacaccctggccatgtgtgtcctgctagagccggtgtcaccatcaagcaatacttcgtggcacatcaatgtggatgtggctga

SEQ ID NO: 78275 - DNA, 243 bp, Glycine max
  Peptide Sequence Number=SeqID_195053
atgctaacaaacaataatgaggcctacattattgaaaacaaccaaaaccagaaccatatactttggaaggcctacattgccgaaaacagtcaaaacaccaataaaaggcctacactatcgaaaacaaccaaaacaccaataaatctgcaaaaccagaaccagaaccagaaccatgatttcactgtcaaaaaaagcttcaagagaaaaacatacagtgagagcgagagtgacaatgacatctag

SEQ ID NO: 78276 - DNA, 330 bp, Glycine max
  Peptide Sequence Number=SeqID_195054
atgcctcaccctatagtggctgaatgcacacaagtcatgacagtggatgaagggtctcatgttcgagccttaactgtctaccaagctagcttgggtggtgaatttgacatagatccgcgatatgacaccttcaatagaggcctgaaacccattgaagatcttgcgcagttgcaacttagacctaaattggggccaaacaagtatcatagaagaaaaggaagacgagagaaaagtggcataaagctgtcaaagaaaaagttgacaagctactccacgcaaacttcatcagagaggttaggttatgtacctagctcgccaatgtcgtcatga

SEQ ID NO: 78277 - DNA, 306 bp, Glycine max
  Peptide Sequence Number=SeqID_195055
atggaagtagttttatacacaaaagttagtcgtattcatcgactaacatgtatccccaatgaagaactagctcatgaagtcaattatacggggaaccagccaagacaaaatttcaatgctgatgaaggtagagctgaagagaaggtgaagggatataaacaacagctggaagctgagccggcactggaaccagtttctgattttgttgaacttgaggaagttgtggaagatgaagatgaccaacaggagagagagataccaataaaagagagtgaaataggaataaagatgaaggaaaaacaataa

SEQ ID NO: 78278 - DNA, 435 bp, Glycine max
  Peptide Sequence Number=SeqID_195056
atggctactccatccagctctcctcctcttcatcctcctccttctcttcctactgaagcagcatcacattcgccgtctaccttgaagtggacaagaaaagccacacggctaagatcattggcgactagaccagctggggcaggcagaccggtggtccacgtcgatcctacgaccgggatggccgtcggtccccacaagaagaaattaagaacatatttggggattgtcgctcgtgataaggctgaatttgatatccctgaagcatctgacgttaggacaaaaaagaaaatacttcagactatggtggagcggtggagacagtttaagtctactttgacgtcaaaatgggtacttgcaatcgacaaggacagtgtcgatgacactgtttgtgaaaaatatggcattagcaaggagaaatgggcccaatgttgttag

SEQ ID NO: 78279 - DNA, 165 bp, Glycine max
  Peptide Sequence Number=SeqID_195057
atgaactcactaagcgagcatgctgcgctaagcgtgttcatcaatacttattgtatatggcctctaagaaatgtaagagtagtgattctaggccacaggatcagaatgataacaggagatttcaatcagaggaagcctagaaccgatatatcgataatattttag

SEQ ID NO: 78280 - DNA, 516 bp, Glycine max
  Peptide Sequence Number=SeqID_195058
atgaaattcaaatccatattacttgcggttgcaatcagtacttctgctgtagcattcgctcaggagacatcacagaaaaagttcgctccgccggcaggaaatgctatcgtgggagatacttatggtgctggtgttgactcatctgtagaatctaaggcgattacggttgaaaaacttggtaaaaaactgaaaaaagaaaataaaaaacttgagaatgtagccatcaaaggaaaagtaaccgatgtatgtgagaaaaaaggatgctggctaactattcagactgaagataattctcagttctttgtaaaaatgaaagattatgcattcttcgttcctactgctctgaaggggaaaaacgttgttttggaaggaaatgccgaaagaaaagtaatctctgtagatgaacaaaagcattatgctgaagatgctaaaaaaccacaatcagagattgacgctatcacaaaaccaaaagaggaagtgagatttgtagctaatggaatcaaagttgttaattaa

SEQ ID NO: 78281 - DNA, 251 bp, Glycine max
  misc_feature (249)..(249): n is a, c, g, or t
  Peptide Sequence Number=SeqID_195059
atgggttctatgattgggagtggaatctttattgtaagtgctgatatgatgcggaatctgggatccggatactggttgatcgtagtatgggttattacaggaataatgacagtggcagcagcaataagctatggggaactgtctgcattgtttcctaaagcaggaggacaatatacttaccttaaggagattttcggtaaaaggatggggtttctatatggctgggggctttttacggttattcagacngg

SEQ ID NO: 78282 - DNA, 501 bp, Glycine max
  Peptide Sequence Number=SeqID_195060
atgtgcgctgagaaaggaaaggcaaattgggagcaactcttggctagtatggtaggggcatccattaattggttcccccgatggaagaaaggaagagttggggttttgtcctcatgtgaggggttctcgaacatccccttgatgggaatgaggggttgtatcaattataattccgtccttgccataagacaacttggctaccccatgagaggggtgccatcggaagaaagtatcacgcccttcatcgcacggggtttcagttaccccaatgcaatgatatttcaaagggtccgaaaggcatggagtgcggtgcaaagaaaggataaggagcttaggggaaacaaaaatgggatcgttggcggctattacaagtggctgaaggcttggacgcaagagttagattggcttccaaaggtaaaggtttcaagtgaggaagaggctgaaacccctgaggagagcaaaaaggtgcaagccttaatggccaaacttgaaagggcgtaa

SEQ ID NO: 78283 - DNA, 483 bp, Glycine max
  Peptide Sequence Number=SeqID_195061
atgtgggcttttcttaccgatcgtcagatcgactgggcccacttggttaagtaccgtatgcataaggcattacggaccaatgcacctcttccgtatcctcagttagtcactctatttcttcgtcactttcaaattcctctcgatgatgaaccttttgttcaagtcaagacatcttttgccattggtgttggagtggtaacttcttttgggtaccgtaaggatattgatggacaatggattaggaaacaagatttaccaccactaattcctgatgagcgtacttcgtctcctctgccacagagagatgcttcatctactcttatgcatgaagtcctttctgaactatgtggtcttcgagcgttcgtaggtgaccgtttggatgccatggatgctcattttgaaggcatggatacatggattactcatcttgaagacgacatgggtttcattcgccgttgcttcgatccaccggctgccccatag

SEQ ID NO: 78284 - DNA, 667 bp, Glycine max
  Peptide Sequence Number=SeqID_195062
gtctgagttcctcattggaggatacgtaggagcaagagcctcgcttttgtcgaccacaccgccttttgttgccatgactcaagagctggtagcccgcggagacaccttacggttatccgcacctcgtcattcagtgaccccaagtgtgattgatgagcagaggctaatgtggtcatctgcgccttttccggagatgtcagcattttccgatggagacttttcaagtctcacaagttatctagaactacgtcatgtgacatgcacccttgtatcatccagaggcggcgggcccgatgatacgcggagataccttacggttatccgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacgagcagagaccaaacagaacgcttgatagcatgcagaggctgacacagtcttctgcaccttttgttcctccgggaacagcaagtcatttacatgcggaaatttcatggtcacccgcgactctcgtcaaccgagaggagcgaaattag

SEQ ID NO: 78285 - DNA, 291 bp, Glycine max
  Peptide Sequence Number=SeqID_195063
atggggacaaattctaggaatccttattattacaaaaacataagttgtactagaagagattggtcgaagctggtgaatcatggcattaatgcatggaagagaggttcaccaaagagcactacaggaaatgcttggaagagattcaaggaattagtggcaagcaaaggtctacatgctgtccaaactaaggtcaaggatatggattgggagagcatcttccacttgcatcacctccctgattcaaacatcttggagatctctgatctcatttatgagtacaagttacaataa

SEQ ID NO: 78286 - DNA, 330 bp, Glycine max
  Peptide Sequence Number=SeqID_195064
atggttcccttttgcaaacttattccccaaatggggtcgtttttaaacaatttctgccatggtgttgttttttacgtggtctgcatgcaaaatgcatgcaaaacacaagctccattggctacttcgtgggcattggacacgtggaagcccaacccgccagtgctgctggcgacttcaggtggaagcgcgtcccgccagttctgctggcgacttcaagcctgtgctgaaatcgcagctttgattggcaatttccaaggctatcaggctagggtgcaggacgcacagaagccatttccgagggagctgcagagcaaggaatcgccagtttga

SEQ ID NO: 78287 - DNA, 303 bp, Glycine max
  Peptide Sequence Number=SeqID_195065
atgctagaggtaaaacgccactcactttccactgatggatttgaaccagttgaagatatcaatttggggaacattaagtacagagatagaatgtgtcaaactctctatcctgaacttggtcaagagtctctaataccatgtcaggaacctccgctaccaaaaagtcaagcagtggactgcccaaacgtttcaactattgcttgcaaatatgctacaatctttcaggaatttctgcaggacagtgatttaccagtttggaacagatttaaaaatactggattttggcgtcaattgacggtataa

SEQ ID NO: 78288 - DNA, 243 bp, Glycine max
  Peptide Sequence Number=SeqID_195066
atgttgtgtgcgggtgttgtgtgcgtcaccatcgccgccgttcgtgcgctggaggctgctgttggtcgcgccgctgaagattgttgtgttgttctgttcgtggctttgttctcgcgcttcgagtttccttttgcaagagaaactcgggtagggttgggtcggacagttagagaggttttgatgacagtccagaaccaggttgacttgagatctagacactcagaaaagtcgtttaggtcgtaa

SEQ ID NO: 78289 - DNA, 342 bp, Glycine max
  Peptide Sequence Number=SeqID_195067
atgtctctgtacaatttatatttagttaccaaaatagagatcgaaggaacggtcgctagcatcattttattaatgtggcaaagctggtcagacccatcttggcctaccaaaaatgggttcggatgggttgaaaatcctgatccatcccacttaaggggtggattggccgtcaaaaataaaaagaaaagatcggtgggccaactcgtcccatcccgcttagttggcagggttaggcgggataaacaatatggggacagagaaattgagtcacctaacccacctcttgacatttttggttggttggactgctgggccaagacccgcccacaatgtcaaccctaa

SEQ ID NO: 78290 - DNA, 399 bp, Glycine max
  Peptide Sequence Number=SeqID_195068
atgaaggtaggtacaagcaaagaaacaccatcacaaagaacaagagttacaataacaaggaaaaaagaagaggaagattcgatttcttggttaagaaagaaatacttagtgaggattggtttgtcatggggggttaggggagtggaggctaaagtgtcatactccatggccacggggtgcagaagtcgaagccagagtgtgatagggcttagagaaaaacgcgtgttggttaatgctttgttggggaactccgattccatggctgcgcgccgaatgcgggtgcgggagaggaagaggaggccaaggagaaggagggtgcagaggaagaagaagcgaaggagaaagagagaagggatggagatcaaggaggacacgacgggatgtaatgtttgtggataa

SEQ ID NO: 78291 - DNA, 273 bp, Glycine max
  Peptide Sequence Number=SeqID_195069
atgggtgctcagttgcgaaagagtgcagtgaagaagatgatagtagtgatgaagattatgctagcatccagaggcctgcctttatggttgatggagaacctaattttgattttggtccaccaaactggtatgttctctactactcaaactgaggctattgaagagcttgctaaggcaggattgaggaaccctgtgagggttgaaggtgttctagttgatgatacctacagttatctgagtaagcaacatagagaatgtgtcattcgagaatga

SEQ ID NO: 78292 - DNA, 633 bp, Glycine max
  Peptide Sequence Number=SeqID_195070
atggctacaacaaggttacaagaagcaatattgactatccctcgtggtataactcaactaatggacatgcttatggatcgtgaggtaataaggaataaggcattattgcttcttactcatctgactcgtgaagctaaggagattcaaaaaattgtcgtctttgaaggtgcatttgagaagattttcagtatcataagagaggagggaaattcagatggtggtgttgtggactgccttgaattgttgaacaatttgcttcgtagcaatgcatccaatcaggtactactaagagagactgtaggacttgactcattgatattgattttgaagctgagaggaagtagtttcacttttaatcaacaaaagaaaaaggtattggaccatttgttaatattaggtgttgaaagccaatgcgtacctgttctcgttcgctgtgcggcaatgcgatgcattggtgatttgattgctggagattcaaagaatcgtgatcttcttgctagcaaagttcttggagaggaaccacacattgaacctactttgaactctatacttagaatccttttgagaacttcaagcatgcaagagttcattgctattgattatattttcaaaagcttttgtgaggtcagttaa

SEQ ID NO: 78293 - DNA, 165 bp, Glycine max
  Peptide Sequence Number=SeqID_195071
atgtctctcaatcaagttcctgtgaaaagaaagaaagcaagatggtatgataaaaatattgagattatgttgaaagtgtgcatagaagaggacactggtcttggctgggatggagagaagaaaactattactgctagtgatgaatggtgggaagccaaaattcag

SEQ ID NO: 78294 - DNA, 106 bp, Glycine max
  Peptide Sequence Number=SeqID_195072
atgtcaacgtcatcacgtcggctcggcagctcctcaccagaatttcactttctgcaccctactgctgtcattctgctcccaggaacaatgttcgtgatcatcacag

SEQ ID NO: 78295 - DNA, 324 bp, Glycine max
  Peptide Sequence Number=SeqID_195073
atgcaaacctcaatgcagtgtactttgactcaacagagtaatggtgacttcagcctccttgcaagcatcaccaatcccaataggaacattgatgtgaggtttgagttgtttgatgttgagcttttcttctcagacaggatcatatcaacactccattcagccctttactcagggagaagggagggcaggacaggggcacaatggaacagggttaagtacagtgtaagaggaaacataaaagtgattaaagtgagagtgagtgtgggattcttccacttgtcttacttactggttgttgcacaggagatgccagatagagattga

SEQ ID NO: 78296 - DNA, 1103 bp, Glycine max
  Peptide Sequence Number=SeqID_195074
atgtctgattattactttgacgaggaggagatactagagttgctgaaggagaatgattggccagtctttgatgacttatttaacaattttgccactcaagattcttcccctccagctgatgagattcttcccgccaatgaggattcttctcctccagcggatgatgagattcttcctgcccatgaggttcttgatgctcctgcccctcttcctgttcctcctcctgcacctgcacctaacagggttcatacttctgccactgctctggatcctgctcctcagatggttcttgcctctcaggatcctaccaagccatctgaggagacattgtcgagcagccacccacaccacttgctgcagcataatatggaccctagtcatgtcattttgtccggtgactcatcccattcagttcatcacaagaaatacgaacattggacaatagaagaacacaagtcatttctctttgggcttgagataaagaaagagaaaggttggaaacagatttcagataaatatgttccatcaaaaaccgcatctcaagttgccagtcatgctcaaaattacgtcaaacgaaagaatagccctatgaaagagagaaagagaagaagcatccacgacacaattttagaagacattgatataatccgcattgatcaacataattgggttccaccaacttcaaattttatagtgcagccacatactctcggcagtaattgggttccatcaacttcaaatcttatggtgcagtcacattctaccgttactgatcaacataattggattcctccttgtgctccaaattttgcagtgccaccacgtatccctcatgttgatcaaaataattgggtttcacctccttcaaatcttgcagtgcaatcatgtactgcccatattgatcaatatacttgggttccacctcctccaaattttgcagtgcagccacctactcctcatattgatcaacataactgggttccatcacctgcaaatcttgcaccacatacttcccttattgatcaagataattgggttccaactcctccagattttgcagtgcagccacatgaaatgcaacgagcacaacatatgcagatgca

SEQ ID NO: 78297 - DNA, 189 bp, Glycine max
  Peptide Sequence Number=SeqID_195075
atggaagagctttttaagaggtggaatgaatatcttgatagcacacgatcaagggaaacaactaaatcaacacaacgagcattccaaagtgcagaaatccaggttggtgagctggcagaaaaagtgactcaatttatggtcagaagtgaaaaagactttgtagaggttgaagctcaagaggaaaaccct

SEQ ID NO: 78298 - DNA, 207 bp, Glycine max
  Peptide Sequence Number=SeqID_195076
atgcgggggtatcgcatggttatccgcacctttcgtcaaccaggggcaaacgagcccgttgacgcgctgagactaacatcgtcttctgcaccttttgtcatcctgacccatgaagtcagaaatggcaagtccgatgacatgcgggggtactgcatggttatccgcaccttttgtcaaccaggggcaaacgagcccgttgacgcgtag

SEQ ID NO: 78299 - DNA, 762 bp, Glycine max
  Peptide Sequence Number=SeqID_195077
atggtctctgctcacagcgttgatctagtggcggccaaggctcaggccatcacccagtggcccattatagaatcccagagagcattgcgagatttcctgggactctcaaaattctataggctcttcatcagaggctatgcgaccatcaggacccctcgcactagtctcttagcgaaggacaatttcatttggtccgatgaagcccaaattgctttcaacagtctaaaggatgccattacaacgtcacaagttcttttgttacccaattttgagttgactttcatccttgagatagatgctttcagcattggaatgggcattgtgctttcacaacaaggccatccaatttcctttttcaacaatccctttagttccaaattgtatcacgcctccacttatgtacgagaactctttgtgatcacggcagccgtaaagaaatggagacaatacttgttgggtcatccattcaccattctcactaatcacaaaagcctcaaagagctcaagacacaagttgtgcagacgccagagcagcagatgtacttggcaccctttgttgcacaatacgtgaagttttgtgacatgccggagatcaaaaggaagcattgttacacaatccgtgagatttcgatgttcctccagaaagcggttgcttctggaggaagcaacctggctcgcctgggcgagctgggtggcaagcacctcccctattttcctataaatatggggaggagtgaaggagaaaggggttcagcccttctg

SEQ ID NO: 78300 - DNA, 487 bp, Glycine max
  Peptide Sequence Number=SeqID_195078
aacctgccccaagacacagcagacacttgtgcatacagcccttacccctaactatgttttgaagagtttgattgctttatggtgtgaaagcaacgatattgagctaccaaagaggcaacgaaactgtagaacaaagaaatatggtggcagctgtctttcaaaggatgctgctactgctctaataaagttactttgtgaagatgaagcactagctattatggcaatccttgcaagccaccatgaaggcagggtagcgatcggtcaggccaagccaattcatattcttgttgaggttataagaaccggctctccacgcaatcgagagaatgttgctgctgctgtcttgtggtcattatgcaccgaagatccactgcaattaaaactagcgaaagaacatggtgcagaagaagcacagcaggagttgtcagaaaatggaactgatagagctaagataaaagctggaagcatattggaactcttgcagtga

SEQ ID NO: 78301 - DNA, 802 bp, Glycine max
  Peptide Sequence Number=SeqID_195079
ccgcgccggcgaatccggcgcgcaaaaacagcaggcgctgcaggaagccatcgccgaacattaccaggcactgtatcaggcggcttgcgaacgccgcgatcggctgggcctgccgctgccgatcgtcgccaccggccacctgaccaccgtcggcgtcaccacctccgactcggtgcgcgacatctatatcggcaccctcgacgccttcccggcgcaggccttcccgcccgccgactatatcgcgctgggccacattcaccgcgcgcagaacgtcgccaaatcagagcatattcgctatagcggctcaccgattccgctcagcttcgatgaactgggcaaagccaaaagcgtcttcctggtcgatttcgccgacggcgccctgcagcaggtagaagcgttaacgatcccgcagttccagcccatgcagctgatcaaaggcgatctggccgagatcgaacggcagctgcagcaatttgccgactatgccggcgagctgccggtgtggctggatatcgaagtggcgacgcaggactacctcagcgatatccagcgccgcatccagctgctggcggatgagctgccggtggaagtggtgctgctgcggcgcagtaaagagcagcgccgccaggcgatcgcacagcaggataaggaaacgctcaacgaactgagcgtcaacgaggtgttcgaacggcgcctggcgcaggaggccgacatgccagaagcgcgccaacagcggatgcatcaactgttccgccaggtggtcgaggcggtgcagcacaatcctgaggagacccaaccatga

SEQ ID NO: 78302 - DNA, 201 bp, Glycine max
  Peptide Sequence Number=SeqID_195080
atgaagcatggctccaaactctttggcggaggatgcatgaacgaaaacgcaattcatggggctccgaaaaaaaaggcgaggatggaggattgcactagagggttctcactagtcaatcgtgaagcatggctccaaactctttggtggaggatgcatgaacgaaaacgcaattcatggggctctgaaaaaaggcgagactga

SEQ ID NO: 78303 - DNA, 999 bp, Glycine max
  Peptide Sequence Number=SeqID_195081
atgccgcgctacctgcacgcccccgatgtggccgtgcagctatcgaaggtgcccgacatgaaaaagcgcctctttattgacgcgctgtggtacaccggtggccggctcaacgagatcctgccgctgactagggaggatctttgcactggacgatccgctgaccggcgccccgctttcctcaccgttcgtggtgctgcgcacgctcaagcagctaaagctagaggaggccgcgcgcagccgccggcgcggccagccaacgaaggaggaacagctggccttgtaaagaagcgtggcatcgggcggcgctcaggctgggcgcacttttcagcgacaacttccgccagtatgaatacgttgccgacgcttaggttaagcagacgggtctggtcatttaacagactgcgcgagcgcgaactggtcataaaggacgagcacattgccgaaaatgcgctccgcttcgtaggctactaccggctgcggggctacttttatcctttttaccggatgacggaagagcgcgtgccccgggtgcacgaacccaaacgttttctttcaggcaccacgctcgggcaggtcatcgatctgtatgaatttgaccggcgcctcaggcttatcattctggagcagatccagaaggttgaagtggccctgcgcacctgcctgtcagagcacatgtccgcccgctacggcgcccactggtttatgaatctcgcaatcatgcgacctgactacgatcatcaggaatttttccgccagatagccggtgctaaagaggtcttcatccagcactatcgcgaacgctacagcacgcccgtgtgtccgccctcgtggatgatcaccgaggtcatgacgttcgggacctggtcggcgatgtatgccagtattcccgtcagcgatcagcgcgcgattgcgcgcatgttcagcctgaacagccatgacgtccttggctcctggttccacactctttcgcacctgcgcaaccttttgcgcgcatcataa

SEQ ID NO: 78304 - DNA, 111 bp, Glycine max
  Peptide Sequence Number=SeqID_195082
atggatgccgagagctacctcgccgtgactccgatgtcgttaagcgatattacgcttgaagtctgggccctctttgctcagttcatggggtgccctaagcgcttagattaa

SEQ ID NO: 78305 - DNA, 318 bp, Glycine max
  Peptide Sequence Number=SeqID_195083
ttgagattgcctgctatcaaacaacaattgatattgcaatttaaagctgccttccattgtgacaaggacgtcatagaaataccaggcttctatcagcgccaatggctaccaaattatcctgaaattgttgaatttaagtatgatggggaaacctacgaaattcaagacagacaacacaaaggcaaactttactttgctgatggcctaacaagattgaggacagaactgcagatttatgaatctgtgacgataaatttcctggcctgcgaccacccctcaaaatttgacctccacttcactccaccattagaccagtag

SEQ ID NO: 78306 - DNA, 626 bp, Glycine max
  Peptide Sequence Number=SeqID_195084
gcaccggaggaagacgaagaggtgcaggcccttaggacaggactcgagcaagctcaacagtcaaagaaaggttcaatcagtggctcttaggatccgaaaggagaatatcgaactgagggatgtaaatatagctaccaccaaggccttggaacaagagaccaagagggctcgtagggaggagcacggccggaacaagttccgaggggctctgtggggtagtaacaacgagcttaaactccggagggagaaaagggaccaatcgtgggtagacagtttgatcttgaagaatgagtggaaggcttgcttgaggtccaagagaagtttgtctcagcgtttatgcgagacagagaccaacatgttagccatcatcagcaagtaccaaaaggaactaagtctagccacggcccacgagcatagggtggcggacgagtatgcccaagtgtacgcagaaaaggaggctagaggaagggtgatcgactcgttacaccaagaggcaaccatgtggatggaccgatttgctcttaccttgaacgggagtcaagaacttccccgattgctagccaaggccaaagcgatggcggacacctactccgcccccgaggagatccacggacttcttggctatt

SEQ ID NO: 78307 - DNA, 423 bp, Glycine max
  Peptide Sequence Number=SeqID_195085
gaatttaaagatgtctttcccaaggagattcctcatggactgccaccttcaagaagcatagaacatcaagttgatctccttctagaagcttcattgcctaacaagccaacttacaacagcaagccccaagagactcagcacaaggatgcacaggtcaaagttgagtatgtgaaaagattgtatgaccaagtgaaggtgcaaattgcaaagaagaatgaaagttatactaagcaagccaacaagaaaaggaaggaagtggtacttgaacctggtgatgatcctggacatttgagggcaaatgttttccaagaaggacggaatgatgagaatcctgaaattggccaaatgcaggctaaaggcccaagtggagaagggcgaaggcccaagtggagaaggataaagcccccgagtggagaaggatga

SEQ ID NO: 78308 - DNA, 219 bp, Glycine max
  Peptide Sequence Number=SeqID_195086
atgacgttgccacttagcaacattctgcccagcaaccacaatgccgatctccccttacggaagtatcagttggggtcgcgcccgcaagacacccagtggacccggagaagtccaacagggccttggggtttccagctcgggttacaggcctttgtcagttctacgaagcgctcgttgcccccagcaaggtcatttggccccccattaaccgggctttga

SEQ ID NO: 78309 - DNA, 204 bp, Glycine max
  Peptide Sequence Number=SeqID_195087
atggtgattaatcaaaacttacttaaaacgaagaaaaagaataccgaaagtagacgagatgaagatgaaaacatacaaagcaagaatggacccctaagggtccatagaatgaattcaaagcttcaaaatcgaaaactaaccagtcgaaggacaatgaacgatgaagaatggacgaagaacagcgaagaacattcacggatttag

SEQ ID NO: 78310 - DNA, 381 bp, Glycine max
  Peptide Sequence Number=SeqID_195088
atgggagaaaatataaggaaacttgagtatggagttgttaatgttgttgaacctgggaacaagtacctaacacactgctcaatgaggggcttgtgcaaggaaactacaaaagaaaatcctcaacaaatatatgatggtaacaacaatgaggatcacccttccttccatgaaagtaaatttgaaactaaccaacaaacacaaaccctggctgatgaagcacctgctgataccacaaattccatgagtagttcaacttgtgaagatcctcctccaccactatcagaatggttagaggacacgtttatcgatctttacttatttggctacaagaacatacaagaacatggtttagatggtgatgaatatgtgagaatgttttga

SEQ ID NO: 78311 - DNA, 261 bp, Glycine max
  Peptide Sequence Number=SeqID_195089
atgacacaaaagacaattaatcaaacttgtaaatatagggatgttgtgattcaagatatttgcaagtgcatatatggtaatgcattaccatttaatttgttaaggagtcctctttttgtgcaaatgttgaagagtgttggagaatatggtaggggtttgaagcctcctcttatcatgagtacgttcaagggagcaaaggggctttttggattggagatggcaataactgctagagataagaagcaaccagctcttttgtag

SEQ ID NO: 78312 - DNA, 300 bp, Glycine max
  Peptide Sequence Number=SeqID_195090
atggtttcggttcggtcggaggccatggacatcatcccaagttctcgtcagcaaagccactcctctggctcgacttttcaacagggaaacattgattccttagaggagaatgatggatattgttcgaagaaagttgatggtttggacagagcaacaactttatctgatggtgagatttgtggtggttcaaattccaaggttaacaaagatgtagggaaactggacacagaggttcttgtcaaggatacaccttccactgggaatggttcttctctcaagagcaaatatgtaagggtctga

SEQ ID NO: 78313 - DNA, 495 bp, Glycine max
  Peptide Sequence Number=SeqID_195091
atggtggagttgactaccaaaactattgagcaataccatcgtagctcttttactcctcaagacgaacacgttgaatgtgaaactcagagctggtaccaagaggtgtcaaagctaaaggcaaagtatgattctcttcaaaggacccagaggcatttgcttggggaagatgttggaccattgaacataaaggagttgcagaatcttgagaaacagcttgaagggtcttcagcacaaccaaggcaaaggaagtgtttgggtggttcttgtctcggttttggagggattccaaccccggcgagaatttgggagggagttgattgtatagtggggttttttgctttaagtggtatacaggtttttggttggatgttaatgatgttggggcccacttccagcaaggcagcgagcggtaccacatatgctttgctgccaaagtatgtgctttgcggtaccacatatgttttgctgccaaagtatgtgcctgtgtcacaatag

SEQ ID NO: 78314 - DNA, 537 bp, Glycine max
  Peptide Sequence Number=SeqID_195092
atgttaatcattctcttaaccatatcatcatgtttatcatacacagtctcagcccaacaaatccgaattagagaagcaactataagtgataccaaagctgctttcaaggaaaaaatcctcacatccagggaacttgttcagttttatctggacgaaattactaggcacaacccacatctcaacggggtcatagatgtgaaacttgatgcgctgtacgacaccgagaaggctgaccacgagcacgagaggaactcgacggcggcattgcttgcgctgcacggcatccctgtcctgctcaaaggtaacatgggaacccagggcaagctgaacaccacggctggatcctacgcgttgcttgggtctgtggtgcgtggtgatgctcttgtggtgaccaatttgaaggatgctggggctattattctggggaagtccaccatgagcgagtggggttactttcgctcttcaactgcacccaatgcttggagtgctagaggcggcctaggaaggatgtatatagtgagagcctttatgatttga

SEQ ID NO: 78315 - DNA, 222 bp, Glycine max
  Peptide Sequence Number=SeqID_195093
acaccacaacagcattgggatggtcggcagcgggaaacagacgcaccgccatcacctctagagttcacctctgctcatccacaaaaaggtttgagtattgcctacacacatggccgaccagtaggcgaccaagtccaaagccaaaggatgcacctagttgctcatgatcctggggatttaaataaaacaagcgcaagctcgaaaggtagaaagataccttag

SEQ ID NO: 78316 - DNA, 126 bp, Glycine max
  Peptide Sequence Number=SeqID_195094
atgagtataaaaaaaggcctaggaggcaagatcgcaagagagttagatgacactcgagaaagcaagaggcaaactgcccaaaatccccttttggtgaaggctgaacaagaccaatataattggtaa

SEQ ID NO: 78317 - DNA, 201 bp, Glycine max
  Peptide Sequence Number=SeqID_195095
cgtcctaatcagaagtcattggttgctgctctatttcctctaccggaggattctgaggttatagtgactcaattgttacatgatgcgttcctggtgcttgcggtccttgtggacggcacgatggtcgatggtgtaaggaacgtgttagcgtacaatcgaagagagtacaaatacagaggacgaatgagtgttgtcgagaag

SEQ ID NO: 78318 - DNA, 462 bp, Glycine max
  Peptide Sequence Number=SeqID_195096
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcatccacacatcagctatgctagaaccacttgcatctgcagctactaatgtagacatgcttcgacatgcagtggacacttgccaaaagacagcagaaagtttggaatgcatgattggtatgaggatggccactgctagaactgaagcatacactctgaccgaacactatctaagattagctaggggtgtcactgagcaatga

SEQ ID NO: 78319 - DNA, 327 bp, Glycine max
  Peptide Sequence Number=SeqID_195097
atgataggcctcaccaagccaacccctggtattgcatttgttcaagcatgggtgtatgcccatagcatgagtaagttggaatttcctccaatttatatggttcttttaagcttgctgtgggaatccctaataggaagagagcacctactcttttacactagacttaaaagtcttaaaggttcagccttaacacattatttatggcacacaagtggaaggttaagtgtgtttgaaggaaaaggaacaatggagaagttgaagttgaagagaacaatggagaatggcattgataaaactgaggacaaagacaggactagtgataaatga

SEQ ID NO: 78320 - DNA, 996 bp, Glycine max
  Peptide Sequence Number=SeqID_195098
atggcagatggcggaagaccgaaattccgccatataaacacaccattgcgccttatggcaggtctttcttcacaaattgcccatgtcagttggcaaaatattcgccatgccattccaccaatgcggtgccatggccgctatgacattgaattatcaaaagaaataaacgagtccttcaagcagtcatcccaggctaggacaaaactcccatcagggattgaaatgagtgttcatgtcttgacaactgggtactggccgacatatccacccatggatgttagacttcctcatgaattgaatgtttaccaggatattttcaaagagttctatctaagcaaatatagtgggaggcgtctgatgtggcaaaattcattaggtcactgtgtcctaaaggcagagtttcctaaagggaaaaaggagttggctgtctccctatttcagtctatcttgtgttgcacacatgtttctgtgattaattctgcatgcctgattgtgctccagactgttgttcttatgttattcaatgatgctgagaaactaagctttcaagatatcaaggactctactggtatagagggcaaggaattgagaaggactctgcaatcacttgcatgtggaaaagttcgtgtcctacaaaagttgccaaagggtagagatgtggaggatgatgactcatttgtttttaatgaagggtttacagctcctctttatcgtataaaggtgaatgcaattcagttgaaggagacagtggaggagaacacaagcaccacagaaagagttttccaagaccgtcagtatcaggttgatgctgctattgtgaggataatgaagactaggaaagtgcttagtcacacgcttcttattactgaactcttccaacagctcaaatttccaataaaaccagctgacttgaagaaaaggatcgaaagcctgattgacagggagtatctggagagagacaagaacaaccctcaaatatacaattacctggcatag

SEQ ID NO: 78321 - DNA, 186 bp, Glycine max
  Peptide Sequence Number=SeqID_195099
atgacaacggttttatataaggttgagaacataggcgaaggaacatatgatgttgtttacaagggtattcgtattttggtgtggggagaagtagtttcatcattgtcagaaaatccagcagcggcggaggcgagggccatgttagagaaattcaaccgcaaattcgaggaagcgtatcggaaatag

SEQ ID NO: 78322 - DNA, 948 bp, Glycine max
  Peptide Sequence Number=SeqID_195100
atgcagcgtgttagattttcatctcagcaggcaccagtacacaagctaggagatcctcaaatgacattatctcccaagtttaggttagctgtgatccaatcttctttggcaaatccatcacctgagttagagctttctctcagagaagaacccttaattcctggccttcctgatgatgttgctctcaattgtcttctccggcttccggttcagagtcactcatcttgtagagctgtgtgcaagaggtggcatatgctacttggtaacaaagagaggtttttcaccaataggaagcaatttggtttgaaagatccttggctttttgtttttgcctaccacaagtgcactgggaagatcaagtggcaggtgcttgacctcacacacttttcttggcacactatccctgcaatgccttgtaaggacaaggtttgccctcatggttttaggtgtgtttcgatcccctgcgacggcacactgtttgtttgtggtggcatggtctctgatgtggattgccctcttgacttggtgttgaaatatgagatgcagaagaataggtggactgtaatgaataggatgatcactgccaggtcattttttgccagtggagtgattgatgggatgatatatgtagctgggggaaatagtactgatctttatgagcttgattctgctgaggtgttggatcctctcaatgggagttggcgccctattgccaacatgggaacaaatatggcatcttatgatgctgcagttctcaatgggaaacttctggtgactgaagggtggttgtggcctttttatgtctctccaagaggccaggtctatgatccaagaactaataactgggaaaatatggctgttggactcagagaagggtggacaggttcgagtgtggttgtttacgggcacttatttgttgtttctgagctcgaaagaatgaagctaaag

SEQ ID NO: 78323 - DNA, 174 bp, Glycine max
  Peptide Sequence Number=SeqID_195101
atggtcaaatctgtggtgcagaatgaaatgcagcaatccaatgaattgaaagcaagaaggatgcatgttgacaagaattttgcttcctcagtgcctagaaatcatgaagtgtcgaataagcaactcagccgaatacggctacaacaggaatgcttaacagagttcaaccgatag

SEQ ID NO: 78324 - DNA, 822 bp, Glycine max
  Peptide Sequence Number=SeqID_195102
atggaaatattttatctcctttgctctatcgtctccacttccctcacctctctttttctatcccttgttcttacctttcacgcgctactgcggcggcggaattcctcacgcgccgcttcttccttctccaatatagaagctgaacccatatctctctacgaaggcacagtgtggcaccaacgtcgccaccccgtcaaccattccttccaataccgggtccgctacgcgctcattgacctcgaccgtgcacctcgcgagcctcacgaccatctttctcccgataaagctcgccaaattaccgataccaatggacccattttgctcctgacaatccctcctagtgtgggttatgaacagaatcctttgagtgtgtattattgctatgctgttgaaggctctactaaatggttgaagaagtgcattgctgaggtgacaaatacaccatggggtgaaagagtatcttttcttttcaacccacactctgatctagtggccaaggctttgcatgtcagtccttttatggatatgcttggaagttggaatatcaaagcaaatgatcctggagagaatcttacaatatcaatttcagttcatcatcccgagcatggaaactattttgctgctagtctgaaagccagaaagctgtgctcatccccagagtcagatcatgcagttttcttttggttgatgcctcataaagttgcagtatggatatattggcaactgaaatttactgagaccagctccttacactcagaggtagccctctgtactgaacaaaaatggggattagggactaaactattgaccatgacattatag

SEQ ID NO: 78325 - DNA, 514 bp, Glycine max
  Peptide Sequence Number=SeqID_195103
taccaaggaagtgtttggaggaaagggcaaaggccttggaaaatcaaggcgaatgggctttcttttattgacatcttgacgcttttgatctttggaggtgtcctctttccgaatatggaagggttagtggacctagcagcgattgacgctttcctcgcctttcatcatggcaaggaaaccccggtcgtcgccattttggccatgtatgacacgcccgtctatccgctacaaggtcaccgctcgtgcgtcgaaaaaggaaaggcgaattgggaccaactcttggctagcatggaggggcgtctgttaattggttccctcgctagaaggaaggaagaatcaggattctatcttcatgcgaaggatgagtgccatcagacgaaagcatcacgcctttcatcgcacggggtttcagtgaccacaacgcgagggtactccaaggagttcgcaaggcatgggatgcggcgtgaagaaaggacagagagcttagggggaagcagtaatgggatcatcggcg

SEQ ID NO: 78326 - DNA, 1125 bp, Glycine max
  Peptide Sequence Number=SeqID_195104
atggcttctttctcttttcatcttgttgtgttccttttgtttgcttgtgaaatggtggggatgagaagcaatattgtacttggggaagaaatggtaatgcaagaggaggagttgttggggttgtttgaagtgatggatgctcttgtggatgaccctgactggtcccaagcacaccctcaaccatgtactgacactcaatggcctggaattgagtgtgaagttagcaatgatccaccagtttttcatgtgacaaagatccacattggtcctgatatactctccccaccttgcaagtcttctgcttacctttctgaatctttgctgaaactcacttacttgaaaacactttcaattttcaactgttttgttgcttcaccagttaacctaccctcaactctctttggtcctttctctaccttggaacacctggctttgcagtctaatccaacactctctggagaaatacctccaagtttgggtggtgttgctagtcttagagtcctgagcctgtcccagaatagattccaaggaaatattcctagacaacttggtggtttggtttctttggagcaacttgatctgagttataataacttcaatggccaaatccccaaggaaattggaggtttgaaaaatattgccattttggacctaagttggaatgaaattgaaggcaaccttcctagctctcttggacaacttcaacttcttcagaagatggatttgagctcaaacaggcttacaggaaaaatacctcctgatttaggaaagctcaagaggttagtcttgcttgatctgagtcataattttattggtgggcctattcctgaaaccttgtcaaacttagagcttttagaatattttctcattgatgacaaccccatcaaatcagagatacccctcttcatagggaagcttagcaagctgaagtcagtgagcttctcagggtgtggattgattggctccataaccaattctttctcctccttgaagaacctcacagctctctccctggataacaatagcctcagtggatcagtccctccaaatctagctttgctcccaaacttagatcaactgaacatcagccacaacaaagctgaatggtgttcttcagctccctga

SEQ ID NO: 78327 - DNA, 264 bp, Glycine max
  Peptide Sequence Number=SeqID_195105
atggaaagcagtgaaggctgcaaagaaaaaaaggcaaaggcttgctgtcgcctttgggttcccaaatttgcaattgtgagtatgacagtgttagtttgcatggaaaaggggagtgagatggggaaagacaaagcggttactataaaaggcaatgcacatttccagaagagtttaatggttaatgcagtatatgcagataaatacatagcattgataagacatgactgcaacaaaagtaaagtaaaaggagggatgatcaactga

SEQ ID NO: 78328 - DNA, 568 bp, Glycine max
  Peptide Sequence Number=SeqID_195106
gagaggcacatgtatggatacataccgtagagagcttgttcaaggtgccataaatctggacaaagtaagcctccaagagcatctcaagctccttgacatcaagttgcttggtgacgacactataggtggcgctattgtgggttccatggttgtccctactgagaatagagagttaaaagggaaggaagaggtgcctgtgagtgtgatcatgaacatgaggttgaagaaaatcatcgttgtcagcagaagagagatacatcttagccatatcttcgtcgtcatcgagcaggtgctccaattcatccttgaccttctaaacacgaccggtgatggttttagcctcattttccaagacgctacaagcagcttccagacagacctcgagggaaacaaactcgaagggaagaatcttgatggggttggggttggggttggggtcaacattagcttggttgtggtggcggatgatccttgtctggagctcatgaaggaagcgggtgatggagggttcgcgagagttgaggaggaggagctcttgggcggtgatgatggccttgatgtgctctaa

SEQ ID NO: 78329 - DNA, 192 bp, Glycine max
  Peptide Sequence Number=SeqID_195107
atgatgagtgatgcatttggcctttttatgtgtttatcacatggttatcaaggaagaagaaggttttcgggtagtgcggtgagtcgaacatcgacaagcaaggcaacatcattctccaggacgacgccgtcgaacagaggtgcctcgctcttatcctcttgtcacgtcgattgctctatcctagctacctag

SEQ ID NO: 78330 - DNA, 543 bp, Glycine max
  Peptide Sequence Number=SeqID_195108
atgtcaaagcttcaggtgaataaactgaaccaactaagagaaatttgcgcaacattctacatggattcggatggcagcctaacgattttggagctagctgcgctccttcggtcaatagggctgaatccctcgggggatgaaatccatgccttgttggccaacatggactcaaatggcaatggctttgtggagtttgatgagttggtggatgcaatattgcatgacataagtgcagagattttgttgaaacaagaaatgctatttggggtgttcaagtgttttgaccgtgatgggaatggttacataacggcagcggagttagcaggggcaatggccaaaatgggtcaacccgttacatatagagagctcacagagatgatcacagaggctgacacagatggtgatggtgtgattagtttcaatgaatttgtcactgtgatggctagccgttacggttactcttccttttcccttgtggaccgtttgaggtggatgattttcaagtttcatcagacaaaaattaacatgtttccagtctgctaa

SEQ ID NO: 78331 - DNA, 795 bp, Glycine max
  Peptide Sequence Number=SeqID_195109
atggcactgttttctctccaaaacaacctcttccctcttccaatgctaactactccttcctcaacaaagagctttccctctgttactacgtgtcgagccacaatctttggttccagcctcgttcttctctattcaacaccactcacacttgcacagcagctgccaaattatgatgagcttcagcaacaagaagaccaccttgtgcaactctttcagggagtcatgttaaatgaggatgaagatgccaaagtggaaggcactggttcgggcttcatttgggataaatttgatcacatagttaccaattaccatgttgttgctaaactggcaactgatacacgtggtttacaacgttgtaaggtgttcctagttgatgccaaagggaatagctttgacagggaagggacgataattgggtttgatccagcgtatgatctagctgttctgaaggttgatgttgatggatatgaagtaaaacccgttgttcttggtcagtctaacaatttacgtgttggccagagttgctttgccattgggaatccttatggatacgagaacactctcacaacaggggtggtcagtggtttaggccgcgagataccttcaccaaatggaggggccattagaggagctattcaaactgatgcagcaattaatgcagtaaacacagctaccttcactaagaaaggtactggaatatcatcaggtgttaactttgcaattcccatcgacacagttgtcagaactgtaccatacctcattgtccacggaacaccttatagtaataggttttga

SEQ ID NO: 78332 - DNA, 663 bp, Glycine max
  Peptide Sequence Number=SeqID_195110
atggaaagtccccactctcagaacagtccaagaagaaccctcagtctgtcgaaaaagcggagggcaactgcgtcctgttttgaccctgatgagataagctctggcttcggattgtctggtgatcatggccctaagccttctgaagtttatggttttgtaggttctattactactgttgttgctacagttattttcttggtatgggcatatgttccagaatcatggctacaatctgttggcatctcttactatcctagcagtaattatttgagtgcacttaacaagttgaggaaactcttgaagtctgaactgttaagtgaagtagggcttttggggaagggattgagcgtagtaggctcaacttcttccttcagagaccttaataacgaaaaatatatgaaaaaggaatttgaagccggatattgggctctagcagtaccaacttatgtaatggtgaccattgtattgatgctgggattctacattggccttaatttcatttcaacaccttcccctgcatctttaaacacagtttttgatgaattcagtagggatcctttgagtctcgagtgtaccctagaagatgagaaacccatcgagcccatttcagatattggtattgacagaatcaatgatattatgttcaaaaataatgcagcctaa

SEQ ID NO: 78333 - DNA, 256 bp, Glycine max
  Peptide Sequence Number=SeqID_195111
atggggtcgtttttgaagtatttccgcgagggggctcttttggacgtaaaacgcatgcatggcccaagcaaaccgctagtgggactggcgggttcgctgttgatgaaggacttgccactgcgaatggcgatatgcacatgcaagctgaagaactcggcacttggaatggcgacatgcacacagcaaggggaaccgccagtttgactggcgagttcccaccacgtaggctcagggctataggcgtcaggccatgcag

SEQ ID NO: 78334 - DNA, 447 bp, Glycine max
  Peptide Sequence Number=SeqID_195112
atggcctccaggaaatgtaagagcattggggcaaggccaactgctcaatatgatactagacggttccattcgcttgatgcttggaaccgttatacagataatgtcttggggaagaatattttgccagaaagaaaggttgaggtataccacacggagtttgacaacttcaagacaaagttggagaggcgtaatcttcacaaacgcctcaccaacttggctgatgggactattgatcttgctttggtgaaggaattttatgctaatctctatagctctgaggtcctagaggagggggagtcattacccacctactctaggtactgcaggttgcccacaaactacagagagattgaggctgctctttgcataccagggagggggttcatcttgaacgctgagggccatcctgggaggattctcaagaaagatttgactacattagcccag

SEQ ID NO: 78335 - DNA, 543 bp, Glycine max
  Peptide Sequence Number=SeqID_195113
ggttcaaaaattggagctactctctggcaagaactcttcactgaattgcgagacaagttacagtgtggttcttcgtatttggttcagaacctgaggattattgacaaccaatctgaatacagagtcagcccagctccatatttagtttatttcctaaaaactacatctgtcaaggaaattcaccgtccaaaaattccttctaatgtttatctcataactccttttactgatataatctctggcctcgcaccacgccatactttagtggtaactatttgggaggactatgctattcagctacatgatgctattgacaaaaaccttctgcttcaggaaccattggttgttatgttgaccttaggtaaaatcaaggatgctacagacaagtatcccctaagcgtgcataatatcaaatttggatctaaattgtatgtcaacgctgatattacagagatacacgaatttcgtcaaagtttgtctgtgccattttattctggtgggatgatcaatgataaagatggttctcagtcccaatctagctag

SEQ ID NO: 78336 - DNA, 225 bp, Glycine max
  Peptide Sequence Number=SeqID_195114
atgggtgcaaaggattcatcattcttgaacaggtgccgtctccctcctcaggtgcctgagatggtgtggcagcaggggcataagccatggtggaggctctacagcattggcactatctggtctgagctctgcatggaagtgtcgaagggtgctggagtaggtgttggtggtggtggagcgggagcagagagagcagaagaagaagtatcaggtcctcaatcctga

SEQ ID NO: 78337 - DNA, 723 bp, Glycine max
  Peptide Sequence Number=SeqID_195115
atgtttacctttacatctcccggtatcaaatttgacaaatcctataacgctggaaaagaacctccaactttccgtatacatggacaaacacatcatcttattggaagcctcctccctatgcctaataacccacctaagtttgcacaactatatatttatgatacagacaatgagatcatcaacagactttcacagaacccgttaattatcattgcaatcaaagacatgcttgatcatcacaatcactatgctcaaaggtttcgaatggcaagggacaaattgcattctgctgcagttccagacctgaagatgaaactcattagtcaaagacaaacagacagaaggttgtataacttaccaactaccactgaagttgctgccttgattgttggtgatgaacactcagctgataaaagagatattataatagaaaaacaatccggacttctgaagagaatacatgaacttcatcatgcatatttgcctttgcaatatccacttttatacccaaaaggagaagatggttacagactaaatatacctcacaaagatcatgccaatatacatgctgcaaagaggaaacaagtcacattgcgtgaatatttttcttaccgcctacagtcaagaactgatgaagcacagactatacttcattccagaagattatttcagcaatggattgttgatggatattgtatggttgagtctcaaaaactaaactat

SEQ ID NO: 78338 - DNA, 582 bp, Glycine max
  Peptide Sequence Number=SeqID_195116
cacatgcttgcccgcagccagtgccgcgattgccagcggcgcatgctgttcattcggcgtggcgatcactacggcatccacggctggatcgtcgaacacctcctgcggcgtggaacgcacgtgcacgtcgctgaacgcgcgcagcagcgtgtcgcgctgcgagctcacgatgctgtgcagcaccaggcccggcgtgtgctggatcaggggcgcatggaagacgcggccggcaaggccgtagccgatcagggccagatgcagcgccacgcgtgctctacgcctacttgtccagactggcagcacattccgcaggagtacgacacgatgagcaatacgacccgcacgctgattgcctcggcccttacgctggccctggcgctgtcctcctcggccgcattcgccaaggatccggccgcgaagagtccccccaagaccgatcattcggcaatgacccacgccgaccgccatgatttaaacgagccggtgaccgacagctggatcaccaccaaggtgaaggctgatctgctggccagcagaaaagttccgggcacggagatcaaggtggaaacggtgaacggcgtg

SEQ ID NO: 78339 - DNA, 291 bp, Glycine max
  Peptide Sequence Number=SeqID_195117
atggttaaaacagaaggcttagatccatcaatatacaagcaaaactcaggcagtattacaagttttgatgctgaaattaagaatttgtctcctgattctccatcatctctggagattgatggaaaagctttggaagacttgagagcttctctctttaatcaatttcgttcctctgaaggtgcaaagtgtcaacaacagtgcatatatggtccaggcattgcactttcattcaattttctggttgcagttggtactattttcatgaacaaaatggtgcttcaaactgtttag

SEQ ID NO: 78340 - DNA, 243 bp, Glycine max
  Peptide Sequence Number=SeqID_195118
atggaagaagtcaacatggaaaacctatcatttgaggctaaggaagatctggttatgacaatgaggaagattgaggatgtgcaaaatctatccctttgtctagtagggcgtttcctcacagagagagccatttatgtccccatcatgaaggaacgaatggcagaagtttggcaacctcttcgtggagtctctattagagatatgggagtcatcacctttctcttccaattttcccacctatag

SEQ ID NO: 78341 - DNA, 960 bp, Glycine max
  Peptide Sequence Number=SeqID_195119
atgggatcgaatcaagcacccttgtttaagaaaaggttctatcaagtcaaaattaaaagcctagaggttgccagtttgcaagaattggggcaattgatggatcagctccaacgtcaagcttttcgcaagacctatggaaagatttgggatctagctatgatagaagtctctattgaagccattgcagccctcactcaagatcttgggattcctgctagggggaagaaggccacatctttttccgagttctatccctccatggcgagaatagccaaggcgaaggcattggtggatcaaggtgaatgggcttcgttcattgatgtcttggcgctattgatatttggggtcgtcctttttccgaatatggatgggctagtggacctagcggcgattgatgccttccttgcttatcaccatggtaaggaagtccggtcgttgctattttggtcgatgcctatgacactttcaaccgaagatgcgaaaggagtggtcactgcttgtgcgccaagaaaaggaaggcaaactgtgagcaactcttggctaggattctcaaacgtccccttgatgggaacgaggggttgtatcaattataatcccatccttgccataagacaacttgtctaccccatgagaggagcgtcgtcggaagaaagtatcatgcctttcatcacacagggtttcagtgaccccaatgcgaggatacttcgaggaatccgcaaagcgtggagcgcggtgcaaaagaaagacaaggagcttagagaaagccgcaatgggatcatcgacggctatcataagtggctaaaggctcggacgctagagttggattggctcccaaagctaaaggtttcaagcgaggtagaggctgaaacccccgaggacagtgaggaggtgcaagccttaaaggtggaacttgaaagagcacaagcggtcaaggaaaagttcaagacgacggccatcaag

SEQ ID NO: 78342 - DNA, 333 bp, Glycine max
  Peptide Sequence Number=SeqID_195120
atggaggccatgaaagaccaaatggcccccatgatggaggccatgttgagcatgaagaagataatggaggtcaatgcggctgcagatgccactaccggcgttgccactgaggtagacccgactcacccatcaagcctcaatcaaaacaagcattccttcccaccatatggcttgccacccaactatacacccccaatgttgcacacattcctgatgagaatgtcaataactccaatctcatactcattgagagccaacaaccccaatttggtccggcataggtccctcaacccatggggaaggcacatgagtcaccctaagaccacaatctag

SEQ ID NO: 78343 - DNA, 243 bp, Glycine max
  Peptide Sequence Number=SeqID_195121
atgggggatgcaaatagcaaatttgaaattttgaattgggccttccagactgtttttcaaagatggattgcttctggaggaagcaacccagttcgcctaggcgagctgggcggcaacctcctccccctttttcctataaaaaggcaaaatggggttgttctaagggtccctgattcccctggctatgcatttcagctgttttgggtgaaaaaaattgtttttgagaagaaaattcaagctgag

SEQ ID NO: 78344 - DNA, 675 bp, Glycine max
  Peptide Sequence Number=SeqID_195122
gtctgagttcctcattgaaggatacgtcggagcaagagccttgcttttgtcgaccacaccaccttttgctgtcatgacccaagagctgacaaaatttggtcattctgcacccttgtgtcatccagaggcggcgggcccgatgacacgcagagacaaaatttggtcattctgcacccttgtgtcatccagaggcggcgggcccgatgacacgcggagataccttacggcggcgagcccgatgacacgcagagataccttatggttatccgcacccttttgtcatccagaggcggtgggcccgatgaaacgcagagacaaaatttggtcattctgcacccttgtgtcatccagaggcggcgggcccgatgacacgcggagataccttacggttatccacacccttttgtcatccagaggcggagggcccgatgacacgcggagacaaaatttggtcattccacacccctttgccattcagacacagtcgtgtccgatggcgcgcagagacaaaaattggtcattctgcacccttgtgtcatccaaaggcggcgggccagatgacacgcggagataccttacggttatccgcacccttttgtcatccagaggcggcgggcccgatgacacgcagagacaaaatttggtcattctgcacccttgtgtcatccagaggcg

SEQ ID NO: 78345 - DNA, 1091 bp, Glycine max
  Peptide Sequence Number=SeqID_195123
agctagctgttggaaatattgtgaggcgtgttttgcacattataagggaagaggatctttcccttgcaacagctgctatggatggtttgggggtatcagctgcaagtgacgatgaagatgatgcggagcgagatgaaaatcctgttttatctgcggctgctgttgcagctgctgccagaagcacattgcgtccaccgtcattgcaaactcttctagaggatacatctgattcagctgctgctccccccacatcttcctcagggggtgaatctgacgggagaagtagatctgtggaaaaaggttcaagagggaggaaattgaagcatgatgtcatcgaagcagtcaatgaacttattcaagacatatctacttgctatgaacaaatagctgagcaggcagtggagcacattcatcacaatgaggtaatattaacattaggcagctcaaaaacagtgttggaatttctttatgctgcgaaggaaaaacagagatcatttaaggtctttgttgctgaaggggcccctagatatcagggacatctccttgcaaaagaattggctgctagaggcttacagaccacagtaattactgattcagctgtttttgcaatgatttctcgagtgaacatggttatagttggagctcatgctgtcatggctaatggtggagttattgcaccagtggggttaaatatggctgcacttgcagctcaaaggcatgctgttccatttgttgtacttgctgggagtcacaagcttaattgtactcctattgtctgctgtctatctatttctattgaatgtaatttgtgccctttgtatccacacaatcctgaagtcctactgaatgagctgagatccccatctgagctacttgactttggggaattctcagattgcatggattctgcaagcggtgccggttctcttcatgttgttaatccaacatttgattacgtgccaccaaaacttgttagtctctttattactgacacaggagggcataatccttcctatatgtaccggctcatagctgattactactcagctgatgatttggtggtgaaacgaagacccactacagggagttga

SEQ ID NO: 78346 - DNA, 246 bp, Glycine max
  Peptide Sequence Number=SeqID_195124
atgtccattggatttaatgatgagatatgtgcaatttcaggtgaaaataagttgagcttagctcatcagtgggctaagcgtgcatccaccgctaagcgcagcttcaacacgcttagcgcgatagaagaatctgacaggacatcatcatcaaggtcgcgtgctaagcgcaagattagtgcgctaagcgtagcagttgtcttcagccaggctcagtgcacgactagggctaagctcaaatccacttag

SEQ ID NO: 78347 - DNA, 981 bp, Glycine max
  Peptide Sequence Number=SeqID_195125
atggaggaagacaagatgtctagaaaggctgaaagctctgtgctatacttttacatcagtgaggttgttggccaggttttgtttggaatactattgcttgtgtatgttcctactttggatccttatccaggttatacccccattgggactgagatgattactgatgctacatatgatgaactccctggaggagatatgatatgtcccgagaggagtgccaacatattgtcaagaataatgttttcttggatgaatcccatcatgaaactaggatatgagagaccactaactgagaaagatatatggaaattagatacatgggaacggacagagacactgatcaataagttccagaaatgttgggttgaggagtctcggaagtcaaaaccttggcttttaagagcattaaatgcaagtcttggaggaaggttttggtggggaggcttttgcaagattggcaatgatatttcccaatttatgggcccacttatattgaatcagctgctacagtctatgcaaaatggtgaaccatcctggactggctatgtttatgccttctcaatatttgttggagtggtctttggggtgttatgtgaagctcaatattttcagaatgtcatgcgtgttggttaccggttaagatcaacattggttgtcaaagagctacttgactcgatcatacttaaccaccttgtgtcagcaggagtggcagtgcaagtggctgctgtatttcgcaagtccctaaggcttactcatgaagcacgaaagcaatttgcaactggaaaaataaccaacttaatgactactgatgctgaggcacttcagcaaatatgccagtcacttcacactctctggtcagctccagtacgaattgttgttgctatggttcttctttaccaacaacttggtgttgcttcccttcttggtgctttgatgctagttcttatgttcccattacagatatgctctcaggaagggtaa

SEQ ID NO: 78348 - DNA, 3044 bp, Glycine max
  Peptide Sequence Number=SeqID_195126
gtggttaatgcaaacgtatcgttgaagcgactagaagatttactcttagcagaagagagagtacttctaccaaatccacctattgagccaggattaccagccatctcgatcaagaatggatacttttcttgggatgcgaaggcagagagggcctcattgtcaaacataaatctggatatacctgttggttgcctagttgcagttgttggcagtacaggagaagggaagacatcactagtatctgcaatgcttggagaacttccaccaatggcagattcatctgttgttttgagaggaacagttgcttatgtaccccaagtttcctggatttttaatgcaactgtacgggataacattttgtttggttctgtctttgacccagcaagatatcaaagggcaataaatgtgactgaactgcagcatgaccttgagttactgccgggtggtgatcttactgaaattggtgaaagaggggtaaacatcagcggtggccaaaagcagagagtatccatggctagagctgtctactccaattctgatgtgtacatctttgatgatcccctaagtgctctggatgcgcatgtggctagacagtgttctaactcaaaagtaatttgctatggcattgtttttggtcatctgagggcgagccctggtgcagcggctgcgtacaacatccctccctcataccttcgcatagcgaagagcctccgggcaatggggtacgaagttaatagaatcattttggtccatgaaggtatggtgaaggaggagggaacttttgaggaactctctaaccatggaccgctgtttcaaaagcttatggaaaatgcgggaaagatggaggagtatgaagaagaagaaaaggtagatactgaaaccacagatcagaagccctcttcgaaaccagtggccaatggagcaattaatgatcatgcaaagagtggaagtaaaccaaaagaaggaaaatctgtccttattaaacaagaagaacgagcaacaggggttgtcagcttgaatgttctaacgaggtacaaaagtgcattaggagggttttgggtggttttcgtactctttgcatgctatgtctcaacagaaacgttacgaatatcaagtagcacatggttaagccattggactgatcagagtgctacggagggttacaaccctgtcttctataatatgatatatgcagctctatcatttggacaggttttggtgactttaacaaattcttattggttaatcatatcaagtctttatgctgctagaaggttgcacgaagccatgcttagctccatattacgagctcccatggtgtttttccaaacaaatccactcggaagagttatcaacaggtttgcgaaggatctaggtgacattgatcgtaatgttgctccatttgtgaatatgtttctaggtcaagtgtcccagcttctttcaaccttcatcctcataggcattgtcagcacaatgtccttgtgggcgatactgccattgttggtgttgttttacgtagcatatctatactatcagagcaccgctcgtgaagtgaaacgcttagactcaattagcagatctcctgtttacgcacagtttggagaagcactgaatggcttatcaacgattcgtgcttacaaagcgtatgatcgaatggcagatataaatgggaaatccatggacaacaacatccgattcacgctggtgaacatgagtggaaaccgatggctcgcaatccgattggaaacattgggaggccttatgatatggttgactgcaacttttgctgtcatgcagaacgggagagcggagaaccagcaagaattcgcatccaccatggggttactacttagctatgctctgaacattactagtttgcttactggtgtgctgaggcttgcaagtttggctgagaatagtttaaatgcagttgaacggattggcacttacatagatttgccctcggaggctccctctgtcatcgataataatcgccctcctcctggctggccttctttaggctcaattagatttgaagatgttgttcttcgctacagacctgagcttcctcctgtgttgcatggcttgtctttcaccattttcccgagtgataaggttggcattgttggaaggactggtgcaggaaaatccagcatgcttaatgctttgtttcgaattgtagaattggaacaaggaagaatattaattgatgattatgatgttgcaaagtttgggcttgctgatttgcgtaaagttcttggcattataccacaatctcctgttctcttttcaggaactgtgagatttaatctcgatccattcaatgaacacaatgatgctgacctctgggaggctctggagagggcacatttgaaggatgtgatacggaggaattctttggggctggatgctgaggcaggcgagaacttcagtgttgggcaaaggcaactgttgagtctttcccgggctttattgcgtagatcgaaaatattagtacttgacgaagcaaccgcagcagtagatgttagaacagatgcactcatacaaaaaacaattcgagaagaattcaaatcctgtacaatgctcattattgctcatcgcctaaacaccattattgattgtgatcgaattcttttgcttgatggtggtaaggttcttgaatacgatacccctgaggagctgctgtcaaatgaaggtagtgctttctctaagatggtccaaagcacaggagctgcaaattcccagtatttacgcagcttagcacttggtggggataagtcagaaagagaagagaacaaacatctagatgcccggagaaaatggctggcttcttctcgatgggctgctgcagcccaatttgctctcgctgttagtctcacctcatcccataatgaccttcaacgattggaagtggaagacgagaatagtattctgaagaagacaaaggatgctctgataactttgcagggggttctggaaaggaagcacgataaagaaattgaggaatctttagagcagcgccaaatatccccagacggatggtg

SEQ ID NO: 78349 - DNA, 322 bp, Glycine max
  Peptide Sequence Number=SeqID_195127
atgcaagggtacgtcgctcgcacaatgacattgctaggaggatcatcttctttactaggcattggcatgtggggcttgctgttggcggcgtttccgttggcactgcaaaatccatggaaggcagagtcggcatggtttgcacagtttgcaaagtcgtggtaccgcacaaggctagcaagcggatccgggtactctcaaaatcaatcccaagagattgagctggatgtacataaggagaagatgtgtgctgaaacggaagggatggatccgatagaggtagttgctgatggatggctgtgtggagagaatgcaatgggaagag

SEQ ID NO: 78350 - DNA, 270 bp, Glycine max
  Peptide Sequence Number=SeqID_195128
atggcgcttagagcaagggttgcgcttagcgaatggacaattgaaaaattttctaagtcttttatgtccatctcttcacctaggcttagaaaccccttgttcactactaaacaagttgaaaaattaatcacaatcacaagcaactatcctaactacatgcaagcgatacttaatgaaaaagagaaaagggaaagaaaagttgggttacctcccaataagcgctcttttaatgtcactagcttgatgcatcatcctgttattctagcttga

SEQ ID NO: 78351 - DNA, 1569 bp, Glycine max
  Peptide Sequence Number=SeqID_195129
atggggttctccatagctgttgataaattagaagaagaagcacaacaacaacaacaagagcaagagacaaagtctttaggttcctctttgaatatcgtcatggcttcttcaagtgttaagagcaataccaactcaacaactcaacttgaaccattcctcccacctttacatcttcatcatcaacaacaaccaccacaacatcattttcatcatcatcaaataccagaccaacaaatctcttttgggatgatgccatcttcctcattagcttctatcccaggaaatttcttaagcaaagattctggagcttatgatttgggggaattggatcaagccttttttttgtatcttgaaggtcaggctgacccttctagtgttcaagaccaaaaacagaactcatcatcaggaatgaggccaccaccaactctcaacattttcccatctcaacctatgcacgcagtgccaccatccaattccaaggttaacatgggattaccctccacacaaaccagcactggctcaaagagacaaccagagtcatccatggccaagcccaatccacacactgaagccccttctgcacctgagccacccaaagctgtaaagcgagagggcaatcgcaagggaacaacatcaagctctgagcaggaagcacccaaaacaccagatcctaagttgaataatgtgttggtttcaaaatggtgtgcaaagacactaagaagacttgctcagaatagagaagcagcaaggaaaagcaggctcaggaaaaaggcgtacgttcagcaactagagtcaagtaggattaagcttaatcagatagaacaagagttacaacgttctagagctcaaggcatattaatgggcggaaatacacttctgggtggggagcaaggctttcctatggccatgagtggaattagctcagaggctgcaatgttcgacgtggaatatgcgagatggttagaggagcaccaccgcatagtgtgcgagctaagagctgcactccaagaacaccttcatgagaacgagcttcgtttatatgtggacaattgcctggctcactatgaccaagtaatgagccttaagagcatggtggccaaaatcgacgtattccaccttgtttttggcatgtggaagaccccagctgaacgttgcttcatgtggattggtggcttcaggccatctgaactcatcaagcctcttacggagcaacaaatacttgggatatgtgggttgcaacaatctacacaagaggcagaagaggctctttcccaagggcttgatgctcttaaccaatctctctcagagactataacatcggactctttgtggtgtcctccaaatatgaataactacatgggacaaatggttgtggcaatgaacaaactctccactcttgaaagctttgtgagacaggctgataacctcaggcaccagacaattcaccgtctgcaccaacttctaacaacacgccaagctgcaaggtgcttggtggccatttctgagtacttccatcgtctcagagccctaagttctttgtggtcgactcatcctcgccaagatcagtag

SEQ ID NO: 78352 - DNA, 228 bp, Glycine max
  Peptide Sequence Number=SeqID_195130
atgttgctgaagaagggatcgctcaacgaggaggattggctaagcaaggctcaaccgcttagtgaggaagtcagctcgctaagcgagtacaaaaccctagagaatgttgagccaaagagcagcaaacttagcgcgcagccagcccgcctagcgaggacgttgtctcttctcacgcttagcgcatatttatggcttgattacccatttatatgctttgttaggttttga

SEQ ID NO: 78353 - DNA, 180 bp, Glycine max
  Peptide Sequence Number=SeqID_195131
atggatattcctcagcacccgacgacggcagtagctatggacgaagcacctgcagatgcacctactcatgtagagcagcctcaacatgtagtgaagacttgcgaagcaatagttgaaaggttggaacagttgttcaacctaaggatagtgataaaaggactgtcatggaagactgcctaa

SEQ ID NO: 78354 - DNA, 618 bp, Glycine max
  Peptide Sequence Number=SeqID_195132
atgacaggggaagtgaagaaggtgctgagtggggaaacggggttagaggtggatgaacagagactgttgtacagaggcaaagagcgagaaaatggagagtacttggacgtgtgcggagtgaaagacagatcaaaagtggtgctaatccaagacccttccagcattgagcgacgcttcatccagatgcgtatcaacgctaagatccaaaccgcacatcgggcaatcaacaatgtcgctgtccaacttgatcagctcgcagaccaggattcaagaatggataggaataaggacctatgttttgcttttgattacgagtattcaaggatagaagtctctgccattgaaaagtctatttccaacggagtcaaagtaccagaagttcaaatcacaacactaattgagatgcttatgagacaagcaatcaaattagaaagcatttctgcagaaggcgatgcttccgcacagaaaaatttgcagggaaagagagtacaaaaatgtgttgaaaaactggatcaacttaaggtatctaatgcaagaataaagcctgttgttgttacaaccaagtgggagacctttgatcatcctccatcctcaaccacgtgggaattattcgattga

SEQ ID NO: 78355 - DNA, 2958 bp, Glycine max
  Peptide Sequence Number=SeqID_195133
atgggggatctagagagaatggccagagaacttatatgtcccatctgttggagtttgctcgattctgcagtgtcgcttacctgcaatcatcttttctgcaactcgtgcgttttcaagtccatgaaatcagcctctgcttgtcctgtctgtaaaattcctttcactcgtcgagaggttcgccctgctcctcacatggacaacttggtcagcatatataaaaacatggaagctgcttcaggagttaatatatttgaaacccagaatgcacctgttactaacttatctgatggagaaaagcaatgtgaagttgatgctaactctggcaagatggaagctggtggaactcatacaggtcgtccgcgggagaagaaaacccggaagaagaaggagtctaagaagacggttcaggccagcatggaaagctcaggttctgactttgcaaagccttcttttccagcaaagaaaagggtacaggtgccgcaaaatctcctttcagaaactccaatgaagagtttgaagattggagtttcacttagtgaaattaacaaagagaaagagggaacagaaaaggtcccagtcatggaaagtgaaaggcccctccaaagggaaaaagataatcctgttctctcacctttcttttggttgagagaggaaaaagacggtgaaaggttaagtcaacaaactgatgatgatgaaattattgatggctcaacaccaaatcctccttcattcagtgatctcaaggactccgatgatgaaatcccttctaatgtggcccctatggatgaggtgcaaaataaaggctctgttaatttatttgacagtgaaatgtttgaatggacacaaaggccttgcactcctgaattattttcaagtccctccaaaatgcaggtcatggatacttatgaggatgatgaaaatcaagaggaattggtggcttcctcactagagctggcggaaaatcagccaagagttgatgctggcaacatgaaatttgataatcccaaagaaggaaatataatggctgatgtattaccaccgagtgtgtctcctcaaattagaagttctgatgatctaaatggaatgaagaagtctacgaaaagaagaaggaagggtagagataaaaataaacaagagcatattggggaaccaaaaaattcaattgatgaaatgcatgttgattcatatatatcattagaggttactcaggaacaagcattggacaaatcttctaatccgaggaaggatagtagaagagacaagagggtttgtttcaataccagtacaattccaacgcctataactgcttgtacagtccccaatacattaggagttcaaagcattggtgaaatgaagaaggctaagaatacagatatttcgccattgaaacaagaaaatgagaagcatcatgctcaggagatttctggaaaaagccggatgaaaagatctggaaaacaaaatgtcagtcaaaccaatgagtttgctggttctgattcatccattttcagtctgcaaacagataataacgggaaggactctaatagcaggcaatgcaaaagcaagtattccagaaaatctatgtcttgcagtaaagaattgaaagctactaaaaggcaaaagctttcctctgattgtatctctaagactaaaaatgttgaagaaattctacctattgaaagtattcatcaaggtcctgatgtcagggatttgaatgatacatcaaaagagaaacattgtcctttgatggatcaaacagctttaaggaaatgtgagagccatgtcacaaagtatcaatgcattttctgtctctcatcagaagaatcagagacttctggccctatggtgcattaccttgatggcaggcctgtaacagcagattatgaagggggatctaaagtcacgcattgtcacaggaactgcacagaatgggcccccaatgtatattttgacggtgataatgcaataaatcttgaagctgaaataagtagaagtcgaagaatcaaatgtagtttttgtggactaaaaggggccgcacttggttgttatgagaaaagctgtcgcaggagctttcatgttccgtgtgccaactggacttctcaatgtcgatgggatacgcaaaactttgtcatgttatgccctctgcatgcttcctccatgttgccctgtgaaggttcaggatcccaaaaaaggagcaagaaatgcgcagctagcgagggtaaaaaccatggtcttaaacatgacactacaaaccaaagtcgggctgctcatagatcatacaagaaaattgtactatgttgttctgctctatccgtacaggagagggaagttgtttccgaatttgaacgagtatcgaaagctgcagttttgaaaaattgggactcgagtgtcacccatgttatagcatcaacggatgaaaatggggcatgcagaaggaccctcaaagtattgttgggtatcctggagggaaagtggattctcaatattgagtggattaaagcttgcatgaaagaaatgggtcctgttgatgaggagcgatatgaaattaatgtcgacatccatggaattagagatggtcctcgtcttggacgactaagagtattgaacaagcaaccaaagcttttttatggctacaagttttatgttatgggagattttataccttcgtacaaggggtatctgcaagaccttttggttgctgctggagggataattctgcacagaaaaccagtgtctggtgaccaagaatcaacatcaccagatacgcatccataccaaacccttataatttacagcctcgagcttcctgataaatgcaagcctttgaaaaaggatacaatttgcagccaaaggcgtcatgatgcggaggttctggcaagttctacaggttcaaaggtagcaagtaatacatggattctgaattcaattgcagcctgcaaactgaaatgccttgctcaatga

SEQ ID NO: 78356 - DNA, 1170 bp, Glycine max
  Peptide Sequence Number=SeqID_195134
atggcattctgtccagacgagttactgttatttaagatatgttcttatttaccagcaaaagcaatttataggtttaaatgtacatgcaaaacagtgtccaatattgttgaggaaaccgaatttgcaactaagcagacagagaactcattgaaaaaggatgacacatgcttcttccttcggcatgagacacctcaaacatatgatgaaaaagtggagttgtaccctttacctggaaagcaattgtcttctggcgtgtctgaggatgttttgagattcttgtcaaagtcgtcaacaagaatgttggcttccactaagggattgattcttctttgtcttacaacaagcaacacatacacaccagcagttgaactcttcatttgtaacccagcaacaaagtcttggtcgaacattccttcccccattcaagttcaagaaaaacagttatatgctgatcctaaaatggtgttgctagaagaatgttccaccggttacatgataattcattttgaagtccaaactgattggtctgcagattatccctgcaacatatacaagtccaaggaaggtttgtggaaagcaatgaaaagaagcttctatgcaggtggtaggaacatgaagtttgaaatgccagtctatttgaatggggcaatccatttcatttcagattgctttccttatctgactgaaaggagcccattttataggccttatataatgtcctacaaccttgagagttgcctttcaacaatgctgagggtgccagaagatgctacacatgatttgagttgtgattgtgagatgagcatttttagttggggaaaggctcagtccatgagcatctgtttggtgaggctaagaaagtctgttgttaccgtttggatcttgacagattatgaatcacacacgtggttcagaattctcgaggtagcaacacaagagatgggtttgagggaggaagatcctaaaataaccgggttcacggttatcaatggcgatctcctgattttggcaactgaaacaagagtctacagttatggtttgactgatgatggaaactgtatgagggttgaggaaatatgccaacacagattcgcatccaaagtttgctttacttcctactcagatattcttcgtctctgtggaccaggggctacatgtttgccttgttaa

SEQ ID NO: 78357 - DNA, 1563 bp, Glycine max
  Peptide Sequence Number=SeqID_195135
atgggcaagcacctcatcttcacaatcgtgtccctctctgcgcccatgtcctatgcttacaacgtgttcacgtgggtactgtcctatgcttacaacgtgtttaccatgattcataaccccaacgtgttcacgtggaacaccatgaccaggggctatgctgaaagcgataacccgagccctgcacttcgtttctatcgccaaatgatagtgtctcgtattgaacctgacactcacacttatccttttcttttgaaggccatttccaagtctttgaatgttagagaaggggaggcaatacattcggttaccataagaaatgggtttgagtcgttggtgtttgttcagaacagtttgcttcatatatatgctgcttgtggagacacggaaagtgcacacaatgtgtttgagttaatgagggacagagatctcggcgtggagcctgatgggttcactgtggttagcttgctatctgctagtgctgagcttggagctctggagttaggacgtagggtccatgttgaaaggaatgcggtgtcttggacgtcgttgattgttggcttggctgttaatgggtttggtgaggaagcacttgagcttttcagagagatggagggacaaggactggtgcctagtgagatcacttttgttggtgtgttatatgcttgcagccattgtgggatgttggatgaggggtttgattactttagaagaatgaaagaggaatttggaatcatgcctaggatagagcactatggttgcatggtggatctattgagtagggcgggtttagtgaaacaagcatatgagtatattcagaatatgccagtgcagccaaatgcagttacttggaggaccttgttaggggcatgtacaatacatgggcatttgggtttgggagagacagcaagatcccacctattgaagttagagcctaaacatagtggggattatgtgcttctttcaaatctttatacctctgaatgtcgttgggcagatgtacaattaataaggaggtcaatgctaaaggatggtgttaagaaaacctctggctatagtctagttgagttgggtaaccgtgtttatgaatttacaatgggtaatagatctcatcctcaaagtcaggatgtatatgcactactagagaagatcacagaactgttgaagttagaaggttatgtgcctcatactgctaatgtgcttgcagacatagaggaagaggagaaggaacaagctttgtcttatcataattgtcatatggctatcaaactcatggcaaaggtttacgatagagagattgttatcagggatcgtggtaggtttcatcattttagaggaggttcatgttcctgtaaggattactggccatatggcaatcatcaggatttgaaatggcatcttgagagtcaattgttactagatcctattagaaaagaattgaataatgatcctagtaacaatagatggcctgatgttgaagtgcaagcactcatcactgagaacttcattggaacacaagtttcgtctaatggaatcaaaagggtcaatatgggaggagatatctga

SEQ ID NO: 78358 - DNA, 891 bp, Glycine max
  Peptide Sequence Number=SeqID_195136
atggatcatgctcgagcatattcatctccccattttctttcttcttcaactagtaacttcaatggacagccagaagaagaatgcagtttggaaggccttgccaccaatgttaagctattactgaagctaattcaagatcataatgggtctagcacaaaagaaaatgatgagcgcaagtttcatagggtgaatggaatgatgtttatcctagatgaggctaggtccaggattcaaaagattcaatctacaagccagagaagagctgaacttaggaggtgcaacactgaccttaggcctaagattccatctcccaaggacagaaagcctccttctgatgtgcctatagatgagaaagagaggctaaagagggagcttaacgcgagcttggtggcacgacaaagccttcaagcaatgtgttcaagtttgggaaaagagaaacaaattatggccgcggaacttgcgaggaaggctcaagagttgacagaactggaggacttcattggtgatctaaaggcgcagaatgacatgttgatggagaagttgcatgcatggagctccgaacagaaggagaagaagggtagtggagtggagatggaatgcaacatagtgctacgagagcgtaacaaggcgctttcggagcaactccagaagtcgattgatggttatcggtctttgaagagaaggctcagagacattcaagaggagaacaggcaaattcgcgatacggtggagcaaatggaggaggaagttgatgcaggaattcacaggataggtagcttcaaggaagggaggatgagaacaaatgagatcaaagaagaaatttcagctatggagcatatgcttgattctctcaagatgaaaatctctaaatatacacagaagaaaacttga

SEQ ID NO: 78359 - DNA, 630 bp, Glycine max
  Peptide Sequence Number=SeqID_195137
atgttcttcattacaagtaatctacgaagcctacgtcttgcatgttgctaccaaatttcagatgaaggattgtgtgaaattgcaaaagagcttcctcagctggaggagcttgatatatcaatcagcagctttaacccaactagggaccctctagaagctgttggccggtgttgccgacacttaaaaacattgaaattcaacatgaaaggttacagacgtccgcacattgagtgtgatgaggaggcttttgctattgcagagaccatgcccacattacaccatctccagctttttggaaacaaacttactaatgaaggcctgcttgctattcttgatggctgtcctcaccttgaatctcttgacttacgacagtgtttcaatgttaacttggcaggaagtttggggaaaagatgtgctgaacagatcaaagaattacggcttccatgtgatcccactgatgactgcccatttgaagctgatgttgattatggatcacttgatgaagactcatctgcgatttctgacatagatttcttgtctgatgatgattatgactattatgaattctctggagggagcgacttttctgactatgattttgattctgatcctgattattatggcctttga

SEQ ID NO: 78360 - DNA, 1083 bp, Glycine max
  Peptide Sequence Number=SeqID_195138
atgtctgggagcacaagaagggtggagttggtgctgaagaacaggttcctgagttacttgatctggcaatccatacattcctctctcattttcatctctcttctctctttttcctcacctcactacccctttctctcctttctcctcttcctcccttcccatcttctcttctccaccaccctctccttcatcgcctccccccacccccgccctcgcttcaccctctccctcctcttcgccttctccgccgccttctccgcctccctctccctctcctccgtcgcccccgccgcccacggtctccccggcgtctcccgattagggtttaggggtttcctcgtcggttccctcttcggttcgcattacgtcttcaagcgccgatgggttcttcacttccccatcattcagcgtcctccatttttcagcttcaagatgggagttccttcttctgctaggcgagccttgaagctttccattgttgcttccgttttctctggtattttgttggagcttctgccgcatccgttcaagtacagcgtcgccaccggaagattcttcaccgagcagattacctctttagctgccacttttactatctttttttcttgggaattgactcatcatttgcattgggttttgcatactaagaggtccatatttgcacctccaaaaggatcggcagcggcagaaacaaatccaagtgagcatctactttcagctttggaggagagtagtcctacttctcttcttcggtatcttgcatatcttgatctctgtatggtttgcgagaacaatgttgacacttggaggcgtgcgggattttttgaagaaaccggtgagacttacaaaagagtaattgctgtgtgcttgaagccgttggagcatcttgcaacaaaattaggtgaaggcttaggaaatcctgttgacaaagccactcaactatcaaatcagctgttgtccccaactgatgcacggccagatttgaagcacatagaagaactgcacaactttcaggcacccaaacctcatcttgttcttgttttaaccacaaactcctgccttgaagatgaggcctattactag

SEQ ID NO: 78361 - DNA, 918 bp, Glycine max
  Peptide Sequence Number=SeqID_195139
atggagtcaattaagaaaggagaagcagatttggtgaacttagaagccgggcttgcttataatgcattcatcaaccactcaatgaaagccatagccaatgagatgtactatgatcattccaaaacctataaagcagttgcagttgtaaacagaagggcgtgtgagaacaacgaaaagatcactttaatggacttcaaaggccacaagtcttgccatggaggttactccacagcagcaggatggaactaccccatcaactacatcaaaaatttaattaacaatgaagaactgagtgacagagaaattgcaactagttttttctctagtgtttgtgctccatcagaggttgaaggttttgatatatgcaatgcatgcagcaaagagaatgaaacatgccctgaaaagggtttgtactctggtcattcaggagcttttaggtgccttgtagaggaattgggagacattgcttttgtcaagggtgacactgtgttgctctattctatggaggggcctcatagccaattatggtcaagcaagtctgttagagacttcatgtatctttgtcctcaagggggttgcagagaaatcaatggctatcctggagattgttcatttggagctgttcctgcaaatgtgataatggcacataactcaatgcccaacaaaaagagagagcatattttagaaacattaacgaatagtagtttggtggatgctctttatgccccaaacaacgtttcgattattcacctatttagtccaagtactcaaggactagccatgattgaaaaggtcacaaggccatatctggggaaatcagcttcaatctcacagagcatactaagattgaatgctccagaaaccagggtcgcctcatatgaagcagataatggttcaggtttcaataatgaaaagtag

SEQ ID NO: 78362 - DNA, 321 bp, Glycine max
  Peptide Sequence Number=SeqID_195140
atgggaggcacactattaatggtgggaggaagcggggggtgtgctggagcaaccttcattggacaaggaggcttcgagcaactaagagacgagattgaagagaaagtgaatgagaacgacgccgtgttgagtgtcgtgggaggaatagagttaggagaagtgaagaaagtgataggtgaaggccatgactttgtggtaattggggaagtggatatggagggagaaggcgtggcggctcaggaggtccatgtaaagagtgtaggcagcagggtggaggcggcgctacaggaccacgcgggtggagaggagggagagggctag

SEQ ID NO: 78363 - DNA, 621 bp, Glycine max
  Peptide Sequence Number=SeqID_195141
atggaaggtcaatgtctctccaaagtgtataaacttgatgtggaggatatgcaaaaacatagtacacctatgaggaaaaatctccaaaagaaaatccaaaatattaacatgatttgcccttgttgtggtgaggaggaggagtccatagagcactgttttctaacatgccctgaggtgcagagtatttggtttgcaagccgggtgaaggatgataaatatgaaaatggtcaaggagggggaggacacaagcagatttggagaccaccaacccaagaagaagctataaagattaatgttgaagaaggtttctctccaaaagtagctgaagctttaagtgcaagatgggtcgtacaattggctttggatctttgctttgacagggttgttcgcgtcacgaagatgatcgaggtggtgttgaacgatcgattggggaagaaggtgcgcgtgaagtgcaacgacgatgacaccatcggcgacctgaagaagctggtggcggctcagacgggcacaagagccgacaagatccgcatccagaagtggtacaccatatacaaggatcacatcactctcaaggattacgagatccacgacggcatgggtctcgaactctactacaactaa

SEQ ID NO: 78364 - DNA, 276 bp, Glycine max
  Peptide Sequence Number=SeqID_195142
atgtgttcgcaaaaatattggtttgtgacatatgagaagcagtctggtggtaatgttctcttggaatctggaagtcatgcgtccaatggctcatctgatattcctctgtggcatttgtgtctgggtcacatgagtgaaaaaggtcttgatattataagcaaacgaggcttacatagaaatcacaagaagttaaagtcattactcggtagtgaatttgagatgaaagatataagaactgctgaaaagattatgggaatggagattaagagggattga

SEQ ID NO: 78365 - DNA, 2454 bp, Glycine max
  Peptide Sequence Number=SeqID_195143
atggattttacttcgttcttgacgtccctggggacttcctttgtgatatttctggttttgatgattgtgtttgcgtttctgtcaagtaggccagggaacaatgtggtgtactaccccaacaggatcttgaaggggttggatccgttggaaggagggtacaagagccgcaaccctttctcttggatcaaggaggctttgacttcttcagaacgtgatgttattgccatgtctggggtcgacactgccgtctactttgtctttctcaccactgtgttgagtatcctagttttatctggagttattctgctaccagttcttctgcctctttctgttactgaccatggtatgaagacacaaacaactagcaacggaactttcagtgaacttgacaaattatcaatggctaacatcacggcaaagagttcaaggttgtggggattttttattgcctgttattgggtttcaattgttacgtttgctctcctatggagggcttacaaacatgtgtcatggctgcgagctgaagctcttaagtctcctgatgtgaagcctgaacagtttgctatagttgtgagagacatacctcatgttcctcaaggtcagactaggaaggaacaggttgactcttactttagagacatctatcctgagacattttacagatctatgattgtaacagacaacaaagtggtgaacaagatttgggagtcattagaaaagtatacaaagaagcttgcccgtgctgaagcagtatatgcagggtcgaaaacaactgccaaaccagaaggaacaagacctacaaacaagactggcttccttggacttgttggtaaaaaggtggataccatagaatattgcaacgagaagattaatgaacttgaggccagattggaatctgagcaaaaggtcactctcagagagaagcagcaagatgctgctgtagtatttttctcaagtagggtggttgcagcatctgcatctcagagtttacatgctcaaatggttgacacttggtcagtctttgatgctccggaacccaatcaactaatatggcctaatttgaaaatcaagtattttcagagagagctgaggcaatacttggtgtatttcattgtggcactgactatattcttctacatgattccaattacatttatatctgcattaactactttggataatttggtgaaatatctcccattcataaagccaattgttaatataaaggcattgaaaacagtgttggaagcttacctccctcaactcgcactgattattttcttggctttgttgcccaagttgcttctgtttttgtctaaatttgaaggcattccaactgaaagtcatgcagttagggctgcatctggaaaatatttttattttaccgtgctgaatgttttcattggagttactattggtggaaccttgttcaaagcattcaagagaattagggagcacccgacgttggatgaaatttcatccttgctagctgaaagcctcccaggcaatgctacttttttcttgacctatgtggcccttaaatttttcattggctatggccttgaactgtcccgaatagttccccttattatataccatttgaagagaaaatatctttgcaagactgaggctgagttgaaagaagcttggcgtcctggagatcttggttacggaactagagttcctggtgacatgctgattgtcacaattgtcttctgttactctgttattgctcctgtgataatcccatttggtgctctatattttggcctaggatggcttgttttgcgaaatcaggcactcaaagtctatgtaccaacatttgaaagttatggaagaatgtggccacacatacacaaccgtattctagcatctttgatattataccaaattacaatgtttgggtactttgggacgcagaaattctactatacaccacttgtgcttcctcttcccatattgtcattggtctttggttttgtctgtgcaaagaaattttaccccgcctttcaacatccagcacttgaggttgcagctaatacgcttaaggaagttcccaatatggaattgatttttggagcttacattccaccaagcttgaggtctgagaagatagatggtgaccgggttgaagatgcattgtctcaagcttcaagaacaacacctgagtttgtggtaggtcttacaacgttctggcatgtgctctcccagcagcctggtcccaaatgggaagggaaattggaagcaataaaagtggggaaacaacttctgcaaggttgcatcacgataacactaggtggaaattgcacaccagtatttgctccagctgaagtatcatctggccctgcaaagttgtggtctgctccatacaacattaatatttgcggtagcaagaggctgcatttcagcagaaaaggagaccttttgccaccatatcatcagtatcagtactag

SEQ ID NO: 78366 - DNA, 618 bp, Glycine max
  Peptide Sequence Number=SeqID_195144
atggcttccattcatgccaatgtcgtcccctacttgtccttcaatcacttccagacaccaccatcatcgtgccttgttggttctggtattgtgcaacatggagttagtttgagcaattatagaaggaaggttccttgcataaagtgtgaaaagaaagatgatgaggaaattcagcatgtgtcagttgagcgtccaccctattacagttacttggattccacctccggccagcttgagccggcttccggtgcccgagcgagtattctgggccaagagtattggcctgagggaactgctagtcgtatgagggctgcaagggcacctgctccaaccgctgaatcatcaacctctccaatgtctccatcttatggagccaagcctggaagtaggaggaagaattacaagacaactcctgtaactgagcaagagagactggaaagagatggtccaattgcatactattcagaatgggtgaacgcatggaaaagggacacatctggcaaagctattctgaagcattttgaagagaccggagaagatgaaactacacagctaattgaaatgttttgccatggaactgaccgagagtatcgcatactgattgggactgatgtttga

SEQ ID NO: 78367 - DNA, 993 bp, Glycine max
  Peptide Sequence Number=SeqID_195145
atggatcaagttgtgctttgcaacttcatgatgttcctggtggagccaaaaatatttgaggatataaccaggttttgctatggtgtaaaattagaaatcacatcattaaatgtagtcagcctcagatgtgctgcggagtacctccaaatgactgaaaactatggtgaagggaatcttgttgcacagactgaggcctttctcaatgaaattttcagcaattggccagattccataaaagcccttgaaacatgtgaggaagtgcaactctttgcagaagatctccatatagtttcaagatgcattgattccttggctatgaaggcttgttcagatccaaacttattcaactggcctgtgcccggacgtaattgcaagcaaaatcaagcagaccaccatgcaatgtggaatggaatttcttctgagaaaccatctcaacgtgatggttggtgcttcactgatacaagccatgctaccattcctaatacttctgaagcagaccaaagggctctactggaggaaattgtggagttgcttcctaataagagatgggtcacatcctcaaagcatctgcttaggctactccgcacagccatgatattgagtgcaagcttatcatgtaaagaaaatttagagaaaagggtaggagctaaactagaccaggctacgcttgtggatcttctcattccaaatatgggatactcggtagcgacactatatgatatagactgcattcagaggattcttgatcatattatgtctatataccagcctgcatccgtatcagctactccatgtatatttgaacagggggcactgatagctggagctgatgcattgacacctatgacaatggtggcaaatttggttgatggatatcttgctgaggtggtttcagatactaatttgaacttgactaagtttcaggcacttgatgatggtatataccatgcaatagatgtataccttaaggttagatcattttggatatcctag

SEQ ID NO: 78368 - DNA, 1557 bp, Glycine max
  Peptide Sequence Number=SeqID_195146
atgaagagattgaaaactgaacctcccagttcgaggaggtttaggttgtctcattttttgtttggtgttggggtgttatacttggtttttatatcgtgtaacttttcacagtttatgaaagttgtgtcatcgttaagtggggatgagacttacaatggaattggatcggataaggtagcaactattggggatgctgaagatgcagatttgagcaaaccctttgttagttctgtttataaagatgcatttcattggaggttagtggatggtagggaccaggatgctcccttgaggccaaaggaggaaccaatgaaggaggaagatcatggccctgaatctatgaagcagatttcggatggatatggtaggattaccggggaaatcttgcggcaacggaaccggactggtgatttgtctgtgctcgagagaatggcagatgaggcttggacattggggttgaaggcttggaaagaattggagcaggctggtgagaaggaggttggagaaagctctataattgaaggaaggaccgagtcgtgtccttcttggatatcgatgagcagggcagatttgttgaagggggatggcttgatgtttattccttgtggtcttgctgctggttcctcaatcactgtggtggggacaccccattatgctcacaaggagtatgctcccatgcttgcaaggtcaaggaaaggtgatggattggcattggtttcggtttcacagtttgtggttgaattacaagggctaaagtcagtggaaggggaagatcctcctaagattcttcacttgaatcctaggttaagaggggattggagcaaacggccagttattgagcataatacctgttatcggatgcactggggaacagctcaaagatgtgatggtttgccatctgagaatgctgaagaaatgcttgttgatgggtataggcgatgtgaaaaatggatgcggaatgacattgtagactcaaaagaatccaagacaacatcatggttcaagcggtttataggacgtaagcagaagccagaagtgacctggccatttccttttgcagagggtagaatgtttgtccttactttacgtgctggtgttgatggataccatattaatgttggggggcgccatatgacttcatttccatatcgaacaggctttacacttgaagatgctacaggattggtagtcaaaggggaccttgatgttcattcagtttttgctacttctctccctacttcacatccaagtttctctcctcaaagagtactggaaatgtcggagacctggaaagccagtgctctacctaaacatgctgttaaactttttattggagttctttctgcctcaaatcactttgcagaacgtatggcagttcgtaaaacatggatgcaagcagctgcagtcaagtcttcagatgtggtagtacgattctttgttgcattgggagtcaccctgtcaagagatcaatcactcttgggttattctacatcataccaagaatttcatagaactgctttcatggagaagagaaacacaagctttctggggtattga

SEQ ID NO: 78369 - DNA, 2121 bp, Glycine max
  Peptide Sequence Number=SeqID_195147
atgggtctgaaattgtttcaagatgcattctgtttcttgaagtgcatccttattgagttatatttcattctggaaggatttaggaagtttctacgtctaattcctgaagaggatgtggatgatgcgtcatctcagtataattttggaatggtgttaaaggaaacattgcttaatcttggccctacctttataaaagttggtcagtccctttccacaaggccagatatcattggtgttgagatgtccaaggcattgtcagaattgcatgatcaaatccctccttttcccaggactgttgctatgaagattatggaggaagaatttggttgtcctctggaatcattctttagttacatttctgaggaacctatggctgctgcatcatttggtcaggtttactttgcccgtactactgatggtaataatgttgctgttaaagttcagcgtcctaatttgcatcatgtggtggtgcgggatatctacatccttcgtcttgggttggggctgctgcaaaagattgccaagagaaagagtgaccctcgcctgtatgctgatgaactagggaaaggttttgttggtgaattggattacactttagaggctgcaaatgcttcaaagtttctggaagttcactcttcctttactttcatgaatgtgccaaaagtatttccacatttaactcgaaagagagttctgaccatggagtggatggttggtgaaagtccaacagatttgctctctgtgactgctggaaactctgttggaaatgtctctggatattcagaaaggcagaaattagatgcaaaaaggcgtctacttgatctggtcagcaaaggcgttgaatcaacattggtccagcttcttgaaacaggcttattacatgctgatccacatcctggtaacttgcgttacacttcctcaggacaaatagggtttctggattttggtttgctctgtcaaatggaaaaaaggcatcagtttgctatgctggcttcaataattcatatagtaaatggtgactgggcatcccttgtccgtgctctggttgatatggatgttgtgaggccagggacaaatatccgacttgttaccctggaactcgaacaagccttgggagaagtagaatttaaagaaggaattcctgatgtgaagtttagcagggttctgggaaagatttggactgtagcactcaagcatcatttccgcatgccaccatattatacacttgtcttgcgatccctagcttcattggaaggtttggctatagctgccgatacaaatttcaagacttttgaagctgcatatccttatgttgttcggaaacttctcacagagaactcagctgcaacaaggaatatattgcattcggtgcttctaaaccaaaggaaggagttccagtggcaaagactttccctgttcttgagggtaggggcaactaggaaagccttgcgactagtagcatcaaatagtgagacttcccttgatcattcaacaaataaggccactgatacaattgatgttgcatatttggttttgaggcttttaccatccaaagatggtgttgctatcagaagacttctcatgactgctgatggagcttcattaatcaaagcaatggtctcgaaggagggaaagtttttccgccaacaactctgcaagatcatagttgacttactgtaccaatggatgattaaattatttggacaaggaattacagttactcagtattcccgggtggtattggctaatggacctagcaacaaagaatcaggtctatcccctagatcatctttgcctacatatgattacaattccatctttagagaccggcgacttcgagtgatattctctaaggttctaaagtctgcaagtagggataaaatattgatgctgcggttctcctgggcttcccttctaataattattacagcttcaactttggcttgccaccagcttgttgtgtctctatctgaagcttacttgggcaaaatatttgatgctcccaagagatatgcagtcagtcttaagttgggtgtgttagatttggagcaaatctggtgtcaggcagtttatgtatggggaaacactgtacgcggtactgatgctgctatcaacatctaa

SEQ ID NO: 78370 - DNA, 417 bp, Glycine max
  Peptide Sequence Number=SeqID_195148
atgcagtcgcagatgcaatcacataaactcgtactgcctcctgagcttgaggttggtccctctgctgctcatgtcagcacaaagggaagctatgttgatccctcggggcagaacccagacatggatgactcaaagaaatgtgggttgtattttgatgagaatcctccttgcctagttacccttggaagagtttatgagggatctataaccgtccacgacatccctttgggcaatgatcaagtgaaggtcggtgttgaggaagttcgagatgctaatgctcgcattcctgtacccactcaagagggacctgaaggactatcaaaacttgtagatagactagatcatgatgtcgatcccctatacctgatgacattagccatcttgcagcctttcctcaagcctttgcaggtttcatag

SEQ ID NO: 78371 - DNA, 273 bp, Glycine max
  Peptide Sequence Number=SeqID_195149
atggtgcctaatttctatatgcttggttctaaagtgttgagcgacaaagcttccctcttagctcatcagtgggctaagcgtgcatccaccgctaagcgcagctttagcgcgcttagcgagaaagaagaatctggcaaggcattagcatcaaggccacacgctaagtgcgagatcagtgcactaagtgcagcagacttgaagcagatgattggcacagattccagagcataccacagtgcctatttcgggaaaagagctctggaggcagcatga

SEQ ID NO: 78372 - DNA, 222 bp, Glycine max
  Peptide Sequence Number=SeqID_195150
atgcatgttggggtagagggtgtcacagttcatgtggatcctaccattgggaaagtcgatggtccccatagaaagaaattaaggacatatttggggatctttgctcaagacagggtggacattacatttgctaactggaaaaaagctcctacaactcaaaaggatttgatttgggaagacattcagcctaaattactaaacctcgatccctcgtcagactga

SEQ ID NO: 78373 - DNA, 519 bp, Glycine max
  Peptide Sequence Number=SeqID_195151
atgggggttctcacacaagttctatgcagttatgtgactttgcctctttatgctctagtcacacagatgggttcaaccatgaaacctaccattttcaatgaaaatgtggcaacagcactaatgaactggcatcactctgctagaaatcacatcaaacacaacaagggttctacttctaacacaccattctcaagcaggccaggaaccccaacacatggcatgtctccagttcacttgcttcacaagcaccctagacacagtgacagtccaatagtttctccaatggcatacaattacgaaaatgaacaatggggtgttgaagggatacattccccaaaccaccatgcaagagatcatgatcatgatcatggagagaccatgcagatgcagcagcctacagctccaacagcagatttgcctcctagtggactaaatcctattcgaactcaacatgaaatcaacattgctttatctgaattttcatttgggaggggacaccacactggtagtaataactaa

SEQ ID NO: 78374 - DNA, 443 bp, Glycine max
  Peptide Sequence Number=SeqID_195152
tttggggtggagatccagtttacccaactgtgaactatattcaagatccaaatgaagtgattgactacagggggccagattttcatgaaccaatgccaaatatggtggcttatctgaaggagcaaggaaaactcacttcaagggaggaatttgacaagattatggctaaggaaaagactgaacaaattgaggatgaagaggatagtgatgttgatgagggagagggagaggaagagaagcttagtgattattggagtgtgttgaaaagtactcctgagctttgcaagtcaaagatattcttgctttctggtatctcctattattgggatgactatcaatcagaaccaaaaccaaagaaagaaggtcctttgtcactggacgaggctatggcagagtcagagaacttgactgattttctgatggactttgaagaagaagaatga

SEQ ID NO: 78375 - DNA, 444 bp, Glycine max
  Peptide Sequence Number=SeqID_195153
atgaggagaaaggaaacgattcagcgccacgagagtgacatcaacagtgaggttgcagtgctagtgatgagggagtttcagcaccgcgagaggttgcaaatgagagtgagaaagcgtttgagtgagagtgggagtcagaaaggtttcaaagtgagggagctcgagggttttcagccccaagcaatcattataaaagatctcacaacatcgggggctattttgcacgtaaattgcatgcaagccccaagcaaaccgccagtcaaactggcgagttcgctggcagtgaagaagccgccatccccattggcgatttcgccatgcatgggggaaccaccagtcaaactggcgagtttgtggcaggagagggcagagaaggccaggctagttgtagggctacgtcacgggggtgcaggtgaacgttgcaaggacgcagcagggacatag

SEQ ID NO: 78376 - DNA, 150 bp, Glycine max
  Peptide Sequence Number=SeqID_195154
atgtcacgtgacttcatgggtcaggatgacaaaggtgcagaagacgacaagatgatgttagtctctccatgctaccagactctaagtctgagggattgcgaaagagtgtttatacggataaccaattgggtatctccgcctgtcacctaa

SEQ ID NO: 78377 - DNA, 431 bp, Glycine max
  Peptide Sequence Number=SeqID_195155
ggaccgcgtccacaagacgcccagtgggcccgaagaagtccaacagggccctggggtttccagctctggttacgagtctctgtcagtcctacagggtgcccgttcccccagcgaggacatgccatcgtgacataggaatcacacctacaaagacacccagtggacctggagaagtccaacagggccctggggtttccagctctaggatcgcgcctgcaagatacccagtggactcgaagaagtccaacagggtcttggagttgtcaagctctaattactggtctctgtcacctccagcaagggcatcaggccccctactaatcgagctttcatcaagaagtactgcgtccccaggcaggcgtacggcgaaacaccacagcagcctggggatggccagcagcgggcaacagacgcaccgccatcacctctag

SEQ ID NO: 78378 - DNA, 321 bp, Glycine max
  Peptide Sequence Number=SeqID_195156
atggctactactagtagtagtgttgctcaaggaaactcaccaacatcacaagttgatgtttgtaaaaaggagaaaaatttgaagggcaaaagctgttgtctcgctaagcctggaccagaatcttccatgtcatcacgcgctcagcgtgtcatcagctcattcaacgagaagattgtctcttctgcgcttagcgcgagaatggcactaagccaaatttcacttactcgcgctaagcgcgaaaatggcgctaagcgcgaaaatggcgctaagcgtgccttcaaggacaaaaggccctttttaagcctgaattacgaagaatga

SEQ ID NO: 78379 - DNA, 300 bp, Glycine max
  Peptide Sequence Number=SeqID_195157
atggagataaccaaatcacttgtctccaacaacaataataaaaagaacaaatgcacagcttccaggttagtagggcctgatggtgttggactgttggtactgcctcgcaaagttgaacttaaggatgactcaagcttgctagttgcaagctatcatccactaccagcagcattcacaaagtcactacctaacctaggatactgtcatattgcatcacagcgatacaacgatagaggcagtagtggctggcgcggaagtaacagcatgaggcagttagaccaagacagaaagagtgattaa

SEQ ID NO: 78380 - DNA, 2941 bp, Glycine max
  Peptide Sequence Number=SeqID_195158
atggttactgatggaaccaaaaagcctcaagtttcagtacctacaccaccaccaccacctcgaaaaatcaatgtgcagaaatatgctgaatcccgtgctcttgaactccagagtcttcaatctatcatagaaaatagagtaaacagtgattataggtctcaaaggaacaagagaagaaggacaactgcgtttgataaccaaattgcaagaaaagggtgcagaagaaagaggcagaaactgggaataattgataaagcccttgccgaatcaggtttggaggagaatcacctaaagaagcttcctcggtgtgttcgtcggagatatgaactaaagaaaaacccagagaatggtttttgcacttctggggatggaaccaagaggctgagaactcatgtgtggcatgcaaagcggtttgctatgaccaagctttggggttaccaccttcctttgtgtcttcaaggaaggggtaaaggttcgagggcgctcttgaaaaggctcaaacaaggggtgcttgtacatgatgcaagctattatactgccgtccaattggagggtccagaggattcattaatgtcagtattaagaatggtgctggaaccctatccagcaacaacaccacatcctggaaatcatgatgactctgttctttacagtgtaacctatggaaaagcaatgctgcatcaatgtggagcaccggtttctcagccaattgctcctgtaacctacatgtggcaaccaagttcccaacaaaatatgagtacagagctagatggaagaaatcattgtacttcttttggacaacatgacattggtaatgattcaaacaaacatggtgtggagttaagtgaaaaatcaggcaaaatgaagcacggttcttcatttagatgcctatgggtgtggatacatgcttctgcctttgaagaaggatacgataatctaaaaattgcctgccagaaagagggtcaacttgcaaaattagaattaattggattagggacatttcaacttcttcaaaaagtattgcatggtgttggaagtatttcagagaattattggcaattgaagaaacatgtgcctatcgaagaagagtctgtttctcagatcagaaattcatccatactgagaaatgaggattatttttcttcatgtgctatgctatctcttaatgtcaaggatcctcgagaattgccatggaagaagactgttgttccagtggagtccatttcaactaagactccgagtgatgcccaagaaaagaaatacaaagagcttgctgagttgggaggaatattggaagagaatagagatttatcttcattatcaaggtctaaacttgtagacagccagtttgatattgacgatctatggtatgctaccaccagagggttgaggcctccagtggaagacagtgtcctttccaaggagaaacaccatgaacgtatggttaatttctgccttgatgatatagattctggagaggccaactcttcaactaaggtgcagtgctcgagatcttgccctattcttcttttaaaaaatgatatgaaggaattgattataggatggtctgttatacttcccttaagttgggtcaaagccttctggattccgctcatctctaatggggcacatgcaataggtttgcaagagaagcactggatttcatgtgaaatggggctaccatttttcccttcagattccccagattgtaaggcatactcttgcttaatggaagctaaagctgctgcatttaataaaaaagaagaactccgtcctcctgtgataaggcatttaagagttcccatactgcctccatggggtattgttcgcattacttttgacaaagtgattaatgcaatggagactcatgatctatcaactagggaagatttgaccaatgctaattcattaccaaacccttgccatggaaactttgaaatttttaattctgactccgggagtaattcgtttgatggaactgtagtgaggacaggttgtatgctgactactttcctcaatgaaaccaaaactggtcaattgttattgtttccttatgcagcagatggaaaggctagaatctctaagtttattaatggtgaactaaagcttgatccaaggcatagaagctctgacatttatgaccataagctatgttttgtaagagttcatcttcgtcccttcaaggaaggatgttttgaagagggtgcagttatttgtgcaccatatccttctgacatatctttatggacttcaagttgtgagaaaagagaagagggacttcaaatgtctcaatctgctatgcgattatacttcaaagaacattcctctggtaaatggggaatgcagataccagatgattcaattgctagcaagtctcagcggtggcctattggctttgtcacaacagcttctgttcaaggaagcaagagtctagtagcagagggcttttgtgaggctgttttactatctcatttgagagaggaacagtggaaggagatgcctatgaagaagaggagggaaatatacgtacttgttaggaatttaggatctacagcatatagacttgctcttgcctctattgttcttgaaaatcaagaaaatgacattgatttcttttctggcacattgattactcctctagcaataattgacacttgttgggacatcatcaaattcggtcaacgacttgtggtgcttgtgcaatggaaagggttgcatctagacgatacatcatgggaagattggaaaacattgaaagatacttattaccttgagaacaaggtgttgttcaaagggttggtggatgataggccaaaggatacagacctggaagacacaaggagcaggaccataagaagaactaatcctgtatctgaaagattatgtttgaagcaagttgcaaattcagttaagggaataatgtgttggcctgctaggattg

SEQ ID NO: 78381 - DNA, 405 bp, Glycine max
  Peptide Sequence Number=SeqID_195159
atgaagaagaaagaaaccaaacggaggaagcaagtcggtgaagatggaagagatgaaagcaggtttcaagacgggagaagactgcagaagaagacacgtggagcacccacagaagaaaacaggaatttgctgcacgcggtgacccaattcggtttcagttcatcttctcttttccgcaagcaaaaccccacattcttcttcatgaaccctaattcactctttccattccaaatctcaatcacctttctgattcaatctttatctcctcgccaatctcttcatttgcctcgcaaatcaagtgagatactagcagaaatgagggcttcgtcgggctttgcgtatttaggaaagggtgtaggttgtagggcaccagggagttgtctaaacaatctaacgcaaaagtga

SEQ ID NO: 78382 - DNA, 309 bp, Glycine max
  Peptide Sequence Number=SeqID_195160
atggttttgcaacatcacccgcgagaaagtatccagacattgactcatattcctgcacatcagcaaagagaattgtttaattgtagagagggagcaaccatacctctagaagaaaatggtgcaggaccaaaaagagatgagcttgattttgagtttttggggaacaaaacaggagagccttatttgactgagactaatgtatacaagaatgggactggtgggcgtgagatgaggcacatgctttggtttgaccccacagaggactaccacacctattccatactctggaacaaccaccaggtagtgtaa

SEQ ID NO: 78383 - DNA, 894 bp, Glycine max
  Peptide Sequence Number=SeqID_195161
atggcacccatcacttccactaccaccaatgagttaaaagaactaatggagttcaacaacaatttccagtttccaatcaagcttactgctaccaattacccttcctggtacaaacaggttcatgctctactcattgtttgtgaccttgaaggctatgtcactggcaaaattgtttgtccacctgccaccattggttctggcgatgttacagcaccaaatcctatatattccttatggattcggcaagataagctaatttatcttgcttttcttgggtcgtgcaattctgaagcacaatttgtcatggttgttgccgacacttctcgcgatgcttgggtagcccttgcatgtgcattttctaatcgatctcaatctagaatcatgtctatcagagaacgtctcagttctatcaccaaaggcacctcctcagtttccattcatctactgtcgattcgcaatattgctgatgagttggctctcattggccatccaattgacgaccttgaaatggtcatacatactctgaatagtctaggaccaacatttcgagagttcactgcctccattcgaactcgtgattcaccaatttccttcaatgagttatatgataaattggtggatttcgagatgtatttacagtgtgaagaatgcctctcaactcccatccccgtcactaccaatgttgttcagcgttatcaacatggtcaaggggcatctcatcacatcaccaatgatctaacaaacttgactctcaaggatgactaccatggaaatgacaatcttcaagttgcaaacggtaatcaacttcctattactcacattggctccaccactattcccactaatggtaaaggacctacgaacgagggagcttcttctacaaggattgaatga

SEQ ID NO: 78384 - DNA, 363 bp, Glycine max
  Peptide Sequence Number=SeqID_195162
atggtgctgaactcggggtggacgaggcgggccacagatgaggtgtcgtcgaccgacgtggagtattgtaagggaagggggaagtggtactcgatggcgaatatggaggcaaatagggttgtgtgggtgttcaatagcgtggaagttatggtggttctcccgacaacgtgtttagggttgttgttgcaactagagctcaacacgagcttcgttttgctacaggagcaaatgatgggatcgagggagacacaagagtatcactggttgggtgcaatgcatgtgaaggagattgttaaagcttatgttttgttatatgaaacccccgttgttgctagtagatatctctgcaccaatgacatctag

SEQ ID NO: 78385 - DNA, 2506 bp, Glycine max
  Peptide Sequence Number=SeqID_195163
ggtcagcagccgtgatttgggccgcaacatcaaggtatttgaattgcttgtgaccgttattgggattgcatcggtcgcatttgtccacgatatcaacaacggtgacgaaactgcaagttcttctcaagcagcagcaaagggaaaccaagaggactacaagctgaaggacacaaagccagagcttggagaaaagtggccacatggagggcaacgtggagggagtggttggatatacagcgagagagcaacaagcacctatgacatggtggagcaaatgttctacctctatgtccgtgttgtgaaggccaaggatcttccacctaaccctgtcacaagcaacgttgacccttatgttgaagtgaaggttggtaactacaagggtaaaactaggcactttgagaagaaaacaagccctgagtggaagcaggtttttgcattctctaaggagaagattcaatcctcagttgttgaggtctttgtgagggacaaagagatggtggctagagatgattacattgggaaagtggagtttgacatgcatgaagtgccaacaagggtgcccccagatagccctttggctcctcagtggtataggcttgagaattcgagaggtgaagcaaggagtagaggagagatcatgcttgctgtttggatggggacacaagctgatgaagcatttcctgaggcttggcattcagattctgcttcagttaagggagaaggggtttataacataaggtcaaaggtttatgttaacccaaagttgtggtatttgagggttaatgtgattgaggctcaagatgtggagccaaatgacaaaagccagccaccacaagtttttgtgaagggtcaagttggacaacaagtgcttaaaaccaaattgtgtccaacaaaaactccaaaccctatgtggaatgaggatttggtgtttgtggcagcagagccctttgaggagaagcttgtgataactgtggagaacaaggcctcccccggaaaggatgaggttgtggctagaataagtttgccgttgaacaagtttgagatccgtttggatcaccgggcagtgcactcgcattggtacaaccttgagaggtttggctttggtgtgttggagggtgacaagaggaatgagacaaaattctcaagtaggattcacctaagggtgtgtcttgagggtgcttatcatgtgcttgatgagtccacaatgtatattagtgacacaaggcctactgctagacaactttggaaacaaccaattgggattcttgaagtggggatattgagtgcccaagggctccaatctatgaagaaaaacaatgctaaagggtcaacagatgcttattgtgtggccaagtatggtcagaaatgggtgagaactaggactatcactgagagctttaatccaaaatggaatgagcaatatacatgggaagtgtatgatccttgcactgtgataacttttggggtctttgacaattgccatttgggtggtggtggtggagggcaaaatcaaggagccaaagttgactcaaaaattggcaaggtgaggattcgtttgtcaacattggaaatggataggatctacaccaactcatacccgctacttgttctgaaaacctctggattgaagaagatgggggaacttcaattggcgattcgcttcacgtgtctctccatggctcacataatctacctttatggacaccctttgttgccaaaaatgcattacctacatccattcactgtgaatcagttggacagtttgaggtaccaagctatgaacattgtggcagttaggcttgggagggcagaaccaccccttaggaaagaggttgtggagtacatgcttgatgtggactctcacatatggagcatgagaagaagcaaagccaatttcttcagaattgtgtcactattttcaggtgcaatatctatgagcaggtggcttggtgaggtgcaacaatggaagaatccagtcacaacaatcctagtgcatgtcctctttttcatcttgatatgctaccctgagcttatcctccccacatttttcctctacatgttcctcattggaatatggaactttaggtttaggccaaggcaccctccacacatggacacaaaactttcttgggctgaagcagcacacccagatgaacttgatgaggagtttgacacttttcccacttcaaaggctcaggatgtgatcagaatgaggtatgataggcttagaagtgtggctgggagaatacaaactgtggttggagacattgcaacacaaggtgagaggtttcatgcattgcttagttggagagaccctagagccacaagcctatttatgtttttctgcctcattgttgctgtggcattgtatgtgacacctttcaaggttgtggcttcaattgctggaattttttggctcaggcatcccaggttcagaagcaagctaccctcagtgcctagtaatttcttcaagaggttgccatctcatgctgatggcatgctttga

SEQ ID NO: 78386 - DNA, 510 bp, Glycine max
  Peptide Sequence Number=SeqID_195164
atggagcttgttgatgcacctttggttggttggaggtttacatgggtgcaaatcggtgggcatgcaatgagtaggctagataggactttgatatcattgggttggttacgcctttggcctaatgctactcaatttgtccttgactggtctatttctgaccattgtcctattattctaaggcatgaaaaggtggagtgggggccaaaaccctttaggttctttaattattatattattgaaccgggttttcacgactttatgaagagggtctatgattcattccaagtccaagaggtgggagttaggagcttggagaagtttagtgaacatagatttaggatacaagatttggtgaaaaatattcataatctcaagatggatggtatgtcattggaggtggccttggaaagagaattgttgtttattttcggagtttgcgcttacttgaactatttgtcttgtgcaagacatataggacattatagaacttcaaatggagcatgtgagtag

SEQ ID NO: 78387 - DNA, 2633 bp, Glycine max
  Peptide Sequence Number=SeqID_195165
atggctggggaaaaacgagttctagattcagaactttggcatgcatgtgctggtccccttgtctctttaccagcagttggaagccgcgtggtgtactttccacaaggtcacagtgaacaagtggctgtgtcaaccaacaaggaagtagatgctcatatcccaaactatccaagcttgcctcctcaactcatttgtcaacttcataatatgactatgcacgctgatgttgagactgatgaagtgtacgctcagatgaccttgcaacctctgaatcctcaagagcaaaatgaggcataccttccagcagagttgggcactgcaagcaaacagccaacaaactatttctgcaaaactttgaccgccagtgacacaagcactcatgggggattctctgtgcctcgccgggcagctgaaaaagtgtttcctccattggatttctctcaacagcctcctgctcaagaattaattgcaagggatttgcatggtaatgaatggaaattcagacatatcttccggggccagcccaaaaggcatctacttacaaccggatggagtgtctttgtgagtgctaaaagacttgttgctggtgattctgtgctgaatgaaaagaaccaactgcttcttggcattcgccgcgctaatcgaccacaaactgtgatgccttcttcagtgttgtcaagtgatagtatgcacttggggcttcttgctgcagcagctcatgcagctgcaacaaatagtcgtttcaccattttctataacccacgtgctagcccttcagaatttgtcatacccttggcgaagtatgttaaagctgtgtatcatactcgagtttcagttggcatgcggttcaggatgctgtttgaaacagaggagtcaagtgtgcggcgatacatgggtacaataactggcattggtgacctggatcctgtccggtggccaaactcacattggcgctcagtcaaggttggctgggatgaatccactgctggagagaggcaacctagagtgtctctatgggaaattgagccgttaactacatttcctatgtatccatcttcattcccccttaggcttaaacgaccatggcctccaggactgccttcattccatggcatgaaggatgatgattttggcctgaattcacctctgttgtggctccgagacaccgatagggggcttcagtctcttaattttcaggggattggggttaatccttggatgcagccaagatttgatcccaccgtgttgaatatgcaaacagatatgtatcaagctgctgctgctgctgctgttcaggacatgaggagtttagatccttccaaacagctttctgcttccttacttcaatttcagcaaccacagaacttcccaaacaggactgctgctttaatgcaggcccagatgttgcagaagtcgcaacctcagcagatttttggaaataatcaagagaatcagcattcaccacaatctcagccacagactcaggctcatcttcagcaacatctacaacatcaacactcattcaatagtcagcatcatcatcaccagcagcaacaacagcaacagcaagtagttgataatcagcagatttctagtgcagtctctacaatgtctcagttgttttcagctcctcaacctcaatcaccacctatgcaagctatctcttccctgtgccaaaatttttccaattcaaatgggaactctgtgactactattgtttcccccctgcacagtatcttgggttcttttccccaggatgaaacatctcacctcctgaaccttcctagaacaagctcttggattcctattcaaaattcaagtgggtggccctcgaagcgtgttgcagtggatcctctcctttcttccggagcctcccattgtgttctacctcaggtggatcagctagggcaaccacatagtaccatgtctctaaatgctattacattaccaccttttcctggtagggagagctcaatagaccaagaagggagcaatgatccacaaaaccatctcttgtttggtgttaatatagacccctcgtcccttctcatgcctaatgggatgtcaagccttaagggggttagcggaaataataactcctcaaccttgccatatcaatcttctaattatctgaatactaccacaggcactgattcttcattgaatcatggaatgacacccaacataggcgactcgggtttcctgcattgtccggaagatgcaggacaaggaaacccactgaacaaaacctttgtgaaggtttataagtcagggtcctttggaaggtcattggatatcaccaaattcagcagctaccatgagctgcgtggtgaactcgctcgaatgtttggccttgaaggcgagttggaggaccctgtgagatcaggctggcagcttgtatttgtagaccgagagaatgatgttcttctccttggtgatggcccctggccggaattcgtaaatagtgtatggtgcataaagatactttctcctcaggaagtgcagcaaatgggcaacaatggccttgagctgttgaactcggttccaaatcaaaggctctctaatggcatctgtgatgactatgtgagccgtcaagacccaagaaatttaagcactgggataacaactgtggg

SEQ ID NO: 78388 - DNA, 201 bp, Glycine max
  Peptide Sequence Number=SeqID_195166
atgcgagatcttagagcccacattggccacatccaccctgacgtgggacagctcaggattttgggcaatacttatgcctactacaatgatttgggtgatcctgataagggtgcacaatatgctcgtccagttctaggagggtccattgaatatccctaccctcgaaagggaagaactggtagaccacctaaagtttcctga

SEQ ID NO: 78389 - DNA, 2292 bp, Glycine max
  Peptide Sequence Number=SeqID_195167
atgccacttctgaggttcaatcactatttactgggaaaaattttagcctcccatttccatgctaactatttctcctctgttgctttgtcccttttttctgcaacaaattctgttttttctgcttcttattcaaccgctaatctcagagatcaaactgagagtaaatgcagtaactttaggaatatcaatgatgatttagggaaagtgggtcctggttttcaagaaagcttatgtttttctgcaagtgttagtgatggggcagaagaagaggagggtgaagaaggagaggggtctagtgatgatgatgagagtcttgagtttatcacttcctttcatggtaaaaacgataaacagacacaaagtattgcaagagttgaaattggtgacagtgaatttagacaccctgtggtgagggaggtttgtaggttaatcacgctgagctctgcttggaaccctaattttgaaggacgcttgaggcatttattgagaagcctcaagcccccacttgtttgtgctgttttgcgctctcaggctgatgaacgtgttgctttgaattttttctattgggcggatcgtcaatggcgctacagtcatcaccctgttgtctactacacaatgctggatgtccttagcaagaccaaattgtgccaaggtgccaggcgtgttcttcggcttatgacacgccgcggaattgaatgtccgcctgaagcttttggctatgtgatggtgtcttatagtcgtgcaggcaagttgaggaatgcgttgcgggttttgaccttgatgcagaaagctggggttgagcctagtttgtctatatgtaacaccactatctatgttttggtgaagggtggtaaattggaaaaggcgctgaaattcttggaacgaatgcaggtgactggaatcaaaccagatattgtcacttacaacagcttgatcaagggttactgtgatttaaatcggattgaagatgcattggagcttattgcaggattgccatccaagggatgccctccagataaagttagttattatactgtgatgggtttcctctgtaaggagaaaaaaattgaagagcatggacatgcagatgatgctcttgctttcctaaaggaagcacaagacaagggtttccacattgataaggttgggtatagtgcaatagttcactcattctgtcaaaaggggaggatggatgaggcaaagagtttagtgattgatatgtactcaagaggatgtaatcctgatgtagttacgtatactgctattgttgatggattttgccgcttggggaggatagatgaagcaaaaaagatcctgcagcagatgtacaaacatggatgcaagccaaatacggtatcatatacagctttgttgaatggcctctgtcacagtgggaaatcattagaggcaagagagatgataaatgtcagtgaggagcattggtggaccccaaatgccatcacttatggtgccgtgatgcatgggctccgtagggagggaaaattgtccgaggcgtgtgatttgaccagggaaatggttgaaaaaggctttttccctactccagttgaaattaacctgctaatacagtctctctgtcaaaatcagaaagtagtagaagctaaaaaatatttagaggaatgtctgaataaggggtgtgccattaatgttgtaaacttcactactgtaattcatggtttttgtcagattggtgacatggaagctgctctatccgtgctagatgacatgtacttaagcggcaaacatcctgatgctgtcacatatacggcattgtttgatgcattgggaaagaaaggtagactggatgaggcagctgagttgattgtaaagatgctcagcaaaggtttggatccaactcctgtaacatacaggtcggttatccaccgttattctcaatggggtagagttgatgatatgttgaacttattggaaaaaatgctcaaaaggcagccatttagaacagtatacaatcaggttattgaaaagctttgtgattttggaaaccttgaggaggctgagaaactactggggaaagtattgagaacagcatcaaaagttgatgctaatacgtgccatgttctgatggaaagctatctgaaaaaaggggttgccatatcagcgtataaagtggcttgtcgaatgtttagacgtaatttaactcctgatttaaaattgtgcgagaaagtgagcaagaagctagtgttagatggtaagttggtggaggctgataaccttatgttacgatttgttgagcgtggaatacaacaaaaatga

SEQ ID NO: 78390 - DNA, 288 bp, Glycine max
  Peptide Sequence Number=SeqID_195168
atgtgttttccggagaggaagcgagggcggttggcgaggacgacgtcatttttggtgaagcattcttggaatagggtttgggaggagatgacgacgacgaggcgggagctgaaccatagggagatgacgtggccgtacttgttggagagggctttgaaggataagctttacgaggagaaagcgaaaaatgcagaggagagagtaggacaaggaggagaggatctccatgcttttttaggtgccacaggactaggactatcacttgttgatgatcatcactttttataa

SEQ ID NO: 78391 - DNA, 492 bp, Glycine max
  Peptide Sequence Number=SeqID_195169
atgactaatacgatggtagggttgagaccctcactctcactttcaattcctctttcttattcctttccatcctcttctcccctttctctcaaaccccaccctctccttctctccccaaaaccacacccacttctcacattcgcaaacaacaacaacaacaacaatgaattaagggaacagcgaaacacccaacaacaacaacaacaacaacaacaacaacagcaacaaccacccaatggttcaaacgagcaagaagaaaaggtcaacgattggagcaatcaaagacgacccattttggggttcaattggaggacccttttggaccctgaccccgacaacgtccttgcacttggattaaccggtattctcacttgggcaagtgtgcaagtcctctggcagctcttgttcatctccttggcaatttttgttgctgccatcaagtactctttcatcgccgctcttcttgttttcattctcattgcccttctttaa

SEQ ID NO: 78392 - DNA, 204 bp, Glycine max
  Peptide Sequence Number=SeqID_195170
atggttacagcgcttacctcgacggtggacggtggcgtagctcttcacggaaacctcctcaatgcacctcgcaacctcttcgcagcaagctcctcttcacagcaacaatggttcgtggctgaatacgaaaatggtgaactagagttagcaagagggagagaggtcggagaggtcagcaacaaaatacaaaaatggctgaggtga

SEQ ID NO: 78393 - DNA, 828 bp, Glycine max
  Peptide Sequence Number=SeqID_195171
atggcatgttctgtcccttttaacaacaagaatttggacataagtttctttgttttcaagcctactattgtaatcatagatgaccttgttcatggactcaaagccttctccttaaccactgagagccttggttgtgttcaaagctctatatttaggagcatccatggaaatatgatcatatggtatggagcatggcagaggcggtcgagtaaggaaaaagaggagctgacctcaacccttagaaccctgttaggctatccactatccagactagacaggacatctaaaacagatactacagatgttgtgccaatttttatagctgaaaaatcaatgctgaccagcatatcaagcatggcagtgttaattgaacacagtttccttgaagcatacggtggagaatcaagagatggctcttcaactgcaaaattctccactggggacataatatcattgaactcagcagtcaccactactaatgacctcaatgacctctgctacgctgtcttagcaattttaaggtctcgctttgcgaaaatggaaggcataaccgcaggcctttgcttcaagggacaaagcaagcccagagtggtgtgcattcatgtgtggaagtctctccatttttgttactgttggattctcaactctgaccacagaaaatggatgatgccatatcttgaacgcttctctatcgacatgaagtatgatattttccgagtagtctatgttagtggtgacaatgtggttgatcttaactgcatttctactcatcagatgttagaaaatgggaatgagagtagtaggcaaggccaggttatgcagaactga

SEQ ID NO: 78394 - DNA, 327 bp, Glycine max
  Peptide Sequence Number=SeqID_195172
atgtgtgaatgttttgaaattgctgttaatgcctgcgtggtactttctacgcagcctaagcaaatccacgagattaaggatttccttctcactgctagaaggaaggacgcaaggtcggtgaagatcaagaggagcagagatgtggttaagttcaaggtcagatgctcgaagtacctctacacactttgtgtgtttgacccagagaaagctgataaattgaagcaatctcttcctccaggctacaagcctacaattatcagataccctgccgttttctgtgataacttttggtggatggaagtggaagaattgaataatagcaactaa

SEQ ID NO: 78395 - DNA, 501 bp, Glycine max
  Peptide Sequence Number=SeqID_195173
atggcaagcactagcgcgcttcgaagtagcggcgcgaaaaactgctccaaaacccgtgccaccgcgatagcggccgctccaaacgcgacacgaaactgctctgctacagaggtgcccgtcgtggatgggggccgctccaccgctatagcggccactgttgacaactatgcttatgaccatccatatgaaggattagctatggcctttgagaaggtatttgttgaaatgaaaatgctatacttgggaggtggtgagaactacttcccaagatgtttagtgacttttcaatgtatgtgggatgaattgttgttaatggtaaaacttggatactcaagaccaacaatgagtgagatggtgggtatggatgtgttgtaccaaaaactctcaagtaatctaagtgtagttgtcgttgtgagtaggcacgtaagttggaagtgcttagtgggtcctcaacctaatgttggaggttatcaacgatggctaatgggaatgagcctatag

SEQ ID NO: 78396 - DNA, 356 bp, Glycine max
  Peptide Sequence Number=SeqID_195174
gagcaagagccttgcttttgtcggccgcccacacaatttctgtcatactgacactggagtcacgtggcatgcggagatacccgagtgccaacgagcccgttgacacacggagatttacgtcatcttctgcacagacaatttttgtcatactgacactggagtcacgtgacatgcggagatacccgagtgccaatgagcccgttgacacatggagatttacgtcatcttccgcgcagacaattcctgtcatactgacactggagtcacgtgacatgcggagatacccgagtggttatccgtttaaactttcttttgctatctctaagactcaaagcatgatagcacgcagagactaa

SEQ ID NO: 78397 - DNA, 570 bp, Glycine max
  Peptide Sequence Number=SeqID_195175
gacactggggcagacattcctgcagacacaggcgcgcaggctgctgaggatgagcatgagggatttccgggtgctccaagcgacccatccgtgctgacccagtatgcggatcacgttgcttgcagtgtatgtacgggagaggagcgtcctgagttgaagttatcctttcatgggaggaaggcccatagtttaggcaggcctgtccctgccattgagggactaattgctaggacaggactaagtcctctgatcacgtctagtttccatctccctgtgggagagctcacgatcacgctggacgacatctcctcgattctacatctgcccgtggttggcgacttgcacgcctttcagcccttgcacgtggatgatgcggttcagatgctggtggacttattgatggtctctgtagaggctgccagggctgagacagggcagtgtcgtggaccgtacgcaggtcattggacagcttcggctcgtgcatatcttctgggttgcactctgtttgctaagaagagtgcaaccaatgtgcatgttgtgtatttggaggcccttcgtgacctcagttag

SEQ ID NO: 78398 - DNA, 1728 bp, Glycine max
  Peptide Sequence Number=SeqID_195176
atgataatatcctggaatttaagggggttaaataaggctagcaaaattagagaggttagctcccgcctctttttgttgaagcctcatattgtagttatgttagaaattagagtgaagaataacaaggctggtaatgttagagataaacttaagctcaaaggtaaataccttgataactatgtgaagcataataatggtaggatatgggtatattgggatgacaacatagtggatatccaggaggtcaattgcacggctcaattaatccattgtaaggtgtatgatgcaactggatactttatgcagtggttgactgctatatatggtttcaactatcttgagcagtgcacagatttatggcatgaccttgaagctataaacaaaactcagcagggcccctggtgcttaattggggacttcaacaatgtccttaaaactaatgacagggtagggggcaaaatggtgtgtgagaaagagtacaaagatttgcgtaccatgatggacaacactgggcttgctgaaatggatagtaaaggggattactacacctggagtaataagcaaagtgagaacattatctattctaggattgacagaatccttggtaatacggagtggtttagcaagaacttgaatctcagccttactaacatgacaccggggatctcagaccatgccatgctctgtctgagagatgacagtgttcctgttaagaggaaggccagatttaagtatgcgaattgtgtgagtggcatggataacttcactgaaactgtagctaacagctggaattctgctagaaggggagggccgcctatgaaaatgttatggcataaactcaagaagcttcagcctgtgattaacaatttgagcaaacctttgattggcattaaagttaagctgcaggaggctagagaaaagctcactcatgctcagatggagctaactttagacagactaaacaaagacaaaatagacagaaccaacgactgcactgaagcagtcattaagtggactgagatggaagaacagatgttgcagcagagagccaaaattcgttggcttaggcttggggatggcaacaatgcctatttccacgcctctcttaaagccaagtacaaccaaacgtccatcaagaagctgtacatgaatgatgggaattttgttaccactcaaaaagagattgaggatgaaattatgcggttctatggggatcttatggggagagaggagcctaatttggacagtgtggatatcaatataatgagaaaaggctgccagctgaattttgaccaaaggaagtatcttattggtagaattactgatgaggagattgacaaagcgctcaagagcataggggatcttaaggcgcccgggattgatggctacggggcaaaattcttcaaggatgcctggagcatcattaaaagtgattttacagatgctattagggagttctttgaaaaaggaaagatgtatgagcccatcaacactagcttggttatccttatccccaaaaaccaggaggcaaagtatgctcgtgactatagaccgatttcgtgctgcacaacgatatacaaggtaatctctaaagtgttaactaccaggctgagtagagtcataaagagtattgtccatcagagtcaagcagcgtttgttccgggccagaaaatccatgaccaaatcctgcttgcgtacgagttaatccaggggtacgagcgtaaatga

SEQ ID NO: 78399 - DNA, 354 bp, Glycine max
  Peptide Sequence Number=SeqID_195177
atgaggtgtggtgtggtgcgttctgtggaaggaagattccgatgggtagaagagattgaatgcacttggaaagcaccacctacaaatgctgctgtccaagctatagatgtttctattttgaaggataaaggaacgcggtatgctgcggaatttcgtgaccatgagggccaggtgctcgctgttgcaacgaagaattgcactcaatgttatatgctgcaacaattgtggaggcattgtgtttcaactttcaagtctgcagaattatccttacaacaggtgatgtatgagactggtacaagagtgggaaaaagaagcaatgcaggccacgaaatcatctcactgcggaatatttga

SEQ ID NO: 78400 - DNA, 541 bp, Glycine max
  Peptide Sequence Number=SeqID_195178
atggccactttcaatggcttcgtcgacggcactccctcggaatctgcattgatctttctcggcaccggttgttcgagcatggttcccaacctcatgtgcctccttcagccttccgaccctccctgccccgtctgcgtccagtcattgtccatccctcccgaacgaaaccctaattacaggtgcaatacgtctctcctaattgactacggcgccgccgccgccaacggtggcgatcgcaagtatatattgatcgatgtcggcaagacgttcagggagaccgtgcttagcatagcagagaagtttccttatttggttcagaaaaagcgcaaggaaggagcagaaatacgaagggtggctcaaattgactggaacattattgcggatgactgcaatcaacagttttttgcgtcgggattaaaattcactcctttaccagttatgcatggagaggattacatctgtttgggctttctttttggtgagaaaaacagggtggcttatatatctgatgtttcccggtttcctgctagtacagagtatg

SEQ ID NO: 78401 - DNA, 1119 bp, Glycine max
  Peptide Sequence Number=SeqID_195179
atggaatatctgcacagatccctccaagagttaagatatacccctgactttaactttcatgctaagtgcgagaagttaaacatcattagcctcagttttgcagatgacgttctaatgtttactaaaggggataagatttctgttgatctacttatgcaggctttcatgaatttttctaaatctaccgaccttgtgataaacccttccaagtgcaaagtgtattttggtgcagtggaaagttgcataaaagaggagattaaacacatcactgcatttcaggagggatctctcccattcagataccttggtgtccctctcacggggaaaaaattatcggttaaccattatatgagcttaatcgataaaattgttgctagaattactcattggagcgccaagttacttagttatgcaggtaggcttcaactcattcggagcaccacctatgctataactaactattggatgacttgtttcccattccctaagaaagtgattcaaaaaatcaatgtcatctgtcgatcatttctctggactggtggaactactatctctaggaaatcccccatctcttggaagcaggtttgtaccccaaagaatcaaggaggtcttaacttgattaatctggaaatctggaatgcagtaaccatgattaagcttctttggaatgtgtgcagtaagaaggacagtctatggattaagtggataaattgttattatatgaaaaatggcgacgtgatgtcaatgggaataaaagattcttgctcttggattttaaaaggtattctgaagcagagacaaaagattcaatctcttactagctggagtactttgttgcaaaaggatagatttgtgtcgaagataatgtacaatgaattgcaggatgtttccagtagagttccttggaggaaattatttttctccaacctggctagaccccgtgcaaagtttgttttctggactgcctatcatggcagacttgccactaaggttagaatgatgaaatttgagctacttagtgataccaaatgtaacttctgtgatcatcttgaaacaattgaccacctcctgtttgaatgtgctgaaatgaaggatgtttggattcagatcttggaatga

SEQ ID NO: 78402 - DNA, 321 bp, Glycine max
  Peptide Sequence Number=SeqID_195180
atgatcgaccctctcaatgagtcaatctcttgctttctcataagggtggacccttggagggctactcgccctcgcctttgtagcgctacacgccctcgcctttgtaggactacacgtcctcaccttcagaggactacacgtcctcgccttcaaagggtcatgtaccttcaccttcagaggactacacgtcctcgcctccagaggactacatgtcctcgccttcagaggactacacgtcctcgccttcagagggctacacgccctcaccctcagaggactacacgtcctcaccttcagaggactgcgtgtcctcgcctttag

SEQ ID NO: 78403 - DNA, 348 bp, Glycine max
  Peptide Sequence Number=SeqID_195181
atgaaacatcccttttcaatgcaccctctaatggttagaaagggtagaattgttaaacacaaggatttttacatagaacatttgacttcacctgcaaaacaaaaactgggggggcttgacaaattcccagcccttatacttttccaagctggggagcttgacaaactcgcagccctcatacttgtcctggctagggggcttgacaaacttgcgaccctcttacttgtcagggctactaccctcgacaccaagcaacctctttcgccaacaagttggctcgaagcttggggggcttatgtactatccggggtccacaaaatgaacatggcaagtgatgtggtgctctaa

SEQ ID NO: 78404 - DNA, 1197 bp, Glycine max
  Peptide Sequence Number=SeqID_195182
ggaactgagattcaacttggtcttgcggtggaaagtcagaaggcaactttgtctgtgaagaggaggttggcatgtgaacagctgatttactttactcaggcttatcactgcttgtcaggatgcgacatcaaccaagggcatggaaggaagcaaattcgatttatcaaatggaagttccttgaagccaaggctgcagcctactactaccatggtctgatccttgacaagggtagtgaaccaagcatccacattggttctgtgtcttgttttcttgctgcagaagagcttctggctgaaagcaagaaggcctgcttaagcttttgtcttgcacctccagtgacaagggctcctccactctggggtgctatgaaatttttacaccagaaaattcctgaagttgcatcaaggaagtcccagatgtatggttacctctgggagcaagagaacttggcggaggctcgggaaagggaagaaacattacccactacactttcagagaaggagaaaagtgcagtaaccatctggttaaaattggagaacctgtacatgaccaagtccttggccaatcgtctattcttgaagtataaactctacattttcaagatgatgcctagaaaaactcttgaagattacattgatgatttcaataagatcattcttgatctagagaacattgaaatcaagatggatgaaaaggaccaagcattgcttttgctacgatcattaccaattcccttatgtgattgctcatggctcattggtgtaaatctccccggtgtttactcccctcatttccccaacagatgggatctctcttggaaaccgaagttgacatcgagactgaatttggaactgagtctgatactagataggaaagacatgggagcaactagcaagatcataaggctgctagaacactctttcattactcagcaggaatatgttgaaaagatgttgatgaggtttaacatggaaaattgtaaggaggttctcattcttttagcacaacatttcaaactttcagccaaagattcacctaacacagatgaagaggtagctaagatggaaaatgtcccatatgtgagtgttgtggggagcctcatgtatgctatgatatacacacgatctgatttagcttatgccttaagtgtggttagcagacacatgggcaaaccagaaaacaacactaggaggtag

SEQ ID NO: 78405 - DNA, 1017 bp, Glycine max
  Peptide Sequence Number=SeqID_195183
atgagttacaaaggaggtgcagttactgtcactgatcattatttggtcagctctcctcctctggactttttggtatttagggtggaaggaattcggggaaacgaggaggttaaaattgtgattttgtcagctatagcttcttgggcagttagatctactgatatcattcaagagagtttggtttcctttttagtttctggcctcaaagagaaggaaactttaagaaagggttttctgcgcagtctacatgctatatgcaaaaatgaagatgctatcttaaagatgttaccattgtttggccctcttgtccaacttgttaaaactggctttacaaaggcagtgcaacgtttagatggcatgtatgcattgttactagtcgtgacgatagctgctgttgatattaaagctgaggaaacattggtaaaggaaaagatatgggctctgatatcacaaaatgaaccttcggtcgtgccaatttctatggtgattactcaactaaaaattgtaaatagtattacccaggcttcaaagctatcaattgaggatagcatggcatgtgttgatctgcttgaagtgcttcttgtggaacatttgcaacgtacattgtccaacttctcggtcagattgatgttgcagttaatgatctcttttatgtgtcatccaagatgggatattcgaagaatgacttatgatgttgctaggaagattatcacatctgctccacagttatctgaagatctatttttggaattttcaaagtaccttactttgattggagagaaacatttagctttaaaaataagtgatactgatatttctttggaccctcaagttctgttcattccatctgttgaggtgttggtaaaggctctgcttattatgtcaccagcagctctgaaacatgctccagaatcatttttcagaataatactttgctcacatcacccatgtgtagttggtggtgcaaaaagagatgcagtgtggaaggaagttactcaagtgagaacatttagttga

SEQ ID NO: 78406 - DNA, 486 bp, Glycine max
  Peptide Sequence Number=SeqID_195184
atggggtgcacttactctgtgtataggaagaaaaaatcaagcttccctgaagtggtggtctttgttccatcaacaagaattccggttcaatctgatctccaaaggatggtcaagggtgtaattccaagggatcttgctgataaattaacttcactaaggaatcagatagtgttgattgcagaggatactggtgggtcagctatagctgaattgcggcgagctttgaaagaatatttgtctgttctgattggacttacaaagaaagagtatggtcctgaaggactaatagatttcaagtggaaaaatttagaagatgggagacaagatagcagtatatcaaatacctggtttgaggtgctatcttcagttcaccttatggctatgctgacactctctgacgctgactcactgatgattccaaaggatccctcagggtctggattcagggttgtatcttcaggttttgtgccaatccacaagctttag

SEQ ID NO: 78407 - DNA, 237 bp, Glycine max
  Peptide Sequence Number=SeqID_195185
atggaggaggactttctattttttgagcaacaaccatcttatttggatccagggttgcttttttatgttttacgagttgaaactcctaaagtatctgttatgcaggcacctcctttctccgttggcagcgatcgaccctttttcacagtaacagatgctggattaaagttcgacgggcaatttgggggaaagaaggtggagttgaaagagagaaagggcaatatagggatattttaa

SEQ ID NO: 78408 - DNA, 489 bp, Glycine max
  Peptide Sequence Number=SeqID_195186
atggaggagaaagagcacacacgaaaattgaagaacaaaggaaagggtagcacactggaggagaagctcaggaatttggggaggagaagctttgtacgtttgaaatcagaaaaagtaaatgctcaacgttcaaaagcaacgttaaaaagcattgttcttctgcatgcaagccctagctcctggaacactgcaaccttagctcctgcacccctgcaacactgcactctagcaacctgcaacactgcaacgctgggcagcagcagcgacacaccctccacgtcaggccaagtcagcatgcttctcgccattgttgttggcggttcctacgtggaatgcatcttgcccgtgacaatggcggcaccctctaggtcagtaaccttctcgccatcgtcaatggcgacatcagtggtctcgtcattccttccggcgacacccatgaaaaaagagactccctccgttaatacttccagaagggaccctctttggtaa

SEQ ID NO: 78409 - DNA, 459 bp, Glycine max
  Peptide Sequence Number=SeqID_195187
atgcatcatgtaggcgagaaaattgggtcagaacccacattgccgtatctaagtcgcgagctcgatggagagaggctactcgttggtgccaattttgcttctgcggggataggaattctcaatgacactggaattcagtttataaacataattcgaatcaccagacaattacagtactttgagcagtatcaacaaagggtgagcgcactaattggaccagagcagactcaacgactggtcaaccaagcactagtcctcataaccttaggtggcaatgattttgttaacaactattacctggtgccattctctgcaagatcacgccaatttgcacttccaaactatgttgtataccttatttccgagtatcgcaaaattcttgtggtattgctatcctttacttctttttctgttgctgttatatgttatactactattattagtattatccctttttaa

SEQ ID NO: 78410 - DNA, 276 bp, Glycine max
  Peptide Sequence Number=SeqID_195188
atggcgcacggtggtgtttgtgcgacaaaggtgtcatggtcacctgcacaggatggcccgtgcaaatctgtgagacagataactatgcgcgacaaaggggggaggtggcgacgcacgcaggttgtggtgggtgagggtggcgcgatggaggttacgcctctgctttgcaatgttgtgagaagcaacgttttgttcgaggaagggggtggaggagaagtgggtgcattagagaagatgaatgtgattaaattacaaggattgccaccatgtttttag

SEQ ID NO: 78411 - DNA, 1992 bp, Glycine max
  Peptide Sequence Number=SeqID_195189
atgacggagtcaacccaattcataatgcgcaatcttggagtaatgggattcatgttctttcttttcatgtatggtgtgaggatggatccaacacttttaagaaaatcaggaaaattgcacgtatcaactgcattcataagcataacaatccccatggtgacagcgtttgttgtggcactatgcatgagaaaaaacatggacaaagaaatggccttgattccttcactaggatcaatatcaggttacttggggatcacagcattccctgttctctaccacatcctcaaagagtttaaccttctaaactcagacatgggtcgaagtgcactgtccatagcattaattggtgactcatttggtatgctttgtatcatggcatttgaggcatcaagtcaaggagaaactaagatgatcaataccttatggcccgctatgatatggatcaataacaatactccagaagggcaccctgtgcaacagtcctttgtggttgcaatttttctaggggctcttgtaatgggcttcttaactgacatgtttggcatagcaattgctaatgggccagtgtttttgggcctggtaattccagatgggcctcgtgtgggagcaacaattgtacaaaagaccgaaacaattatggctgatattcttctaccattctcattcattatggtgggatcatacactgatttctatgccatgagtgcttctggttggtccagcttagaaccattgattgtcatggttattactggctacgttctcaaattcttttccacttggattgttctacatttctggcgaatgcctctcagagagggactaacccttagcctcactttgagcttaagaggccatattgaacttatattgtttgtgcattggatggacaaaaatatcttacatattccagacttcacattattggttcttatgacaacaatactgacagcaacattcgctcctttgataaacatattatatgatccaacaaagccatacatggtgaaccaaagaaggaccattcaacacaaccctccagatgaagagcttagaatagtgttatgtattcttgacactgaaaccataaatggtttcatccgtttgcttgatatctcaaatccaaactcaagcagccccttatctatttctgttgttagactagctgagcttgtagcacgtgccaaccctttgttcttagaccatgaaaagcaacgagtgcctccaaattatcaatggacaaacaccataaatgccctcacacagcatcagcaacacaaaggaatgttaatgaagctccatttcttcacagctgtgactccaaagcagacaatgttcagagacatatgtgagcttgccctagaacaagaggcttctttgatcatcttacctttcaaatcttcttctgatgttcacaaccactcagtgaattcacaagtcttgaacactgcaccttgctcagttgcaatttttgttgataaggggcttccagatatcaacaacataggcagtagtagtacttcctttcgtcgaagccagtatcgattcgccgtgttgtttcttggtggtggagatgctagagaggctcttgtttatgcagataggatggttgctaaccaagatgtgtccctcacagttataagatttctctctcgcaactttaaagggtacaatgaaattgagaagaagcttgatgatggaattgtgacttggttttgggttaagaatgagattaatcaaagagtggtgtatagagaggtgctggttagtaatggagaagaaacaattgaagaaattcaagccatgaatgatggtgcttttgatcttttgattgtgggaagaaaacatggaataaacccaattcttctcactgggttatcagaatggagtgaaagtgacgagttgggactcataggagactatgtttcctctgcagatttttttggctcagcttctgttttagttgttcaacaacaaatcttaagaggctaa

SEQ ID NO: 78412 - DNA, 342 bp, Glycine max
  Peptide Sequence Number=SeqID_195190
atggtgtttacaggattggctagacagtcctccataggaaaatccgcctacaatggtgttgatgactccctcaatctattgagcagtgtttggttctgtctaacccaggtctgggaggaagtgtcaaacactttttttcatagattgtctacgaacttaccaggccgtaaggcaagtagcatggactgtagtgcaacttcaaggttcagattcctgatttggacaacaattcatccaaacatgtccatgaacttatggagtgattcatcatctgcctgctgcaaactagttagggcgcagaagttatacgatatgatcggctggttgcatactaagagctga

SEQ ID NO: 78413 - DNA, 216 bp, Glycine max
  Peptide Sequence Number=SeqID_195191
atggtagtaggtcagtataaggcattggtattgggtgaattcggatggctttcattccgggaagttactcctcaggtttgtgtttgtgttgggattggcgtttctgattggtcgagactatgtgggaaacaaattatgtgggggaggcctttgtggttgagtgggcaatctttgttggatgggcggcggattgggaggggttccgatattggctga

SEQ ID NO: 78414 - DNA, 330 bp, Glycine max
  Peptide Sequence Number=SeqID_195192
atgaggatgtcgaacaaagatgaagcttgtggcacactttcgaggtcacgacagagggaaggaggtgacgatggagcttgtggcacactatgtaggtcaccagaaaatgcacatcttcaacaagctgtagtatttcccggttcatttagcgttgcccctcttctcccccaaaggcctctcctccctctcctcaagttgctaacctctaattcatcttatgtggaattcctctcatgctctcaatatgctcgcacctctctctttgctcctcaagccgcaacctctttcacctcttattgggaaaaatccaagtctcatattcaagattaa

SEQ ID NO: 78415 - DNA, 423 bp, Glycine max
  Peptide Sequence Number=SeqID_195193
atggaggacgacggttccaactcgacccgccgcatgtcaagccgaacgcgaaaagcggcacttgcgcgcttggatgcattggagaatgacaatgcaggttttgaaattgcagatgccaataatgatgacgatgatgcttctctagacgaggaggatcaattttatatacagaaaaagcagtctaaaggcaccaaaaggaaaaccaggcaggcaaaagcacttgaagctagaagggccccaagaacgttccttgagctcttacatgaggctaacttagaatcattgcctcctcatgtgccatcctattggaaagctgcagttgggcctccaagctcaagctcccgttgccacttctgtaccgtttgtgctttttctgctaattacacttatgtcaaaatgtgcacaatgatacccgttgcttga

SEQ ID NO: 78416 - DNA, 207 bp, Glycine max
  Peptide Sequence Number=SeqID_195194
atgtcggaaacaaggcttcaaggcatgtcatggagttgttcaacaatatccatgaaaaggactgctactgtgagggaggaggtctggaagagggctgaagaattggagcagcacgctcaacgcgaggagccaacttggaggccaggcttagcccgcatctggcagcttagcgcgcatttgtggcttagcctgcatcttgcggcttag

SEQ ID NO: 78417 - DNA, 319 bp, Glycine max
  Peptide Sequence Number=SeqID_195195
atggtgtcatctcacggcatggaaccagtttcagccaaggttgaggctattatccagtggcccactccacactctcagagagcattacgggatgcctctgtcgtcgaaatgggtgtcgtgttatcacaacaaggccacccaatcgcatttttcattaaacctttcagccccaagctgcttcttgccttaacctatgtccataagttttttgcgataacgggggccgtgaggaaatggtgccaatactttttgggtcattcattcacgatacttacagatcacaagagccttaaagaactcattgttggactattggcaa

SEQ ID NO: 78418 - DNA, 1260 bp, Glycine max
  Peptide Sequence Number=SeqID_195196
atggtaattgaatttgtccagttcaaagataggttgcaacactctagtcagtatctagtggctcgagttgaaacacccattttacaactaaagcagaatgcagataacattgaagaagaggagggtatccttcaaaacttgaaatgtggtattcacttccttgagctgtctaaggaggtagggtcaaagtctttgaccttcaatgaagacttgcagtcacggccctggtggacaccaacttcagagaaaaattaccttttagggccatttgaagggatttcttattatcctagagaaatattgaccaaagatagggaaacaagtctaaagagagtcattgaaaagaaatccctacttccacggatgatctatctttcgattaaaagtgcttcagcatcaatcaaggagcatgttgaggtcaatggttctgttaccccagacatcacttcagagctgaaattgttgctggagtgctatgcacagtttttgggcttttctctcactgaagcaatagaagtggtcatgggtttttctaatggtgaaagttcttgtgtggtttctgactccaacttgattgactggttgaatttcactgtatttttaaatgcatggagcttgagttcccatgaacttgtgcagccagacggaaatggatgtaggcctcgaatttggaatatcttagattctatgctggagaagtatattttagagaatgttaagtctatagagcctcagctctgctctccttggagtgtcatggaacttctgatgcagttagttacagaacctttggcgtggcatggactcgtaatccagtcttgtctgagatcctgttttccatctggtaaaaagaaaaagaaaagcggatcagcttatcagtctagtgcgaatctggctcatgcaatcacagattctgtcatgcatttatttcatgtgttagaggttgttttgaaatggataactgaatggaacaaaagacctgaagatgagcatctggagaacattcttttgcttcttcggagagatgggcataatgatggaccggggaaggtctttcacattttagaaacattcatttcctctgtgaatgatgtggaactcggtgaccgcatctcccaatctctcaagtcttggagtcctgctgacgttgccaggaaaatgatgactgggaagctaaaagtactgacggaattttctgccatctgtgggtcaaaattgaagctatttaagtctatgaaacagcagatagctcaactgtga

SEQ ID NO: 78419 - DNA, 486 bp, Glycine max
  Peptide Sequence Number=SeqID_195197
atggtttgtccggaaggcagtcttctggatatcatcttcattaatcaaaatctaatgatagccctacaagaaatcgagtttggagaaccagtgcacacgacccaattcgtcaaggagttgatcaattgtcggaatgggaaaacggtctttgatggttatcacattgagtgtgtgataatcaacacaaactgccaagtgttgtcgcgcttcttaaccagaagaacacgggaagagaatggattgttagttggtcgagatggaggtagtgttgtaggagtttggaatagggtggcaaattgggtaatgagggtcgagattttgggtggtagggacagggagaggaaaattgatgcaaaaactggaagaaaaagccttgaagaaaagttagaagaattgaacagttcgcttagcacgcacctgcgcttagcgagcgacctcaggcttagtgcaaagaaggcccacgaagaagccctaaggcatgcttag

SEQ ID NO: 78420 - DNA, 270 bp, Glycine max
  Peptide Sequence Number=SeqID_195198
atggcgtgggtgttgctggatagggagttttgccccaaaaagtttcaattttttagaacaagcacattcacggctgatatcaaattgcgaatacagaaaaagttgcaagttccagatgtggagttttcaaagagaagggatatatatggtgcttgggagcaatatcttggactggaacacgatgacaatgctccaaaaaagtcctatgcagtcaaccaggtggatgtgcaactggaggtgcaatatcaacaaaagctttgtgctagctga

SEQ ID NO: 78421 - DNA, 1566 bp, Glycine max
  Peptide Sequence Number=SeqID_195199
atgggacggaatcggggatacccaatacccgacgggtatggggatggtacaataaacttaaacccgtcggatattaggtacggatacggagatatattgggaagtcgggataaggaattggggaaacaatacccgtacccgtcccgccccgcctcattgtcatgtctagatatgtatagatattgttgtgagagttttccaagagagaatgtaaagattacatatgtggcctcttcaagaacggtgaggattacaggagaaagaccacttcaaggcaacaaatggcacaaaatggaccaatcatatcccattcctgactattgtgagcctgaggcacttcagggcaagtttgagattccaattctcacccttacaatgccaaagaagatcacttctcaagttgctcctaaacaacaagaagtgggaacatcccaagagaaaggtgaagcaaagcccacagaaaatgtacaagacaccactccaccacaacctacaataactactagtaaagtggaagaaccaattgaagagaagaaaagtgttttaccaccaagccctgacttaaaggcacaacaaaaaaaggattctcaaatcctttcagaaccaattaaggatcaaaagctgaaagaggaattggtgccaaaaccaacaccaccaccaagggtagcgacaatgcaaacatatgaaaagtctcaaaagggtcaagaggttgttgagtcaaaaccaacaacaacaatgctaaccaaggtcaaaacagctgaaagatcacaaaaaggtgaagaggaatttgaatcaaaatcaaaaccaacaatgttgacaaaagtcaaaacagctgaaagagcccaaaagggtgaagaggagtttgaagcaaaaccaacagcaacaatgctgaccaaagtcaacacagctgaaaggcctcagaagggtgaagaggaatttgaagcaaaaccaacaccaacaataataaccaaagtcaaaacatctgaaagaccccaaaaggatgaagaggaatttgaagcaaaatcgacaccaacaatgctaaccaaagtcaaaacatctgaaggaccccaaaagggtgaagaggaacgtgagtcaagacctgcaataacaaatgttactagaaagctatcagttaaggagcaatgggaggaaaataagtcaaaggaaaaaagtgttgaagatgtagagaaggaaaggatctcaaagaaggaagttaaagacgaaccttctgagttaacaaagcccgagaaagataaggaggaggaggaggattttgaagagaaagaaaccaagacagagaaattattagccaaggaagcagaaagttctgtcccaaaagttcagaagaaaaaggaaaaacaatccagcagcagaagtgattccaaaagggaagggaagagtgaagagaatgcaatggaaaaggtgggtcctatgtcccaggttttcaccaaaatagcagaagggatattaaatgaggaagagaaaaaaatagttgcaaatattggtgctgctgttctggtcattactgcattgggatactatgtatcttataggtttgcctcttga

SEQ ID NO: 78422 - DNA, 312 bp, Glycine max
  Peptide Sequence Number=SeqID_195200
atgctgaacgaactcaaagccatcgcctccacaccacatgtcaagataaaatttccaaccttgatgggagagatcataactatcaaggaagaccagaagcaggcccgacaatgctatgttgaaagcttaaagccttatctcacatctggtggtagcagtcaagtcatgagcatggacgacgggtccccaatccgaaccccgacaatttacaaagcaagtatgggagatcaagataacatattcgatgtggatttgcgtgacgacaccattaacaaaggcccaaagcctattgaggaacttgtcaagctatag

SEQ ID NO: 78423 - DNA, 174 bp, Glycine max
  Peptide Sequence Number=SeqID_195201
atgaggccaaggaaagcgtgcaaagtagaagctcaatgtggaggaggccaagaggcaatagcctgcaacttctcatggtcaacgatgacacaagtaggtggtctaaatgagtggatggatccaggctatagatatggggggatatcactaaaacacaccaagacaaatttgtga

SEQ ID NO: 78424 - DNA, 321 bp, Glycine max
  Peptide Sequence Number=SeqID_195202
atggctagagaggcgaggaaggaagcaccatctgtgcctgtgaaggatatcccatactctttggtgccttccaagaagaaaaaagagcggtattttgcttgcttcctggacattttcaagaagctggagacaatacctgatggagatggtgttggtggcaacaaaagtgatggggtggtggtggtggttgtggggatgacaatggcagtgagtggtggcacgaaggtagtggtggtgacaacgctggtaaaggtggtggtggttgatatgatggaaatggtggcgacgatgacggtggtggtgaagactgatttattttaa

SEQ ID NO: 78425 - DNA, 171 bp, Glycine max
  Peptide Sequence Number=SeqID_195203
atggccattgcaagggaggtggcagcagtgactcgccttggcattgagtgggatggagctggacaggagcgattcaagactataacaagcagttattatagaggaggggataccaaagataccagtagatcatcagagaaaaattcaattgaagaagagattgaaacttaa

SEQ ID NO: 78426 - DNA, 147 bp, Glycine max
  Peptide Sequence Number=SeqID_195204
atgagtgctcctcaaagacaggatgaggggtggacaccatcggtgcctcaatcttcgggttcaatgagacaaagtctacctctgaagtcttacctcacatacaagaaggaaagcactagagaccaggttaacaaatcaaagaattaa

SEQ ID NO: 78427 - DNA, 621 bp, Glycine max
  Peptide Sequence Number=SeqID_195205
ttgagattgtctgctatcagacaaccattgatattgcagtttaaagctgccttccattgtgacaaggacgccatagaaataccaggcttctatcagcaccaatggctaccaaattatcttgaaattgttgaatttaagtatgatggggaaacctacgaaattcaagtcagacaacacaaaggcaaactttactttgctgatggcctaacaagattgaggacagaactgcagatttatgaatctgtcacgataaatttcctggcctgcgaccaccctgcaaaatttgacctccacttcactccaccattagaccagcagaaatgcaaaaggcgtcgtgcaacaagaaaacacatctggacatatgaaatcacccaatcaatgctaggcgcaccatatccactgcaactttcaacctctgtcacacaatgcctaatccactgtggtgatcatatgacaattctcagaagattcggacctccactgcaatggaatgtagttgtgctcgacaaaggcatcggtgacaagtatgtcactctcccttggtacaaattccttcaagaaggtgattttagccatggagacgagctctcattctattataggcgtgctgagaagatctag

SEQ ID NO: 78428 - DNA, 318 bp, Glycine max
  Peptide Sequence Number=SeqID_195206
atgaaaaagaaaaaaagaaggttgatgaggagaaaaagaagagcaagagataaagagcgacacttagctagatttcttgacatcttcaagaagctggagatcactttgccttttggagaagctctcaaacagatgccactctatgccaaatttttaaaagacatgctgacaaagaagaatcggtacatacacagtgacataatagttgtggaaggaaattgtagtgttgtcattcaacgcatccttcccccgaagcacaaagatcctggaagtgtcactataccatgtgatgtgagattattttctcctatttcttaa

SEQ ID NO: 78429 - DNA, 318 bp, Glycine max
  Peptide Sequence Number=SeqID_195207
atgaaggattggggaaattttctccaccgattacaacgttcttcttggtgtggaggttcaacggcaagcaacggtagctcgtggtggccatcagtggtcatgggtggtgaagaaggaggtgttaggatttgggtggcatttggagaggaagagaggggaaaaatcgtgtttttcacgctgaaaaacggggctaatgctcgctcagcgcaattccctcttgggttcaaattgtgcttagcgcgcccctcgcgcttagagagacataaaaagttgttattttcaaaatcccaacggtcagtcgttgaaaaattgtcttag

SEQ ID NO: 78430 - DNA, 792 bp, Glycine max
  Peptide Sequence Number=SeqID_195208
atgcctctatcaccttcctgggcaccatcacatattgtgatcccacccccaattttgcttggcgaggagggaggtgtggtggtatttgaggcctttccaccaaccgtattgatagtcgagggaggtgctcatccaacgcaggcgaacttggtggctccgcggcgggggagggcgatggtgggagtagtggaggacctgaaggagatagctcttgtcgacggtggaatgggtgtggttgtctacagaggcatccacgatggaatgcaccttggatcacatgaggaggagttttccaatgtgcttcactcccaaccttcttcgaccccttcatctaagaacactgctgctggcacggttcctcagtcgaataccacagacagagccacggagttcgaactgagctttgtttgtttagacaaaaaggtgcaaagcttcatggaagagtcgctgaacttgggttctagtcaatggaagggtgcggaaaatcaaaccatggaggcgaaagttcataacgacggcacaatgtctcgtcgccaagtgccccacgtgccatcctctatctttaaccagctcggctacgcttgtggcgttgttccccttgaaaaccccttaagtgtcgttgttcattatggttatgcaacagctccgcatgacaagcttttggagcatagaggcatggcacgacttgagaggggagttgagtcctatggctctgccatggttgcacgcgagcgccaaccagctgcttttgcatcattaggaacggctacaaacccaaaggagccttgctag

SEQ ID NO: 78431 - DNA, 217 bp, Glycine max
  Peptide Sequence Number=SeqID_195209
atggttggttgtggtttccagggtaacaacgcggttaatgaggtcatcgagcttctcagtgagatgaaggtgtctcgaagcaagcttggtgatagcctcttctatacgatccatattagtcttggagcggagcaatcagaggaaaaaattgaggaatctcaggaacatgctaaagatgccgctattgctgtcggaagacacgtgagcttgcttatgg

SEQ ID NO: 78432 - DNA, 660 bp, Glycine max
  Peptide Sequence Number=SeqID_195210
atgggagtggaggaagaagaagaaaatggatgccatggagatgagaaggaggaggaaggtggatttgactatgcgaggattgagactgggaattcgaggatttttacaagcaattatggattcctctctaggcactatgcagcaagcaattatggattcctctctaggcactatgcaacttggacttcacgcctgacgttcgattcgaggctagagatgaagaaactcaagagtgaaaaaggcgacaaccccaggagtcctgttggatcctcatatggggactgtgcgaagcgagcttctatagcttgcaaaaagccaaaccatgctggatctttgagcttcaatggtgatttttcaccatggagatgcagcggaaggcaaaggagaataggagatgggagacaccatccacaagggaataagccatggaagaaagagcttcaccaccaagaatgtgcctcgaataagaagcttgaagaagatgctttaatggaggaaaagaaagagagaaggggggagcacaaaattgaaggaataaaagagggagagaagtggaactttgaagtgtgtctcataagactttcattcatcaaagttacaacaagtgttacacatgcttctatttatagattaggtagcttccttgagaagctttcttga

SEQ ID NO: 78433 - DNA, 264 bp, Glycine max
  Peptide Sequence Number=SeqID_195211
atgtcgatgaggataccaccggagcgaatggcagagaaggtgcaggcggtggaggaggatggagaagaggtcagagaggtagctgacaatggagaagatgacgttagagcgagcaacaatgatgtgggggttgagaagtgggttccaaggtcgaggagtgataacaacctaacttctctcaaatttgaaatggtgacaagttggttcagttcgttcttggaagggagtgctgagacagttgcaaaagagtggtgggaaagttga

SEQ ID NO: 78434 - DNA, 402 bp, Glycine max
  Peptide Sequence Number=SeqID_195212
atgtttgggtttggctatgatccgtcaagtgacaaatacaaggttgtagcaattgcattgactatgctttcacttgacgtatctcaaaagactgagataaaagtttatagcacgggtgacagtagttggagaaaccttaaaggttttcctgttctttggactttacctaaagttggtggagtgtatccgagtggaacccttaattgggttgttattaagggaaaagaaaccattcattctgaaatcgtaattatttctgttgacctggagaaggagacttgcagatcactgtttcttcccgacgatttttgctttgttgatacaaatattggagcttttagagactcgctgtgcgtttggcaagatagcaacacccatcttggcttgtggcagatgaaggaa

SEQ ID NO: 78435 - DNA, 321 bp, Glycine max
  Peptide Sequence Number=SeqID_195213
atgaaggccgacatggaggccatgaaagagcaaatggccacaatgatggaggccatgataagcatgaagaagataatggaagccaatgcggttatagttgccgctactagcgctgtcgctaaggtgaacccgatgctcccatctggcctcaagcaaatgaatcatccaacctcaattatggcacatatctctcaaaccatgggggagacacatgaaattccccaccacaatctagccgacttcgagccttgcctcggatatgccactgaagggcaagcaattggtggtatacccctgcaaaacactttggagggcccttag

SEQ ID NO: 78436 - DNA, 198 bp, Glycine max
  Peptide Sequence Number=SeqID_195214
atggttacttacatacttcaacttgactcgatgaaccttttcgtaaaagcacgagcttggttcaaccccataacccagggaatggcaattttgatcgccaatacttcatcaacatttcatagggatgaaagactcgggaatacgcatgctatgcatggaaaatggaaaaacgcaagggtcacgcatgagcaaacatga

SEQ ID NO: 78437 - DNA, 435 bp, Glycine max
  Peptide Sequence Number=SeqID_195215
atgctgacatccaaaatctcattttatggttatgggagatttcatcagcagactctccttccccgtggagaaaacaccgagactttttcaagtctcacaagttatccagaactacgtaggtctgagttcctcattggaggatacgtaggagcaagagcctcgcttttgtcgaccacaccgccttttgtcgccatgactcaagagctggtagcccgcggagacaccttacggttatccgcacctcgtcattcagtgatcccaagtgtgattgacgagcagagaccaatatggtcatctgcaccctttccggagatgtcagcattttccgatggagacttttcaagtctcgcaagttatcaagaactacgtaggtctgaattcctcattggaggatacgtaggagcaagagccttgcttttgtcggccgccacataa

SEQ ID NO: 78438 - DNA, 243 bp, Glycine max
  Peptide Sequence Number=SeqID_195216
atggaggagaggctacacgccatcgaaggagggggaagttatggttttgccgacatgcaataccaatacaactctgacatggcgccagacaaaatgcagttggaaaacttgtccaagagagacaatgagtcattcaaagaatacgctcaaaggtggagagatctggcagctcaagtagtgcccccgatgatggagaaagatgataacaatgataacaaacacgctgccagtgttcaactatga

SEQ ID NO: 78439 - DNA, 183 bp, Glycine max
  Peptide Sequence Number=SeqID_195217
atggaggggtggtgtttgatattggatgtgttgtgggtggatgttgtggccgatttaagggtggcctttgttgttgactgggtgttcttggttggtgggtggtgggtaatgggcaggactgacattggcagagtagtgatattgctaggaagaatattggtacataggattataaggggctag

SEQ ID NO: 78440 - DNA, 276 bp, Glycine max
  Peptide Sequence Number=SeqID_195218
atggagtatatgtatatagtaaagctcgtggttgaacatgcaggatttgttacatcaaaagtagcatgttgcggtcaaggaccctacaatggtcttggactgtgcactccggcatccaacttgtgccctaaccgtgatatttatgccttttgggatccttttcatccatcagaaagggctaataggttaatcgttcaacagattttgtcaggcacctcagagtatatgtatccaatgaatcttagcaccattatggctttggattccaagaactag

SEQ ID NO: 78441 - DNA, 1140 bp, Glycine max
  Peptide Sequence Number=SeqID_195219
atggctgtacccgtcgaggaagccattgcagctctatccacattctcgctcgagatttacatggcatgtaatttgatgttgaggttccaaaataacgcatttcaggaactcgaggttttcatggatgagcaaccagaggtgcagggacctggagtgtgggtatcaactgagagaggtgcaacagaaagtccaatagagtatagcgatgtttctgcttacagactatctctatcagaggacacaaaagctctcaatcagctgaatgctcttacccaagagggaaaggagatggcatcagtgctttacacatatcgtagttgtgtcaaagcacttcctcagctacctgattctatgaagcaaagtcaagctgacttatatttggaaacatatcaagttctggatttggaaatgagtcgtctgcgtgaaattcagcgttggcaagcatctgcttcctcaaaattagctgctgacatgcaacgtttttctaggcctgaacgacgcattaatggccctacaatatctcatttgtggtctatgttgaagttgcttgatgttttggtgcaacttgatcatcttaaaaatgctaaggctagcatacctaatgacttttcatggtataaaaggactttcacacaagtcagtggtcagtggcaagacactgattcaatgagggaggaattagatgatttgcagattttcttgagcacaagatgggctattttgttgaatttgcatgttgagatgttccgtgtgaacaatgtagaggacattcttcaagttcttatagtctttgttgtagagtctttagaattggactttgcacttctctttccagagcgccacgttcttttgcgtgttttgcctgttcttgttgtcctagtgacatcatcagagaaagacagtgagtctctgtacaagagggtgaaaatcaacagactgatcaatatatttaagaatgaagcagtcattcctgcatttccagatctgcatttgtctcctgctgctatagtgaaggaattatcaacatactttccaaaattttcttcccaaactcgccttctcacccttccagcacctcatgagcttccacctcgtgaagcacaagaatatcctccaatttttatttttttttaccgataa

SEQ ID NO: 78442 - DNA, 453 bp, Glycine max
  Peptide Sequence Number=SeqID_195220
atggaatccaagaagcagtggaacgaaggagccaattcatccatctcaatggttaattatatgattgatgacaaagaaacaaaaatttcagcactgattgtggatgatgacgctatcattcgcaaaatccacaagaccatgctcgagcgcttatttaacatagaggcaaaaacggttagggatggaaaggaagcagtggatttgtgtcgttctggggaaaattttgacataattttcatggacaaagaaatgcctatcatggatggtcacgaggcgacaaaacatctacgtgctatgggtgtgaagagcatcattgtgggaatcactacccgtgctgatggaaaagataaagaggaatttctagcttcaggatcgaaccattgctttgagaagcctcttgaccaagcaaaggttgaaaaagtcttgcaagagcatggaaattttagcatttga

SEQ ID NO: 78443 - DNA, 945 bp, Glycine max
  Peptide Sequence Number=SeqID_195221
atggatttcatgcaaactgctccctggctgggcttgcttcctggagcagatggtcaaatagtaacttctcaagatggtggagacagccctgttgttagtttgtttaaatcaacagctgctgcaatggtttcataccctggctgtccatcacctacctctttccacattatgtcaaaacaagcagaagctgcagatcttttatacaaggctaacttgaacactggaagtgtgctggagtatgcacttgctttcgctagtgctgcgttggataaatattgtaataaatggagtgctgcacccaaaacgggcttcattgacatcacaatttctaaagatttctatcgaatatacagtggtctccaaattctcacagttttgggatacttggaagaatctgcccaagtgccatcaaatagtcatgaaaggctgggagattcaattgcttgggggggctgcactataatttatttgcttgggcagcagctgcattttgagctgtttgacttttcatatcagatcctcaatatcgcagaagtggaggctgcatctgttatgcaaacacataagaactcacaatttgccgtgcagggatgggaagccttattggaagcaatgaaaaaagcaaggagattaaataaccatgtattttctatgcttaaagcacgttgcccccttgaagaaaagacagcttgtgctattaagcaaagtggtgctccaatacatcgtataaaatttgataacacagtttcagcatttgaaacactgccgcagaaagatactaagtacggtgttcgatttgaacaaactgttggacaatatttggcatgctcttatggaactaggtccaatctaagttctgaaccctacgaaaaaatacagaccaaaatattgttgtcagattacagctttagtggagctcagtcagttggttacaactgtcactag

SEQ ID NO: 78444 - DNA, 1560 bp, Glycine max
  Peptide Sequence Number=SeqID_195222
atggctaatacaaacaagtcagaatctgagttacagtcctctcagcatggaggtgaagaaagcaaagcaaacatattttatccaagagcagttgccccaactgctgctcaggtgcactgcttgcagttcttaatatatgaggtggtttctggtggtaaccttaggaggccaggtggactcttcggcaatagtggctcagaaattccagttaatgatttaaaacagctggagacatttttttacaagcttggttttttccttcatattttagactactcagcaactgttgcaacattgacagatcttggtttcttatggtttagagaattctatttagagtcttcacgagtcattcagtttccaattgaatgctcccttccttggatgttggtggattgtgtacttgagtcaccgaattctggtcttctcgagagtgttctaatgccatttgacatctataatgattcagctcagcaagccttggtgttgctgaagcaacggtttttatacgatgaaattgaggctgaggtgggaaggaaggggaaacttgggagggtgaaaataagggaggggtgggaggatctttgtggtggcatccagaaaattgagtggggacagggaggaggcaggaccctcaatgagcctgcatttttatgtgttttcttttctattttgagagttgtttgtaaattcttgcctctgttgacatcagtttataccggtagcagagatgaattgcttgatccttcattcctctttgcttcggacaatgcagaaaagtatgccgtgcaacccataaggctcaatatgctgcttaaaatgactagagtgaaggtgctgggagagtgttgcctgtctaattggttcaacccaactcaacttggattagttaagatgatttctctcacactcacactcccacactcacatctgcttggaaggatgattaatttgcgaagtttgatcactgaacggatgaacaaggttttccgtgaaaatattgagtttttatttgatcgttttgagtgtcaggatctgtgtgccatagtggaattagagaagttgttggatgtcttaaaacattcccatgaactactgtctagagatctttctgtagactcttttagtctcatgttgaatgagatgcaagagaacatttcccttgtatcattttctagtcgattggcctcacagatttggtctgagatgcatagtgattttttgccaaatttcattctctgcaatactactcaacgttttatcagatcatcaagaacggttcctgttcaaaagccatctgtaccctcttctaagcctagtttctattgtggtactcaagaccaatatgccaggtgggtctgttccaagtgtagaagtattgggaaaaacccaagtctcacattggctagagatagtgccaacatagagtatataagtggaggacaagtgtcatcctatgagttagcttttggggttgacttagactcaaacccacattctaagatggtatcagagcatatcctagatccattcaaagggccacgcaccaagtttttttga

SEQ ID NO: 78445 - DNA, 135 bp, Glycine max
  Peptide Sequence Number=SeqID_195223
atgttcaaccaaccatttcaagattttcgacagtgctggatgatgactctactctccaagaatattggtgcttgctgtttttaccgagttctccactccttcgatctattagaggttaccttattcttagtctga

SEQ ID NO: 78446 - DNA, 1323 bp, Glycine max
  Peptide Sequence Number=SeqID_195224
atggccaagagggagcagcgattgagaggagtgtcggcatcggaattgaaggagaagttgcgggaattggtgaagtccatcgtggactccgacgactacacgcttgaagccgccgacgaagccatagccaccctttcttctctgaaacatttaaagtcccccatccccgacgactttcctcttcctccccaatttcgctgccccatttcaacccaattgatgtccgatcccgttatcctatccaccggccagacttacgacaggccatttattcagaggtggttgaatgagggtcacagaacatgtcctcagacacaacaggttctttctcacacaattctaactcccaattacttggtccgagacatgattctcctgtggtgtcgggaccgtggaattgacctacctaaccctgctaaggacctcgatgaagttgtcaccaatgccgatagaaaccatttgaattcgttgcttcgtaagttgcaattgtctgttcctgatcagaaagaagctgccaaggagcttcgccttttgacaaagcgaatgccttccattcgaacccttgttggggagtccagtgataccattcccctgttgctgagtccgttagctgcggcctcaactgaccctgatctccatgaggacttgatcaccacggttctcaatctctcaattcatgatgacaataagaagtcgtttgcggaggatcctgcgctgatttctctgcttattgatgccttgaaatgtggcactattcaaacaaggagtaatgctgcggctgctattttcacgttgtcggctattgattccaacaagcacatcattggagaatctggagccattaaacacttgcttgagcttttggatgagggacaaccattggccatgaaagatgctgcttcagccatatttaacctgtgtcttgtgcacgagaataaggggaggaccgttcgagatggggcggttcgggttattctcaacaagatgatggaccacatactagttgatgagttgttggctatattagcacttctctccagccatcccaaggctgttgaagaaatgggtgattttgatgccgttcctttgttattgggggttattagggagagcacatcagagagaagcaaggaaaattgtgttgcaattctgtatacaatctgttttagtgatagaacaaagttgaaggaaattagagaagaagaaaaagccaatggtacactgacaaagcttggaaaatgtggaacttcaagggcaaaaaggaaggctaatggtattcttgagaggcttaatagatccccctccttaactcacactgcttag

SEQ ID NO: 78447 - DNA, 198 bp, Glycine max
  Peptide Sequence Number=SeqID_195225
atggcctcaacaaatttcttattcccagaaggaaattccatggaacatgagatgaaattgcaaagactcaatcaaaatgaagaaagcgacaaaagaaaaagaggaatagtacgcaaagtctcattatccatccaagaaggtagcgacaacgaggacttggatgatgaagaagatgattctcaagaaatcagagactaa

SEQ ID NO: 78448 - DNA, 773 bp, Glycine max
  Peptide Sequence Number=SeqID_195226
gccgcaaaatgtctgaagtgaatgcgacccctgaaatccctcaaaacaacaccatctacatcaacaacctcaacgaaaagattaagattgatggcatgctatttgtttcttgtcttatgttgttggatgcagagttgaagaagtctttgaacgctgttttcactcagttcgggaagatacttgaggtgttagctttcaaaaccctgaagcacaaaggtcaagcttgggtggtctttgaagatgcctcttctgcttccaatgccctaaggcaaatgcaaggtttccccttctatgataagcccatgagaatacagtatgcaaagaccaagtctgatataatagcaaaagcagatggtacttttgttcctagggaaaaacgtaagaggcatgatgagaaagccaaaaagcggaaggaccaacatgattctaatttagctggaatgggcctaaatccagcttatgctggtgcttatggtgcagcacctgctatagcttatccaggtggtgcaaaatctatggtacctgaggctcctgcaccaccaaataatattctctttattcagaatcttcccaatgactcaactcccatgatgctgcaaatgctctttctccagtatcctggatttaaggaagttcgaatggttgaaacaaagccagggattgcctttgtggaatatggagatgaaatgcaatccacagtggccatgcagacactacaaggtttcaagataaccccacaaaaccctatgttgataacttatgccaagaaatag

SEQ ID NO: 78449 - DNA, 678 bp, Glycine max
  Peptide Sequence Number=SeqID_195227
atgggattgttgtccaagtccaagactatgcctaagagagaaagccacttcctaaaactagtacaccctggtggctttgtagagctacatgctaacccaatcttggcttctgaagtcatgagcaagaatcctaggcactgtgttacacgacccgacttcttccaatatccttggattgtggttagaccagaatccattctcacacccggcaacgttttctacatcgtaccttgtcacaccatccgtcataagttgaagtccacaaatttcactgctaacacccttcttcctaatcaatcttctcttgattctcacagagaagctaaaacctctaactccaacaaaattcgatgcttccaaaaacaatcctcatgcgtgaaattacccagagaggggaacaaacacagcaaaggaggtaactgggatcaatcttatgtcagagacaggcctgtttattattctagcgactacacttcacgttactcgggaaaagtaaaggcacgaagccctagtgggagattcaaccactctgagcagatccctaagctgaagccgtgcctgaagaatgataagacccacagtgctagatcgcgacgtaatcttaaagtaagatttcagtgcagtgacgacaacgccaacagcgccaatttcacaacaaaattctaccgttactcctaa

SEQ ID NO: 78450 - DNA, 1533 bp, Glycine max
  Peptide Sequence Number=SeqID_195228
atggcaacgtggggtgcgcactcaatgttgttatcccatggggaaggcactggcactcccaaagtatgtgtaaaagcaggccttacggttagaggtgatttaaggtttcacaggactagaggttttaaatatgctcctagtgtggtagtgctcaaagtgttggccaccgccagaaagccaacacggttgcgcttgttaagaccttattgcagtgtgagggggcaacacgaccatgggaaaggatatttttctcccactaattcacaaataccacggcaacatatattgaaattcgccgcggatcgaatgcttgcgtttctcaaagattggagtaatttacgcatcacggcagtagctggcatattggtatccgttttaatgatcattccaccagctgatgctgttgacgctctcaaaacttgtgcttgcttgttgaaggattgcaggatagaactggctaagtgtctttcaaacccatcttgtgcggccaatattgcttgtcttcaaacttgcaacaatagacctgatgagaccgaatgccaagttagtctcgcgctttacatcaaattcatgcctgcaccattattcatgtctccaaatcctgctcatgaagcttttattttcttcttatttttccagattaaatgtggggacctgtttgaaaacagtgtggttgatgaattcaatgaatgtgcagtatcacggaagaaatgtgtacctaagaaatctgatgtgggagaatttcctgctccaaatcctgatgtccttgttaatagctttaacattgctgagttcagtggcaagtggttcatcactagtggcttaaatcctaccttcgatacctttgactgccaattacatgaatttcacacagaatccaacaaacttgtgggtaatttgtcatggagaatacggactccagatgctggatttattactaggtccgctgagcagagatttgtacaagatccttcctatcctgggatcctttacaatcatgacaataagtaccttcactatcaagatgactggtatattttgtcatccaagattgagaataaatcagatgactacgtatttgtatactaccgaggcagaaacgatgcttgggatggttatggaggtgctgttgtatacacaaggagtgcagttttgcctgaatctatagttcctgaacttgaaaaagcatctaagagtgtgggaagagactttagcaagttcatcaggacagataacacatgcgggccagagccttccctggtggaaaggctggagaaaaaggtagaggaaggagaagagaccattgtaagggaagttgaacagatagaagaagaggtggagaaggtggggaaaacggaggcgaccttatttcagaagttggcagaagggttcaaaatgtttcaagaagacgaggaaaatttcttaagagggttatcaaaagaagaaatggagattcttgatgggcttaaaatggaagccggtgaagtagaaaagctctttggacgtgccttgccgattaggaaactaagataa

SEQ ID NO: 78451 - DNA, 1827 bp, Glycine max
  Peptide Sequence Number=SeqID_195229
atgacactatatctgctcaattccactcgtctcacggaaaaattttggttgctctgccttcaacgttacgctgcttcacaatgggctaatttaacttctgtggtggcactccccgcgtattccccacttgtatcgcctgcacccaatgatcctccacaaggtacatgtgtgctgaagttcaatacgtcccaatatgtgccatttgatgagtgcggtgatgtgaatgaggagatagacaagtggggtgacgatgggttcccgacaaccttgtgttgtcgaaatgctctgacggttttgtcgaatgcgttggcctcgcaggccctgaactcaggaggacaagtgttcatttcccaagatcagttgcagagttgtgcccagtcatttaacccacagcaaggggtatcgcttaattcatgcggctttcaaagcttgtacctaggcagttccaaatgctccaacctcgttttacaggatgttaggaaactgcaacagtaccaggatgcattggacaagtgttcccacttcgaccacccatttggtgaatcttgtgcagattgcaccggtgcaatattgagcttgagagatggtttacataatcaagtggccaacaacaacaacaaccacactgagctagccatatgtgaggtagcagctattgttgctgttgcagctgggaaaccaaacgatcctgtcgttgacaaagtcttacgctgcttgccaccttcagcttcaggatcagacaagagatctttgtggaaacccttgttgagtgtgccggtagttatccttgcaatattgcttgtggttattatggtaaaatgtttgtccaagaagaagtttcgtagacaggcaaacttgaaggagatcgtggcgtggtctggattgtactggttctgcaaaagggaaattgagaatgccatgaattatggcggtgaaaagatatgccttggacgtgggagtacagggcaggtgtatagaggtgttctgccaagtggtcaactcgtggccatcaagcatttaacaaagagtaacacctccgagtctttcactcgagaagttgaaggcctttcaaggcttcgccatcctaacctggtttgcctctttggaagttgcatagaaggggatgagagatatttagtctatgaattttgtgcaaacggaaatcttgctcaacatctcttaagaagagatagccacttgacatgggaaacaagagtaagaattttgagagattgttcatacgcactcaagtacctccaccatcatatagaaggctgtgttgtccatagagatataaagcttacgaacattcttttgaatgagaaataccaagccaaactatcagattttggactggcaaaggtgatggggattacagagagcaaggtttttactgatgttagaggaacaataggctacatggatccagagtacatgagtaatgccaagctaacctgcgctagcgatgtatacagttttggtattgttgctctacaaattctgtcaggacagaaagtcatagaattggatcttgatgccagagatcaactcactaggaaggcaagagatgtgagcatgggaaagcgtccactgtcggattttgaagacccgcgactaaatggaaaagttgataaggcagacttcgaagccatccttcagattgcagtgttgtgtgttgccaaatcaagcaaaggtcgtccaaccattgagcttgtttttgaggaattggacaaggtctgcggggacacagaaacacggatgaagcaaaagaaggatgagagctcatcaacaacatccaccccgagctccaaatcggctcctctatga

SEQ ID NO: 78452 - DNA, 1200 bp, Glycine max
  Peptide Sequence Number=SeqID_195230
atgactaataaaaaatcaaaagaatcagatgtaaagaaacaaaaggcagatgatccaaaccaatttgacacctcaaagattcaagcacaaaatttcacattccgtgagctggcaattgcaacaaagaatttccgccaagaatgtttgttgggtgaagggggctttggcagagtttataagggaacaattcctgcaaccgggcaggttgtagcagtaaagcaactcgaccgaaatggggtccaaggcagcaaggaatttctggttgaggttttgatgttaagtctcttgaaccatgacaatctggtcaaactcgctggttattgtgctgatggagatcaacgtcttttggtctatgagtttttgccagggggctgtttagaaggccgtcttcttgagaggaaaccagatgaacctgtattagattggtacagcagaatgaaaatagcatcaaatgcggcgaaaggactatggtacttgcacgacaaggccaatccttcagtcatataccgggacttgaaatccgccaacatcttgctggataatgataacaatgcaaaactatctgattatggactggccaaacttgctggtaaagataagacgaacatcgtaccaacaagagttatgggaaactatggttacagtgctccagagtacgtaagaacgggtaacctcaccctgaaatcagatgtgtacagttttggagttgtcttgctagagctcataactggacggcgtgccattgacaccacaagaccgcacgatgagcaaaatctagtttcatgggcacaacccatattcagggacccaaaaagatatccagacatggcagatccaagtctggaaaataatttcccagaaaaggatctcaaccaagttgttgcaattgcagcaatgtgcttacaggaggaaacagcagcgcgtcctttgatgagtgatgttgtaactgctctaagttttctttccaccactcctccagaggttgttcctgcagccaagagtgctgctgctcctgaaaatgaagcaggatctgttaaggacagagatagctcctcctccgatgaagggagttctagtgaagtagaggagaatgtaactgctcaaaatcagtccacaagacatcaaacagaacaaggagttctactccaaatcaagccgcaagagcagcaccagatcaaagaatggaaccgcttcttctag

SEQ ID NO: 78453 - DNA, 507 bp, Glycine max
  Peptide Sequence Number=SeqID_195231
atgaggatgttccggtggatgtgtggtaagactcgccaggataaaattagaaacgaagctattagagagagggttggagtaacgcctattgtagagaagatggtggaaaatagacttaggtggtttgggcatgtagagagaagaccggtagactctgtagtgaggagagtagaccagatggagagaagacaaacaattcaaggcagaggaagacccaaaaagactataagagaggttatcaaaaaggatctcgaacttaatgatttggatagaagtatgttgactccaaaggaagcctttcggatgatttctcataagttccatggtaaaggacctggaaaaatgaagcaagaaaagcgtatgaagcaatatcacgaagaattgaagatgaagcaaataaagagcttagatacaccatcactgtctgtggagagaatgagggaagttcaggctcgtttgcagacatcctgtgacaccctctacctcgacatatatataaataaataa

SEQ ID NO: 78454 - DNA, 819 bp, Glycine max
  Peptide Sequence Number=SeqID_195232
atggctttcacaaacaacaattcatctttgccaccacctccgcctccgccattggttccaacgctggcaccacactcccctatcttaaatttctcaccgttgaagatcacgacaacaacattgttagcgctacctatcgtttctgggagcaacatgatcaatagatcctctcttggcttcaatcaactattgcagaagcatttcttccttgcatcatcaattgcacaacctcatggcatttgtgggatcgattgcatgagcactttcaatccattgcgcatgcaaagaagaagtaattgcatagtgaacttttgctcttcttctcttgagagtcattcaattattgcttatatattgcatattcaatccctaattaattcatttgcatcaattggagacttgatttcgaggagtgctcacatcaacctgattcttgatggtttgcctgatgaatatcgcaccatttgtacttttctaaacaattcatgtgatcctctaagtctggatgatgtcactcctatgctactggctgaggaatgtagcattgaaaagtgtcacaagaagaatttgggctcgttgaattttgcagagggtttgaattccaattctacttttgaagctcagatttgtcacaaatttgggcacaaagcgtctcatttgatgagaatcatgaaactggccaaatacaggctaaaggcccaagtggagaagaacaaaggctcaagtggagaaggacaaagcccccgagtggagaaggatgaaggcccagaggcagagacactatcaagactattaattgttgctgaaggcccaagttaa

SEQ ID NO: 78455 - DNA, 777 bp, Glycine max
  Peptide Sequence Number=SeqID_195233
atgacattcgacgaggtttccatggaacacaacaagagcttcatcttcgccctgcaggaacttaagaacctgaggcctcaactctattctgctgcagactactgtgagaaatcttatctcaatagtgataaaaacaaatattatgcagcaagggcccttgttaatgctgttgatcatctaggaactgtggcttacaagttaagtgacattcttgagaagcaaacatttgatgtctcaaccatggatttgaaggtctctacgttgaatcagagacttcttacatgccatatgtacaccgataaagaaggtcttcggcaacagcagttgttggctttcattcccagacatcataagcactacattttgccaagtacccctatttcaaaaactctttcatggcatttagcatcagaaactaagtttaccttaaaaaaacaggcttcacgcacttcaaaaaatgccaaggactcaaaattttctgccaagacctctggagttttccaccttttaggtagtgaagggagtacgaggatgaaaacctcagcagcacaacctcacttggcaaatggagttcctacttctggtgctgccacccaaactttgggtgccacaagcagggatgcactgaagcgttccaaaccactgacagcatatggttcctttgatgatcgaaatggacgtgaggctgttcaagttcacactcgcagtaaaagtgtgctttctagtttccttgtcaagcaagcggcagctaagttgaaggccggttctgtcttatga

SEQ ID NO: 78456 - DNA, 2184 bp, Glycine max
  Peptide Sequence Number=SeqID_195234
atggacaagtctcacatgcccaaagttttcacctcctaccataactggtattcatccacccttatcgactctgctgccactccttccattttgtactcttacgacaatgcacttcacggcttcagcgtttccttatcacaagaacaattggagactctaaaacaaaccccaggtttcatctcagcatacagagacagagaaaccacgctggacaccacccagtcttacaccttcctctctctcaaccactcccatggcctctggcctgcttccaactacgcccaaaacgtcgtcgttggcgtcatcgattccggaatctggcctgagagcgaaagcttcaaagaccatggaatggaaactcaaactcctccgaaatggaagggaaagtgcgagggtggtcaaaactttgactcctccctatgtaactccaaactcataggcgcaacctacttcaacaaaggtcttctcgcagcgcaccaagctgacgctaccaaaattggagccgactcagttagagacaccgtgggacacgggacccacactgcatccacggtggcaggaaactacgtgaacggggcctcgtatttcggttacgctaagggcacagccagaggaattgcgccacgtgctaaaattgccgtgtacaaggttgcgtgggcacaagaagtctacgcctccgacatcctagcaggtttggacaaagccatcgccgacggagtggacgtgatttcaatctcaatggggttgaacatggcgcccttgtatgaggatcctgtagccatagccgcattctcagctatggaaaaaggagttgtggtttcagcttcagcggggaacgcaggcccgttactggggaccttacataacgggattccgtgggttttgacggttggagcgagcaacacagaacgtgttttcggggggacgttaattctggggaacgggaagaggttttcggggtggacactgttcccagcgagtgccacggtcaacggccttcctctggtttaccataagaacgtttcggcgtgtgactcttcacaactcctgtcacgtgtggcgcgagggggcgtggtcatatgcgattctgccgatgttaaccttaacgaacagatggagcacgtgactttgtctggagtgtacggagcggtgtttatatcaagcgatcccaaagtgtttgaacggagaaaaatgacgtgtcccggccttgtcattagccctcgggatggggaaaatgtgatcaaatatgcacgagggactccacgcgcttccgcgactataaagtttcaagaaacctaccttggacccaaacgggctcccacggtggccagttacagttccagaggcccgtcttcggagtgcccgtgggtattgaagcccgacgtcgtggcccctggctcgtccattttggccgcttggattccggatgtgcccgcggcccgaattggcccaaatgtggttttaaatactgaatacaatttgatgtcgggaacgtcgatggcctgccctcatgcttccggggtggtggctctgttgaagaatgcacatcctgaatggagtgcttctgctattaggtctgcgttgactaccacggctaacccactggataacaccggaaagcccattgaggaaagcggagactggcctcaacgggcttctcctctagccatgggggctggccttattgaccctaaccgggcccttgacccgggcttggtttatgatgccagccctcaagactatgttaacctcctctgtgcgatgaatttgacccaggcccaaatcatggccattactagatcaaaggcctactctaattgctccagagcatcctatgacctcaattatccttctttcgtggctttctatgctgacaagagtgtgaaagtggagacaaaattccggaggattgtgacttacgttggagatggtccggctgtttacactgctcgagtgagctcctacaatggcactgcaatctccgtatctcccaataggctggtcttcaagaataaacatgagaaacggaaattcactttgagcttcaagtctcaaatggacaaggactatgatgtggcttttggttcactccaatgggttgaagaaactggaaggcatcttgttaggagtcccgttgtactggtacctaggaacgttgccttcaacttccaaactcggatttaa

SEQ ID NO: 78457 - DNA, 459 bp, Glycine max
  Peptide Sequence Number=SeqID_195235
atgtcccttctcatcttttccccggaaacgtcctttgtccccaaaattgtacacaaccctaaccctaaacccagtaaactccacaacttaaaactcatcacaaggggcaagaccattgggttaaaagtgagttgcaaagttaagtatcagaagacaagcaacaatactatggatgatatcgtatttaaagatcctttgaacacgttcgttggcattgagaattacaagtcaatattctgggctctagggtttcatggcaggatgtttttcaaggctttgtggattgacttaagcagagtgtggcagcctgctgaggatgtcattatggttcgctggactgttgatggaattccacgaggcccatgggaaagttgtagtcgtagtaggtttgatggaacctctgagtataagctcgacaagaatggattgagctatgacacggatacaattcgaaaatga

SEQ ID NO: 78458 - DNA, 381 bp, Glycine max
  Peptide Sequence Number=SeqID_195236
atggtgagcacgaaggaactcgagacttgcatggaattctatgaaaagaatctctttgatcatcaagaatcaatgcagaaaatgttggaaacagtgcagatatcgatcgaaagcctcacattgatagagcgcatattccatttctgtcctttgatggctccaactttcgagattgaaaagcaaaagcagaacaattttttgaattggagggtacccttgaagaacaaagaagtcgtttgttattactatcgatggatggtaaagcctttgcgtggcaaaggcactacatgcagaacaacaatagcagagggaattcttgacaacaaatcattcacgatactggaagcaaattcgacacaggtgcatttgatgatccaatag

SEQ ID NO: 78459 - DNA, 210 bp, Glycine max
  Peptide Sequence Number=SeqID_195237
atggataaggtgagtaaggatagggtgaattgggattctgtttggggtaattggattggtaattggtttgggaatttggttgagagggcttggaggagtagcttgcatcatttctataccagcaatgatgatgtgaacctgactaggagcggatcgttcgatacaggctatgaagttttggatgacgccacttccagtgaaggaagataa

SEQ ID NO: 78460 - DNA, 372 bp, Glycine max
  Peptide Sequence Number=SeqID_195238
atgggggattcacaagaaaataacaaaggaaagagtagagacaaagataattatgtatcttggactatggaggataccaatgagttgttgcacctcttggtggatgctatgaataggggattgcgtgatgccaatgggtcacttagcaaaaaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggatatatgtggaaaaatgctaataattaggcgaacatga

SEQ ID NO: 78461 - DNA, 1020 bp, Glycine max
  Peptide Sequence Number=SeqID_195239
atgggaagagctccttgttgtgacaaagctaatgtcaagagaggtccatggtcacctgaagaagacaccaaactcaaatcttatattgaagagcatggaactggtggcaactggatagccttgcctcagaaaataggcctcaagaggtgtgggaaaagctgtcgtctcaggtggctgaattatcttcgtccaaacatcaaacacggaggtttctcagaagaagaagataacataatttgcagcctctatgttaccattggaagcaggtggtctattatagcagcacaattaccagggcgcactgataatgacataaagaactattggaacactaagctgaagaagaagctactagggaagcaaaggaaggagcaacaggctcaagctcgcaaagtttttaaccaaaagcaagagatcaagagagagagtgaagatttgatgttacctgttggagttattttcagaactccttattattggcctgaacaacaacattcatggcacattccagtgacaaataatgcttccattcaatactccaatctcaactacaacaatcaaacatcatcattcatcaaacacttccctagcaacaacatagtcactgccaccaccatgaattcacaacactcatcacgtgacatttccttaatacaaaaccagttacatgatttacatccttccacagtgagcatggtaaccacggacacgtgtcacacatcaaacgtgcttcaagggtttgggaatttttccatggccagtgacttggcctgtgtgaatcagcagcaacaaatagatgggtcaatgcgggttttttatggattggaaaccatggacgtggcaacaaatggtagcacaaacactagtacttcaacagaaagcattagttggggagacataagctctttggtttactcgcctttgttggtttctgactacgaagcttgtcaacaaagattattaatgcctcaagatgttactttcgaggagtctagttactttgcaatgcaaacgcaataa

SEQ ID NO: 78462 - DNA, 483 bp, Glycine max
  Peptide Sequence Number=SeqID_195240
atgtgttgctatatgtgcaattattgcacagctgcggagtctgcatgtagcaacgccggcgacatagtggtttactggggccagggcgagagcgagggcacattgaaggaaacatgcaactctggactatacaaaatagtgaacatagcctttctggcaaaatttggcgcttggtggcggcgaagccttctacgctgtgctgcaccacagtgtcccttccctgatcaacaccagaatggagcagtgtcaacggggctctttgactttgtttgggttcagttttacaacaatggtccatgccagtttgagtctacagaccccaccaagttccagaaatcgtggaaccaatgggtcttatccatcaggtctaggaaaatttatgttggactccctgcatctccatcaccagctacgcctgttagtgggtttgtgccaacacgaacgcttataacacaagtatgggggagtaatgctctgggatag

SEQ ID NO: 78463 - DNA, 252 bp, Glycine max
  Peptide Sequence Number=SeqID_195241
atgtatagacacaggattgcaaaggatcctcgatttgagagaatactctgtactcataaagggacgtatgctgatgattgtcttgttgagagagttactcagcataagtgctacattgttgcaacatgtgatcgggacttgaagaggaggatccggaagattcctggtgtgccaattatgtacatcaccaaacacaagtactcaattgagcgattgcctgaagcaacaattggtggaggtagatcctcataa

SEQ ID NO: 78464 - DNA, 582 bp, Glycine max
  Peptide Sequence Number=SeqID_195242
atgaccaaaactggaaaaaggctgacatatgctgccgcagcttcaggaaacatcacatatgagtttggtatttacttctgtcatgtacctgtgaatgaacaagtaaatgaggttgtgaatgacaatgggactctggaggttgatgaagtgtatgtaagtgatgaagatgtgacttaccaacagttaagagaagattcttcatctgaatataatcctattggtgaggatgcaaatttgagtgatgtggatgacttaagtgactttgatgaaatagtgggtgtcattggaattgtgcattcaaattcaggcaaggatgaaatttatgaagaaaggggattgaattcaaactccgtcgttgcagctactgaagatgttcaagctgaaaacacaagtgctgcccaaaatgaaatagtagaagttgttcatcctaacactcagccaatccaaaggactgcagaaaacaaggcccaaaagacaaaccactacccctacctacttgaaggactatgtgcagcttgggtagcagaggccccatgcagcatgcaccgttcgtacgtaaggaaaagcgcaccattaggatag

SEQ ID NO: 78465 - DNA, 942 bp, Glycine max
  Peptide Sequence Number=SeqID_195243
atgtccaagccactgctaggcatagcggaagaggaaggtcaaagcaatgtcactttgttggtttcttcctcagccaccatggaaagtgtgtgcctgaatagctcaaaactgaaagagcgcaactacatggggttatctgattgttcatctgtggacagctccgcgccgtccttctcagatgagactaagagcaatctgaacctcaaggctactgagctcagactggggcttccggggtcgcaatctcccgaacgagattcagatctttgcttgagaagttcgattcagtttgatgaaaagccactgtttcctttgcatcctgcaactgatgaacaccattcctcatcaaagcctgctgttttgggaaacaaaagagggttctcagatgtcatgagtggattcgccgaggagaaattgcttgttagttccgaggtcaacacaatattgccaccaaggccttcttctaatgtggggttgaaaccaagctctatgcttgagaacgtcggggctcagcagcaagccaaagaactcgcaacggtgaaggttggtcacgagaggtctcatgctgtcaacgaaagcagaccaaatcttaatgattctactaataacaatagcagtgcaccagctaccaaggcacaggttgttggttggcctcctataaggtcatttaggaagaattcattggtcactacttcaaagaatgttgaagaagtagatggaaaagtggggcctggtgcactgtttgtaaagccattttgccaggatccagttactgcttatgttgatgtgatgtcaggttcttgtggatctcatggaaatctgggaggggaggtgctgaatgaaaccaagctgaaggatctgcttcatggatcagaatatgttcttacttacgaggataaagatggagactggatgctagtgggtgatgttccctgggagtga

SEQ ID NO: 78466 - DNA, 324 bp, Glycine max
  Peptide Sequence Number=SeqID_195244
atggcagtgacattgtacgaccttagctctgcctctgggttgaagaagcttgatcagtggtacaagcacattgatgccttgttgagaatatctggtgtttctggtgagggatctcttgttgcagctcccccaactgcagacacaaaggcaactggaaagtcatctgttatgttggatgtgaaaccttgggatgatgaaactgacatgaagaagctcgaggaagcagtaagatctattgagatggaagggttgctttttggtgcatcagaatttacaatcgtgggacttggagatcaaggcaaccagaggaattgcaaattttag

SEQ ID NO: 78467 - DNA, 111 bp, Glycine max
  Peptide Sequence Number=SeqID_195245
atgaatctggcgacgatgtttggtggttgcgctaatgagcgggaccttggtcgacgacgctgtgagggagatgccttggtgcacaaccacgatgtagtcctatcatcctag

SEQ ID NO: 78468 - DNA, 336 bp, Glycine max
  Peptide Sequence Number=SeqID_195246
atgacattcatggggctccgtaaaaaagtggagaatggagaaattggcgaacagcgctacgcaataacttcgcggggctccagagactgctacgcaataacttcgcggggctccagactcgttggtggaggatgcatgaactgcgtcaggcaatggcattcatggggctccgtaaaaaagtggagaatggagaattggcgaacagtgctacgcaataacttcgcggggctccagactcgttggtggaggatgcatgaacagcgccaggcaatgacattcatggggctccgtaaaaaagttgaaaatggagaattggcgaacagcgctacgcaataa

SEQ ID NO: 78469 - DNA, 408 bp, Glycine max
  Peptide Sequence Number=SeqID_195247
atggagaataggtcaaatagattaaattctactccacatatgcaagatttgtcttcaatccttacacctgagcatcttaatggtttacaatggcggcgccatgatggccgccatagccatggcggtatagcagaaataacgggttttttttttttgtgcggtaggagttgggctgacccgacccaaccctacccgttattttattcaaaagcgcagcgggaaaacgcaacacagaatgcagcacgtgaccaggagcgacaccccacacccaacaacgacccagcacgcagcagccatcgtgcaccctgcaacgacgaccccgcggcctgcatgcacgacccagcagcgatgagcaccgacgcacgaccccgcgacggggaggaccccgtgaaggcgacgccacattga

SEQ ID NO: 78470 - DNA, 139 bp, Glycine max
  Peptide Sequence Number=SeqID_195248
atgacgtttggatcaaacttgaaatctccagtgtcatttcggagagatttgttgctcgatgcaattaaggagatttcagttgtcaccttcttgcctaggcaagggaactgggcaatgggaacaccatggttcctaactg

SEQ ID NO: 78471 - DNA, 336 bp, Glycine max
  Peptide Sequence Number=SeqID_195249
atgaacagggagcatctcgccaatgctaacggcgagattgccctagcctgcgtggagccctatctcgccatcacggtgggcgagtcccacgtggactataccgccagtcctgatggcggctccagctggtggtgtgtcgccattcccattggcgacactgtcctttctccctcctacgtggcctatatcgccactaccagtgacgataccagcctctctccacctttgccgccagtggcaatggcggcttcagccttgccgccagtttcaatggcgggtcacacccaagaacagaccccctccgttatttcttttgaaacagaccccatcccgtaa

SEQ ID NO: 78472 - DNA, 204 bp, Glycine max
  Peptide Sequence Number=SeqID_195250
atgctctccttgttcatgatgagactaaacataaggtctgaaatagggttcaaagctagctgtagatgttcacaggttgcgcatgctctccttgttcatgatgagactaaacataagagcacttgcaatgatactcaatacttgcaaaatttcatactgaatgcgagtaagaaactgaagagaggaagaaagactttcgtttga

SEQ ID NO: 78473 - DNA, 2703 bp, Glycine max
  Peptide Sequence Number=SeqID_195251
atgggcatagtgtggtttgggttcttgttgctgctgctgagtcaggtgacattggagcagattgagccactgagttccgctgaggagcgagaatcgttgctggaactaagggcttctctggggttgaggagcaaggagtggccaagaaagccagacccttgtttaatctgggttggaatcacgtgccagaatggtcgagtcgttgggatcaatatctctgggtttagaagaaccagaattgggaggaggaacccgcaatttgcagtggatgctttggccaatttcaccctcttgcagaccttcaatgcctccaatttcgtcctttctggccctattcctgattggtttggtctctctctcccttcgctcagagtgcttgatcttcgtttttgctccattgttgatgctattccctccactcttggcaatttaaccaacctcactggtctctatctctctgacaacaacctcattgggaatgttcctgggactttgggtcaactcttggccctttcggttcttgatctttccaggaattctcttactggctccgtaccagcctctttcgcctttctttcgaatctttcttcccttgacctgtctgctaactttttgtcgggggcggttcccaccggcatagggactctttccaggctgcagtacttgaatctttccaacaatggccttgcttctttgcctgcccaattggggggtcttgctagcttagttgaccttgatcttagtgagaattctttcgttggtgttggattgcctctggatttgaccgggttgaggaacttgaggaggatgatactcgcaaacagcatgctctctggagttctgcccgggaggttgtttagtgattcgttgcagttcctagtgctgaggcaaaacaattttagtggttctttgcctgttgagttgtggtctctgccaagattgagcttccttgatgtctctgccaataacttcagtggtctgcttcccaattccagttctgctgctaataatgctactgttgcggtgctcaatatttcacataacaagttttatggaggcctcactcctgctctcagaaggtttgctttcgttgatctttccagcaattattttgagggcaaggttctggatttcatgcgtaatgtatctctagatattaactgcctccagaatgcgacaaatcagaggtcaacggtgaaatgtgcatcattttatgcagagagggggctcagttttgacaattttggacgcccaaatacgacaaaacctcccgccgcagccaaaagctctgggaagagcaataaaactaagattatattggcagcagtcttgggtggagtgggtttaattgcaattttggtgtttctactagttctgttgcttctgtgtgctcgtaagaggggtaattcaaatcagagaggaaatggtgtgggtcctgctcctgttggcagtagtcctccaaatcccggtgtaccaatcgactttccaaatgtcggagattcatttacctatcatcagttgctccaggcaacaggagatttcaatgatgcaaatcttatcaagcatggccacactggggatttcttcaatggtgttctggaaagtgggattcctattgttatcaaaaggatcgacacgcgctcagctaaaaaggaggcttacctgtcggaattggacttcttcaataaggtttctcatcaaagatttgttcctttgttaggtcattgctttgaaaatgagaatgagaagttcctggtttataaacgcacgccaaatggggacttgtctaattgcttgtactacaaaaacacatctgaagatggtacttcgcaatcattggattggataactaggttaaaaattgctactggagcagcagaggccctatcatatctacatcatgaatgtgttccaccgattgttcacagagatattcaagcaagcagtatacttctagacgacaaatatgaagttcggttagggagtttaagtgaagtttgtgctcaagaagctgatattcatcaaagtaaaatcacccggtttctgcggttgcctcagtcttctgaacaaggcacatctggttcatcaacatcaatttgtgcctatgacgtttattgttttggaaaagttttacttgagctggtgacgggtaagctgggaatgagtgcagctagtgaggccgaagtaaaggaatggtttgatcagattctaccttgcattagtatgtatgataaggagctagtaacaaaaattgttgatccgtcaatggttgttgatgaggatttcttagaggaaatatgggctatatccattgttgccaggtcttgcctaaatcctaaaccttcaaggagacccccaatgagatatgttctcaaggctctggaaaaccctttaaaggttgtgagggaagaaaattccagttctgcgcggcttagagcaacctcttctagaggctcttggaatgctacgttgtttggtagttggcgtcagagttcttccgatgtaacagttactccagcagcctctggtacaaaactcgaaagagctagcagtttaaagctgtcaggaactaccggttcgcagtcacagggtagtttccacaatggtggaggtgagatttcgtcatcgcggagacgacattcaaaggagatattcccagagccatctggggtacatgatgtagagaggttggagcttcaatag

SEQ ID NO: 78474 - DNA, 180 bp, Glycine max
  Peptide Sequence Number=SeqID_195252
atgaatgataaagaggttgttcaagagtactattccacgaactcaaatgacaacactcctcctaaaaaccttgatgacactgcagaaacttcaactccacttcatttaaaaacctatacattggcaaagcttctatatgtgacaaggtggaaccgtgccccgcccccttcatgtttttaa

SEQ ID NO: 78475 - DNA, 2610 bp, Glycine max
  Peptide Sequence Number=SeqID_195253
atggctcagccgcttgtgaagaaagacgatgaccgcgacgacgaagctgactattccccctttcttggaattgaaaaggggtctgttcttcaggaggccagggtttttaatgaccctcaactagatgctaggagatgttcacaggttattacaaaactcctatacctactgaatcagggagagacgtttacaaaggttgaagccacagaagttttctttgctgtgactaagcttttccagtctaaagatacgggattaaggagaatggtctacctgatgataaaggagatctctccctctgcagatgaggttatcatcgtcacaagctctctcatgaaggatatgaacagcaagattgatatgtaccgagcaaatgccattcgagtgctgtgtcgtatcactgacggaaccctcctttcacaaattgagaggtatttaaaacaagccattgtagataaaaatccagttgttgcaagtgctgctctagttagtggcattcatctactccagacaaatcctgaaattgtaaaaagatggagcaatgaggttcaggaagctgttcaatcaagagcagcccttgtacaatttcatgcactgggtttgctgcatcagatacgacagaatgaccggctagcagttagcaagctggttaccagcttgaccaggggaactgttcgctcacctttagcgcagtgccttttgatccgttacacaagtcaggttattcatgaatcaggccatacacagtcaggggaacgccccttctatgattatcttgagagttgccttcgccacaagtcagacatggtgatttttgaagctgccagggcaataacagagctcaatggtgtaacaagccgagaattaactccagcgattactgttcttcagctattcttaagttcgactaagccagtcttgagatttgctgctgtccgcaccttgaacaaggtggcaatgacgcatccaatggcagtcaccaactgcaacattgatatggaaagtttaatctctgaccagaacagaagcattgctaccctcgctattactacacttttgaaaacaggaaatgaatctagtgtggatcgtcttatgaagcagatcacaaatttcatgtctgatattgctgatgagttcaaaattgttgttgttgaagcaataagatcattgtgcctgaagtttcctttaaaatatcgatctctgatgaatttcctgagtaatattcttagggaggaaggtggttttgattacaagaaggcaattgtagattcaattgtgattctcattagagatatccctaatgcaaaggaagctgggttgcttcatctttgtgagttcatagaagattgtgagttcacttatttgtccacacagatacttcacttcctgggaattgaaggaccaaaaacatcagacccgagcaaatatatccgttacatttataatagagtacatcttgagaatgcaattgttagggccagtgctgtgagcacactggcaaaatttggtgctgctgttgatgcgctaaaggttcgtgatagggcaacactttacctgaacacacttggaggtgatggttcagttgttgagactgataaagatgtaaaggacttcctgtttgggccatttgatgtcccacttgtcaatctggagactagtttgaaaaattatgagccttcagaagaagcttttgacattaactctgtgcctaaggaggtcaagttccagcctcttgcagaaaagaaagcccctggtaaaaagccaactggtttgggtgctcccccaagtggtcccccatcaactgcagatgcatatgagaggatgctttcaaccattccagagtgtgcaaactttgggaagcttttcaagtcctcagcacctgtggagctcactgaagctgagacagaatatgcagttaatgtcattaaacacatttttgataggcatgttgtgttccagtacaactgcacaaacacgataccagagcaattgttggaagatgttattgtgactgtggatgcttcagatgcagatgaattctcagaggtgttctccaagcctctcaggtctcttccttatgattcacctggacagacttttgtggcatttgagaagccagagggagtgccaacagttggaaaattttctaacgttctgaaatttattattaaagaggttgacccaaccacgggtgaggctgaagatgacggtgttgaagatgaataccagctggaggatctggagattgttgcagcagattatgtgttgaaagtgggggtgtctaattttaggaatgcatgggaaagcttgggccctgattttgagcgtgtggatgagtatggtcttggtcctagagagagtttggctgaagctgtaaatactgttatcaacctacttggcttggagccttgtgagggcacagaggaggttccacccaattcaagatcacacacatgcttattgtcgggtgtattcacagggaatataaaggtgcttgtacggttgtcttttggacttgatggtccaaaggatattgcaatgaaattgtctgtcagatctgaggacgaaactgtcagcgataccattcatgagattgtggcaagcggctag

SEQ ID NO: 78476 - DNA, 405 bp, Glycine max
  Peptide Sequence Number=SeqID_195254
atgcagttccagtttcaatcgcatatgcaatcacaaggactcgcactgcctcttgagcctgaggttggtccttcagttgctcgtgccagcacaaaggagagttgtgttgatcccttagggaacgatccaaacacagactttatgagggatcaacaaccgttcacaacatctctttgtgccatgatcaagtcaaggtttggtgttgagaaagttagagatgcagatgctcccattcttgtacccactgaagagggagctttaggatcaatgaaatctgcagataggccaaatcatgatgtcgatgatcccctatatctgatgacattgaccatctcacaactttttcttaagtcgttgcaagttatgtgcgatgttgtgggatgctaccgtgtttggggtgattaa

SEQ ID NO: 78477 - DNA, 1434 bp, Glycine max
  Peptide Sequence Number=SeqID_195255
atgtccgttacggagctgaaggagcgtcacttggcggcgacggaaaccgtcaacagtctcagggagcgcttgaaggagaggcgtctttcattgctcgatacagatattgctggctacgccaggtctcaaggtagatcccctgtcacctttggtcccaccgatctcgtttgttgtagaactctccagggtcatgcgggaaaggagatatccaaactcactataagcaaaggagggagcggttacttgcatcttggagggatatctagtgcgaccactccctctcccttggtccaactaggtcagcctaggagattggcattaactcggctcaaagaggtgtactcattggattggacttcagaaaagaatcgaattgttagtgcatcccaagatgggagattgatagtgtggaatgctctaacaagccagaaaacacatgccataaagcttccctgtgcgtgggtcatgacctgtgctttctccccaaccggtcaatctgttgcatgtgggggccttgacagtgtttgctccctttttaatcttaattcccccactgacagggatgggaatctagccgtttcacggatgcttagtggacataaaggttatgtttcctcttgtcagtatgttccagatgaagatactcacttgattactggttctggtgatcagacatgtgttttatgggatattactactggccttagaacatctgtttttggtggtgaatttcagtctggacatactgcagatgtacttagcatttccattaatggatccaactctagaatgtttgtatctggttcttgtgattcaactgcccgattgtgggacactcgtgtggcaagccgagcagtgcagacatttcatgggcaccagggggatgttaatactgtcaaattctttcctgatggaaatagatttggaactggctcagatgatggaacttgccgattgtttgacattaggaccggccaccaactacaagtatatcatcggcaacatggggacaatgaagctgcacatgtgacctccattgcattctccatgtctggaagacttctttttgctggatatacaaatggtgattgctatgtttgggacactttgttggcaaagaggccaaaacgaagtatagagtgtttgcgtgtagggattaaaatgaaaagcagtgtcagacattacctaatacacgaccttgctttgcgggtggtcttgaatttaggatctcttcaaaacactcatgagggcaggatcagctgtttaggtttgtcagctgatggaagtgccttgtgtacaggaagttgggatacaaacttaaagatatgggcatttggagggtataggaggacattacaacttagtaagatcgacctacttcacctgcctcaaaccgcagtgaagaatgatggagtgacagacaaagggagctaa

SEQ ID NO: 78478 - DNA, 1308 bp, Glycine max
  Peptide Sequence Number=SeqID_195256
atggctgcatccgccacctccaccggcggtgcgctgccggagctaactaaccgaactcccttactcggcctcaaactctacgtcctactcctcattgtagctctaatcgtgatcgcaacggtggtcctgatcctcgtgttcgttcgccggagccggagctcgaagaagcggaaaatgcgagtgaagcacagctccggcgcgatcccactggtctcgaaggagatcgtggaggtgaatactctggagctgaaaatcgatccgaagaagaaggaggtggagatggaagagagtgcgtcggtggagtcgccgaacatagggtggggacgttggtatagcctcaaggagcttgagaatgccactgaaggctttgcggaacagaatgtgatcggagaaggaggctatgggattgtctacaaaggaattctcatggatggctctgtcgtggctgtcaaaaatcttctcaacaacaagggtcaggcagagaaagagtttaaggtggaggttgaagccattggaaaagtgaaacataagaatttggtggggttagttggatattgcgcagaaggtgctcaaaggatgcttgtttatgaatatgttgacaatggaacattggaacagtggctgcatggtgatgtaggacctgctagccccttgacatgggatataagaatgaagattgctgttgggactgcaaaagggctagcctacttgcacgaaggattagaacccaaagttgtccaccgagatgtaaaatccagtaacattcttttggacaaaaagtggaatgctaaagtatcagactttggactggccaagctcttagggtctgagaaaagctatgtgacaacgcgcgtaatggggacattcggatatgtttcacctgagtatgcaagcactggtatgcttaatgagggaagcgatgtgtatagttttgggattctactgatggagttaattacaggaaggagtcccattgattattctagaccacctggagagatgaacttggttgattggtttaagggaatggttgcaagtcgacatggcgatgagctagttgatccattaattgatattcagccctctccaagatctttgaagcgagctttactggtttgtctgcgctgtatagacttggatgtcagtaagcgaccaaagatgggtcaaattgttcatatgcttgaggctgatgatttccccttccgttctgaacttcgaacaaatagagagaaagatcctgctgcttccagtaagattccatatccaaccaggcatgtggagcccgcagataaatcaagctggagatga

SEQ ID NO: 78479 - DNA, 153 bp, Glycine max
  Peptide Sequence Number=SeqID_195257
atgcgggggttttactttcgtcatccaaagacactcaagcccgatgacgcacaagattcttctctgctaggcagggacaatcgagttcaatatcatgtggaaacgtcgtggttatcccgttttatcactttcaaggcactgaagttttgctga

SEQ ID NO: 78480 - DNA, 147 bp, Glycine max
  Peptide Sequence Number=SeqID_195258
atggtgcatggtgttggggctatagagtttattatatgccattcagaggtctcaattgcacttgcggaagagaagaagatacctgagctattcaagacatttccaaatgcaacaaagtatctcaagagatcaaactcagagctttga

SEQ ID NO: 78481 - DNA, 1059 bp, Glycine max
  Peptide Sequence Number=SeqID_195259
atgaagagaatgatagccttggggtttgagggttcagcgaacaagattggtgttggggtagtgaccttagatggcacaattctttcaaacccacggcacacatacatcactcctcctggccaaggctttcttcccagagagacagcacagcaccacctccaacacgttcttccccttatcaaatccgctttggaaactgcacaaatcactccacatgacattgactgcctctgctacaccaagggtcctggcatgggagctcctctgcaagtctctgctattgttgttcgtgtgctttcgcttctttggaagaagccaattgttgctgtcaatcactgtgttgcacacattgagatgggaaggattgttaccggcgctgatgaccccgttgtcttgtatgtcagtggtggcaacactcaagtcattgcttacagcgaggggcgttatcgaatctttggagagaccatcgacattgctgtggggaattgcttggatcgctttgcaagggtcttgacactttccaatgatcctagccccggatataacattgagcagcttgcgaaaaagggagagaagtttatcgacctgccttatgttgtcaaagggatggatgtatcttttagtgggatattgagctatattgaagcaactgctgctgaaaagctaaagaataatgagtgcacgcctgcagacttgtgctactctctgcaggagacattgtttgccatgcttgtggagataacggagcgggctatggctcattgcgacacaaaagatgttcttatagttggtggtgtaggttgcaatgagcggttgcaagagatgatgaggaccatgtgctctgaacgtggtggaagattgtttgctactgatgatagatattgcattgacaatggagcaatgatagcttatactggtctccttgaatttgctcatggcgcatcaactccactagaggattctacattcacccagcggttccggacagatgaagtgaaagcaatatggagagaagcaaatctggcaaaattgaatgggcttgcagagaagagcacttga

SEQ ID NO: 78482 - DNA, 1563 bp, Glycine max
  Peptide Sequence Number=SeqID_195260
atgcagccagtatctgcaacgggactgagaagacatgttcaaacatcacttgtccagcaccatagatctgctaaaagaaatggtcgcactaaacagcctgtatcccctccttgctacaaaagctcaatgcaagtggcaccgtataatcatgtaaatcctataagttccctagaattcaagggttggattacagagtcaagtcgcaaccctaaaacatccagagagttactcaaggtactcaaccgtatttggagtcttgaagaacagcatgcatcaaatatatcagtagtgaaagccctgaaaatggaactagaactttcttgggcacaggttaaagagttacaacaagaaaagcaattgaataagcgtgatatggagaacttaatggaacaaatagctgaggagaagcttgttaggaagaacaaagaacatgacaaaattaaagctgcaattcaatctgtcatgcaagagatagaagatgaaaggaggttaagaaagcattcagaaagcctgcaccggaggctggctagggagctttctgaagtgaagtcttcattcagtggttctctgagagatcttgagaaagagagaaaaacacggatccttttagagaacttgtgtgatgattttgccaaaggaataagagattatgaatacgaggtacgctctcttatgcccaataatgctgagaagggtcaagttaaaggggacagccttgataggctaatacatctttcagaagcttggcttgacgggcgcaagcaaatgaagttagctcaagctggccatgatctcccagagatagattcatcaattgttgacaagttaggtgttgatattgaaacatttcttcatgcaaaaagatcttttaactcctccacgaaggagcccatgcaaatttacccttgcctacattcattggacaacaacaacaaaattgaggaggtccataaagaaaagaagggaatgaacaattcagcgaggaaacaagttgttcagtccaaggaaatcaccgaggattgtagcgagttgcaagcacatgtgatgaagagcatgttgtcatgtgatgaaaatgagagttggtttgttgagaggaaatcaagtgaaagcacagctctattcaatacccctggggcatcaactgtgggtgaggcaacacaaggtcaaccagaaagtaatacattattatggacaaagaaaatgaattcaagtcacgtagttagaaacagttccttgtcttcggaaggcaatgataataaggtttatcctgagagtattttcagggaagattcatttgtccattctgcagttactggtaatggtagtccagtaaaacagtggaaatctacactgattatcccagattttgacaagtctgagtcttgttccaaattgcctacaaaggacaacaacacattgatggcaaaactgcttgaagcaaggttggagaggcagaaatctcgctccagagctagcattagcaaaagagaagtttctgatgagaatcatgggaatgtgagtggtagctgtaacggtataaacactttgatcttctgtcaataa

SEQ ID NO: 78483 - DNA, 3282 bp, Glycine max
  Peptide Sequence Number=SeqID_195261
atggagctgtcgactccgaattcttcctcgaagcacttgtccattacgccgggttctagggttttgagaaaccctctctccgacgaacagatctggaagcgcctccgtgacgctggcttcgatgaggaatcgattaagcacaaagataaggctgcgcttattgcttacatcgccaagctcgaagctgagaaagcagaagtcgttgtttggaattttgtggtattgggggaaactgtggattcaggccaaaattcatttggtcctccaccaacattatattactctgacatttccaattttttgttcatcctggtgcatatatatgatcaccagcaccacatgggccttctcatattggagaaaaaggatttggcttcgaagtatgagcaagtaaaggccttggctgaatcatccgagttaatgcataaacatgattcaaccatgaataaatctgcgttaactgaatcaaagaaacgtgaagaaagtttgaagaagacagtaagcatcaaagatgcatgcatagcaagtcttgagaaggccttgcatgagctgcgtacagaaagtgctgaaacaaaggttgcagctgagagtaaatttgttgaagcacgccaattaatagatgaagcacagaaaaaatttacagaggctgaagccaaggtgcgtgctgctgaatctttgcaggcagaggctaagcgatatcacaatgttgcagaaaggaagcttcatgatgttgaagcacgtgaagataatctcaggcggcaaatcatatctttcaagtccgattgtgatgaaaaagataaggagatgattattgagaggcaatccctttctgaaaggcaaaagggtttgcaacaagaacaggaaagattacttcaatcacaatccttgctgaaccagagagaggaacactttttgagtaggtctcaggaactgaatcgtcttcaaagagagttggaggacacaaaagtgaaatttgaaaaggaacatgaagccctatatgacgagaaaaccaccctaaaactgaaggaggcaaccttaatacaacaagaagaggaacttgctaaatggaaatctgagctgagcaagaaagaacaagagttacttgaatttcaagcgaaactttctaatagagaatctgataaaacacagaaagttgttgctagtcaggaagccgcactgagaaccaaaaaatataacttggaagttgagctgcaaatgcagcgcaaattggttgaaaatgaaattgaggaaaagagacgggcttgggagttgaaggaggttgatcttaaacattgtgaggatcaaatcctggaaaggcagcatgagttggaagttctgtcaaggtcgctgagtgagaaggagaaggatctgaaggacctgtcaagtgctcttgaagaaaaagatcaaaggttgagtgctgctgagaaggactttgagttaaataaagtgcttttgcagaaggagaaagatcatgttgaacaggcaaaacaagatgtgcagaagtctttggaatcattggaagataaaataagacaagttgatatggaaaaggagaaactggaagccatgaaaagtgaaacgggtgacttgtcaattttggaagtgaaactaaaggaagagattgaccttgtaagatctcagaagttggagcttttggctgaggcagagaagctgaaagctgagaaggcaaagtttgaagctgagtgggagcttcttgatgaaaaaaaagaagagttgcgggaagaagcagaatttatagcaaaggaaagggaagcggtttccacttttattaggaatgaacgtgaccaactaagagaagagaaagaaaatctgcacaatcagtacaaccaagatctggggtttcttgctagtgaacgagaaaagttcatgaacaagatggcacatgaacatgctgaatggtttggcaagatgcagcaagagcgagcagatttcttgcgggaaattgagttgcaaaagcaggagctgaataacctcattgagaagagacgtgaagaggtggaaagttatttgaaggaaagagaaaaggcttttgaggaagaaaagaacactgaacttcagtatattaatgctcttaaagagaaagcagcaaaagagttggaacaggtttccttggagatgaaaaggcttcagactgagcgagctgagataaatttggatcgtgaacggagaaatagggaatgggctgaacttactaactgtattgaggaactcgaggttcaaagggataagctccaaaagcagagagaactgttgcatgctgatagaattgaaatttatgctcagactgaagaattgaaaaaactagaagatttgaaagctgtctctgatgataatgctatcactgaaatgcttaaatctgatatggagtctaaccaaaagaaaatctctgcaaggaagaacttgaagcatcaatctcttacacatggtggtgatagaatcagcaatgggtttgatactccacttgtgcagaagtcaactgtttctcctcctagccctgttcgattctcatggataaaacgatgcacggagctaattttcagaaattctcctgagaggccacttgagagaaacgaggattttctcatgggttctgatacaggtaatgttagtaacctgaaaaagcacttggaaaatgacgaaccacttggtaatattggcaagagacaggaaataggatttgctcttgaagaaccaaaagtaatagttgaagtaccctctctagatgatgctagaagaagtgagattgaatctgaggctaaagatgtgaatggaaaaagtgctctcctgattccagatggacatcgtgcaggcagactaaaaagaaggagggggaacatgactgataaagttggcaatccatttgtagatgtggggcaaaataagaaatcgagagcagaagaacaaaccaatgaaaaggtccaatcaggtgtgtctaaggtccagcaggtgttaacgtcatcaaatcaaacacaagggaacacggaagaaactcgtgtagtaataatggttgataaggttattcatgtatcagaagtgacttccgagaaacttgatgttctccctatcctcagtcaagaaccaagagataatttcccgagtcctacattgggagcagatcaatgtaatcttcatggagaaacaattgatcaatcaaattataaaactagacaggaagatgttttgccttgtgcttctagtgtattgggaagcacagaagaaatatccaaaggaaacaatgaacaggtttctgagcactgttag

SEQ ID NO: 78484 - DNA, 249 bp, Glycine max
  Peptide Sequence Number=SeqID_195262
atgaacgatctgaatctaccaacagcaacttcccaaaaccatgttgatttcggctggccagtagcggaaaaccgcattaccggcgtcaattgcggcagtgaatcgacggcagcgcttgctgatgacgtggcttctaaaaacgatggccacacactcactcacatgccttctttcaatttctcaaaacttttcaattcaatcactattttattttggattatagtaacagatgaatatgatgtcatttaa

SEQ ID NO: 78485 - DNA, 406 bp, Glycine max
  Peptide Sequence Number=SeqID_195263
atggcatccaccgtgcttctgcctaatacttctttgtttgtcactggcatcagtcctttttcccttggtatccaactcaaccaaatgaagcaattcaaaatcgaagttgaggaagaagttgaacaagttgttgcagttgttgcagttgcagaggatttcaattcggatctatttgacccgggaatggtgatggattcttcctcctccgattactctcgcagtgcttcctcttccgacgccgatttcgggttcgctttcaatgacagtaatttctccgacaggatcctccgaatcgagatcatgggggaccccgtcgaggcccgacccgactccgagggttgcaccaccatcgccgactgggctcgccaccgcaagaggagacgcgaggatatcaagaaggataacg

SEQ ID NO: 78486 - DNA, 309 bp, Glycine max
  Peptide Sequence Number=SeqID_195264
atggcatcaaatacccactcaccacctttcgagatattaattggaggaccagaagatttctcgctctggaccgaacctcccttcgcgaatggtcaaccaaaagacagtgttggagggcctgatgtaactgtaggaattttgccgaagctggataaagtgacacttcttcaaatggattctaaactaccaattgacattttggaaaatgttatgcaactggcaattgaaggttgcaaagcaatagcaaactatattcgagaaattttactggcaaacacaaagcaacttgagtatcgaagaggtgtatag

SEQ ID NO: 78487 - DNA, 1203 bp, Glycine max
  Peptide Sequence Number=SeqID_195265
atgaggtcatgcattattctgctgcttctctttgcatccaagacctggtgtcgatttagacttggaattcctaattcaggattgttcaaagagcttttgaatctgtccgagtttgttcagtatttattgtctttttctgttgtaaatctgacgagtttcaaggacatgcttagatgtgtgccaggtgtgagctggatcccccttctatcctctggcattggcatgtaccaaatttgggaagcctataaggctgtgtgggactatagagcagcaactgaaattacaaaggactggaatggaattcatcaaattgtgcttcggactccaaggggtgcttcggcacaggtaagcttacatggggcgcaggtcacttcgtggcggaatgagcatggggaagaacttcttttcacaagcagcaaggcaattttcaaggctccaaaagcaatacgaggaggaattcctatatgttttccacagttcggaaactgtggatcgctggaactgcatggttttgtgagaaatagaatgtgggcaattgatgataatcctcctcctctacctgcaaatgattctagtgggaaatccttcattgatctggtattaaaatcatctgaagaagatatgaagtgctggccatatagttttgaattccatcttcgggtgtctcttacaacagatggggacctgactttgatatctagagtcaggaatataaatggcaagccatttagtttctcatttgcatatcacacatacttattggtctctgacataagaacaaggaatttcattttgagtttgctaattaatactcacattaacaatgatagtgagataaggattgaaggtctggagacactggattacctagacaaccttttccaaaaggaacggtttacagaacaaggagatgcaataacatttgaatctgaggtggatcgagtgtatcttagctctccaaacataattgcggtgctagatcatgagaggaaacgaacatttgttataaggaaggatggtctccctgatgttgctgtgtggaatccatgggagaagaaatcaaaatcaatgtcagactttggtgatgaggataatagagaaacctgtgaacttgaagccgggcgaggaatggactgggcggctgcagctctcgattgtgccgtcaagtttttgcagcgaccatctaggtctggacagaagtga

SEQ ID NO: 78488 - DNA, 426 bp, Glycine max
  Peptide Sequence Number=SeqID_195266
atggttgcaaccacccctcaaccacgtataaacctcgagtccttatttgatttcaacggcaacaacaaccacgagttcagattcatagttgacgataacaaccacaggtttagattcattatcgttgagtgctatgtctcaaacgaaaaatccggccgtacaccgtgccgtcaaaatcttcctctcaatttctcgcctttgcatgtgtcggagaggtcgacggcgacgctgattttgcagcgagcgccggtggtgagggtggggggtggaagtgcagtatccgttagacaattcaagagatcaatagctttattcctcaaaaatccctcccgaagccccacgaagttaccctgccttaaattccaaagatgcaagaaaggtggtggaaaagctatagcagcacggatgacaaaatacagtatataa

SEQ ID NO: 78489 - DNA, 1428 bp, Glycine max
  Peptide Sequence Number=SeqID_195267
atgggaaacagtgaggaagagaaatctaccaagactgaaaaaccttcttcacctgtaacagtggatcaagccaatcagaccaaccagaccaatattcatgtctatcctgattgggcagccatgcaggcatattatgggccaagagtcaccatgccaccatactacaactcagctgtggcttctggtcacgctcctcacccatacatgtggggaccaccacagcctatgatgccaccttatgggcctccttatgcagcaatttatccacatggaggggtttatactcaccctgcagttcctattgggccacatacacatagtcaaggagttccatcttcacccgccgctgggactcctttaagcatagagacaccacccaaatcatctggaaatactgatcagggtttaatgaagaaattgaaagagtttgatggacttgcaatgtcaataggaaatggccatgctgaaagtgcagagcctggaggtgaaaacaggctgtcagagagtgtggatactgagggttccagtgatggaagtgatggcaacacttcaggggctaatcaaacaagaaggaaaagaagccgtgagggaacaccaaccactggtgaaactgccaaagtttttaactttgccattagtttgacaaatgtagcagactctaagatgggctttattgtgattacagacatgatacagtataggatatcaatgtacttggtgttgatggttgttcttttctgcactgtacaagcagatggagaagggaaaactgagatgcaaggcagtccaatttccaaagagactgcagcttctaataagatgttggcagttgtcactgctggtgttgcaggaacaatagttggacctgtagtttcttcaggtatgaccaccacgctggagctgagaaatccttccagtgttcattctaaagcaagtgccccacaaccttgtccagtattgcctgcagaaacttggttacagaatgagcgtgagctgaaacgtgagaggcggaaacaatcaaatcgagaatctgctagaaggtccagactaaggaagcaggctgaaactgaagaactggcacggaaagttgaatccttgaatgctgagaatgcaacactgaaatcagaaataaatcgactgaccgaaagttctgaaaaaatgagggtggaaaatgctacattaaggggaaaacttaaaaatgctcaactgagacaaacacaagagataactttgaacataattgacagccagagggctacacctataagtacagaaaacttactatcgagagttaataataattccggttctaatgatagaactgtggaggatgagaatggtttttgcgaaaataaaccaaactctggtgcaaagctgcatcaactactggacacaagtcctagagctgatgctgtggcagctggttga

SEQ ID NO: 78490 - DNA, 282 bp, Glycine max
  Peptide Sequence Number=SeqID_195268
atggaagaaattacatgtttgggtcattcttggactcctttgaggactgttagcgaggacgagtttgagaatcatcttttgtcattgaacatgaaagaaaaatttatcattcatctagaggcacagtggagaggaagaatcaagaatcaaatactagaagatgatgatgcggttcacaatggttttgggacagaaggggacgatgatgatgtttgggctgagatgactaggtgccttggaagcaaaacaatgtcgatcacaatgggtgtttcaattcgctga

SEQ ID NO: 78491 - DNA, 426 bp, Glycine max
  Peptide Sequence Number=SeqID_195269
atgactgaagggttaggtgaagctgttggggagtactccatgtgccttcatgtgagcaaaggcgaagagggtatgagaaaagagattattttagcagtgggatttgatgagtggtcaagaggaaggtggaagggggagatcctcatgcagaaactagaaagtaacgaactaaaaagattaagagagaattggcattatcaacttatagctgcaaaggtattaagaagccatcaaagaacacgaagaaacaagaacaagatttcatttcaagaaaagaaaaacaacaaagaagtaatttctttcagcttcatcttctgttccacaattttggatagcgtggatgatttgattcgggaagctgagagggaagcatactattctgtcttgcgtgctttcagaggtcaatccgtcgttggtctttcgtgg

SEQ ID NO: 78492 - DNA, 192 bp, Glycine max
  Peptide Sequence Number=SeqID_195270
atggctgacaacaggcaacagatgcaccgccgccacctccaaagcccctcaactcatctacaaaagctggagcgttgcttgcgacccatggtcgaccaacaagcgaccaagtccgaagccaaagctcaagacattaaagaagcgctactaggaggcaacctagtaccctttaaatttctgcttgttatttga

SEQ ID NO: 78493 - DNA, 516 bp, Glycine max
  Peptide Sequence Number=SeqID_195271
atgaatgagtggagtaatggcttgggtcatcgatcggtgtatggattccttgagcctcaatctatacacaatgcaaaggatagacgtgggcaatgtgaagaatatattgaaaaatggcttaaggaatctcaacgacaactgtacataggagcttatttgaatgatcgtttaacctattttaaagttggaggctacaattctgaacattatattaacatcatattaatcttccaatgcaatgcatataagaaattaaacacgactgctgatgggaaagttcctaaaactggaccccagtggcttgaactgaagactcacattcaacgcggaggctatgagtgtgggtattatgtgatgcattggatgtggaacataattggcgcagagttgaagagtgattggagtgtgtggttcggtgatggctcggcactagacccggaggcgatcacaacattacgtaaaaaatgggtagcttactttttgaaacttagaaccatccaatgtacaaagttgtaa

SEQ ID NO: 78494 - DNA, 1620 bp, Glycine max
  Peptide Sequence Number=SeqID_195272
gccatggaagaaatcaaggcaattgggaggatatcatgcccaacagccatcacaggattaatcctatattcaagagctatgatctctatgattttccttggctaccttggtgagatggaactagcaggagggtctctctccattggttttgccaacatcactggctactctgtgatttctggattagccatgggaatggaaccaatctgtggacaagcatatggagcaaagcaatggaagattcttggcttgacacttcagagaaccgttctccttctactctcaacctccatccccatctcattcatgtggctcaacatgaagagaatcctcttgtggtcaggccaagaccaagaaatagcatcagtggcacaaaccttcatcactttctcaatccctgacctcttcttgctctcactcctccaccctctaagaatctacctcaggactcaaagcatcacattgccactcacatattgctcagccatctcagttcttctccatgtgcctctgaatttcctccttgtggttcacctcaagatgggaattgctggggtggcaacagcaatggtgctaactaacctcaaccttattctctttatttcctcctttgtgtacttttctggtgcatacaaggcctcatgggtttcccctagtgtggactgcatcaaagggtggtcctcattgctatcacttgcaattccaacttgtgtctcagtttgccttgagtggtggtggtatgagttcatgataatgctgtgtggccttttggtgaatccaaaagcaaccattgcttcaatggggatcctaatccaaacaacatctttggtctatgtgttcccatcatcactcagccttggtgtttcaacaagggtagggaatgagttaggtgcaaagaatcctagaaaggcaagagtgtcaatgatagtttcactcttttgtgctctggctttaggccttgcagcaatgctattcaccaccttgatgaggcaccaatgggggagattcttcaccaatgaccatgaaattttggaacttacatcactggtgctgccaattgctggcctttgtgagcttgggaactgccctcagaccacaggctgtggagtcctgaggggaagtgcaagaccaaccattggtgccaacatcaatttgggctcattttatttggtgggtatgccagtggctatccttttgagctttgtggccaaaatggggtttccagggctctggcttgggttgcttgcagcccaagcctcatgtgccggcctcatgttctatgttctttgtacaacagattggaatgtgcaagtggaaagagccaaggaactcacaaaatcttcaacaacaacaactactgctatgactgcgactattgctacgacttcttgttctacttctcctaattgtaactacaaattgttacctacactcaccaaaaaagaagctaacatgaacaagaatgcacatgtttgtctcgaagagatagttattactagtggtggtggtggtgatgagcttaccaagatatcttcagttgaaacagatccactgatcattccaactaccaaacatactcaaggatttctacctgactttggtactgatcccattccataa

SEQ ID NO: 78495 - DNA, 327 bp, Glycine max
  Peptide Sequence Number=SeqID_195273
atggcgaggcttgattcgataaagataatgagcccatccaagagggagaaagctcacaatagagacaacaatgagatgttgatgttaagagtggaagtgttccttggaatattgtcgttggcaacattgctgagatattgtcgagaagaaggaatgaaaggtggaggtgatggaaaattcaaccttttcttacttgtgtgccacaaactttgtagtgtgaagaaaggagaagaagaaagagaaaaggacacaaaaggaaggggaaaaaagggtcaccgtcgccaaaaatctcctttgacgatgacgagttctggttccagccaatga

SEQ ID NO: 78496 - DNA, 192 bp, Glycine max
  Peptide Sequence Number=SeqID_195274
atggaggaggcaccagagccagagattgttgcacaagctctagaagtggaaatgaagcctctttctccttttgaggccatattgctcaggaaaatagatcagatttatagctggaaactcaagcaaaatgaagctcacaatgagtacatggaaaacatagtgagaggttggaaaacattgaagagaagttaa

SEQ ID NO: 78497 - DNA, 936 bp, Glycine max
  Peptide Sequence Number=SeqID_195275
atggcagtagctacactttttggtaagctaagagaatatgagttagaacttgaaagactcaaggatgaagaatttgacaagaaaaagaagggattagccttaaaacaaatgataacaaaagatgatgacaaaggtgatgacaaaaagctcaaaggtcaatcaaagaatgagttcaagatattcaagatagaatcaagaacacttcaagattcaagagaaaagttgatttcaagaatcaagattcaagagatcaagatttcaagaatcaagattgaagagatccagattcaagaatcaagagaaggcttaatcaagataagtatgaaaagggtacatctacttgggttgttgactgagaacaagagagggtacatctcttgtggatcagttctagtggagggtacatccactaggttcaaagagaacaagggagggtacatcctttgtggatctttgcttgtaaaaggatttttacaaggccacttgatccaacaagaagcaaacttgtgtctcacggccaacattgatgaggatgagaccaaaagcaatgaagtctatgatttgagaaatgagaaagtggactcagaaaaattcattgaggactccacttgtaaatgtaaatctagcaatattgcttctagctcagtcagtttcatagacgtagatgatgattctgctatggacaacgtagtcttcaatatcccaccacttccaccaccacacactgctcccaaagatgatgttttgcctgttctatttgccattgtgtatgactcatcaaatgatgactatgtggtagttgttgtaacaatgagatatcctgccatggtggtggaatgtttctctttgagaaacaattcatggaccttcactgagaggcgtatgcttgaatacttgatcatcataatctttccttcagtcaaggggagttcttga

SEQ ID NO: 78498 - DNA, 330 bp, Glycine max
  Peptide Sequence Number=SeqID_195276
atgtctgaagaaaaggtcaacaccaaaggtgctcaaaagaaattgatgaccaaacatcaaagatcaacaaagcgtgattcgtcttactgggagtatattgatgctttacattctgtgcaaaatagtatgggtgaagattcatggttgttggtgcacaaccatttgcttaaagaacttgacaaatggtctgatgagtatatcaacctccttggtagcatagacaaatttgagaaattaaagaggtccctacttgttgatggattatccatagttactatggataagtggatggatatgagacatgagataagtcattgcatcaaggtataa

SEQ ID NO: 78499 - DNA, 588 bp, Glycine max
  Peptide Sequence Number=SeqID_195277
atgaagaattcctcaaatacaaattcctatcctttgcgggtaggggcacttcttgcaaagtggaggtgggaattgatgtgtgaaaatgagttgctttggtgtgaggtgttggtctcaaaatatggggagtggagaggtcttgagggggctttgtcggatcatagcacaccactttggtggagaggtttagtagatgagagtggagctaggattgaccaactttggaagtcatgctatagctggtgtgagttgttggtggtgctgccattacacccgtcagatcacttctctcagcatgtaattcaaagtgtgtggagcagcttagtgtgggcatatggaactacaggaacaatatcatatttagaggaaaagctttttgccaagaggaaattgtctatcaagcacggtatcactcatggcagtggatataaaggggatattggaaagaggcttctctgtttcttttgcacgacggcactcgaacagggacctgtattttggaggattatggatgaagaccagatcttgtggaaggttcttctaatcacagtctgcaatgttggcatagctagaaatatctattattaa

SEQ ID NO: 78500 - DNA, 1275 bp, Glycine max
  Peptide Sequence Number=SeqID_195278
atgttaggcaaggatcctcgaaggacacgtgttgcaaatgcttattactcactgtttatggccattggtaacattcttggctatgcaactggatcatatagtggttggtacaagatttttacttttgccctttcccctgcttgcacaattagttgtgcaaatctcaagtctgctttctttcttgacattgctttcattgcggtcacaacatatatcagcatcatggcagctcatgaagtgcctctaaattcaagtgaggcagcccatgctgaagcaggggcaggggagtcaggtagtgcagaagaagctttcatgtgggaattatttgggacattcaaatattttacaacccctgtatggataattctgtctgttactgctctgacatggattgggtggttcccatttactctctttgatactgatggatgggtcgagagatttatggtggtgatccaaatcaaggcccttgtttatgatactggagttagaatgggagcacttggtttgttgcttaattcagttgttcttgcattaacatcattgttcatggagaggctatgcaggaagaggggagctggttttgtgtggggaatctcaaatatcatgatgaccgtttgctttcttgcaatgctagtagtaacctatgtggcaaataacatgggctatataggcaaagatttaccaccaactggcattgtgatagctgcgttgattatctttaccattcttgggtttccactggcaatcacttatagtgttccatatgccttaatttccacacatattgagtcattgggactcggccaagggttatcaatgggtgtcctaaatctggcaatagtggtcccacagttaactagcagtgtcagacatgttgatgttatgtgctctgatggctcctatgttggtggagatgtgataatagtgtcactgggaagtggaccatgggatcagctatttggtggaggaaactccccagcctttgctgtggcagctgtttcagcccttatcagtggactcatagctgtgttggctattcctcgatctggtgctcaaaaggctcgaagccattgttattattttctgaagcaagctttgggaacaatttttgtgtatgatcctgacgatggagaccttcctcattgtaagttagttcttctcgtgcaagatgttcttttcgaggttaattgcaaagaagttaaggcatcttccatgggttctaaagttccatcttgggcaacattctttcccaccaagacgagttgctgctga

SEQ ID NO: 78501 - DNA, 748 bp, Glycine max
  Peptide Sequence Number=SeqID_195279
atgaagaaaaaccaatgtaaaattggtgcactggccatgatcttaattgcagaatttggctttgcacaaaacagggacagcctttccgccaaagagcagtctataaaagaagtcgtggtggttgcctttggaaaacagaaaaaagaagaaataacagggtccgtacagtctttaaagacaaaagatattgctaatctccaaaacggaaatattttacagggaatcgggggtaaagtagcaggggtacaggtagtatcctcaggtcagccgggttcacagcctgtcatcagaatgaggggaataggttcgatcaatgcttcaagtgatccattaatcgtattggacggcattccttataacggaaaccttaacagcattccgggatctgatattgaaagcatctcctttcttgaagatgcttcttccaacgcattatatggttccagaggagccaatggtgtgatcattgtgaacaccaaaaggggtaaatccaaaggacttcatatagaagcagatatcagaacaggggttaatttcagatctgttgaagattattcagtgtatacttcaccacaggattactacaccgcttattataaccgggcaaggatcggtgaaattgccagattaacacaacccggagcagttccttccggtactaaccctcatgaagttggaatagcggctctgaccagcttgagatacaatgcctacaacgtccctttcagtcaaatgatagggcaggatg

SEQ ID NO: 78502 - DNA, 354 bp, Glycine max
  Peptide Sequence Number=SeqID_195280
atgcaagaacaaaggaaaccacttacaaagactgtggtggtggtagcgaatggctctacggcgacaatgaacgcaaacagcagagaagggaggcacgacaacgagaagaaaaccaaggagagaagtgcagtgattgttaccacaatcaccaccatcgattgtggtagcaacagcgacgatggttatgttggtagcgatgacgattgtcatagatgtgatcacagtgttgtggtggtggtggcgatagtaacaacgagaaaagtcatgttagtggtggcggcggttgacaatcatgatggtgattatagtggaggtcatgacagttgtgacggaaacggatggtggtcatggtga

SEQ ID NO: 78503 - DNA, 801 bp, Glycine max
  Peptide Sequence Number=SeqID_195281
atgatcaatttccaaaaatcagaaatattcttcagttcaagcactcctcaaagctctatacaaaccatctcctctcgtttgggtaaagactttggaagcgcatcaaccattggacatccaaaaatttgtcaaaggccggatgagcttcagaagatgatgagttctttttggtggggttcaagaaatcaatcaagaaagggtatcaattggctccaacgggacaagctcacaatgaaaaaagaatttggaagagggaatgaagtggaatattggaaacagtctatccataaacctttggtgccagttgtggctcaactctccccaaggatcctaggtttcatctacaaatccccttgggttgtttaccaatacgtcaaagactcctcactagaggagttaattgcccatctcagtgttgtttctgctcacgaaaatgaatggcatatttttatagcatgtgttaaagccaaagagatctggattgctgctaatctttgggatgtgattcgaggaaagatagattctactgatagttacaatgatctcatcttctctcttctcgagcaccttcaaccgcatgactccaacatgaaccacacaaacactttgcctcctcaagttgcagctacttatgtatggaaccccccacatacaggttcacttaaatgcaatcttgatgttgctcttttcattgaccagaacaagtttggtatcgggttttgcatgcgtgatgaccagggtactttcataaaagcaagaacagagctctatccaggaacacctactgcacatgaagctgaa

SEQ ID NO: 78504 - DNA, 426 bp, Glycine max
  Peptide Sequence Number=SeqID_195282
atgtacaaagataattggacccaaccttggcccatgggcctaaaaatctaccctgaggttcatgagaaccatagggccttcttcaacagttctagcccaatcctcttggagcctcttgctcatggctctagtgaccgaattcaagggactaaccgtctaagaattctttgtcctaacacattggaggatacatcctttgtggcacaagtggagggtacatctacttgggttgttatactgagaacaagagagggtacatctcttgtggatcagttcaagtggagggtacatccacttggttgttcaaagagaataagggagggtacatcctttgtggatctttggcttgtaaaggattttacaaggtttaaagaaatctcgaaaaccgttggttgcttggggactggatgtaggcacaggttgtga

SEQ ID NO: 78505 - DNA, 334 bp, Glycine max
  Peptide Sequence Number=SeqID_195283
gcagagaaaaacgaactacgcgaagagaaacttgttctgaaagcagataaggaaaggattgagaagcagttgaaggccttgcccgttgcaccagcagggtttatggctccacctgtagctgctgctgctgcagcatatcaagcaggggtgaacaagatggccgtatatccaaactatggctacatcccaatgtggcaatatctcctcaatctggctgtgacagccgagaggcatggagtcgagggtgatgtgatggggccggtgtctagaggcgcattggttatgaaggttcgttggcaagtggtggtagttggtgtgactgttaacgacgaag

SEQ ID NO: 78506 - DNA, 1317 bp, Glycine max
  Peptide Sequence Number=SeqID_195284
atggctgcattgtcagaagcgccattcttttcttcaaagcctcacagcactaatctccctcccaccaagtttcacactttcccctcaaaacccatctctctcacctttcgcagtacgtatactccttgtttcgcaaatgcttctccttctcttcctcaagacccggacccgggaaccgactccgaccctgacccgacccgagaccgccggagaatcgttcgggtcgcctgggagaagatcgtacgctggtccaggtcttggcgctccaaggccaacaccgacgtcctccaacgcacaaataaggtggttgtacttggaggagggtcatttgggacggcaatggctgcccatgtggcaaataggaaggctgagttagaggtgatcatgcttgttcgggaccctcaagtttgcttgtctatcaatgagaggcactgtaattgtaagtacttcccggatcataggctgccggaaaatgtagttgcaacaatggatgccaagtctgctttgcttggtgctgattactgcctccatgcagtgcctgttcagttcagcgcatcttttctcgagagtgttgccgagtatgttgatccagggttgccattcatatctctcagtaaaggcctagagttgaatactctgaggatgatggctcaaattattcctcatgcactacggaatcctcgccagccttttgttgcactatcagggccttcttttgctctggaattgatggataagctacccacagcaatggtggtggcatcaaaagacaaaaaattggctaatactgttcagcaactacttgcttcaaatattgatgcagatgttcagcttgtaatctctgataactccagtgatgttacaggagttgaaatagcaggtgcactcaagaacgtgcttgcaatagcagctgggatagtagaaggtatgaatcttggtaacaactcaatggctgctcttgtctcgcaaggctgttcagagatacggtggcttgcaacaaagatgggtgcaaagccgactactataacagggctgtcaggaactggagacataatgcttacatgtttcgtgaatctttcaagaaacagaacagttggtgtgcgactaggatcaggcgagaagcttgagaacatacttagttccatgaatcaggtagcagaaggtgtctccaccgccggggctgtgattgctttggcgcagaaatataatgtaaagctgccagtcttgacagcagttgctcgtattatcgacaatgaacttacccctaagaaagctgtttttgagttaatgagcctccctcaggttgaagaagtatga

SEQ ID NO: 78507 - DNA, 537 bp, Glycine max
  Peptide Sequence Number=SeqID_195285
ggcgcagaagacgaagttagtctctgcgtgttattaggcttttcctcttacagacagcaaaaagtttttacggataaccactcgggtatttccgcccgtcagcgtgactcaaaagtcagtatgacagatcgtgtgagcgcggaagatgacggcgcagaagacgacgttagtctctgcgtgctatcaggcttttcgtcttacagacagcaaaaagtttatacggataaccactcgagtatttccgcccgtcagcgtgactcaaaagtcagtatgacagatcttgtgagcgcggaagatgacgtaaatctccgcgtgttaacgggcatacagcaaaaagtttatacggaaaaccactcgggtatttctgcccgtcagcgtgactcaaaagtcagtatgacagatcttgtgagcgcggaagatgacggcgctgaagacgacgttagtctctacgtgctatcaggcttttcatcttacagacagcaaaaagtttgtacggataaccactcgggtattttcgcctgtcagcgtgactcaaaa

SEQ ID NO: 78508 - DNA, 231 bp, Glycine max
  Peptide Sequence Number=SeqID_195286
atgagcaaaaagggatcagcagcagtccatatgatccttgttagaggccaaggtgcccatcgacgagctaaaatactgttcttattatttgggtacgcaatatttgaaggttgtgttattctgaaagagaagatagggagggcggtttggtttggtgcaaatggattccttagaagacagcggctgttgggattttctcgattactctttcatcgatcaagcgccccctga

SEQ ID NO: 78509 - DNA, 672 bp, Glycine max
  Peptide Sequence Number=SeqID_195287
atgaatatcaatgaattgtttgaatcagttgatatactcaatatatctgaacatcatgcaaattttaatgtttgccttcatactcctccccatattgtatccgatggcatatggggaggacatatcacagaagccccacctttaagatcatctttctcgttattcctacttcaagtcattgtaatctatactgtaacacgagctttacattttcctataaagaagttaggtttaccatcaatcatttcacaaatgatggtcgggctaattataggaccatcattgaacatattggaggaagacaagattatgttgtttccttatggaagtcaagatacacttgctacgatagcatcacttggtcatgtgctatttgtctttgaaaatggtgtaaaaatggattttagcattaccaccagaataggaaaaaaagaatgggtcattgcccttgtaggattgttattacctctgctaattggttatacacaactagaaatcatttctacacttttaacccaagtgattgcttccgtcctcaatgaccttcaaatcctaaactctgaacttggaaggctggcattatcttctgcattggtgggtgacatactaagtaatattcttataatttcaactgtggtctttgatgtaaatcaacaagtagatgggattggg

SEQ ID NO: 78510 - DNA, 1173 bp, Glycine max
  Peptide Sequence Number=SeqID_195288
atgtctcttgccattcttctaaactgcaaaggtgttgtggaagtagcaatgtatagctctgcattagacaaaaatgatcttgaacctgatatttacacagtggttataacaacaatcatgatcacaaatagtattgtgcatttgatggtgaaacgtttgtatgatccttcaaggaaatatgttggataccaaaaaaggaacatttttaatttaaaaccagactcgaatcttcggatactagtttgcattcataaacaatatcacacaatccctatcataagggctcttgatctatgtacccctacaccagaataccctaccaccgtggatgttttgcatctaattgaactagtaggtcgttcttcccctatttttgtttctcacaagatgaaaaaaggtgttctctctcacacacgaaactcctactcagagaatgtcatcctttctttcaaaatctatgaagatgaaaaaaagggtgcaacaacaataaacccctatacagccatatctccacctacgttgatgcatgaagatgtgtgtttccttgcattagataaagttgcatcaattatcattcttccttttcatcgaaaatggtccattaatggtaaaattgagcatgaggataagacaataaggtcattaaattgtaaggtcatggaaaaggctccatgctcagttggaatattagtgagtcgttttgttcatcaaagagattcaccacttcgattagccatgatatttttgggtggaaatgatgatagagaggctttgtgcttagccaaccgagcagccaaagactctagtgttaaccttgtggtatatcacattacaaccaataacaaggatgaaatccaagacgtggacactatgcttgatcatgcgatgttgaaagacgctaagaaagaatgctctaatttgaaaactgttattcataaggaaataatagtagaggatggagcccaaatatcttctattcttcgtcaaatgatagatgaacatgatttttttatagtagggagacgtcatggcattgtctgtcctcaaacaaaaggacttcaaggatggagtgagttttcagagttaggtctcataggtgattttcttgcttctacagatctagaatgcaaatcttctgttttggtagtgcaacaacaacaattgttccattaa

SEQ ID NO: 78511 - DNA, 159 bp, Glycine max
  Peptide Sequence Number=SeqID_195289
atgtggtatttgacaaccgctgaaaagctaaagactggactgaaggctttattagatgacaaagattatgttctagatgaagacaatgtggaagtacaacaaatggctaagccaagtaaaatattgcaactattagcctggacctggtgttgtgattaa

SEQ ID NO: 78512 - DNA, 327 bp, Glycine max
  Peptide Sequence Number=SeqID_195290
atgggtggagtctacaagtttgatgaaactgcaggtggctacaacaagatgcaaacctataagggaatgcttcttgatcctgcaaggatattgagaaatcaccaaggagttggtggattgactgttgaattcattgactgctttaaggttgatgtctctaatgagattaccaaagcctccaatgagatgactgaaaggtatctcaagaatcttggtatcaagtatgttgatcatgaatggataatggttggagagcctgctactagaaaccctgaaaagatggaagaagatgttgaagctgaagctcaacatgagtttgtaccttaa

SEQ ID NO: 78513 - DNA, 963 bp, Glycine max
  Peptide Sequence Number=SeqID_195291
atggaagcgcatccaaacgcggccatgctgagaacccgaactataataccttctcctccaccatcactcgccctgagtaagaggctgccgtcaccgtcaccgtcaccatcaccgttaccgttactgtcaccgtccgttatcctctccgaacccgtgaaaccctcgttccaccggtttcctctgttctcgaatcctcacactcttcgaaccatgacgctctccaagtttcgcggatttccccgaccacgccctcttgcgaaatcccttgaagcaactgtgccaacgcctggtgtggtgtcttacccatctgatgccactcagcgtgtttcaggtggaattattcttgcaccggaagggatcaatggcagcatatgtgggactcgggagtcagtggaggaagttcttacgtttgtggagagcgatgatcgattaaaggggctaaggcgagtggaatcacctgttagtcctgaggaggaggccatccatcatgggcacagtgccacttctcctcttgctgcaggggaagatgcgcccttccgatgggatcatgtgagggtcaagttgaagaaagagattgtcactcttgggatgcctactgtgtcgcctattgaaagggttggaaagtatattggcccagaagagtggaatgctttgattagcaatccagatacagtggtaattgatgtgcggaataactatgaaaccagaataggaaaatttaaaggagcagttgatccttgtaccacatcatttcgtgaattcccatcttgggtggatgagcatttccagcttactgaaacagatgatagggagcatccaaaagttgaggtaaactcagtccaacctgctgaaaaagaaatggataataaaagacaacatatgccacgtgttgcaatgtattgcactggaggtattcgatgtgagaaagctacaagtctacttctcagcaaaggtttcaaagag

SEQ ID NO: 78514 - DNA, 301 bp, Glycine max
  Peptide Sequence Number=SeqID_195292
atggcaatggggcgggtcgggtacgggtattgcctccccaatcccttaccccgactcctcaacatatccccatacccgtatccgatactcgacgggtttgagtttattgtcccatccccgtacccatcggattttaagtggcggggcgggttcgggttcggggtcgggatgagtctagtaatcccatacccgtacccgtacccgacttttggttatcggggaaaacccgaacccgaacccatacccggtcaactcgggtattacccatcaaagtcgggacggattcgggcgggtaccacgg

SEQ ID NO: 78515 - DNA, 420 bp, Glycine max
  Peptide Sequence Number=SeqID_195293
atggtgggtgtatgcacacaggtggttctatcagcttgcaggatcatgccatttgcttggtatttagaggagcttggtcaatttgtatatgtagatgaggtctttcaacaaactcatttacgaaaggatattggtcaatttgtcaatgatagatctaggcggacacatcatacacaaggatcttcgagtagtgctgaagatgctgcagagatgaaccgcctgagggaggagcttcatctatcaaaagaggagatgtgcgtttttcagtcagtagtccttcagttcctacctcgagaggccggaacattattcatcaacaacaacaacctcaccaacagcaggaccatgcagataaccaacagaggcactctctttatgactattttgactactgacttagcatcacaaaattactattga

SEQ ID NO: 78516 - DNA, 405 bp, Glycine max
  Peptide Sequence Number=SeqID_195294
atgccacgacatcctgccgctgcggttcttgacctcgacacgtgcggccgtgtcggcagccaggtaggccccgtcggcggcattggtgacgttaagtttggggacgcggaaggagccgaggtgaaactcagggagggaggggtcgtagatgaggtagaagagagcggcggcgataacgagcacaaggaggaggatgaggatgaggatgcagaaggtacagcagcatatgcggcagaagttgcgacgcttccgtttgggctggaaggaggggggcagcatgagctttcgaggaggaggtggtggcggtttggagttggggtcccggtaaccggggggtttcttcacatggcgggatggaagcctacctatacaccacaactctttctgcaactgtgcaacacctaa

SEQ ID NO: 78517 - DNA, 1947 bp, Glycine max
  Peptide Sequence Number=SeqID_195295
atgacaatcgtcaacaagatgcggatccatggtgacaaaaaggaggatatcattgtagttgagaagattcttcggtccatgactccaaaattcaattttgttgtttgctttattgaagaagctcatgacatcgaggaactctcaattgatgaactgcaaaaggacgaggaagcaatgatcatggcaatcaacaagaacattagcaacaccatgagaatcaattccacaaaagaggaagagtcagaatgccgaactaacttgaacaaagacaatggagagaaaactaactttgttgaaaaggaagaggaggtgtcgtttttgatgatgatgttctctgatttagacgaaaccttatgcaatacagtcaagtttggtgataattccacagtttttgtcttagggaaacgaacggtaactctccaaaccaaagagaattcaagtcacactatctctaatgttctttttgtcccagatttaaagaccaatttacttagtatgggtcagttgcaagaaaaggggtatgaaatttctttcaaagatggagatgatgcatggctttggcattttctctatggtcacttaaactttagtggattgaagatcctatggcagaaaaatatggtgattggacttcatcaaattatagctccctctgaagtttatgaagaatgtgtggcccatggaatcaagaggcaacttacagctgcctacacacctcaacaaaatggtgtctgtgagaggaagaatcgcacaattatgaacgtggtgcgcagccttttgacaaggagtggtgttcccaaaactttctggcctaaagctgtaaattggagcattcatattttgaatagaagtcccacacttattgttcaaaatatgacaccagaggaagcatggagtggacaaagaccatcagtagatcatttcagaatttatggtaatcaatcaaaagcttataagctttacaatcccatcactaagaaaattattgttagtcgtgatgttatttttgatgaagaaaggcagcaaccagcagaaaatgatcaacaaattccaccagaaaatgtagcagatacttcaggctcaccaacaatggcatcagatgatgaacgacctcaacgtgttagaaaaaggcatgcctggatgactgattatgaggtaactagaatccaccaatctgaagatcctcttatacatttcgctttattttcggattgtgatcctacaactttcgaagaggctataaaagagtcaaaatggcaaaaggcgatggttgaagaaattgcaaccattgaacgaaacaacacttgggagcttattaatcttccaaagggacacaagacaattggtgtcaagtgggtgtacaagacaaagttgaaggaaaatggagatgttgacaagtataaggcacgcttagtagctaaaggctacaatgatgctgccatgtttgacaaattcaagaaatccacgatgattgaattcgatatgattgatcttggcatgttgtattatttcttgggcattgaacacacctatgaagtgggtttgaagcttgttcgagatcctgaaggaaggaagattgacaacactctttacaagcaaattgtagggagtctgatgtatttaacagccactagacctgacataactcatcttgtaagtcttattagcaggtacatggaatgtccaagagaaatgcatcttctagcagcaaaaagaatttttcgatacttgcaagggactgttggttttggattgttttacaagaaaggagaaaagacagatttagttggtttcactgatagtgattatgctggagatcaagatgatagaaagtgcacttcaggttatgtctttatgattggttcacgagctgtcttatggtcatcaaagaagcaaccaattgtcactttgtcaacaactgaagctgaattcattgttgcaacttga

SEQ ID NO: 78518 - DNA, 228 bp, Glycine max
  Peptide Sequence Number=SeqID_195296
atgctgatggaaaacttcttaaggtccaaggagtattggcaagttgtatcggatggaattcctgtatcagaggccagcatggcaatgacagatgcacaaaaaattgaaatagaagggatgcatttgaaggatctcgaggcaaagaattatcttttccaagcaattgattgcccaatcttggaaccatcctttgcaaggatacatctaaggaaatttgggattctatga

SEQ ID NO: 78519 - DNA, 222 bp, Glycine max
  Peptide Sequence Number=SeqID_195297
atgctaaaaatcaaaccttgcttggatttcttgaatccgccatttaagctgaagccgggttcgggtcttcccctcttgcgggtatccatagatcgagatccggaagaaggaacgagcttcaagtggaaaaaccctaaccctgacagcggtgaccctgaagaaggggttttggagcaaggagcaaggagagagggaaataataataggctcagtacagggtaa

SEQ ID NO: 78520 - DNA, 525 bp, Glycine max
  Peptide Sequence Number=SeqID_195298
atgagtaatctgatcatgtcatatttgtcttgcagcactgctggttgcccatttggtgagggctgccacttcttgcactatgttcccggtggttataatgcagttgcccatatgatgaatctaacacctgcagcacctccagcatcaagaaatgttgcagctctgcctcctgtaccaaatggttccgcaccacctgccgttaagacccgcatatgcaacaagtttaatactgctgaaggttgcaaatttggtgacaaatgccattttgctcatggtgaatgggagcttggcaagcatattgctccatcatttgatgaccatcgcaccatgggacccactggagtaggtcgtcttgctggtcgaatggagccccctcctggccctgctgcaagttttggggccaatgccacagccaagatcagcgtagaagcttccctggctggagctatcattgggaagggtggcgtgaactcaaaacagatctgccgccaaactggagccaaaactttcaattcgagagcatga

SEQ ID NO: 78521 - DNA, 228 bp, Glycine max
  Peptide Sequence Number=SeqID_195299
atggatagttggaatattgtggaagccagaggaagccctaattgtggatccagtgaaaaatcagcattgtgggtcctagagtggatgcaaatggacgagtcatttgtgagtctcttgtatggagtgcttgatgaaaaggcaatgagaatgaaggtgacaatgacgctgctactagggacacataaccactacaagggagacttgatcaaaaatgcaaaacgcacttag

SEQ ID NO: 78522 - DNA, 421 bp, Glycine max
  Peptide Sequence Number=SeqID_195300
atgcagggaggaaagaaagcgggagagtccattaaggaaacagctacaaacattggtgcttctgccaaggctggcatggagaagaccaaggccactgtccaagagaaggcggcgcgtcagcataacacggcggccaaacagtccgccaccacggctgggcacatgggacatggccaccacaccaccggaaccgggactggaaccgccacgtattccaccaccggggaatatggtcagcccatgggggcccaccagacgtcggcaatgcctggccatggaaccgggcagcccacgggccatgtcaccgaaggagtggtgggctcacatcccattggaaccaacagagggccgggtgggaccgctacagctcataatacccgtgcgggtggaaagccgaatgattatgggtatgggactgggg

SEQ ID NO: 78523 - DNA, 882 bp, Glycine max
  Peptide Sequence Number=SeqID_195301
atggaggctagattcagtgagcagaaggtcgttgtcacttacaaacatgtcaaacctggcattttaaatgcagcagcaccaaaggtagttcggatttctgtgatggatccctatgccacagatgaggaagatgaagatgaagggttggttaatcatccaagaatgaagaagtttgtgaatgaaatcagaattgtggagaagaagagttcaactaacagtgagtctgcaggtgtaaatcgtactaatgtgtcactgagacagcattgcaagggaaaaactggagggagtctcgaagaaaagaagcttagaggaatccgtcaaaggccatggggaagatgggcagcagaaatcagagatcctgtgaagcgaagaagggtgtggttagggacttatgacaccgcggaagaagctgctatggtttatgacaaagcagctattacctttagaggctctaatgctcgcactaatttcatcaagcctccttcaagggatgttgttctcactaatgaaactgaagctagagtgactgtgagtggtgagaatgattcaagtgaagggtcgtctcattttccttcacctacttctgtgcttaaacttcaacctgttgaaattatgttggaggagttttctgaaacagatcttctaagcaaagaagagtctagttctcaagacagtttcttgtttttagattcacattcgccatccattgattgttatttcaattttgaaactcttccaccagtgtttcttggtgaaactagtgtaacacagcagcctgttttccatggcaacttcagtgacatttcccatcttgtcaatgaggattttcaatcatggaattgggatatagatagttacttcagtgatcctctttcgttatga

SEQ ID NO: 78524 - DNA, 594 bp, Glycine max
  Peptide Sequence Number=SeqID_195302
atggcagacaagaagcggaaggagaggaatgaaggcaaccgccaaagaccgaagtcgaagaagaagcggccaaacactcaacagaaggagaggggcccttgtttgccctcatctttgcaaaaacagcttgactgtttaaaccctaccacttcctttgacagcattgattctgacgactacaatgacaatgatgtacacgagtacaaggaagaacgagctgaggaggatgatgattactcgaatgaaaatgctcttagtgacgattctggagaggaagatgatggaaggcacacaaggatgctacaagcaattactagcatgccaagtgaggcttttcaaggatcctatgggataaatctttcaaatttctcagttcttcgattatcaaggtttaccggatcacgagagactcacggtggcgtcgttctacatggagggactggcattatgctagtaccagtggatgtctcaaaacgggttcctcacttcgtggccggcgatgctttgggccttggggtcccgtttcgccccctcattttacgacaatccgtaggatgccttgttcaaattgcaacagcgaggcaccgccaatga

SEQ ID NO: 78525 - DNA, 963 bp, Glycine max
  Peptide Sequence Number=SeqID_195303
atgggtgacactatgaaacgggtgccaattgaaaaacctccatttactctcagccaaatcaagaaggctattccaccacactttttccagcgttctgttctgcgctcattctcatatctcatttatgaccttaccatagccttctgcctctattacattgccaccgattacttccacaaccttcctcatcctctcactttcttggcatggccaatctattgggctgtgcaaggattcaccctagctggtctttgggtcattgcacatgactgtggccaccatgcattcagagattaccaacttcttgatgataacgttggccttgttctccactctgctctattagtcccatacttttcatggaaatacagccatcgccgtcaccactccaacacaggttctcttgagcgagatgaagtgtttgtaccaaagcagaagtctagtatcaagtggctatctaaatacctaaacaatccaccagggagagttttcacacttgctgttaccatcacactcggttggcccatgtacctaactttcaatgtttcttgtagcaaaagggcttgcctgggtggtttatgtttatggatttccaatgcttgtggtcaatgggtgttggtcacaatcttgcagcacactcacgctgcattgccgcactacaatttctctgagtgggactggctcagaggagctttagcaacagtagtggatagagattatggaatcctgaataaggttctccataatattacaggcacacatgtggtgcatcacttgttctccacaatgccacattatcatgcaatggacgctacaaaggcaataaagcccattttgggagagtattatcggtttgacgagaccccatttgtcaaggcaatgtggagagaggcaagagagtgtatttatgtggaaccagatactgagaacaaaggtgtattttggtacaacaataagttgtga

SEQ ID NO: 78526 - DNA, 477 bp, Glycine max
  Peptide Sequence Number=SeqID_195304
atggtgtgcaatggagtgggtcggaggaagggagtgaggttcgtggaaaagctcatcgaattggatgaggagggaggtggtggctggggtggaaagggagaaagggacatctgcgaaaagccattgaacccccaaaactatgtctgcactgctgaggggaaggtgataaaggttgagggtgaatgtgtgaccttgaacggtaatggatacctaaggggaagtggtgttgcagtcgagaatactatcgttatccaccatcacctggagtgcagttgttggcaacgacaacagattgaggaacttggccattcgcgactggatgaagttggaatcttggagctggacggagttgaagatcctgcggtagttggtgtcggcgatggcggattctgggaggaaaatgaagttgcaggccgaggtccgcggcgcctgtcgttgaatttgtcttcctggagtttggctaaggcaactgcctga

SEQ ID NO: 78527 - DNA, 210 bp, Glycine max
  Peptide Sequence Number=SeqID_195305
atgtgtgaagaggagggagtgacaaatggggacgctgaggggctgtatttaagccagctagtgtgtgagcaatcagcactgagcagtggaggtgaggtttgggaggatatttggctcacactccacaggatcgggactattcccataatggctgaatactccccaggatgccttatgcctcagggacttaggtttgttgttctcctttaa

SEQ ID NO: 78528 - DNA, 2547 bp, Glycine max
  Peptide Sequence Number=SeqID_195306
atgggggctggtggccgaactgctgttcctcctgccaacaggaagtcagaggctgaccctttgaagcgggtaccatttgaaaaacctcagtttagtctcagccagattaagaaggccattccacctcactgtttccagcgctctgttctccgctcattctcctatgttgtttatgacctcaccatagccttctgcctctattatgttgccacccattacttccacctccttcccggtcctctctctttcgtggcatggccaatctattgggctgtccagggttgcatccttactggtgtttgggtcattgcccatgagtgtggtcaccatgcattcagtgactaccagctgcttgatgatattgttggccttatcctccactccgctctcctagtcccgtacttttcatggaaatacagccatcgccgtcaccactccaacacaggttctcttgagcgagatgaagtatttgtgccaaagcagaagtccagtatcatgtggtactctaaataccttaacaatccaccaggcagagtcctcactcttgccgtcaccctcacgcttggttggcccttgtacttggcttttaatgtttctggaaggccttatgatagatttgcttgccactatgacccttatggtcccatttactctgaccgagaacgacttcaaatatatatatcagatgcaggagtacttgcagtatgctatggccttttctgtcttgccatggcaaaagggcttgcctgggtggtgtgtgtttatggagttccattgcttgtggtcaatggatttttggtgttgattacatttttgcagcacactcaccctgcattgccacactacacttcctctgagtgggactggttgagaggagctttagcaacagtggatagagattatggaatcctgaacaaggtcttccataatattacagacactcatgtagctcatcacttgttctccacaatgccacattatcatgcaatggaggcgacaaaggcaataaagcccatcttgggagagtattatcggtttgatgggactccatttgtcaaggcaatgtggagagaggcaagagagtgtatttatgtggagccagatcaaagtactcagagcaaagttcttgccaagtcgaaagaaacaaacaattggagcgaggcaagtgttcccgccatgggaatggagcgagtgcagtgtgcctatgcctctctggacgaagcgttcgaaatagggaaagagacgtatcagggtcagcaatacagccagatttacttcgcgcgccttcatttgatgcgaacactcttgtattccctcattcctcattggaaacccaattctcccgtgtgcacggtgctgggattggaagagggcaaggagtgtgtcattgttggaaccctctataaacacatgaagctcaaaccttgcattcttgatgagtattctaaggagagatcagtggttccactcgtcaagccacataacttcatacacccggatgatcacctagttttggaagatgaaagtgggcgggttaagctcagtgggtatatcatttcgccatctgaatatgtaacaggaattgtggttgctttacttggaaaggaaacgggggcaggcgactttttggttcaggatgtcctacaagctggcttaccaccacagatagaatttccccttaaatcaagggaagacaaatatgttgttcttgtgtcagggttaagtgttgggagcagcagctctaatcctcttcagtttcagcttctcattgatcatattacagggcatttaggagatgagaaggagcaaagtattgcatcacaaattgctcaagttgtctttgctggaaatttaattgagatacctcacagacttcttaatggacagaatttggcttcaaaggatctctcaagaatggctgagccaataaaggagctagatattctgttgagtcagatagctgctggtttgcctttggatatcatgccaggacccagtgaccctgctaatttctcattaccacagcagtcattgcatagatgccttttccctgggtcgtcaacgtataatacttttagatcttgtacaaatcctcattgttttgagcttgataatgtcaggtttcttgggacatccggccaaaatgtagatgatcttgagaagtattcagaggcaaaagataaacttgaattcatggaaaggacattaagatggaggcatttggcacccactgcacctaatactcttggatgctatccttatactgataaggatcctttcttcattgagagctgtcctcatgtttactttattggaaatcaagataaatttgaaactcgtgtcataaagggatcagaagggcagttggtgagactcgtatgtgttcctaaattcagtgaaactggagttgctgttatggtgagctccaaatctcacacacttaatgttaacttagatatggtccggttttggaagtttgttcatggtgctgttattggtgtatcttgggacatcagccaagaactgaaaattgaagctgacagttga

SEQ ID NO: 78529 - DNA, 1317 bp, Glycine max
  Peptide Sequence Number=SeqID_195307
atggacactgctattgctactgaagctaaggttcagcatgtcaccaggaaatcttccgatgagcttctgaggaagttcgccgaagcgggttccaacgaggccggaaaaaacaaacggaggaagaagaagaagagggaaagtgaatgtgattgtgacagccctatgaatggtggcgccgccgtggtggaaaggagatctcttctgccgccgaaagtgacgcggaggcctgtgaggcgctatgcccgcatgagcaaagatggtgatgatgatgatgatggtgttgatgagtctacttcatcagttgaagactctcttctgtggcgtagagaccttttgaaacattcttgtggtgaattctcctttgctgtggttcaggccaatgaagttattgaggatcatagtcaggtcgagattggctctgacgccatctttgttggggtttatgatggccatggtggtcctgaagcttcacgtggtcttttggcttatatggtcttggccctggctgggattgctcaggataatggaaatatctctgaagaaattctcagaggtgctgttactgctacagaggatgggtttatgaaacttgttcataggagttatatgataaagcctttgattgcatcaattggttcctgttgtctggttggtgttatctggaaagggactctatatatcgccaatcttggagactcccgtgccgttgttggttctttaggtagatctaacaagatcattgccgagcagctgactagagagcacaatgcttgtagggaggagattagacaagaacttaggtctttgcatccacaagattcacaaattgtagtaatgaatcgtggaacatggcgtgtcaaaggcatcatccagttctctctcgatccatcattcccacgtttccacatgcctgaacctataacccaacctgtgctaacagcagaaccatctctatgttcaagagttttgcagccccatgacaaatttcttatatttgcgtctgatggactttgggaatacatgacaaatcagcaagcagccgagattgttcagaagaacccacgaaatggggttgcaagaaaacttgttaaggctgctctaaaggaggcagctaataaaaggaaaatgaaatataaagagcttcagaagattgagaaaggaaacagaaggatttttcatgatgatatcactgtgattgttgtcttcatagaccatgagttgctcgggaagaaaattactgtgccagagttgtccatcagagggttcattgactcggctggaccgtcaaattttaaaagtgtccaggagtttatgtga

SEQ ID NO: 78530 - DNA, 1128 bp, Glycine max
  Peptide Sequence Number=SeqID_195308
atggataactactaccatcaacaccaccaccctcactttgacaacagcaataacaatgaaccacatttacctcctggcttcagattccaccccacagatgaggaactcatcacatactacctcctcaagaaggttctagatagctccttcactggccgagccatagttgaagtcgacctcaacaagtgtgagccatgggagcttcctgagaaagcaaagatgggtgagaaggaatggtacttctatagccttcgtgaccgaaagtacccaactggattacgcaccaatagggccaccgaagctggttattggaaagccactggaaaagacagagagatctacagctccaaaacttgctcgctcgttggcatgaagaaaaccttggttttttatagaggaagagctccgaagggtgaaaaaagcaactgggtcatgcacgagtatcgcttagaaggcaaattcgcttaccactatctctctagaagctccaaggatgagtgggtgatctcacgtgtgtttcagaagaacaccaccggcggcggctccaccgtgtccgccgccgccgccgccaccagcggtggtagttccaagaaaacaagaatgaccacatcaaacactagcagcaacatgagcctgtgccccgaaccgggttcaccctcttccatttaccttccgccgcttctggaatcctctccttacgccgccgccagcaccaccaccgccacccccgccgcggcagcattcaacgatcacgaaagctgctccttcaacagcgccgtcagcaacaacaaccaaagggagcacgtgtcctgtttctccaccatctccgccgccgccttcgaccacctcgtacccccaccggagccgccgcttgaccctttcgcgcgctttcattgtaacaacaacaacgttggtgttggagtctctaccttcccgtgcctcagatccttgcacgacaaccttaacttgcccttctttttctctccaatgggccacgtcagcagtgctgatgtggcatcgtttggcgccgtcacaaactggccggcgccagaagagcagaggatggctgacggtggctccggcatggggattgtaccgtccgagttggattgcatgtggggctattga

SEQ ID NO: 78531 - DNA, 291 bp, Glycine max
  Peptide Sequence Number=SeqID_195309
atgaagaagaatgaagaacaattgagaaaaaaagagagagaaaagagaaagcttgcagaacaagccctgcacgaggtagataggtcaagtaattgtgctagtggtggcaatgataatgatgatggtgatagtgacaacgatgaagttaatggtggtggtgataaccgtggcaatgacaacaataatagtgctggtaacgatgccagtggtggcggaggcaacagtagtggttgtggtgacactggtggaggtgacattagtcatagttgtaacatcccatttttttcataa

SEQ ID NO: 78532 - DNA, 258 bp, Glycine max
  Peptide Sequence Number=SeqID_195310
ggtagaactttggaggaagaacttgttccgtttaatccagagattaaggctatttgtcataaaaacaatgcttcacagaagaaacaaaagcaacaagagaggcaaactaggcaaagagcaaggggggcttcttcctatcagcaatctacaactcttcccttcatcttggaggaaccaactatttctattcctcctctcatctctaagaagcctcaaatggaggaagaagatccactaagagtgacccttgaagattaa

SEQ ID NO: 78533 - DNA, 456 bp, Glycine max
  Peptide Sequence Number=SeqID_195311
atgggtacaagttccaaactcttgcatggtgcaagggaaaaaaccataaacaacggggtttatgtaaagggcattataaaaggaggtgaagatgattgctatgggatcattcaacacatatatgagcttgagtacaatgctttaagctatcctaagaaagtggtagtattttattgtgattggtttgatccatcaagaaaaaggcaaatgtactatgtccagtatccaacaacacaaacgggcaaacatggttggtgtgttgtaatcaaaacaaagccaaggggtcacatggaatttgatgatgtggaagatgatgtgccataccaagaaggttcaccttcacataccaacgaagtcattaaatctgaagatatttttgcatggcaagatgtagaaagtgatcatgaagaagtggatgagcctgaagaacccccacaacatgttcaagaagaataa

SEQ ID NO: 78534 - DNA, 591 bp, Glycine max
  Peptide Sequence Number=SeqID_195312
atgttcaggtacatagaaagaattgctgtggtttcctcaggggttgagagtatcagtgccagtagcagggaagtggttgaatggatgcagaagatacatgactgggaccccaagtttttcacactttcacacatacctgagaaataccgcctttatgtttccaagttcataaggcaagtggcgattgctcgcatgtcagagtcgcccgaattagcaagtgattaccataggaagttgaaagaagcctatgagactgaagagaaattgaaagaagcagatgttttgagaaggagcaaggagcatttggttatactgcttgatgaggtggagaggcagctgagtgaaacaccttatttggcaggtcaagagtttaccatggcagatgtgatgctcattccagtattagttcgtttgaaactcttggatttagagaatgagtacataactggaaggccaaacattgctgagtactggattttggttcagcaaaggcctagttacaaaaaggtgattggaatggtgatgctaggtgctggtaaaagaagggatgcttgtcaaaatggccagtctgcaaaagatcttttggcttag

SEQ ID NO: 78535 - DNA, 1311 bp, Glycine max
  Peptide Sequence Number=SeqID_195313
atgatgaaggtgaattatagattgatgaggcaacctcaaaggagacttaacccgactatgaaagaagaagtgtgcaaggaagttctcaagttgcttgaagttgggctagtttatcctatctcgagtagtgcttgggtaagtttggtgcaagtggtcccaaagaagggtggcattacggtaattttcaatgataagaaagatctcaacactacaagaattgtcaccagttggaagatgtgcattgattactgcaagctcaatgatgcctcatggaaggatcagtttctttttccattcatggaccaaatgttggagcggctagccgagcaaaaattttattgtttcttggatggtcactcaaggtacaatcaaatagcggtggttccaaaagacccagagaacaccatcttcacatgcttgttcagtgcttttgcttatagaagaatgtcatttaggttgtttaatgcccctgccaccttccaaagatgcatgctagccattaatctgatcttgtggaaaaatgccttgaagttttcatggatactttttcaatgtttggaaaaacgacatttcatggtcaaagaggggattttcttgggccattacatctcatcaaaagggattgaggttgataaggctaaaattgatgtcattgagaaactacctcctatcaacttgaaaggcatccgaagctttcttggacatgtaggagattatgttgtgggagcagtgctaggacaacaaagaaataagatattttattccatgtactatgatagcaaggtcttgaataatgcacaactaaattatgctaccactaagaaggaattgctaaccattgtttatgctctagaaaagttcatatcatatttgattgactacaaggtcaccatcttcacatatcatgctaccattaaatacctcttgactaaagctgactctaagccaaggttgattaaatggtgccaaagaaccgggggcatttccaagaggcatgagatgtccctgcataatattcttaaggtggaggtgttttattgttggggtattgactttgtaggacctttgccatcctcacactccaattttggtcctgtagaatatgtttcaaagcatgtggaagttgttgccactaaaaaaaatgatgacaaaacagtcatcatgttcctcaataagaacatttgctcccactttggagttccaagagggcttatcaatgatggtgggtctcatttttgcaaatgcacaactacaaaaggtcttaggcattacaatgttagacataaagtggattctccctaccacccataa

SEQ ID NO: 78536 - DNA, 303 bp, Glycine max
  Peptide Sequence Number=SeqID_195314
atgggcattgttgaatcccaaaatctaaagaaagaacttgataatactaaacaagaaaccacaaagatgaagcaaagtaggaagaatactaaaggaagaatattcaaactaggaagagggaaacaagatgaatcatccttgtgtcgttgctcctccccatgtggtaacaatgatggcaacaatgacaaccataataatgatgttcacgtcgtgattggtagtagcgacggtggtgatgacaatggtagtggtaaaaatagtgttggtgtgataacgactgttgaaccgttcaaaaacaaataa

SEQ ID NO: 78537 - DNA, 282 bp, Glycine max
  Peptide Sequence Number=SeqID_195315
atggcacgactacttgcagatgattttagaggtggatttgaaaatggaccctggtggcaacgtattttcaatggatacactatcactacctggatggtggtattgaatctagggtctactggtcttttggtttcatggttaatgaaacatgctgataatattgtaaaggtctattccacatcaatggcgatgctgctgacgatgatactttcactatttctcttcaacttcaaacctacactgcaggatactcatagcttctttgctgtagctctagtttag

SEQ ID NO: 78538 - DNA, 489 bp, Glycine max
  Peptide Sequence Number=SeqID_195316
atgggagttgaagttgaagaagaagagaagaagaagatgcagtggtacttcgtcgcttcgctcctcaccgtcctcaccagttctcagggaatactaacaaccctctcgcaaagtaacggagagtacaagtatgattacgccacggtcccatttctcgccgaggttttcaagtggtgggtggtttcaccttttcagcttgcggtgtcaagtttgttactgtggagggaatgcaaaaagtcacctttgccaaagatgacaacggagtggaaaacggtgtctctgttccccattccctcagttatatatctgatccacaacaatgttcagtttgctacactcacttatgtggacacatccacttatcagataatgggcaatttgaagattgtcaccactggaattctatttaggttgttcttagggaggaggctttctaacttgcagtggatggctattgtgctgttggctgttgggacaaccacaagtcag

SEQ ID NO: 78539 - DNA, 420 bp, Glycine max
  Peptide Sequence Number=SeqID_195317
atggcttttgtagaaatccttaatttatccaagagacctttcaacttctctcttacaattatttctgatctatttaatctgagagaaaagaagtttcaagaacacgcagaagcagagaaagagataaacatgaacatgattgaagagcatggaggaggagaaaataatggtacattgagtcacttacatctgctaaatgcatctctagctgagctaagcatgttgctcgtgttgctttcgttattttacttttcaagcgatgagtgcatagaatatcatgaggagagccaagagaagacaaaagatgaggttgctgtaactaaaacatgcatagcaagatcacaaggcaagagacgagagaaacatgagcctaagcatgggaggaaaccactttcatcaagatttcaaactacaggataa

SEQ ID NO: 78540 - DNA, 171 bp, Glycine max
  Peptide Sequence Number=SeqID_195318
atggtaaggggtaacagggctatgaaagaaaggatcagagaggctcaaagagtttttaagggttacattggaaaacaaatatggtttagctcgaagggggtagtaagggataaattagagtttgggatgttgaaacacggccatgtgtcatttcaaatcttgactagatag

SEQ ID NO: 78541 - DNA, 705 bp, Glycine max
  Peptide Sequence Number=SeqID_195319
atgagtattgtgtatagtcatgctgtgaagtactctcgaggggagacaaggatgaacccagaaatggattcaaatattggtcaacattgtcatcaacaaaattctggactaatgagataccgttctgccccaagctcattgctcacaagccttgtgaacaacaacaacaacaacaatggttatgtcaatggtgaatctttcagaagtgagcataatcatcatcatcatcagcagcagcagcagcagcattatcctccctctacaagctctgaaatggaaaacatgttggccaagttgatttcttccaacaattctgagcctttgcaaatgaaggaagaagcaggggactctgtttcacaaccaccacaacaacacaatggttactcttatgggtcttcacctcagatgatgtaccaaactcagcaaattcaaggcttgcctataccaaatggttctttaggggcttcagggagtgcttttgatggctcattcagtgcagtaaattcccttgcttcacagaattccacacaacctaaaatgggtgcttccaccaattgcaacaatctcattagacaaaagagttctcctgctggttttttctccaattactcagttgataatgggaaaaagaagatgggagggaatgaaataccagggaagaatctgagaaaaaaaggcataagagttagctgtaaaaagtactaa

SEQ ID NO: 78542 - DNA, 501 bp, Glycine max
  Peptide Sequence Number=SeqID_195320
atgttggcactgcttattttctgctctaaggatgaagaagctttcaaagagtgtttagttgagataattaataaggatgaagaagctttcaaagaagccatatttgctgcactacaagagctctttgatctccctctacaaacaaagatactcaatgtgtctaagaagccttatcatggttatgttgggcaatatcctatggtcccactttttgaaagtatgggcattgatgatgcaaatgtctatgaaaatgtagaaagcatgacaaacatcatgtggcctcatggaaacccaagttttaggcatattatcaggaagatgattttggagagtttgggtgttgaaaagtacttggatgagcacatgaactcaaccaattatcttctcgaggttatgaaatacaaaggccctcaaactagtgacacaaaggttggcctcacaacacactcagacaagaacatagtgaccatattgtaccaaaatgaagtggagggtttagag

SEQ ID NO: 78543 - DNA, 246 bp, Glycine max
  Peptide Sequence Number=SeqID_195321
atgagggtgcatgatacaatagccttgatactgttaaaaagtgggctatctattaacacattacggagtgtgggctcatgctcaaagtccaccttgatccatattatagggagattgatcattctgaaagctaaaaaagaggtgttggaaaaaactaggaggtgcaagaaacaacagccttatagggaactaggaaaggcctggtttggatgggtgacaagtgttaaagctttctacacctcataa

SEQ ID NO: 78544 - DNA, 414 bp, Glycine max
  Peptide Sequence Number=SeqID_195322
atggctaaactgggtgttgctgctaatggtttcattctggaaattgcaatttgctatgaaatctcccttaatagttacttctttttgcgcacatccactgtgtactctgccaacctgcatgtaaagggcagaaacgtggaatcgaaagggctccactctgttcctgtttcaggagctccggtgattcttcaatctgggattccattgcctgataagaggactctggaattgatacttgacaagcttcagaagaaagacacttatggtgtgtttgcagaccttgttgatccaaaagagcttcctgattatcacgatgtgatcaagcatcccatggactttgccactatgaggaagaagttgggaaatgaatcttcttatactaccttagaacaatttgagaatgctcagatgtga

SEQ ID NO: 78545 - DNA, 500 bp, Glycine max
  Peptide Sequence Number=SeqID_195323
atggatggaagtgtggagctagatcctcgattggatgatgatgaaagggcaacgcctaatgaagacacatctaatgccgacatgtttgtatggacagcttctaacatgcccaacattgaccctaagttccattcctacaagctctcagtttgccgaaaggtcatgaataccacttggttagccaatatggccatggtgaagaaaggaaacgaaaagtggtggatgtgcatggattatatagacctcaacaaagcatgcccaaagaatgcatacccattgacaaatattgatcgactagttgatggaagattgatagataaagtcttcaagaagaaaattggaaagaacctggaagtatatgttgatgacatggtgatcaagggcattgaagccgatcctaataagagtcgagcagtgatttacatgaggaatccaagcaatctcaaagaggctcagtggttggccgataggtttgcctttcttgcaagattcctaccaag

SEQ ID NO: 78546 - DNA, 144 bp, Glycine max
  Peptide Sequence Number=SeqID_195324
atggtgatgttgaggaggatggtggggttcgtcggcgacggcaaaggattttgccggcaatgtcggcgacaaagattaaagggttggtccaccgtagacgtcgtcttgtattgtatcatagaatcccgatgttttggtgcatag

SEQ ID NO: 78547 - DNA, 252 bp, Glycine max
  Peptide Sequence Number=SeqID_195325
atggttcgtcccttcatagcaacaaccttggtagatggaacccggaggcatccttttgtcgagggcctcatggaggttcacctccctctttcatggaaaggtctaacgatggacaaatataatggtaccatggatctagaaaagcatttagatgtctatgttaaccaaggaccaacattgagttggttcacaaaacttcctccttcctccattgattcattcaacaccttggtagcccgtctcaacacttaa

SEQ ID NO: 78548 - DNA, 207 bp, Glycine max
  Peptide Sequence Number=SeqID_195326
atgacgctggggagaaagctaatgtccttctcgaagcccgtcgcacctccgagcacgaatctcgccgttgtcatcgacaccgagaaagcaacacagtcgattagccttattggtggtgacagagaaggggttgccaaaggtattggcggtgagcttcgtcggaggaggcgcgacaagcttcacggaggatgttgtaatcctgtgtga

SEQ ID NO: 78549 - DNA, 5172 bp, Glycine max
  Peptide Sequence Number=SeqID_195327
atgggtaggcaaaaaagtaaaccacagcgagcaggcgggataatactagagacaaatgctgctgctgagacagaattggataaacaaaatgttatagaaggagggaaagaaacaaagggtgattctagtggcattgataaaccttattttgttgaggttgatcggtgtggttggttatcgagtgaacaccttgatatttctgaggttgttttgagtgatttaaatttgagagaaggtttttctggttttgaactgtctgaggatttttatcgggatcagcagtacttgttaagatttcaggtttgtaatgtcagtaatgttcttggtcgaattaaattagggcattggcctgtgataccctatactgatattcatctggagtttgtaagaagagttaccattgaccatgtggaaacatatacagtgttgttatctggtatttttgatggacctgatgaaggtgttactggtcttcttcacttggcaagtttgaagtttgttacattgaggccagttcttggggctaggctttctgaggaaatttcctccctccggataagggttgaggtattaaagagtgcctttgatgcatgcgagtcgcttcttgatagttctagacaactatggaaaaagagtatggtgaatgtaatgtcttggctacgtccagaaataatgacttcggaagttaggtatgggtttggtacctgtatgaaaatggaagttgatccgcagatagagatggcagatgacacttgcaaggcaaggaaacatgcaaggttcgatcctgcaggtttctgtgaagccattaagccttcaaaatcagagccaatgctcaaagatgacataccagagttacttcctaaattgaggccatatcaacggcgtgcagctttctggatggtagaacgggagaaagcagtggaagaaagtcggggtgaaagagaaaggaatctgtttcattctccattatgtatacctgtggattttctggacaccagttctcaaatcagtcaaatgtttttcaatccattcagtggaagtatttcattgtgcccagagacttcttcaccttatgtatttggaggcattcttgctgatgagatggggttgggaaaaactgttgaattgcttgcttgcgtctttgctcaccgtagacaagcatctggaagtgacatattaattgatttagaaccccaagctaatggggaccaaaaagtcactctgaaaagacttaaaagagagcgtgtggaatgcatatgtggagctgtgagcgaaagtcttaaatatgaaggactatgggttcagtgtgacatttgtgatgcttggcaacatgcggattgtgttggttattcacctaaaggaaaatctttgaaatcaaaacaaggatgtgaaagcaagacatttaaaaccaccatagctgtgagggacggagaatatgtatgtcagatgtgctctgaactaatacaagctactgaatctcctattgcctctggtgccactctcatcatctgcccagctcctattttgccccagtggcatgacgaaattatacgccatacacatcagggctccttgaaaacttgtatttatgaaggtgtgcgagacacatctttttccaatacgtctctgatggatatcggtgatcttgccagtgctgacattgtattaactacatatgatgtgcttaaagaagatttgtcccatgattctgataggcatgaaggtgatcggcactttctgaggtttcagaaaaggtacccagttatcccaactcttcttacaagaatatactggtggagggtttgcttggatgaggcacagatggtggagagtaatactactgctgcaactgaaatggctctaagactccattcaaagtatcgttggtgcattactggtaccccaattcagcgaaagcttgatgacttgtatggacttctaagattccttaaagctagtccttttgatagatacaggtggtggactgatgttattcgagatccttatgagaaggaagatgtgggagctatggaatttacgcacaaaattttcaaacaaatcatgtggcgttcttctaaagaacatgttgctgatgaattggaacttccctcccaagaggagtgcctctcttggcttacactctcaccagtcgaggagcacttttaccagaggcaacatgaaacttgtgttagagatgcccatgaagttattgaaagtttgagaagtgatattcttaatagaaaaggcccagattctgtctctttgaatggttcttctgatcctttaatcactcacaccgaggcagggaagctactgaatgctttgctgaagcttcgccaagcttgttgtcatccccaggttggaagttctgggttgcgctcgctgcagcagtcacctatgaccatggaggaaatactaatggttcttataagcaagacaaagatagaaggtgaggaagctctcaggaagttagttattgctctgaatgcacttgcagctattgccgcaatacaaaatgatttttctcaagctacattactgtacagtgaagctctttctttggctgaagagcagtctgaagatttccgcctggacccattgttaaatatacacattcatcataatcttgctgaaatactcccactggttccaaactttgctctaatatcgccatccaaaggaaagcagttctctggaacttctaaatttaagatgaccaaaaggcatttaagtgtgaaggttgagcattgtcatgagaagaggcaaaaaataagtggttgtgatgacgtaaatgtaacagtgctgtcagaaccatcagatgttgcatttagccattcagaaaatgacttaaatgaggatcaggaatttgatagtttatcagccatcaattctctgatagcagaatgtgaagattcaaaacagaaatacttatctgtcttcagttcgaagctatctacatcccaacaggagtttcaaaattcttacacgcagttaaaaaagaaaaagggaaagaatgcaatatctgttgcttatacaggccaaaagaagaaagtctgtaatgcatatcatgacagcagaacagatcaagatacattttggtggttagaagcactccatcatgctgagcagaacaaagatttctccactgagttgattaggaagattgaagaagccatctcaggaacttcaaacaattcaaagtcatcaagagtaactgctcggatcaccataaaaaaagttgctgaacaatgtaatacagttagaactgatatcaacaacatactatttcttgttatgaacaatgttctagtatgtagtttccgaagcataagctctctgaagtatcaaattcagacagctttggaccagttagaggcctctagaaaaatgctactagatcgactgttagaaattgatcagacaatggaaaaaccaaaagaagaagatattgaacgtgtgggtaaatgtcggaattgtcagcctaattgtgatggtcccccttgcattttgtgtgaactagatgaattgtttcaggattatgaagcaagactctttgttcttaagaatgaacgtggagggataatttcatctgctgaggaggctgtagattttcagaagaaaaactttgcattgaatcatttcctctcaaagctatcacaatctaatcacagttctacagtatctgatattggtcatgaagaatcaaagaaaaggaatgttggacaaagagttgtggtttcaaaatcagcatctgagttggagctaattcttggagttttaaagaactactgcaagtctcgattaggaagagacagtgtctcagctgccaccaagcatttacatgtttttgagggaatgcgaaaggagtttggccacgcaaggtctttggcattagctcaagctatgtatctgcgtgcacatgatgaaataaagatggcagtttctcgtttgcacctaagggcgaatgaagatgataaatctcttgatgctttaggtgaaaatgaattagctgcagctagctcaaacttttcccatgataagtttatgtcattgaccatgttgtcacagataaaaggaaaactccgctacttaaagggtttggttcaatctaagcaaaaactgcaattcgaaagtccaactagttcttcattcacacgagagacaactgcaacgccaaactctacagaagagaaggatgcacttttatctaaaagtgacgacgaaacatgcccaatttgccaagaaaagctgggcaaacagaaaatggtttttcaatgtgggcatgttacatgctgtaaatgtttatttgctatgactgagaaaagacttcaaaatagcaagcttcataattgggtgatgtgccctacatgtcgacagcatactgattttggaaacattgcttatgctgttgatgcacagcatgaatcttccgatccttcagtgctgcatccaattgacagcagtgaaaaatttgaagcatccattagtgttaaaggttcatatggaaccaagattgaagcagtcacaagaagaatcttgtgggtaaaggctaatgatcatagagcaaaagttcttgtattttcaagttggaatgatgtacttgatgtattggagcatgccttcgctgccaataacattacctatattcggatgaagggaggcagaaaagcacatgttgctatcagtcaatttagaggaaaacaaaatggcacaaaaaaatgtgaggggtcaacaccaaaatctattcaggtgttgttgcttttaattcaacatggagccaatggactcaatctattggaagcacagcatgtagtccttgtagaaccattactcaatccagctgccgaagcacaagcaatcagtcgtgtacatcggattggacaaaaaaataagaccctcattcatcgtttcattgtaaaagacacggttgaagagagcatatataaattgaacagaagcaggagcaatcattcgttcatcagtgggaacactaaaaatcaagatcaacctgttctaaccctgaaggatgtggaagccttgctttctagagcaccactaacaatgccagaaagtgatgaaaatcctaacagggacacgaatcttagacacttgccaccatcagtggcagctgctgtagctgctgagaggagacttaatgaacaaaggacatga

SEQ ID NO: 78550 - DNA, 555 bp, Glycine max
  Peptide Sequence Number=SeqID_195328
atggcacgtgtatatcttaacctggtactgacacgtggacactcctcagacatgaaagggtctttatatgttgctgatgcccacatgttagccacttcttctctttctatgagtaataaagccaacaacccttttgttcttccttgtcaaacccttgtctctcatagtagtgtgagagatttgagcttcaaggtcagcatttcttggccttaccatgcttcttgtattgtgcaacgacaaaagaatagtaataacagtggttttgttgtggtagggtgtgcaaaatggggtttggaagctgagatgaaaccacaagaagatgatgaggaaaagggtaggagtagaatggcaaggtttagacacaagtgtggagaaagaaagggggttgtggcgctgttggagtggttggaaagggaagctataatgggtgaagatgtaggaaaagagcctactgattacaaccgaagggctcagatatttgatagaagttctcaagtgttccaagcactcaaggaactcaacaatgatgttttcccacaagagtattcaaagtaa

SEQ ID NO: 78551 - DNA, 348 bp, Glycine max
  Peptide Sequence Number=SeqID_195329
atggcggcttctccgacaacgtttgatatgccaccaaccagtccgtcggcgacgtgctcttcagaaccgcatgacgcgttgcagttgcattcttcgttcccttctatgtctgcttcagatcgcaagctttgccactgtctggaacgccggcgagccgcgatggagatgatgactactacatgttggtggcgttggcaaaatcaaagtcattccaagaccggtggattcgtagcaaacaacgtgtgcggctgcaacaatagcactgatccaacactcagactccgaactcctcccaacagaaacagaagcaaacaacactcttgttgttttcgtattctgtctatctag

SEQ ID NO: 78552 - DNA, 780 bp, Glycine max
  Peptide Sequence Number=SeqID_195330
atgtatgagaaaatgagagaagcaaagatcaaaatcactgaggtggcaatggtgggtgctatttcagcttgtgcacaacttagggacattagaatgtcaaacacactaacaggccatcttgaggagggttgctgtgataggacacatattgtttcaactgcattgatccatatgcactcaaaatgtggaaatataaacttagcattgagcgaattcactacaatgagatacagggatgtgtatacttacagtgcaatgattgcagcctttgctgagcatgggaaatcacaagatgctatagaccttttcttaaagatgcaaaaggaaggattaaagccaaaccaagtcacattcattggtgtcctcaatgcatgtggctcttctggttatatcgaagaaggttgtaggttttttcagattatgactggggtatttggtattgagcccttacccgagcactatacttgcatagttgatctccttgggaaggctgggcaactagaaagagcatatgatctaataaagcagaatgcatccagtgctgatgctacaacttggggttctttattggcaacttgcaggctttatggtaatgtggaacttggtgagattgcagccagacatctctttgagattgaccctgaggattctggaaattatgtgcttctagctaacacttacgcgtcaaaggataaatgggagcatgcacaagaggttaagaagttgattagtgaaaagggaatgaagaaaaaaccttcagggtatagttcaattcagtga

SEQ ID NO: 78553 - DNA, 396 bp, Glycine max
  Peptide Sequence Number=SeqID_195331
atgaaggttaggtattttctggtttgtcacaccctagctagtcggcgtggctatctctcagtggcattggcattaatttctgcaatcaataggaaaaaagacgagggtgtcaatactccatcgactactgcaaatgcgccacccaatcacaatccacctctagagacgacttctacatttaatcatcctcatttctctcatcaagcctttctcaccaatatcattgaaaatcaagaaccaaaatccttttctcaagccatgaaatcaattgaatggtgtgatgccatggctaaagaaattcagacccttgaatcaaacaacacttggtctttgtgctccctcgctgaaggaaaatctccaattagttgtaaatgggtctacaagatcaaatattaa

SEQ ID NO: 78554 - DNA, 697 bp, Glycine max
  Peptide Sequence Number=SeqID_195332
atggcggaatcatcctttctgcaaccctctattcccaaatttgatggtcattatgatcattggtccatgttgatggaaaatctccttcgttctaaggagtattggagccttattgaagatggaatcgaggtagctcctgccaattccactgccgagcaaagaaaagcagctgatgatagcaaactcaaagatcttaaagccaagaactatcttttccaagccattgatcgcacaatcttggagactatcttgaacaaagaaactgctcgtgatatttggacttcaatgcgccagaaatttcaaggctccaccaaggtaaaacgtgctcaactccaagctttgagaagagaatttgaaattctttctatgaaagataatgagactgttaatgagtatttttcaagaactttagcaattgcaaataagatgaccgcgcatggtgaatcaatgggtcaaactaaggtggtagagaaggttcttaggtccatgacatcaaaattcaattatgttgtatgttcaattgaagagtctaatgatgtcactgctctcaccatcgatgaattgcaaagtagcctcttagtgcatgaacaaagaatgcagtatactcttgagaaagatgaagaacaggccttgaaagtctcttctgcaggaaggggtggtaatcgaggaagagggaggaatggtggtagaggaaggg

SEQ ID NO: 78555 - DNA, 237 bp, Glycine max
  Peptide Sequence Number=SeqID_195333
atgcaaccgcaggaattggacactgaaatagtcgtagcaaccacaactggaacagccacaaatgcaaccgctgtcgctgctaatgtagttgttgatgagaggcagatgaatgcactctttcttggtgtggttcggctcttgtactttgaccggtacacacggttgttggctcccaacttgaacatgcttcaggatcagaggatttccattgcttccaatagaagaagcagggtatag

SEQ ID NO: 78556 - DNA, 270 bp, Glycine max
  Peptide Sequence Number=SeqID_195334
atgggtcatgaagatgaggaaaatgatgatgatgataacaacaataacgataatgatgatgatgataacaacaataacgatgatgatgatgacaacggtggtgatcatgtacaaacaatgctgtcaactgtcaaggttcctgttaagaatagttccacatcggccatcttctacttctgtccggtgggtgccgccagccctcgctttgtggtgacgagccctggctcgagggggcgtgttaagaatagtcccacatcgggtaattcatga

SEQ ID NO: 78557 - DNA, 2886 bp, Glycine max
  Peptide Sequence Number=SeqID_195335
atgtctggtgaatcggctcccaaacccaaaccgagactagtgttatgtcctaaatgctggcaacttcttccagagtctccagattatgatgtgtacaagtgtggtggatgtggcaccactcttcaagctaagaaacgaagaaatagggctgtgaactcagaatccaatacacatgaaactgatgcagctcctagaaatgcattgaacagagaatccagtacacgtgaaactgatgcagctcctggaaatgcattgaactcagaatccagaatgcatgaaactggtgcagctcccacaaatgcattggatactaaagctcatgataaaaaatacagcaatggagagcagctagttagttatcaggagaatggtttcaaggaaaatgcaactaattcttcctcaggtgaatgttctttgaatggaagtggtggaagcgatcaaattgaagatggtgaatgcaatggagagcagctagtcacttctcaggagaatggttttggggaaaaatcaactagttcttcctcaagagaaggttctttgaatggaaatgatggaagggatcaaattgaagatggtgaatgcaatgcagagcagccacttatttctcgtgagaatggtttgatggcaaaagcatctagttcatcctcagaagaatgttctttgaatggaaatgatggaagggatcaaattgaaaatggtgaatgcaatggagagcagatagaacagttaaatttaccagatgaagaactgggaaatgagatggatagccataaattatctgatatgagaagacatacagtgtcctacaatggttgttcagatgaggtaacttactttgagattgaggccttggcagaattgatagcagagagttcagtagaaaatgcaaagaacacaaacttgcaactacaaggagaagagctaagtaatggaaatgtgccattagaaggagcagtgaagcacttaataagtacattcgataaagatggcaatgatgagaaattggctccagggctgcaaaagtctgaagtggacattgctggaaatgattttgaagcagaagaagagttaaataatggaaacttgttactggaaggagcggaaaaagatttattttctggattggatagagaagaagtcaataatgacaactcggctctagttggtgcaaatcctgaagtggacattaatggaagcaatgaagcaggatcagaagaattaaataaccgaaacttgttattagaggtaacagaagaggagttgaatgagtgtgcatcggatggtggagatcctaaacatgaccaatcaggtctagtgggtgcaaaatctgaagtggataataccagaaatgcatctattccccaaaggttaagtactgaagaaggaagaatttcacgtgcttaccctcgtgaacttgaagaaggtacatctggttatcatgcttcttccaaagccgttcaccatagctttgactgtgtaagatctgttgatacatttgataacacagaagtaattaatcctggttttgagactagtggtacactgggaggattgtctaagtcctcaaccattcaaagctatcatgcttatgatggcagcatctcttcaaacgatggggtggacgagcagttccctaatcagtatttagattcttttgagaacacttacactgttgctaatggtgtttctgagggagggtccagaaagggaaaaggccttgttaatagcatgttacgcggtgatcttgaaacacaacgccaatcatattttcgcgagggaaggcctcgtatcccaagagacaacaggaggaatctaaatgaagtgtcagagactacaaggcacggccatgcacattggatgagaacaaagaaagatgagtttccactcagagtgcctcaccatcgaagtggttcactatctggctatgaaagtggcagcacatcaaatcaaatgcacgatgagttatactgcagctctagctatcgatcacccgactcctttgatgaccctgaccaggagaagatgaaactgttgagaatgtggcaatgctccgcagagttgcctccacgtgatctttatcagcatgaagagttatgtaggcctaatcaaggtcacagttgttgctcaccttgccattcttatccctcaagtccacaatggctaatgacctctaacctcccagcacatgcccatgaaacaaattcttatgatcagaggcataggcccgaggtgaagaaatatttttgggagaaaccgagcttgactaggcgacattaccggccagtagcaggtggagcaccgtttgtcacttgtcataaatgcttgaagctgctgcaactgcctgctgatttcctcctcttcaaaagggtataccaccagctcaaatgtggtgcatgtcaagaggtactcaagttttctctgcagaacagaagtcatatagtctcgtatgcaccaaatgctctcgagcccccatcatcatctagtaaccttgatgaccgaaacgaggtgattgatggaagcaatccacattcagtgtctcacgcagaccacatttcatattctgatgattatggtcattctgttggtaaaagctactcttcagaaggtgatcctgtgtctgcggcaccattacatcccttgcatgacagtgcatatgataagcaaactgtctcttccggcaccttggagcctataacagagaaggacaaaaatgcttcaagaagtcctaccacaagtaaagctccagtggaaacagacgaacaagccgtgaactcctccaataatgtgtcatctgaactggaggcacattcacagccaaaaagctcaccccttcatcgactgatgggttatacctcgccgagtcaagtgataagagggattccgtaa

SEQ ID NO: 78558 - DNA, 1275 bp, Glycine max
  Peptide Sequence Number=SeqID_195336
atgcctgtcatgggaaagggaaatctgaagctgtatattggtggattagttcaggtggtaactgaggtttactaccttccaggattgatgaacaacttgctcagcattggtcagcttcagcaaaagaatctcaccattgtcttctctaatgatttgtgcaaagtctatcatgagaatagaggcttaataatgtcaactcaaatgtctgtcaacagaatgtacatcatacatgcatctgtcctaactcccatgtgcatgaaagtcacaaatatgagtcaatctcaattgtggcatcatagatatggacacttgaattacaaaggattgcgtgtactggctaaaaaggagatggtcaaggggttgcctgaaatagaagaaacagaagaaatatgtgaagattgcatcattggcaaacagcacagagattctataccaaaaactgcgaattggagggcaaatgagaagctacaactggttcattctgacatttgtggaccaatcaaccctacatcaaatggaggcagcaggtatttcatgacattaactgatgactttagtagaaaaacttggacttatgtgttaacagaaaaagcaaatgctctagctattttcaaacaattcaaggctgttgctgaaaaagagaccaactgtcaaattaagtgtttaagaactgatagaggtggtgagttcacctcaactgcatttaatgatttctgcagtgaaaatgggatcaagagacagttgactgcagcatatactccacagcagaatggagtatctgagaggaaaaacagaacaattatgaacatggttaggagcatgcttgcagggatgaaagttcctaagaggttctggccagaagcagtgttatgggctacatatgtattaaacagaagtccaacaatgtctgtcaaagatatcactcctgaagaggcatggagcaatgtgaagccttctgttcatcatttcaaagtgtttggatgtttagcttatgctcatgttactgatactcaaagaaagaaattagatcccaagagtatcaagtgtgtgaacttgggaatcagtgaggagtcaaaggcctacaagctctatgatcctgttgctaagaagatcatagtgagcagggatgtaatatttgatgaaacaaagggttgggaatgggatggaaaatctcaaaaattgcaaagtattgatgtagaagagagtgtagatccatctgtagcagaagatgtaaatgcacatggtgactcaagtgataatgaatctccactgtag

SEQ ID NO: 78559 - DNA, 243 bp, Glycine max
  Peptide Sequence Number=SeqID_195337
ggaccttatgaccgaaaacagaccaaagaaatagagtttgcggttttgaagagggaggacggagttgcaaaaggatgggtcgcaggcgaatatgcatatggtgttgtgggagacggaagtggtgggtggaaggtatcttgtgtgaaagctagggaggataataatgaggggaggaggagaaatattgatgttgttgggatggaattactacttaagttgttggccatcgaggacttaggctag

SEQ ID NO: 78560 - DNA, 1267 bp, Glycine max
  Peptide Sequence Number=SeqID_195338
atggtggggtctactactctctctcagacagctattactgagtctgccagccacagtacacttgaatcccatagcagtaatcatcttcaaggtcctgtaagactggatagccatgtgggtactatgttccccaaaccctcacctcttggttctccacaaccctttcttcctcttgcaccttcacctttggctccattcaccaataccactatcccaaagttatcaggactttgcactttgaactttactactgcggaaagtttgataagtgtggcagcaattgattgctgggaagtttttgcgccatttctggctaatgtgatatgttgcccccaattggaagccactctcacaattcttattggtcaatccagtaaacataccaatgtacttgccttaaacgggaccgatgctaaacattgcctggcagatgtggaacaaattttgatgggccagggtgccactaataatctgaagcagatatgttcaattcattcttcaaatctcaccgaggcatcttgcccagtaaaaaatgtgaatgatttttatgacatggtggatactactaaactccttactgcatgtgagaaaattgatcccgtgaaagaatgctgctaccaaatctgtcagaatgctatattagaagcagctaaagcaattgcatcaaaaggctctgatattttggaaatagatgcagcacatgttcaacctgaacactcaagtcgggtcaatgattgtagaaatgttgtcctccggtggttagctagtaagcttgaaccttctcatgccaagaaagttcttagaggactgtctaattgcaacgtgaacaaagtttgtccactggttttccctgacacaaagcaagttgccaagggttgtgtggatgagatacgtaacaaaacagcatgctgtaatgctatggaaagctatgtgtctcacttgcaaaaacagagcttcatcacgaacttgcaagcgttggattgtgctgagactttggcaatgaaaatgaaaagatcgaatattactgcagatgtttatggtctctgtcacataagccttaaagacttttccctccaagaggctggttgtctattacctagtttgccttcagatgctacatttgacagtgtttctgggatcagcttcctctgtgatctaaatgataatattccagctccttggccttctacatctcaactgacttcttcatcatgcaataaatctatcaacatccctgctcttcctgcagcagcatcaagtcaaagtt

SEQ ID NO: 78561 - DNA, 222 bp, Glycine max
  Peptide Sequence Number=SeqID_195339
atggagagcagcaagcttacctcgacggtgaaaacggcgaagatcaatgaagacgtcctcaatgccaacaatggaagcactcaacagcaacaacatggtgaaaacaaccacaaaacaaagaagaagaaagcacagtgtgagcggatagcagaacggtacagtacgtacgaaagaggtggtaatgtccaaccaggaagaggagcctttttaaattttaaatga

SEQ ID NO: 78562 - DNA, 402 bp, Glycine max
  Peptide Sequence Number=SeqID_195340
atgtctaaagaagttgatatgaatgatgaaaatgaacacgaagctggtgtgaatgaaaaaaaatatgttgattgttctgaggtgttcaatacttctcagatgtttgctactcaagatgatgttttgcggtgggctcgatcagtcacttatgaaattgaatttgtggcgaagctgtggaatgctcctatgatgggcagatggagcaaaaaggccacatcatcaagcgtgatggtgacctctcatactggacgatggaaactgctcgtttccttctgtcaccctttgacaaaagcggatataaatccccaatcgccaatatccaatgaacatacgatcaaagaacttaatcttgtggctgcaatcatcccttcaatctcagaagtagacctccaaaatttttga

SEQ ID NO: 78563 - DNA, 411 bp, Glycine max
  Peptide Sequence Number=SeqID_195341
atggctgctgttggtgtttcgtctggtctgattttatacggatcgtatgatctgtatgcgttatatgatccgtgtaacacatacggatcagctaatccgtatgaggcatacagatcatctgatccttttgcctcatataattcgtatattatggttagaaatagaggtttaaggtgtgccttagacagagttataggaagagccctgaggagaggggataatcttgattcagatgatgttttccagcggcaaatgcccacaatatccgcacataggcaagggaagttgtcgttgttgctgaggatgctcctcacatggatgatgcagcttaagagctattccaacatgctaaagaagctgttgatgatgctgagggtttttcaggcagacctcgtgacacatcagtactga

SEQ ID NO: 78564 - DNA, 1134 bp, Glycine max
  Peptide Sequence Number=SeqID_195342
atgataccagaactggattttgagattccaccagaagctcaacgtggtagtctgtcaacggtggaagggatacttatgagagcagctgatgaacttcaggctcttcaagaggaacgcaaaaaagttgctccagagacagctgaggcaattgatcagttcctggtgaaactgcgagcctgtgcaaaaggagaatcagccttcacatttattcttgatgatcctgctggaaacagcttcattgaaaacccgtttgcaccatcatctgatccatcattgactatcaagttttatgagagaactcctgagcagcaagcatcattgggataccttgttggttccactcacattgaaggaactcatgatcaagcaccagaaaggggagaagtgactgctgatcaagtgaggagagaacctcatgggtcaataggggcaacagctggtcatcgagccattgcacagagtaacagttcagaaattgctgaagccttatttcgatatactgcaccagaagaggtgatgacattcccaacttcttgtggtgcttgtgccgctaggtatattccttacttccaagaagtaattgttatggcatccacatgtgattcctgtggttaccgcaactctgagttgaaacctggtggtcgaattcctgaaaaagggaaaaaaattactcttaatgtgaagaatgttaatgacctgagccgtgatgtaataaagtctgatactgcaagtgtaaaagttcctgaacttgacttggagctggcaagcggaacccttggaggaattgttacaactgttgaaggtttaattacaaaaattagtgaaagccttgagagggtccatggctttacttttggagatagtctcgatgaacagagaaaaaacaagtggatagattttaaagcaaggctaaacaagcttcttagcttggaagaagcttggactctaattctcgatgatgcattagccaattcttttgtagctcctgcaactgatgatctgaaagaggacaatcaattatcatttgaggaatacgagaggtcatgggaacaaaatgaagaattaggtctgaatgatatagacacctcttctgccgatgctgcttatgaatcaacaaatactactaaaacttag

SEQ ID NO: 78565 - DNA, 468 bp, Glycine max
  Peptide Sequence Number=SeqID_195343
atggtggtgaaggcagagaaagccatgtcagtgagggaggaaagtggtgattcaagaggaacaattgatcccttgaagcagcactttgtgctggtgcatggcgttggtggaggaggttggtgctggtacaaaatcaggtgcctaatggagaactctggcttcaaggtctcatgcatagacctcaagagtgcaggaattgatcaatctgatgttgattctgttctttctttcgatgactacaatcaacccctcatggatttgttgtctgctttgcctgaaaatgaacaggtgatattggtggggcacagtgcaggagggttgagtgttacccaggcttgtcacaagttcgccaagaagattcgtttagcagtgtatgtggcagcaactatgctcaagttgggattcttgacagatgaagatctaaaacatgtgagtcctgttcatcaaatctctttctcagcacattga

SEQ ID NO: 78566 - DNA, 735 bp, Glycine max
  Peptide Sequence Number=SeqID_195344
atggtgtggtgccattggaggcggagttgttgtagagcaacccattggaggctgtatccaaatggaggaggtccaattgttttgtcccttcttcagtcttatagggaccactgtgttggtcatgtttggatacgttgggagtgcccaaagttgaagcttgtaaaccacaatgcccaagcattaacgtcccctactcatttgcaagttaaggcttatgtggagtggtcaagattatctgctcttgctacgacatggtatcctatcgaaaataggagcttggtgaatgccttttttgagaggtggcaccaagagacgtcttccttccactttcctgttaaagagatgaacatcactttggataatgtgtcttgtttattgcacttgcttgtgacatgcagggccattgatcatgtcctctcactctttgacagagaggcgatgaagatcctgttgatgactcatctgggtattccaacagagacaaaagttgcagcagcgacacacgcagacttgatcaatggtatgatatttgccaacatgtccttgactcacgtccatgttgcgtacctcaagtatctcatggtcttggatgcttgccacaatgtttgcgcatctttccaatgttggctactcagagagacacaagggttatgtggtggaggacccaatagccaccagatggaaggcattgagagatattgggtgtgccctttcgatcaggaagagattggatga

SEQ ID NO: 78567 - DNA, 374 bp, Glycine max
  Peptide Sequence Number=SeqID_195345
atgggggagacacatgaagtaccccgagattgcactatagccgacttcgagcctcacctcgaatatgtcactaaagggcaagcatttggtggcatacccctgccaaacactttgaggggccctcagtaccacccacaaccacacttacaacccttacattttgcggtggggaggttgcctcctaccatggtggaaaatgaaaaatttgatcatatagaagaaaggctgaaggccattgaaaggggcagagactatccttttgctgacatggcaaaactgtgcctagtgcccgacatcgttatccctccgaagttcaaggtgtcagacttcaataagtacaaatggactacttgcctcaagaatcacctgaagat

SEQ ID NO: 78568 - DNA, 105 bp, Glycine max
  Peptide Sequence Number=SeqID_195346
atgggactgggttgtgcatactccactggcgcgccagctgaagaggcagaaagaattacaaaacgggggagtgccgaattacaagataaatgcctagggtattag

SEQ ID NO: 78569 - DNA, 150 bp, Glycine max
  Peptide Sequence Number=SeqID_195347
atggaggtgcaacaaagtggtggaaaaccctttggcgtaagcaaaatcgggtttttcccacaacgtggatatgttatgcgcgacaaggatggacggacattcttggaaaaagaattaccaggagagtgtatcggtaataatggggagtga

SEQ ID NO: 78570 - DNA, 3735 bp, Glycine max
  Peptide Sequence Number=SeqID_195348
atggaggaagaggaggatcgaattttgctctctagtttgggtgtaaagtctgccaatcccgaagacatcgagcgcgacgttttggaaaaggctactaggaatgatttagtgaccgttactgaagtcgaaggtagcgccaaggaagagcgttctgatttacctgaaaatgttgatccatcggctaatgataaagctgaaattcgtcagaagttgagagctgttcaatttgaaattgacgcggttgcctccgccgttgaacggttgagtaatgttgaagataatgaagaatgtagtgatgctggtgaggacggcccagggcgagggaccgccgagggtgagtccgatggcaattcgaaccttcagcgtgctcttgctgccgataggctgaggagcctggagaagacgaaagctcaactagagaaagagcttttggatttgttcaaggatgatgactccaaaagtgctgagcatgaagaattggtccttagtttagttaaggaagaacggaaatcaaagagaaaggttaaagaggataaaaaattgaacaaaagtgcaggaaagcggcctaagaaagtctcgtttgatgaggatgctgattttgatgctgttctggatgcagcctctgcaggctttgttgaaacagatatcaatggtggaggtagaaatagaagaactcattttctactacttatggttcaggaaagggatgaactggtgagaaaaggaattttaactccttttcataagttggagggcttcgagcgccgctttcaacaacctgaaacatcaactagtcataatgcagctgaggaagaaaatgacggtgacctcgcttctgccagtattgaaagagctgccagatccatgtctgaggcagcaagatctcgcccaaccaccaagttacttgagcctgaagctgcaccaaagcttgatgcgcccactattccttttcgcaggctcaagaaaccactaaaatcttccaaacctctagatgtggagctgaataaagattcaaaaaggaaaaagaggcggcctctgcctggtaggaaatggaccaagcgtgtttcttgtgaggattcacatccggaagaaagtgaaaacacgaatggttgcttggattcttcaagttgtgaaaatttagaagaacaagatgttgaacttgatgatcaggaatcttcttatgtaacattagaaggtgggctgaaaatccctgataacatatttgaagctctgtttgactatcaaaaggtcggtgttcagtggctgtgggaattgcattgccaaagagctggtggaattattggcgatgagatggggcttggtaaaactgttcaggtcttgtcatttcttggtgcattgcattttagtggcatgtacaaacccagcattattgtctgtcccgttacactcttgcgacagtggaaaagggaagctaaaaagtggtacccaaaattccatgtagagcttttacatgattctgctcaagattctgctccaagaaagaagcgagctaaatctgaagaaacagactatgaaagcaatagtaaaagtgatagtgattatgagaaaagtgtggcatctaaaagtacaagaaaatgggaatccctgataaatcgtgtcatgagatcagaatctggattacttatcaccacttatgagcagctcagaatattgggggagcagctgcttgacattcaatggggttatgcagttcttgatgaagggcatagaataaggaatccaaatgctgaagttacccttgtttgcaaacagctacagactgtacaccgcattataatgactggtgcacctattcagaacaaactgacagaactgtggtcattgtttgattttgttttccctggaaaattgggtgttttgcctgtatttgaagctgaattttctgttcctatatcagttggtggatatgcaaatgcttcaccattgcaagtatccacagcatacaggtgtgctgtggtgctgcgcgatttaatcatgccttaccttctacgacgaatgaaggctgatgtgaatgcccaacttccaaagaaaactgagcatgttctattttgcagccttacatcagagcaagtatctgcttatagagcatttttagctagcactgatgtggagcaaatattggatggacacaggaactctctttatggaattgatgtgatgcgcaagatctgcaaccaccctgatctgcttgaaagggatcatgccttcaatgatccagattatggaaatccagaacgtagtgggaaaatgaaagttgtagctcaagtgcttaatgtttggaaggaacagggtcaccgtgttctcctttttactcaaacccaacaaatgcttaacatttttgagaattttttgactacttctggtcacatttatcggagaatggatggtctcactcctgtaaaacagagaatggctttaatagatgaatttaatgattcaagtgaaatatttattttcattttaacaaccaaagttggggggttggggacgaatcttacaggtgcaaatagggtgatcatcttcgaccctgactggaatccttcaactgatatgcaggctagagagcgtgcatggcgtattggtcagaagcgggatgtgacagtgtataggttgatcacgcgtggaactatagaggagaaagtgtatcaccgtcagatttacaaacattttcttaccaataagatattgaagaacccacaacagaaaaggttctttaaagcccgggatatgaaagatcttttcacacttaatgtggatggagaaactgggtcaactgaaacgtcaaatattttcagtcaaatatctgaagaagtcaatgtcattgggacatataaagaaaataaggataagtataaacatagccaaactgctgaactggtttctgaagatgttgcagttggtaatgatgacaaatcagagagagggtctttgagaggaaaggggaaagagaaggttgaacacgaacatagtaatggggttggtgaagaaacaaatatattgaaaagcctttttgatgccaatgggatacatagtgccatgaaccatgatttgatcatgaatgcccatgatgaggagaagattagacttgaggagcaagcatcccaggttgcacaaagagctgcagaagctttacgtcagtcacgaatgctccgaagccatgatagcgtatctgttccgacatggacaggaaggtcaggaactgctggtgcaccatcgtctgtcaagcggaagtttggatcaactgtgaatccccagttggtaaataatagcaaagcatctgacgaattacccaacaagggaactaacaagatcaatggatttgctgctgctggggcatctgctggtaaagcattatcttcagccgaactattggctcaaattcgaggtaaccaagagaaagccattggtgctgggcttgaacatcagtttggtgtgtcgtcaagttccactaatcaaccaagatctggagatgttagatcttccagggctactgaaaattcatctgtacaacctgaagtattgattcggaaaatctgtacttttatacaacagcgaggtggcagttccgattcagccagcatagttcagtatttcaaggaccgtattccctcgaaagatcttgcgctgttcaagaatcttttaaaggaaattgcgactctgcataaaggatcaaatggatcctattgggttctgaaaccagactatcaattctga

SEQ ID NO: 78571 - DNA, 942 bp, Glycine max
  Peptide Sequence Number=SeqID_195349
atggagagtagtgagggaattaggtgtaaggtatgcgtgaccggcggtgctagttacataggctcttgccttgtcaagaagcttctgcaaaagggctacaccgtccactccaccctcagaaactttaaggacgagtcaaagataggccttctgagagggttgcctcatgctaatgatgagagactggtgttatttgaagcagacatatataaaccagacgagtacgagccagcaattcaaggctgtgagattgtctttcacgttgctactccctatgaacatcaatcggattctctgctgtttaagaacacaagtgaagctgcaatagcgggggtgaaaagcatagctaagtattgcattaaatcgggaacggtgagacggctaatttacactgcctcggtggttgctgcttctccgcttaaagatgacggctctggttttaaagatttcattgatgaaacttgttggacgcctctcaacctttcaatggggactcttcatcagtggtacactgattcgaagacacaggctgagagagagttgctgagttatggaagcggtgaaaatggtgggggattggaggtggtacaagacaatgaagccgcataccagtctttgaagttcttagaagaattggatggaaaaatcccaatagttcacgttgaagatgtctgtgaagctcacatcttctgcgcggagaatccatcaattaatggcagattcttggttgcaagctcatatgcatcatccgcagaaattgcaaattattatcttcaagcctatcccgaattcaatttgaaccacaagtatttggaagggccaaaaagggatataaaatgggcgtcaaggaagctgacagacaacgggtttgtgtacaaaaatgacctgaagatgatattggatgattgtatcagatgcgcaagaaggatgggcgacctctag

SEQ ID NO: 78572 - DNA, 128 bp, Glycine max
  Peptide Sequence Number=SeqID_195350
actcggtgagagttacgccatggacgattcctctcaactcctccaagcagcttctgattttgttcactacccagcgatgattcctccagggactttctcaatcgtttccctctcccagtcatcatcaa

SEQ ID NO: 78573 - DNA, 483 bp, Glycine max
  Peptide Sequence Number=SeqID_195351
gaatccattgatgaagaagatcctaggcctacaagctccaatggagcttgcatcaagacacatccaaggtctgatggatacaatatcaacaagtattcgttttacaccaaatcacaagacgacaagagtacaatgcaaaacagtggggttagtctaagggctgaatctcaacactttgctagtgtagatgatgacaatcctcgcctagcttccatgccttactttggagtcattgaagaaatctgggagcttaattatgtcaaattcattgtttgtgttttcaagtatttgaataagctctcttatgagaataagcctttcatcatggcagaattttatgttcaagatccttgtgatgaaaggcacatggctacaccacccagctcccctcctcctcctcctcctgagtcagcaatgcattccccatctacctcgaagaagacacatgactcaaatcattggctactaaaccagtccttgtag

SEQ ID NO: 78574 - DNA, 627 bp, Glycine max
  Peptide Sequence Number=SeqID_195352
atggaagagagcaccaagaggaaacacactagtctgatccatgaactaatccaaggaaaggaactaacaaagcagcttagtaaccacctggtttcatcttctccaatgtcccatcaaaccaatgaattgtttgttgagaaaatacttttgtcttatgagaaagcactcaccatgctgaactggggctctattatgggagaggccaagaccaccagtggcaacatcatggattcccattgttcttttacaaatggtgggagccccagaagtgaggtcgtggaccgtgaattggagcacaaagctgccctcaagaaaagaaagaccatgcccagatggaccgagcaagtgaagatttgctcaagaagaggacttgaagggtcattggatgatggatatagctggagaaaatatggccaaaaggatattctcagagctaagtttccaagttatgtgagtggtgcaagagggatgcttccatctgtacactggagaaacctgacactcttatcaagcggaacaacttgttgcaaagtgtcatgttggatgtgggtttggcagctcatgtgcccccattcagaagtaaacgcaataacatgcaaattggcaaattgcaaatcgaattcataa

SEQ ID NO: 78575 - DNA, 1986 bp, Glycine max
  Peptide Sequence Number=SeqID_195353
atggagttggagcagcactacgagtatcaggtgtcggttaatgacattgtacttgcaattaggagtgaacttgactcagaaattgtagacacattatcaggcacatcatttgatgtgaaaaggggaaaattgttagtgaacctcagacatttggaacccattcaacttagcccagaaaaggttcaaagttgtagaagatttcagactaccctctttaggatcctcctaaatcgggacgttactaagttaacaagtgtttcagatgatttcagtttgggagataatcctgaaattgattttcttctgctcccagccactgttaaacaccagagaccttcaaattcgattattgattggaagcctgttttatcggttcctttttcatctgaaatctacactcctcataatggtagtatttatatcatttataccactgatggtacaaagaaattgaatggaaattcaactctaaaccaaggacttaagggaattactacttacaaggagcacttcaaaaaacgccacgggattgaattgggttttgaacatcaatccctacttcatggaaggaatcttttcaaagtggagaattaccttctgaagaccagacaaaagacggagaaaggaaaaaatatgagctctgttgacttgccgccagaaggcttgctcgttgctttcaacttaaaaaggatgctcttggatcatttcacgccaaatgatatcccaatcagcaaggtattgcaagcaataactgcaaagggatgtgaagaggcctacgattatgattacttagagacacttggagattcttatctgaaatacattgttagtcaacagcttttcaagaccaatcaaaatgatcgggagggcgccctttcagacaagaggaagaacatcatttccaatgatgtcttgtttaagtatgggtgtacccgcccacttccgggtttcatacggaaagataaatttgatccaaagcagtgggatgtacccggtgataagtcaaacagtattctcttgctaaaacagaagttggactccagtagaacaagagtatatgttcgaaagacgagagaaatagacttgggaatcattgctgatgttgttgaggcactaattggtgcctttattagcacagaagatgaaaaggctgctttatcgtttattaattggattggtatcaatgttgacaccaacattatgccgtatgagaatgagaggcacattagcattattgccccagaggagcttgtaaaagccaaacttttaaaatcccggctgaactactcgtttaaagacccttatcttttagtagaggctctcacccatagttctggcaaacggccagaaattcggacatgttatgagcgactagagtttcttggggacgcagtgttggactatgtcatcactatgcatttctacaaggaatattctaatgacaaattctcagcagaatttttcactaacatgaggtctatttctgtgaacaatgagtgttacgcactgtcagccattaaagccaagctggatgaacacatactctgtgactcggtagtaaaaaataacattgcccagacaatggaaggtgttaagaacttatctttggaatcaacttttggatgggagctagaaacatatttctgtcaggtgctggcagatgttatagaatctatagcaggagcgatttttgttgattcagggtacaagaaggaggttgttttccaaagcataaagccccttttggaaccccttgttacacctgaaacagcaaggagacatcctattagtgagttgcacgaactatgccaaaaaaaaggctacaaaatgaaagtatatccccccgtccgcgtcaacggtgaaacttcagttacaattgaggtgaaaaccaacgggatcacttacaagaataatcctcctgctaaagcatctaataacgatacagctcgtaaactggctgccaaggatgttttaaaacaaattaag

SEQ ID NO: 78576 - DNA, 438 bp, Glycine max
  Peptide Sequence Number=SeqID_195354
atgtctaaagaagttgacatgaatggagaaaatggagaggaacctggtgtcaatgaagaaaatggagaggaacctggtgtgtttcaacatattgatcgttctaatgccttaaatacttctaaggtgtttgctacacgtgatgatgtttgcattgggctcgctctattgcgtatgatattgattttgtggcggagtggaaaatatagggctaggaagaaagatttggtacgaacagttattggtagtagaaaatgtgggtgtctctttaagctgcgagcgaaaccagtggtgggaggtgaaggatggaagactaagttaatgtgtgggagtcataatcatgcattggctaagtcattaattggacatccatatgttgatcgactgactaatgttggatcaagttgcctcagaataattaagaatgggaggttgaattaa

SEQ ID NO: 78577 - DNA, 342 bp, Glycine max
  Peptide Sequence Number=SeqID_195355
atgatgataagtggaaggctactgtccaaggatattatatactccttcacggatgaaccttgtgttaaagctgttatttcgtctattgatggtagacttcagtcattggaagcttcagatagagatgaatgtgaaactgcacttgaatcattgggtcatatgggatcatctatccagggagctacattactactctcaggttcatcacctgctgctcgacatgttataaatgctgcttttgaacgacaaggaccaacagggcatggcagcttgaaggagcacattgctaaggttaaaatagctgaaattgcatttatggtgcaattatgcaatttgctgtaa

SEQ ID NO: 78578 - DNA, 282 bp, Glycine max
  Peptide Sequence Number=SeqID_195356
atgacatatactaggcaaaggactaaaaagagaaaggagccccttggtgttgaagatgctgctgcacctaagacaaaaagaggtcaagtgagaggatcttcatcccttagaggaaaagagcaaatgatagaagttgaagataatgcagtcttggaagaatctgaaaaggagttacaaggcattgattttggggactcagaagaagaagttgaagggcatgccctattactagacaatgaggattatgattgtattggggaaggggcagagcagaatgaatag

SEQ ID NO: 78579 - DNA, 705 bp, Glycine max
  Peptide Sequence Number=SeqID_195357
atggcagcatcagtttcatgctcatggctaactcttccgtcccaaatgaggaaactttccctcacatcctcttcttcttctctttccatctccaattctgcttctctcagtttctccagaaacctctcacaccctctcttctcacaaggtaactgcttgtcgctgagcacagtgcagaggcgcgcgtctgtggtctgcgaggctgcgccgaaaaaggtggattcggctgtgaagagagcgcgccaagccgagaagcgccgcgtgtacaacaaagctcggaaatcggagattaaaacacgcaccaagaaggaaaaaggaaataagaaggtgactcgaatagggaaatgtggaccatttatgtattctaggtctaggtcaattactagtgtaatacaacttacacaagctcagtccactctaaccgaatacaagattccaaaaacagttaagaaacctgacatcttaacagatgatgttttggaggctctggaagtgcttaagaagaaacaagatgcgcaggccgaagaaatcctctccattgagaagttgatcggagaggcatactcgataattgacaaagctgtgagagtaggcacactgcacaggaacactggagctaatcgcaagtctcggcttgctcgaagaaagaaggcagtggagatccatcatggctggtataccccaactcctgaagccagtgtctga

SEQ ID NO: 78580 - DNA, 1413 bp, Glycine max
  Peptide Sequence Number=SeqID_195358
atgaagaagctgaaaaaatcagagatgcttcgtagaggccaggttgagcatgttaaagctgaaaggaatctcctcgcagaggttgacagaaattgcatagtcaagctttattgttctttccaagatgatgaatatttgtatcttattatggagtatctaccgggtggggatatgatgactctacttatgagaaaggataccttgactgaagatgaagccagattttatgtaggagaaacaattttggctattgaatctatacataagcacaattatatacatagggatatcaagccagacaacttactacttgatagatatggacacttgaaattgtcagattttggactttgtaaaccattagattgtagtgcacttgaagaaaaggatttttctgtgggtcagaatgtgaatggatctacacaaagctcaactcctaaacgctcacaacaggaacaactgcaacattggcaaatgaacaggaggacacttgcttattccacagttggtacaccagattatattgctccagaagttcttttgaagaaagcatccaagtttcaccaagttgttggtctgagtggtcataagctcagtccccttaagcaaggtttcgggttcaagccttgtggatggaaaaaagtgattgggaggggagaccccactaaaggcggtcagtcaagttcccctgcagagattagtcatcagcaaagctggtggtcactgggagctattatgtacgaaatgttggtgggatatccacctttttattctgatgatccaatgttaacatgtaggaagatagtaaattggaaaacttacttgaaatttcctgaagaagctaggctatccccagaagctaaagatcttattagtaaacttttgtgtaatgtcaatcaaaggctggggtcaaaaggtgcagatgaaataaaggctcatccattcttcaaaggtgttgaatgggataagctctatcaaatggaagctgcatttattcctgaggtcaatgatgagttagatactcagaattttgaaaagtttgatgagtctgacagccaaaatcaatcatcatcaagatctggtccatggaggaagatgctttcatctaaggacttgaattttgttggatacacttacaagaactttgaaattgtcaatgattatcaagttcctgggatagctgaactgaagaagaaacagtccaaaccaaagaggccaaccatcaagtcacttttcgattgtgaatcagaaacatcagaggggtctgatactgatacttctgcaaatgatcaacctgctcaaggaaagctttttgaagctcttgccaccccagttagaggtatctcctcatcgcaacaagaatcttcctcccaggtcctaacccgccccaatcacaagatctatgcagtctga

SEQ ID NO: 78581 - DNA, 144 bp, Glycine max
  Peptide Sequence Number=SeqID_195359
atgtacagaacagaacctctattgggaagaacattcagcgaagacaaccatgatcaagctccgacaatggcgtccatagatgctagctggacaagacagtgcaacaattggttcccagagattcagatccaacacggtgaataa

SEQ ID NO: 78582 - DNA, 492 bp, Glycine max
  Peptide Sequence Number=SeqID_195360
atggctatattggaattgaatgatttaataaccatgatggtagctataattggcaagctaagggagaatgacttagagcttgggagactaaaggatgaagaagttgacaagaagaataatgaattagccttaaagataagcacttcacatcatgaagctagtgatgaagacccttcagtaaatttggttgatgcaaatatgaatttgcttgttaaaaagttctccaagttcatgaaaaagaaaggaaaagacaaaggaaactttcaaaagaagagcacaaagaaaagtgacttcatcacccctaaaagctacacatcttgggatgataatgatgcaagttcctcaagtgaggaggaagaagaaaatctatgtctcatggttgacattgatgaagatgagaccaaaagcaatgtagatagaagatcacaattatggagagaatcttcaggattgaacaatatgaccgttgtgcaacttgatcttgtttcttga

SEQ ID NO: 78583 - DNA, 432 bp, Glycine max
  Peptide Sequence Number=SeqID_195361
atgaagggagtgtttgaaatgtccatgatgggggagttattctacttcatagtactccaaataaaacagttagaaagtggtatcttcatcaaccaatccaaatttcaagctaatcctaaggaatctcatttagtggttttaaagaggattcttatgtacattaagggtgcattaaaagtaggactgtggtattctaagggtgcatctattagcttatttgggtattccaatttagattatgcaggatgtaaggtagatagaaaggctactagtggaacaagtcctttgcttaggagaactttggtttcgtggcactctaagaaacaaacttgtgtggctttatctatagctgaggttgaatatgttgcttttggtagttgttttgttcctttggatgaagcaacaacaagaggattttggtatctaccttga

SEQ ID NO: 78584 - DNA, 165 bp, Glycine max
  Peptide Sequence Number=SeqID_195362
atggctgacatagcaggtctggctgaggctgcaggggcaaggtttagttcattggagctcattgggcagggatcatttggcgacgtgtataaagggataacagaatgtattgtgttggcatctgtatttgatgataaggtgttcttgatgtacaagctacactag

SEQ ID NO: 78585 - DNA, 546 bp, Glycine max
  Peptide Sequence Number=SeqID_195363
atgggaatgcctgatgttggtccttttcaaaacaatttttgtatacacacgatgagcacacaagaattacagtccccggctcaagcatctcgtgaatcacagagtgaacaaccaaaaaatcacactactgatgctcctgttactgattcggtttcagcatctgcttcaagcaatgatagcaaaaaaatttcacggcaggatatagatcttgtacaaaatttaatagaaaggtgcctacaattatatatgaataaagatgaagtggtcaaaaaacacttcgctcgggcaaagatagatcctggatttacaactctggtatggcagaagctggaagaggagaacactgatttctttagggcctactatatcaggctaaaattaaaaaggcaaatacttttgttcaatcatttgcttgagcatcagtatcatatgatgaagtatcccttgcctacaaagattccactggctcccatacagaatggagtccatccaatgcctggtaaattcttgcctcatattgtattctcttctcatgttatgcaataa

SEQ ID NO: 78586 - DNA, 2160 bp, Glycine max
  Peptide Sequence Number=SeqID_195364
atgtctgcagtgtggtttgaggactggaaatcagagtcatcttttagtccagagcaagaagattctattgacagtgggaatcacaaaagaagaccaagtgtgggtactgttttaaagagtataggaagaaggcttgagagtgggtcggagaagatgaagaacttgagaagagcttcagctgtccatcctgtaagtgatggacagaaaaagctgccacctaggaagaaaattcttgatccacagggtccggtccttcagaaatggaacaaaatctttgtaataacgtgtgtgctggctgtctctgtggacccgctcttctcttacattccggtgataaataatgaggaaaaatgtgttcatttggatggagcattgcagatcactgccagtgttcttcgcaccttctttgatctattctacattcttcgcataatctttcagtttaagacagcattcattcccccttcttctcgtgtttttggaaggggtgagctcattgatgatcctgtggctataatgaaaagatacttaacttcacacttcatcattgatattctatcaattattccacttccacaggtgattgttttagccataaatcgaaattcgaaaacatcagatccatttgtagcaaaggatttgttgaagtattcagtattaatccagtatgtgccaaggcttttgcggatgtatccactattcaaagaagtaactagaacttctggcatattgaccgagacagcatgggctggagctgcttttaatctttttctctatatgctagcaagtcatgtggttggagctaactggtatatgctttcggtagagtcagagttgcggtgttggcgcagagagttaaggaatgcttcactctatcatcgaaaatacatgagttgtgtagaccgcaatccaaatgtctttacacttctcaatcgaacttgttctttggttgaccctgacacaatcaaagacccaaacaccttcaattatggaatattttttgatgctctagattcacgtgttgtagaatcaacaacagattttcctcagaagttcttctactgcttttggtggggtttgcgcaatttaagttctcttggacaaaatctaaagactagtactgatgtctcagaaatagcttttgcaatcttcattgccatctttggattggtcttattctcattacttattggaaacatgcagaaatatctgcaatctacaactgtaagagtggaggagatgagagtgaagagacaggacgcagaacagtggatgtcccaccgtatgctacctgagaacttgagggaaagaattagaaagtacgaacagtaccaatggcaagaaaataggggtgttgaggaggaggcattaattcgtaaccttcctaaagatctcagaagggacattaagcgtcacctttgcttaactttagttaaaaaagtgccaatgtttgagaaaatggatgagcagttgttggatgcaatgtgtgatagactgaagccagtcctttatactgagaagagctacattgttcgtgaagaagatccagttgatgagatgcttttcattatgcgcggaaaagtttcgaccatgacaacgaatggtggaagaactggtttcttcaactccatgttcctcaaggctggtgacttttgtggagaggaacttctgacatgggctttggatcccaactcctcctcaaatctacccatttcaaccaggacagtagaaactatatcagaagttgaagcctttgctctcacggctgatgacttgaagtttgttgcttcccaatttcgacgccttcacagcaaacagctccaacacgctttcaggcaaggcttgataatttatatcatgttctattcctcacagtggaagacatgggctgctactttcatacaagcagcttggcgtcgatactggaaaaagaagattgagaggtcattgcgcgaagcagaagatgagctacaagatgctttggcaaatgaggaagagtctagtctaagccttggtgcaaccatatatgcatcaaggtttgctgccaatgcactgcgaaatttgagagaaaatagcagacacaatagaatgcaacagagactactacctctgttacctccaaagccagctgaaccagatttcacttctcagaaacactaa

SEQ ID NO: 78587 - DNA, 1911 bp, Glycine max
  Peptide Sequence Number=SeqID_195365
atgaagaactggaggagagattcagatatccttcctgtaactgtaagtgatggaaagagaactatgaagaaaatttttgatccacaggaaccactccttcagaaatggaacaaaatctttgtaataatgtgcatattgtcagtcgcattggacccactcttcttttacattccagtgattaatgaagataaaaaatgccttcatttggatggagcatcgaagatcactgtctgtgtctgtgttcttcggactttctttgatctattttacattcttcgcataatctttcagtttaagacaggtttcaagacccctttttctcgtgtttttggaagggatgagctcattcatgatcctgtgcctataatgaaaagatacttaacttcacacttcatcattgatattctatcaattattccacttccgcaggtgatttttttagccattccaaacctgaaatcaccggatccattagtagtaaaggatttgttgaagtattcagtattgatcttgtatgtgccaaggctgtggcggatctatccactataccaagaagtaaagaaaactattggaatattcactgagaaagcatgggctggagctacctttaatctttttctctttaccctagcaagtcatatggttggagccgtctggtacatgctttctatagagtcagaggtgtggtgctggcgcagagagttgaagaatgcttcactctttcatgaagaatacttgagttgtggacacggcgatcaaaatgtctttcaacttctcaataaaacttgttctttcattgaccctgataaaatcatagacaaaaacaccttcaattttggaatattctttgatgctttagattcaggtgtggtagaatctacaacagatcttcatcagaagttcttctactgcttttggtggggtttgcgcaatttaagttcccttggacaaaacctcaaaacaagtattaatgtcatagagatagcctttgcaatctttattgccattgttggattggttttgtactcattgcttattggaaacatgcagaaatatcttcatcaatatacgcaatctaaaaactttatagaggaaaagaagagaaactttatagaggaaaagaagagagtgaagcggagacatgaaatagaactctggatgtcccaccgaatgctacctgaggacttaaagcaaagaattagacgttttgaacattacaaatggcaagaaaatagcggtgttgacgaggaggcattaattcgtaaccttcctaaagatctcagaagggacactaagcgtcacctttgcttagctttagttagaagggtgccaatgtttggattaatggatcagcagttgttgggtgcaatgtgcgatagactgaagacagtcctttatgataagcatagctgcattgtttgtgaaggagatccacttgatgagatggttttcattatgagtggaaaagtttattctgtgacaacaaatggtggaggatctggtttcctcaaggctggtgacttttgtggagaggaacttctgacatgggctttggatcccaactcctcctcaaatctacccatttcaaccaggacagtacaaactatgtcagaagttgaagcctttgctctcatggctgatgacttgaagtttgttgtttcccaatttcgacaccttcacagcaaacagctccaacaggttttcaggcaaggcttgataatttatatcatgttctattcttcacagtggaggagatgggctgctactttcatacaagcagcttggcgtcgatactggaaaaagaagattgagaggtcattgcgcgaagcagaagatgagctacaagatgcttttgcaaatgaggaagggtctagtctaagccttggtgcaaccatatatgcatcaaggtaa

SEQ ID NO: 78588 - DNA, 2088 bp, Glycine max
  Peptide Sequence Number=SeqID_195366
atggcttacactgcagttgccatgcctacatctccagcagctacctctgcaactatggacattgcaaaagagcataatggtcttcgccgctcgcaatccagcaaagaactatgcacacgttccattatgcggaggtcttattctgacaaccacctatgttgctccatcaatcgcatacaagccacatcagtgccgccaaaacttaagagcaatcgatcaatgggcatttccccatttcaattttcaggctccatgcttccaaattcactgcgctccttcttgtttgacccagaaacaagcaaggatgtaagtgtggaggagaaggttgtaagtattgaggaaaacatggtggaaagcagcaaagaagagatagcgaatagagccaactgggtagagaggcttatggaaatcaagaaacattggagaaacagactgccgaaagaaagcatggatccagatgcaatatgcaacgaaaatacgtatgatgaatgtgaatgtgatggagatggagatgacaatgtttgtgtggtgggtgaagatgaagatgagcaggaagtgacatatgattgcgactcattctcaaactttctggttcaagtaccatggtctgataccaaactatactctcaacttgctttcctgtgcaacatggcctatgtaataccccaaatcaaggctaaggacttgcgaagatactacagccttcaatttataacatcttctttagagaagaaagttgaagtggccaagttaaaagtgaaacttgatcaagactccactcgtgttcctatagatgactcggatgtctcagagaaaggcaaagacagtataaagaagcctcaaatcaaactagcttatgatattgctgcctcagcagcctcttatgtccaattacgagcgaaggatctcttacaccgtgctgctaagtcacgagacacacaacagactgaaaatgaagattctaatggaagaggagactcaccacgagaagagctagaaagcacttcgcgaggttacaaatcagaggttgcagcttatgttgcagcgtccacaatgacagcagtggttgcagcaggggagaaggaaaaacaagaagcagcaaatgacctccaatcacttcattcctcaccttgtgaatggtttgtttgtgatgatcccggcaattacactcgatgctttgtaattcagggctctgactccctggcatcttggcaagcaaacctcttctttgagcccaccaaattcgaggacacagacgtacttgttcacagaggaatttatgaggctgcaaaaggaatatacaagcaattcatgccagaaataatggagcatttgaagagacatggggatcgtgctaagcttcagttcactgggcactcccttgggggtagtctctctcttttggttcatttgatgctattgactaacaaggttgtgagtccctccactcttcgaccagtagtaacttttggctcaccatttgtattctgtggaggccaacaaataatcaatgagctaggcctggatgagagccaaatccactgtgtgatgatgcatagagatattgttcccagggccttctcctgcaactacccaaaccatgtagctgtagtccttaagcgcttaaacagctcatttcggtcacatccatgtctgctgaaaaataagctgttgtattcaccactgggtaaaatattcatcctccaacccgatgagaagacatctcctccacatcctttactccctcgaggaagtgccttctatgccctggacaatactaaaggtggatattctccaagtgttcttagaaccttcctgaatcaaccacaccctattgatacactaagtgatccaacagcatatggttcagaaggcacaatcctaagagaccacgactccagcaactacctcaaagccatcaacggagtcttgaggaaacattcaaagattaccgttggcagaatgaggaagcaaaggattaatcagttgtggcctctgttgacatcaccatctccacactcttggagccatgaacagaacttggagagatgcagcttgaggacaaaggagatagttacaggggtttaa

SEQ ID NO: 78589 - DNA, 384 bp, Glycine max
  Peptide Sequence Number=SeqID_195367
atggtaaatggtaatactgtgatagtgaatggttcccctgaatatgttcggtcctgttgcgagggtagcctccaacgccttggtgccagctacattgatctctattatcagcaccctgttgacaccactgtacccattgaagacactatgggagtgcttaaaaagctggtccaagagggaaaaataaggtacattggattgtcggaagctagccttgtcacaattagaagggcacatgctgttcatcccattactgctgtgcaaatggagtgctccctttggactcgtgaaattgagcaagatattgttccactttgcaggttaaagctctaccttacaagcttacaagcagaatttgtggattatccggtcataatttcataa

SEQ ID NO: 78590 - DNA, 723 bp, Glycine max
  Peptide Sequence Number=SeqID_195368
atggttagaattctcctatcacttgcaacaaacttggattggcctttgcaccaattagatgttaaaaatgcattcctcaatggcgacttggaggaagagatatacatgaatagtcctcctggcttcgaacacagatttgggacaaaggtttgtaaactagaaaagtctctttatggactcaagcagtctccaagggcatggttcgaaacatttacccaatcggttaaaaaacaaggatattctcaaggccaagcagatcataccttatttacaaaattttcttctaaaggaaaaatagctgcactagtctatgttgacaacatcatcctcactggagatgatgaagtggaattggctaggctaaaaaagaacttggcagcagaatttgagatcaaggacttgggatccttaaggtacttttttggcatggaggttgctcgctcaaaaaggggaattgttgtttcacaacagaagtatattctagacctcttggaagaaacgggaatgagtgattgtagactagcagatacccccatggatcccaatgggaaactttgggaaaaaggaagtgtttttgttgatgttggaagataccaaagattgggcagggtctgttacagacagaaaatctacttcaggatattgcacctatgtgtggggaaatctagtgacttggagaagcaaaaaacaaggtgttgttgccagaagcagtgcagaagctga

SEQ ID NO: 78591 - DNA, 492 bp, Glycine max
  Peptide Sequence Number=SeqID_195369
catttactcattatcagtagtactcttgaattttcagctcctccacaacatggtcttcgagtatttggaatcatcacatcatctattgtgggaccagctatcatctttgtcattgcaattgcatgctacgcgtccttaaagtacagaagaggcaatacagccagaattgctgctgcacagaggtcggaaccaagtgcaatatcaccccaaccttccattgctacgatgggcttggatgattctacaatcgagtcttatcagaaacttgtactaggggaaagccgacgagtgcctggacccaatgacggatgttgcaccatatgcttgtcagagtataaaaccaaagacacaatcagatgcattcctgagtgtgcacattgtttccatgccgaatgcatagatgaatggcttcgcatgaatagcacatgccccgtttgccgcaactccccctcccatccttctactgctcaagttatggccagtgatccttga

SEQ ID NO: 78592 - DNA, 141 bp, Glycine max
  Peptide Sequence Number=SeqID_195370
atgtcttgcatgttcctaacttatcttgtaacctattgtctgatttgtactcggggaggacgattggcagtgctaaggagagtggaggactctacctccttgaagaggtatgtggatcaagacaacaattacaatcaatga

SEQ ID NO: 78593 - DNA, 422 bp, Glycine max
  Peptide Sequence Number=SeqID_195371
ctgcaaacattttattgactgataacggtgatgtaaaggttgcagattttggtgtttctgcacagttaacaagaactatatcaaggagaaagacctttgtaggaacaccgttttggatggcacccgaggttattcaaaattcagaaggatataatgagaaggcagatatctggtctctgggcattactgcgattgagatggcaaaaggggagcctccacttgctgatcttcatccaatgagagtgcttttcatcataccccgagagaatccaccacaactagatgaacacttttctcgctatatgaaagaatttgtttcattgtgcttgaagaagaggccaagtgctaaggagcttttgagacatcgtttcattcggaatgctaggaagagtccaaagctattggagagaataaggtactaa

SEQ ID NO: 78594 - DNA, 1273 bp, Glycine max
  Peptide Sequence Number=SeqID_195372
ggagcgtccaaagtaccaaataaaggaagatcagacaacacctagaaatgccccaagggggatgggggaggcatctgatactattaaggttgcaaaagatttaaggggtgacgaaactaatcagcctagtggccaaggtaaaaccctgagaagttctggatgggacttcagcattggtggatcacagggtactggaacctttcgtagtgtgtcacggccacctcagtttagagataagaaaactgaagtttcggatcatcagcttaaccaaagaaaaattccagagagtggctatcaaggggaatctggaaataaaagtgcacttaatgagttgctagaaacttcttttggaaaagatcttggagttccctaccatgatgaacatccggataatcacctagaaaatgatgaattttctgggaatggatcaggaactgttgttattcgatctccaaaaggaccacagccatcaatgtttcgtgaccaaagttcccagtctagcagcagctatgcttcttttgaagatgtttctactagcggaactgttgttgttttgcatagccagcatgacgattctgattctccacagacaccaaggtcccgactgggacttaatagcagaaattcaaatgcctcactggaagatagtgctacaaatcttgttgaggcaaaggctgctatccaaggcggattaaggaaagtgaatgtccgggagagatttgcactgggaaaactcaacaatgatgtacaggatagcaagagagatcaaatgtcaagcagctctgattcttcaagtatttttttcagaccatctcgtgaatattttgatgcaccaaaggcattttcaagatcacattattctattgatgatgaagaaagtgccaaaataatctcatcctctgtgccgctatccgttttgcttattccttcattaaaagaggccattgctgatgatccagatgggtcaatagtgcaaattgttatcaatgctcttgtaaacatggagagtacaaagccccaatcctgtgatgtttttgtcaaaaagttgcttcagcagttggcaagttcaaaggaatcttcatttaaggacctgcaagaacttgctggccaaatattcagcaagacaaagtcatctgaagaaacccgaaatgcagagtctgataacaagaaacaaaacaaggaagtccattcaaatagcaatttaagccctcttgcaagatttcttctatcaagatggcaaggccaaacctcgcgggatctaaatccagcttga

SEQ ID NO: 78595 - DNA, 315 bp, Glycine max
  Peptide Sequence Number=SeqID_195373
atggagaaagacaaggaacccattgtaagccatgaagatttgttggcattggtttttctctctcaatgttatgaagatttgcttggaatggttgtggaacactcgctagagtctgatcatgtcctccccttctacttgaaccaattacaaaaggagaaggtgaactcgaatatgctattgccaaaaatgattgaaagttcaaatgcagtgtcatcttcaagtgcagcaaaaacagtcaaacgttcaagtgtgacgaaaatgattgaaggttcgagtgcagtgtcatcttcaagtgcatcgtcgttagtttgttag

SEQ ID NO: 78596 - DNA, 384 bp, Glycine max
  Peptide Sequence Number=SeqID_195374
atggctctgtgtagaaggccttatggttactcaaaggtggacaaggaagaccctgaagacataatccatagaagggcacagtttttgatccacaaagtgttggagaaagcagattcacgtagaaagccatcgtgccttagaatcagaatctctaagttaaaggtgaagattggaaaaaggttaaggaggctcaggaggagaattttgtcaggtgtatctgctgctagacttggctttcatggacatattctgaactcttgtgcagaagaagatgactcggcaatttctgtctgttgtcaattacgattctttattgcactcacttgcggtggaaaaaggtcttttgctaaaatgaattgtcaagtttggaagagagcagggtag

SEQ ID NO: 78597 - DNA, 978 bp, Glycine max
  Peptide Sequence Number=SeqID_195375
ctgccggacttgaatgatcttccaagcgttgaaatggactttgatatgagtgttgagaaggaagaagatggtatggctgacgacaccgaagatgcaagcttacacggggtaatgagtgatggccaagaggaggaagcaaatgcaaaaacagaatttcctataaatgcaaatgctacattaaacaagcaacaaagattcttatcaaatgaagagcgtaggtccgtttgtcgtctcttgttaaattcagtttataatggaaagttgaaggaaggtacaacaaagaacattgccacattttactatgtttcaagaagggtcattcaacgtatatggcgtcaacttagggaaaccaaagaaacattgcacaagaagaccaaaaattgtggaaggaagaggattggattggatattgaaagaattcgtgagattcctctttcaaagcagactactttaaggtctctatcgcatgcattggagattaacaaaacatcactcattagattccataagaatggaattatacgacgacattcaaatgcgatcaagccctttttgaaagatgaaaacatgaagtctcgcttgcgattttgcttatccaaacccgataatcaaaccattccacataatccaatgtttaaatctatgcacaacattgtattcattgatgaaaagtggttttatatgaccaagaactctatgaattattacttggctgttggggaggaagagccacatcaaacatgtagaagcaagaatttcatttgcaaggttatgatcttatgtgccatggctagaccaagattcaactctaacagcaatgagacttttgatgtcaagattgaaaaatggtcaatagaggatagaggagaaactattttcatacaacaagacaatgctccatgtcacattgatgaagatgacaacgacttccatcaagctgctagtgaaggcggttttgacattcgatcggtttcttaa

SEQ ID NO: 78598 - DNA, 819 bp, Glycine max
  Peptide Sequence Number=SeqID_195376
atgatgcagcagccaggacccggcatggcacctcccaccatgggccagcagccgccgcaacagtaccagcagcctccgccgcagcagcagcaaccctacgtcatgatgccgccgcaggcccaggccccgcaggccatgtgggccccctccgcccagcctccgcctcagcagcagcccgccagcgccgacgaggtccgaaccctctggatcggggatctgcagtactggatggacgagaactatctctatacctgctttgctcacaccggcgaggttacatcggttaaagtaattcgaaacaagcaaactagtcaatctgaaggttatgggtttattgagtttaatagtcgtgctggagctgagagaattcttcaaacatataatggggcaataatgccaaatggggggcagagtttcaggttgaattgggcaacttttagtgctggtgagaggtcgcgccacgacgattctccagattacaccatatttgttggtgacttggctgcagatgttactgattatcttcttcaggagacatttagggctcgttataactcggtgaagggtgcaaaagttgtcattgataggctaactggccggaccaagggatatggctttgtaaggttttcagatgagagtgagcaagtgagggctatgactgagatgcaaggggttctttgctcaacaagacccatgaggattggacccgcctctaataaaacccccaccactcagtcccagcccaaagaactcatgttgtctcgaagcagggtgtcaagaggctctgtcatcccggagcctggaactgatttcagctga

SEQ ID NO: 78599 - DNA, 1020 bp, Glycine max
  Peptide Sequence Number=SeqID_195377
atgaacgagcagactggaggattaggctcttcaactccatcaaatgttccaatgaaaaggaaacaaggcagaccacacaaagtagatagtggagttcagggtatgaacatgcctgtaatgcctagctcttctaaaagtgatgtcgctccacaagttaggatgacagaaaggacagagattccaattccagttccagttcttaacccagagacgcagatacatagttctgttccttcatcaggacagtctaacaagcaaccttttgaggccgaattgcaggtacccgtgtctgtagacctagttctcccaactgagctctattccggcttatcagtttcacttgggaaccaatctgcacctgttgtgacacccatgtctgatttgtcaaagattgactcttctatttccactggaggaattatgccaaagggaatgtcaaagcctggacctgaaagtcagcctgcctctatcttgtctgggtttgagggtgacaaaatcatcaaacaagatggaaaattgcatgaagtcgatgcttccagacaggcaaaggaatctagtgctgatggaggagcaataaaagactatcagataacttctgaacccatcaactcagttccaacagttgaaaacactgagaaggagctcccaactggacagcagtctatgccttctgtttatgagctgaataagttgattgctgatgaaccaaagcactcagttattgaaatcaaccaaatccctgtatctgctgagcgtgaatccatgccaccagaacttaaaaataatactgtcgacaattttatgcagaagcagggctctccagaaacaggtacacaagaagatactaaaaccaagcttgccattgagactatacccacagttgacaccacaaactcaaacggaagaccaagtactgatattgctaacgttcctgatgtgggatcaaaccatgcaccgggactcagccacccttcaatactgaatgacagagcgcatgttccttctgagtccaagctttaa

SEQ ID NO: 78600 - DNA, 1896 bp, Glycine max
  Peptide Sequence Number=SeqID_195378
atggatttgcatttgaagagtttgtttgacagatttcaggagcaatttgggtctggtcctggtcttggccctggatctgggacatgcatgatgaaagtggatggcattgctccaaattttattaaatctatatacaaagcttctgcagctttgtatagaactgagccgtggaagaggctgcgtccggggcacttgtttggcgtccgggttgggaaagattcggattggcctggcaagaaacagccttttccatgtgttcagtttattggaggggatggtggagatgttggattttacatgtttagaacagagaatgatgctaagaaaatgacagggtctagggagaccattcactctcccaatgttgagcttctgagggtcacatatgaagtggactctttgatgttcccttctaaccgcaagatgatcaagtctttgtcattggaagcatcaggctcagatcgttttcctgttattgatgttgctcgatgcacaccttctggcgatcttcgatttagaaatccaagcattgaagagcttaggtttgtctatgcattcatgaaggccatttccctggtgcactccttacttcaggttgacagggaaagtggtccaaagtattcaactgtggtgtgttttgaaccttttatagagactgttgatgttcagtggcctccagaagtagccaagggaggttatgaccttgttgctgttaccgtttcccacccgccgggtcaggcatacgatgaaaaatctaatagtgcaagtgctggctcgacccccaccaagtatgtagaaccacctagggaggacacattcaatgacacaaaagcatactcaagtactggcttgagacagtgtgcaatgtgtgagaaagaagtgtatggagaacagtctatttgctgtggccggtgtagagcagttgtttactgcagttcaatctgccagaagcaacactggaacgacacacataaaagcatgtgtggactttacaaggccatgatggagagggaagaagagctggctataatgattttcatgttcccatgttctgctgaccagccttgtaagtggcttgaatcattaggtatccaccagaagggtatgtggaggagaaagtgcagttgctattctcactgctcttttggtctccttcctgtgaaaggtgggctgcaggaactatggggtggaattgatgaatttgaataccctcatgactctccatttaataaccatttcatctcaagcccgtttcttctctctggttggcccgagtactacaaccttcgttcgcttccattgtcaagtcctgttgccgacattctctcgcatccattgactgtgtatcacatactaactacccttaatataagttcaaagaaccttatactgaaagggaaagaggtgattgtccactaccttggacctgaaggcgagttggattggatgccagcatttgcagaagtaggacacttgcttaatgggttaggcaatgtacaaatagtgatggtgggaccagaagttccaacaaatttatcgggtacaacctcaggaattggtagcagagttagagtgaatcttgtgaggggtgtttatcaggtggaagcctcctacctaccttctccacatgttgtcattgctctgaattctagattagaaagctattctagttggggtggagctcttgatttaatcaaatcaattggggtgcctgccttcttcactgatcaatccgaagtttcatgtgtaaatgctaaacaagtccttcggaatgctggactgcacatcacacatccggtgactccaaatcctttccggtcacctgtgaaaaatctcacagcttctagcaatcttccttcatacagcaatggttttgtctttggggtgaatacttga

SEQ ID NO: 78601 - DNA, 366 bp, Glycine max
  Peptide Sequence Number=SeqID_195379
atgcatatgcatgttggagttaagaaagtgcaggaacttgctgatgatgatgctggttcttataacttcaaacgtgtaattaagggcttgagatattggtacggttcaatcagaagacagtgctttatgattctaaagctctcttatttgattgagccgtgccaatatcacatgcaaactttgatcatcgcttgtaacaatctgcagctaactagcacattaaagatattaccctttaatactgagatcaacactttgattcttaagcaagatgtcttggatcttctaatatggtgtagcaagcaaccatcgttcgaacatagtccaacttatgaaagttttttccgcatgtcccagaagcgatga

SEQ ID NO: 78602 - DNA, 501 bp, Glycine max
  Peptide Sequence Number=SeqID_195380
atggaaggtacgacgtggcttaatttctggaactgtgaaactattagaaaatttagtaaagtagaaaataagaacgcgttagatgcaaataagccaaaaaacggaggtagcaccatccgtggtggtgcgggaaaaggcactgccaccaaaagacttaccattgcaagcgataaatcacaacataaaagggttctctctcaccctgtgttagtttcgtgtgttgagaagcagagagaggcagagattcaaggaagcgcagttgacattgaagccttggatttcgaacctgaggacgatgacttgatggatgaggagggcgcccccgacgctgaaacttctctacctcaacctaagcttaaattcaccttcaccgccgtcgtcgcccccaaaaagaccaagggttgtgaattccgacaagataccgatgccagctgtgacactcgcctctctgactctgactctctcaccatcgagggtggccttggccctcaaagatgttag

SEQ ID NO: 78603 - DNA, 888 bp, Glycine max
  Peptide Sequence Number=SeqID_195381
atgggttgcttcccatgctgtaagtcagaggctgaatcatcctcttcaaatgcatccgccggaaaaatttccaaaggaaggagaacattcaaatcattggcttcagttatgtcacataaaacaggtagtagcaggcaaagacggatagatgcagagataagaaaatatggatcagcaaaaaacgatgtcaaagtattcacatatgcacaacttgctgaagctacaaacaactacaattctgattgcctggttggcgaaggtggattcgggaatgtctacaaaggattcttaaaaagtgttgatcaaactgtagctgtgaaggtactgaacagggaaggagcgcaaggaacacgagaattttttgcagagattttgatgttgagcatggtgcaacacccaaatcttgtgaagctcgtgggttattgtgcagaagaccaacataggattttggtttatgaattcatgtccaatgggagtttggaaaatcaccttttagacataggtgcagataaggagcctatggattggaagaatagaatgaaaatagcagagggagcagctagaggacttgaatatttgcataacggtgcagatccagctattatataccgtgattttaaatcatctaatatactattagatgaaaattttaatccaaagctctctgattttggacttgctaagattggtccaaaagaaggtgaggagcatgtggcaactagggtgatggggacttttggttattgtgcaccagagtatgctgcttcgggtcagcttagcacaaagtcagatatttatagttttggggttgtgcttttggaaataatcacaggtaggagggtatttgacactgcaagaggcacagaagagcaaaacttgattgactgg

SEQ ID NO: 78604 - DNA, 288 bp, Glycine max
  Peptide Sequence Number=SeqID_195382
atggcgtgggagaggaatttttcgttgcggcagagatcggggcgggttttgaggtcgtcgaccaaggtgcggatgctgggaaagttgtgcgcggcggcgagcttggagacgacgagggagaaggcgcggcggtcgaggtggaagtccggggtgagggcggcggcgcggcagatgtcgaggatgcgctccgacttggtctcggatttgaggaggtggagggcactgcgggttttttgcttcaaggttagacgggtggaggagttcggggagaggatggaggtggagtag

SEQ ID NO: 78605 - DNA, 588 bp, Glycine max
  Peptide Sequence Number=SeqID_195383
atggctcaagcggttgaagaatggtataagcagatgcccgtcatcacgcgctcctatctcaccgctgctgttgtcaccactatcggatgctcccttgatcttcttgaggagaactcgttcagggggaggactgctgatttcttttacatgctcttatttggtgccactgtattgactggaattgttcttcttgggggcatgataccttatttatcagagtcgttcgcaaaaataatattccttagcaactcattgacatttatgatggtttacgtgtggagcaaacaaaatcccttcattcacatgagcttcctgggtctctttactttcactgctgcctaccttccatgggttctcttggggttctctgtactcgttggtgctagtgcttgggtggatctactgggaatgattgctggccatgcatattattttcttgaagatgtttatcctcggatgacaggtcgtaggccactaaaaacaccatcattcatcaaagcactatttgcagatgacccagttgttgttgcacggcctgctaatgtcaggtttgctcccccacctgctgaagaacttcaccaagattga

SEQ ID NO: 78606 - DNA, 459 bp, Glycine max
  Peptide Sequence Number=SeqID_195384
atggtcaaaggtatgctacagcgaaaagtcattggaaaaggagaaagggtgctggaagacgggcagcgagcagaatggtccaccacggacactaggtccctggtggagaaccactttcgttctgtcaagcataacgtagctctaataccatataacagtgttctattattttgttgtcagcttttgaatgtccacactgtggtgagaggaacaatgaagtacagtttgctggtgaaattcaaccacgtggttgttgttactctttggagatcccatcatgcgaacaaaagtaatgacttgaatggaggtgctcaagtgtggtccagtaagatggcatacaatgatacaaatgtgtggcaaaacttaaatcacgtgaaactttgtaagaactgcaatgctgaggcagaatacagctggattcttcagtcttcatccattctcagatggccaaaattttaa

SEQ ID NO: 78607 - DNA, 255 bp, Glycine max
  Peptide Sequence Number=SeqID_195385
atggtaaatgagagacatactataggcgtttccgacactaaaaaaatcaaagtcgaatcgggaaagtggggaaactccttaaatcacaaatgggagaatttactcacatcctcggatgatggcagaaggagcagttttgcaaacagaagggagagtggtgagattcaaaccctcaccaaactgagcacggtgcttttcaaagcctcagagagacaccactttaataggcctgcacgatttcgcgttaaccaataa

SEQ ID NO: 78608 - DNA, 780 bp, Glycine max
  Peptide Sequence Number=SeqID_195386
atggagtgtgaactcactaaggctttgattggaaagggtgccattaatttttccgaagtggagcatatcatcctcaaatataaccgttcagtggaagaagttttcaagctgttcgacctaatccacattctcaccactgatcacaacactgttgcaagaattaccagagaagttattgaggattttgcatcagagaatgttgtctatctggagttgaggactactccaaagagaaatgattctgtgggaatgagcaaacgctcttatgttgaagctgtactgaaaggtctaagatcaattacttcagttgatgtggatttcattccacattgtgaagattcaaagactctttttactcctgcaccggctattgatggacatgcgagaaaaagaatctttgttaggcttctcttgagcattgacagaagggagacaacagaagctgcaatggacactgtcaagcttgcactggaaatgaggccttatggggtagttggaattgacctctctggaaatccaagtattggtgattggtacatcagcctgatccaggactcgagtgttgcaatgaccacatacttgccagcattgaaatttgctcgagaacaaggtctttatgtaacacttcattgtggcgagttacctaattcaaaggagataaaaaatatgcttgactttcgcccccaaaggattggacatgcttgtttctttgaggatgaacactggagacagctaaagtcatcgaacattccggtcagacttttttgccaaccttattaa

SEQ ID NO: 78609 - DNA, 747 bp, Glycine max
  Peptide Sequence Number=SeqID_195387
atggagatggagagacgccatgaggtggagttgataaagataacaaatgaccatgaccagctagaggcttatgttagatgtccccagggtgatgagcaatctacccacacattgcctaaacgcactcaaggggaatcatacccccgacgtacaggcaacacttccaataacttaagcatctcccataaacaccgtccaacaaggcggactgcccgttggcatcctttcgttgaatgcattatggaggcaagcatacccttggggatcctcaccttacgccctagcaagttcgtagacagtctatgcaaaaattcacctgatagcattgacgagctacgtgagcgagccaatggctatatccaaatggaagaaatatccatattccggaacaaagtccaccaagctagacaaaagctcaacaagtgcaaagtaaacgccaaggccgactcatataagtcggacaagaggcacaggctagacaagccagcctctctccaaagagcccagatgaaacctcccaagtcggggtcagacgcaaccaaatactatagatatcaccgcggtattagtcacaacactaaagactgttgggccctgatggacaagatagaagaacttatacaagcttggtacttagcgcaatttgttaagagactagacaatcaccaagcagaagcaagacccagaggacatcaacaggagcaacacaggaactgggaagcagacagaagaagaatggaagactga

SEQ ID NO: 78610 - DNA, 1623 bp, Glycine max
  Peptide Sequence Number=SeqID_195388
atgacggtggcgtcaatgttgttcgccggcggctgtcgtatcctcgccgtgcctgcggcggcgcgcgccatccgcatcccgcgagcagctctcagcagtcaccacaacaagcacgctccgagttggggctgtcggagttcacacaacagtaacactgcactcgccggtgaagccgaattctcaacaaccgacgccggaaacttaaccgctacctcttcttccgacagtttcccgaagtatgaccggttgcttccatgtccatcgcacaaaaatccaccgagaattgaacacttagttatatcagaaggaggacctgtgttagaacttatttgcaaggccctggatcttcctcctttgtacgtttcagatttgattcaatttggagctgtatactacgctcttgtttgtccgcagcctcctccgaatgctactgaagagcaaattagggtattcaaagaagtaacggaaccttcggtgttgcgcaaaagagcttccatcaaaggcaaaactgtgcgagaggcacagaaaactttccgtgtaactcacgtggatcaatttgttgagccagggacttatttgcgagtacatgtgcaccccaaacgctttcctaggagctatgagattgattggagatcaaggatcatagctgtggcggagtcctatgtagttttggataaacctgctggtacatcagtaggtggcactactgacaacattgaagaaagttgtgcaacctttgctactcgtgccttgggaatgacaacccctttgatgactacccatcaaattgataattgcactgaaggctgtgtggtattggctaggactaaagactattgctctatctttcatggcaaaatcagggagaaaaaggtgaagaagctctatctcgctcttgcagcttctcctttgccaactggaatcattacccactatatgcgtcctatcaacatggctcctagacttatttctgaagtctttagcagcttgcaggagaagccaagaccaggcttcatgcctagcctagtgtactacagcatcatgatgtgtcaatggatgaggcatttgtatcaaaagttaaatgttgaaacatctgtttgctatgtgacttgggtaaaaagtttgcaaaagagggttttgtatcgtggattcaacctagtaggtttattgactgcagattttatcaagggatggcatctgtgtcaacttgaggtcctggaatgtagaaagattccctggccaactactgctatacaagacaagtattgtgttgaagactgtgggtggccttctcaagattatgcatacgagtgcaaaatcaaccttcttactggtaaaacacatcagattcgagctcaatttgctgcctataaggcaccattaattggtgattctatgtatatgccagctgcaattgcggatgtgagtaatcctggacttaatccatttggaaaatacaagaaagatttcagtagtgagagtgaaaaagaaacagctgttgtaaattggatggcacaacatggaaaagagccgagtgttgcaattggccttcaagcatgtcaaatttcatgggatgatgatgaacacttttatgaagctggtttaccttggtggaggtgttaa

SEQ ID NO: 78611 - DNA, 312 bp, Glycine max
  Peptide Sequence Number=SeqID_195389
atggtcattaagtctcgaagcatacaccaacatgtggcgaacatggaagaaatcttcggggaaccaagcaaatatggagatggtggcaagttcctcggcttcatgatcacacaccaggggattaaagccaacctcaacaaatgcactgccatactggagatgcgcagccccaccaacattcaagaagtccaaaagctcaatggtaggctagcatcactttccaggttcctcccaaagcttgctgaaaaggcaaagccattctacaaactgctcaaggagactgagcccttatcatgggatgagacttgttaa

SEQ ID NO: 78612 - DNA, 635 bp, Glycine max
  Peptide Sequence Number=SeqID_195390
atctaaaagaaccaagagactttgaagagctacacaagaacccatcttccccagaccagattccagcacatgttaagtcttctttcatggagaactttatagactatcatggtccacacacgcacccaaatcctcctccaccaaatcttgaagagatacttgttgatgtagactatcatggcccacacacgcatccaaatcctcctccatcaaatcttgaggagatactagctgatatagattatcatggcccacatacacacccaaatcctcctccaccaaatcttgaggagatacccgctgatatagactatcatggtccacacacgcacccaaatcctcccccaccaaatcttgaggagatactagtcaatatagactataatggtccacacacgcacccaaacccccctccacaaaatcttgaggagatacgagctgatatagactatcatggcccacacacgcacccaaatccacctccaccaaatctccaggagatactagctgatatagactatcatggcccacacacacaccctaatccccctccaccgaatcttgaggagatactaactgatgtagattatcatgggccacacacgcatccaaatcctcctccaccctacttctag

SEQ ID NO: 78613 - DNA, 1011 bp, Glycine max
  Peptide Sequence Number=SeqID_195391
atgtcttgttccgtggcagttccaacttcccccgtgttctctttctataacaacaacaacgttaactctaattccattccctctacgacgccgtcttgctcctctccaccctcctctcccttgttgaagagaaggaggccggccaaactcgacattcccgtcgcttctctcgcttttggtctctcgccggcggcggctccatctccggcgagggacgccgtcgtggaggtcgacggacgcgggttttccgtgttctgcaaacgaggaaggaggcatcatatggaggatcgtttctccgctgccgttgatcttcacggtcaaccaaaacaggcttttttcgggatatttgatgggcatgggggcacaaaggcttcggaattcgctgcacataacttagaaaaaaatgtgttggacgaggtggttaggagagacgaatgtgacattaaggaggcagtgaagcatggttaccttaacacagattctgaattcttgaaggaggatcttaatggtggttcttgctgtgtaacagcattgattaggaacggtaaccttgttgtttccaatgctggtgattgtcgtgctgtgattagcagaggggatatggctgaagccctaacatctgatcacaagccttctagggaagatgaaagggacagaattgagactcagggtggctatgttgatgtgtgccgtggtgtttggaggatacaagggtcattggctgtttctaggggaattggagatagaaacctgaaacaatgggtcatagcagaacctgagaccaaagttatcaaaattgagcctcagcatgacttgttgatcttagcttcagatggattatgggaaaaggttagcaatcaggaagcagtagatattgctcgtcctttatgtgtagggaacaatagacaacaaccattgctggcttgtaagaaactcgtggaattatctgtgtcacgaggctctctggatgacataagtgttatgattatcaaattgcaaaactatatttga

SEQ ID NO: 78614 - DNA, 172 bp, Glycine max
  Peptide Sequence Number=SeqID_195392
tggtggaatggcacctagttatttcaacatgccatcatcatcatcatcatcatctggggcaggtcctaggccaaggggtcctccaggatttgcaattggggcaggatttgatgttccttctggttttggaggtgatccaactcttaccattgcaactgatcctcttttctga

SEQ ID NO: 78615 - DNA, 354 bp, Glycine max
  Peptide Sequence Number=SeqID_195393
atggtgttcatggcaatgctgatttgggttggagtcttcccctccacatcatcttcgacatcatgggcacaacttggcgatgacgatgcacatcatttgttaaatgtttggagggcacatgggttggtgttgaggagtgaaaaagaaattatgaacaaaagtgaagaagaatacatgaggaaaataattgagaggcaaaaacaacgtgaagctgacaactctagtagacaaatacatagaagaaaggtgatcgatcaaggtcgtgaaaaaggacatcaacgattgttcactaactacttcgctgaaaatcccatatacacagatgttaaattttggcaaaggtttcaaatgtga

SEQ ID NO: 78616 - DNA, 321 bp, Glycine max
  Peptide Sequence Number=SeqID_195394
atggtcacttattacaacctgcgagtcctttttcgtctttacagttttcatgtctttataataactctggttgtcttgcttctcctcagcgcaggaatcgatacaacaataccagaattagggtttctggtagcacctgcttttgagttcttagctctaataaggaagaaggaaaaatgtacatgtgcagctgttctattaatattgcagcttagtctagtcacattgggagggaaagagagtgaaggagtttccctcagcccattcatggatataatgaaagattgggttgctgaattaactgattcattcatacaatag

SEQ ID NO: 78617 - DNA, 474 bp, Glycine max
  Peptide Sequence Number=SeqID_195395
atggctaaaatctggattgaggtgtgcttgatatctgctcgtggtgtgaggggttctccctcactttggaagcgtcaatggtatgctgtagggtgggttgatcctaagagcaagtactgcaccaaagttgacgcttctgggaacgccaaccctgtctggaggaccaagtttgcccttcaggttgataactctgagccagatcttgcactccacgtggaggtttacagcagagatcctgtgttcttaactgagaagcttcatggctcagctaccgttgttctcagagagtttctgactaaggaggtccacaacaactctgaggaagtggggagctaccagttgagaaagaacaagtctaataaaccaagtggcttcgttgatgtttcaatccgtgtttctgaggacaaggaggagcttaatttccacccacaagtgtgtttcgaagctgttaaagaaggagcaaatgggatgtga

SEQ ID NO: 78618 - DNA, 336 bp, Glycine max
  Peptide Sequence Number=SeqID_195396
atgtcgtccaatgtcatcgttggatacaacaataccgatcttgtgttgtcattggtgaaaattgtgtttccagataaattgcggttagagaaactagacctgcataatgctggctaccttgcacagaaacgccttgcgtgtggtttaaggctcaattatgttgaaactgtggcacagaaactagacctttttattttaaggcataaatattatgcatgcttatggacatttcagattgggacaatgtttggatgtgacaagtacaacattaagccagaccttgtatccctggctaaggcactatcttctgcatatttgccaattggagctgtcctt

SEQ ID NO: 78619 - DNA, 1656 bp, Glycine max
  Peptide Sequence Number=SeqID_195397
atgttccgttttgatggtgccagtaagagtgaaagtgcacgaaatccaccaattatacctgcaagcaacttgcagaatccttcaattccacaaggctctaatgcaaattggctcacatctctatttacttggaagaagggtggaaaaactagtgatgcaccccttgaacattctggagctggttctgctgagcagcgtaactcaacattaaattctaatgatgaaccaacctcccttgaaattggtccttcaaaaggtccacttgctgatacatctgatattaagaatgtaaaatctacgtcaaatattaagcatggacatggagggatgaattctctgatttcatcaacaaatgatttgtcatctatacaatccggtacaaaaggtgctggtgatttgatgaacggagtgcagagtgatgtgcagaattccgtagattttttggcagagaaacaattactggctggaaaccagatattcggtaaggaagagaaaaagaatgcatcagtggacataattaggacagataatgctgaagttatgttgtcggctgctactacaactgaaacaattgaaagggaacctgaatttcttgcttcaacaactgtagggtctcaagtccttaaggagtcaccaaaagatggagacaagacaccagaaattgttaagaatggttattattactctttaggacaaggagcacaatcaccacttcaatcatctggcagtgcagtactagcaaatggtgtagctagtaataaacaaaattctggaatagatgttatcttgccatcaaaaccaaatattatactacttgataatgtgaaaaaggaaattgaaaagggaatacatcatcctaccggaaatgaaaataaaggtggtgatgtgatacttgatgtagagagaggagcatttgaatccacaacatctcatacagcagataatattccagctgaagatgctattataacagaactacaaactcaagtacaaaatggtgaacaaccaagagatgaagttggtgaaccccaaggatgggaaatacttaaaagcattgtctatggtggtttagttgagtcaattactagcctaggaattgtgtcatctgcagttagttcgggtgctaccccattgaatattatagcattgggatttgcaaatatcatcggtggacttttcatccttggtgataatcttattgacttgaaaaaagataactctggagaggatcaaatgcaaacgaatgcgcaaaatcggtatcaagaatcactagggcgcagagagaacttcttgcttcatgctgttgtagctgttttatcattcctgatatttggtgctgttcctcttgttatctatggcctcttaatcaataagaattaccacaccgaagttaagctcgccacagtagcagctacatctattgtgtgcatcattctacttgctattgggaaagtttacaccagcaaagcacccaaatcctatattaaaactgtgttatactatgttacattggcaatttcggcctcaggagtctcgtacatagcaggtaacctaatcaaggacttcctagagaaacttaaccagccagaatcaggttttgctattaccatgcccatatcagacacaagtatgggatcagcatggatgtcttactga

SEQ ID NO: 78620 - DNA, 228 bp, Glycine max
  Peptide Sequence Number=SeqID_195398
atgggtggaaataagcgaaatagaaggcgagaaaaatggattaagggtttggcacatgaaagaaggttgagtgacaaagtaggaagtcactgtccatggacaatcatggattcaaagctagaatgggtgatggaaggttcattgcttttccgagggtgtaactggtggcaagttaagtggtttgggaattgtggagcattgaatgctacgtctaaagattggacgtga

SEQ ID NO: 78621 - DNA, 198 bp, Glycine max
  Peptide Sequence Number=SeqID_195399
atgccgtggagattcttcatcgttctttgttcattcttcgtcgttcttcggtcttcaaccggtctgagttcctcatcgcaattgaggatacgtaggagcaaaagctccacttttttcgaccaccctaagagatcgttaatggttcaacgccttaacgtttctctcctttcaaaaaccaagagatcgttaatggtctag

SEQ ID NO: 78622 - DNA, 204 bp, Glycine max
  Peptide Sequence Number=SeqID_195400
atgtcttctactgctttgctttttgagtattggattgggaacatgcagaatcggtctaggttcgaagccaagagtggttcttctggtatccttgtggattattttgatagccttgtgaagttgcctgctatagtcgtgcagaaggcggagaagtatactttgacgatcgtagcttggtcgtcttgttcggatataaagacttag

SEQ ID NO: 78623 - DNA, 690 bp, Glycine max
  Peptide Sequence Number=SeqID_195401
atgagctgctgcgtcactttttctgtgatggactcctctagctggtccctgatttgctgggtcagctattgcaattcttcaggaggcagggaggaagagctacgggacgtccgtggagccgatccaaagtattgcttgatggtagcaccggctccagcagcacggacacgtccagggtatggctttggctcaatgggatttggcagcctcagattcctggatagaagggtatatgataaagtattgaaacctagaatcttagataccttgagagctcaccatgtttcccaaattagcactggcttgggtcagaaggggtccatgaaccctatttgtgcaaaggtccaaaacctccaaaccaaaacagtcaacaaaaccattaagaatggggccagagaatgggactcagtcatgtatagatcatttttgagatgtgatgatccaaaaggagtagtagaatgtgggacaataaggaaatataggactcgttctcacaaagtgaaggacaagacaagaatccagaagacgggtgaaaacttggagacatccttgtccttgatgaacaaaagatacaaagaagagaataaggtcccaaaaggatgtgatggaaatctcatcgatccatcatcttatagagatattatgtgtgatgaaaagtctaaagatattgcagaaggtattgcaaaatga

SEQ ID NO: 78624 - DNA, 682 bp, Glycine max
  Peptide Sequence Number=SeqID_195402
atggacatcttgaaggtcctcttccacttcttcatattttttcatgtcacatatgcatcagatgactgcaaatattattcttggtgcagtgacaataacatccttattcgtttcccctttcaaatagaaggtcaccaacatccttattgcggcggctatcctggtttcaaattaacttgcaccaatgatagcaaaacagttattaaacttccatacacgggaaagttcattgtccgcaacatcaactacctcagacaacagatacaagtctatgaccctgataattgccttccaaaacgtcttctaagcctcaatctttcaggctctccctttgttgctgcttcactccgcaactacaccttcttaagatgcccaactcggaacgcagggtcacaattcattcccattgactgtcttagcaattctacatctttcgtatcagctattctttcagtgaacttgcccaatccattgcccgagtcttgccatgttattaagaagctcacatttccagtttcaaggccgggaccatatgaggagattttcagagatgaccttagtggagatcttcgattaacatggcatgcacctgactgtagatattgtgaatcacaagaggccttgtgcggatttgagagcataaacagtgatcaagttcgttgtttctttgattaccaaacag

SEQ ID NO: 78625 - DNA, 936 bp, Glycine max
  Peptide Sequence Number=SeqID_195403
atgacggcggatgcaggtattctgttgtcttatttcaattcaagcactaaaaatcataacattgttgttggcaatggtcatttaattccggttgtcggtcacggtagcactaatttacccccaccgcatcctccctttgttcttcaaagtgtgttacatgctcccaaactcattaaaaatctgatctctattcgtaaatttaccactgacaacatggtttctatttccttttatccttttggtttttcggtcaatgatttacagacggggacccgactaatgagatgtgacagtgttggggacttatatccactcttctcaaattctcaagccacatcacccaaacattcagcttttactactatgtctcatgatatttggcataatcgcttaggtcatcctggcgatactattatcaattctcttcgtcgtaataaatttattgattgtaataaggcttgtaagactttttgctcatcttgtcctcttggcaaacatgctaaacttcctttttatgattctttatcatacatttttctaccgtttgatattattcatagtgatctttggacttctccaattgccaactcttccgggcaccgttattatgttctttttcttgatgactatagtaaatttctttggacttttcctattgcaaggaaatcgcagaatttagcaccacaaaatccacagcctgacccaacttctcatattactcagtctcggcccactcctcatgtagcaccaacgttgcagcagccccctccaacttcttctcctatcttggcctcacccacctcacgtggcccagtgatgcaatcctaccccgcaagggcattggatagaaaactccaagtagattgggctagagatgcaagagaaggccttagggttcttatgagccttagggtagatttcgggcccatgggctaa

SEQ ID NO: 78626 - DNA, 228 bp, Glycine max
  Peptide Sequence Number=SeqID_195404
atggcttccagtgaaggccttgacgcgattcaagtgcgtctctacctcttggaatttcctgttctgggactttgtggtcggtttaatgagacataccactatttgtcgttgcccggtggtttaaccgaggtccctcctgatgagcctgagctcgggggaatttggactcagttgctgaatgcaagttatgagcatcttcagattgccgaaccttatttgttgccttga

SEQ ID NO: 78627 - DNA, 573 bp, Glycine max
  Peptide Sequence Number=SeqID_195405
atggagcttgagaaagcccaagcggtcaaggaaaagttcaagtcaacagccgttaggatccgaaaggagaatgccgaactaagagacgtcaacatagccaccgccaaggccttggagcaagagaccaaaagggcccgcaaggaagaatacggtcggaacaagttccgaggggccttgtggggcagtaacagcgaacttaaactccgaagagaggagagggaccagtcacaagtagaaggcatgattctgaaagacgaattgaagacttgcctgaggtcaaaaaggagcttgtcccaaaggctgagcgagaccgaaacaaacatgttggccatcatcagcaagtacaaagaagaattagatttggccaccgcccatgagcacaaggtggtggatgaatacgcccaagtgtacacagaaaaggaggctaggggaagggtgattgactcattacaccgagaagcgatgatgtggatggaccgggaagacaccataactaagcgcgccccgaggcatccctatcgcaccagatccaagtctaggactatgggtgacctagaggaggtacaagaatag

SEQ ID NO: 78628 - DNA, 1800 bp, Glycine max
  Peptide Sequence Number=SeqID_195406
atgtcatctgccggtgtctctactcttagtgtggttcccactgagccattgctctcaccaatggcattcccttttccaattccatcacacttgtctttggaagataaatccattttcatatacctctccttttctggctcattgactcccatccgtgttatggagtgggataccattgaatctgtcaaattcaaaatccaaaggtctgaaagccttccgtttttaacaaacaagcagaagttggtttatgctggccgagagcttgcgcgaagtgattcgctgctcaaggactatggagtaaccgatggaaatgttttgcatttgataatcaaactgtcagatcttcaggtcatcagtgtgaaaacttcttgtgggaaggaattcacgtttcaggtcgaacgaggcagggatgtcgggtacataaagcggcggattgccagaagggagaaacagtttgatgatcctgaggagcaggagcttgtgtgcaatggggaaaggcttgaggaccagaggcttattgatgaaatatgctgcaaacataatgatgcagtggtacatctgtttgtgagaaaaaaacatgttaaagttcagaggaggccccttgagttgtccattgtagcaaaagatttgattaataagaaaaaaaatgatgtcaatggaaatactaacaggagaagttatgatgttggtaaagaagatactattaggaagtctgatgtcattcaaagagctgtgccgaggaagcctcccgatagagattttattttggagccagttattattaaccctaaaattgaattagctccagctatttggaatatggtgaactctacatatgatggacttggcagtggcaaatatccaatcagatctgcagagggtacaggaggggcttactttatgattgattcagcggggcaaaagtatgtgtctgtttttaagcctattgatgaagagccaatggctctgaataaccctcgaggtcttcctttgtcattagatggcgaaggcttaaaaaagggtacaagagttggtcaaggagcattcagggaagttgcagcctatgttctagaccatccattgagtgggcgccgctcgttatttggtgatgggaagggctttgctggtgttcccccaacattgatggttaagtgcttgcataaatcattcaactatcccagagaatttactcctaagattggctccttgcaaatgttcacagaaaatagtggaagttgtgaagatatgggcccgggggctttcccagtaaaggaggtacataaaattactgttttggacataagactggctaatgcagataggcatgctgggaatattttgatcagcaaagaggaggacaacaaccagtctgttctgattccaattgatcatggatactgcctgcccacaagctttgaagattgtacctttgagtggctttactggcctcaagctcgccagccatactccccagaaactattgactacataaagtcactggatgctgaagaagatattgcccttttaaagtttcatggatgggatctgccagttgaatgtgcccgcactcttaggatctcaaccatgcttttgaagaaaggggtagagagaggattgaccccttttgccattggaaacctgatgtgcagagaatccttgaacaaggaatctgtgattgaagaaatagtacaagcagcactggattctgttcttcctggcacaagtgaagctacattgctggatgctgtttcccaaatcatggacttgcgcctcgatgagattgtcagagctcgtttataa

SEQ ID NO: 78629 - DNA, 1956 bp, Glycine max
  Peptide Sequence Number=SeqID_195407
atggatacggaagaaggagctcatggaaagggaacacaggtggtatctttgattgagaaggccaccaactccaccgcgccggaggtcgatccccgcctcctaaaggccatcaagacggtggttcgctattccgattcggagctccgcctcgcaacccaaacccttatggatctcatgaagcgtgaccactctcaggtcaggtaccttgcgcttctaataattgatgagctcttcatgcgttcaaagctttttagggcccttgttgttgagaacttggatcagttgctgagtttgagtgtcgggttcaggcgaaatttgccacttcctgctccgccagctgttgcgtctgttttgcgttccaaggccattgaatttttggagaagtggaatgtgacgtttgggttacattacagacagctcagattgggttatgattacctgaagaatactctcaggctccaatttcctaacatacaagctaacttggagcggattcagcaggagagaagggaaagggagaggaggtcaaaagagattttgttgagcaagtatgagtctttgaaggagaattcaccttcaataaagggacccattctgtctacgatggatgagattgatgaatgtttggagattttgcatgcaaaacaggagtctgtgtcagatgatatcttagataatgaagaacttggtgacttctgttctttggagctgcagcagcttcgtcttgaagcattgaaagaaggggagaaagtttatgaggacagtgataacaaggtagtttttgatacattgagggagctatacaaacttctggtcacaaagcatttggtttccatccaagagtgcatttctgttctagtaagagttgaagtagccgacaatagattcagagattccattttgaaagagtttgttgatatccaaaatcgtctgaaatcagttaaaaataaatgtgaagaggctggttgttctcttttaaactcatcaaaacatgacgaggaagatttttgggaggagggtaatgttgtatctatggaaatctcatctagtgcaaccaacaataaaaataaacatcttgacgtggcatcaacttcccataaaatgagtaatgataatcttggtttgcacaataaagagtctaatgattctggtacggacaccctgcttcatcgaggacgtgaagttgagccaaactctccaaggagtaaacttcaagccgaagctcctgtggtacgatggagttcttacctggataactggggttcaaacagggtttttatggctaaccagcggggtttggagcttgaaagtcactggggtagggtggacaatgatgcagttattccagctgataaaattgccgaattgaatgttcacgcaatgccttatgaagaaaagcaaattgagatccaaccatgcctgactcctttgaggaaaggaggattatgtcagagaagagatctgaaagtttgtccatttcatggtcctatcattccgcgagatgatgaagggaggccactcaatcagaactcttcagaagacatgaatatggatttaaagactgatttagtagagcagttagcaaaacaagcagagaaaaatgttcgtgaaagagatcaagaggtggcaaagaagagagaaattgataaacagttgctgaaacgtgcaaagctagctaaagttcgggaacacaatgaagctgttttacgggatgctgctttggcttctacttcaagatcagccacacttggagaagatggggaggcaactaatgaagataaactgtctgccagagataagaagcaaagtctcgcttccatgctgcgaaagaaagtaacatctaaagatagaatagctcagaaacttttaagttcacgggcaagggttactgcagataggcagcatgtgtcatgtgaagatgccaaatatagagaagccttcccaaatcaatggtga

SEQ ID NO: 78630 - DNA, 819 bp, Glycine max
  Peptide Sequence Number=SeqID_195408
atggaatcgagtagcattgagagcagcactgtatcatcgatgactatgatggaagaggatgagcatccccatcagttttcttcaatctcgaagcttcatagcaatggccccaccactaccagtgtccatgaccttcttgaatgccccgtttgcaccaactctatgtaccctcccatccatcaggaacttggcgatataaggtgtttggcattagagaagatagcagaatcacttgaactgccttgcagatacatctctcttgggtgtccagagatatttccctattacagcaaactcaaacatgaggctatttgtaacttcagaccatacaactgcccttatgccgggtcagactgctcggtggttggggatattccatgccttgtcgctcatttaagggatgaccacagggttgatatgcattctggatgcacttttaaccatcgctatgtcaagtccaatcccatggaagtagaaaatgctacatggatgctaacggccttccagcttggcatggctccggtttacatggcgttcctccgattcatgggggatgaaagagaggcgcggaactacagctacagcttggaggtgggaggaaatggacgtaaactaacttttgaggggagtccaaggagcattagagatagccataagaaggtcagagacagtcatgatggtctcatcatttaccgcaacatggcacttttcttctcaggtggagacaggaaagagttgaagctacgagtaacaggaaggatatggaaagaacagcaaaaccctgaaggtggagtgtgcatacccaacctgtgtagctag

SEQ ID NO: 78631 - DNA, 939 bp, Glycine max
  Peptide Sequence Number=SeqID_195409
atgagtgaccgcaaaatcgttctagtgactggctgtgccaaaggtggcattgggtatgaatactgcaaggcatttgctgagagaaattgccacgtcgttgcctctgacatctcaacgcggatgcaagacatgtcagacttggagtcagatcctaacatcgagacacttgagcttgatgtgtcttgtgatcaaagtgtgtcctcagcagtggccactgttatatcaaaacatggtcacatagatattttgattaataatgctggaataggtagcacagggccattggctgagttgccacttgatgcaatcagaaaggcttgggaaatcaacacacttgggcaactaagaatgacgcagcatgtggtgcctcacatggctatgagaagaagtggtagcatagtgaatgttggcagtgtggttggttatgtgtcaaccccttgggcagggtcttattgtgctagcaaggctgcagtgcaggccatgtcaaacagtttgaggctagaactaaggccttttggggtcaatttggttctagttttgcctggctctgtgaggtcaaatttagggagggccaatttggagagattgggtaattatgagtggaagctttataaggactttaaagaggtaattgaggagagagctagagcttctcagggtgacaaagctactgatggtagagtttttgctagacatgtggttaaaaaagttttaggccctaaaccaccaaagcaaattgtttttggtcacatgactggcttgtttgccttgctctcatggtctcccctatggactaaagagttgaatctctcagatgatggtggtgaagagattatttctcaagctgtggacaagagtaatgaaaaaaagggtgaaggtaatcctgaagatgaattagggaagcttgcacaacaaaatgaagaagtctctcaaacttag

SEQ ID NO: 78632 - DNA, 814 bp, Glycine max
  Peptide Sequence Number=SeqID_195410
atgaggctgaagccgaggcagaccggaaagagggaatcggcgacgccgtggcagatggcgacggaggtggagagggcggtgcagagggcggagtgggaagagggcattcccccggacgcgaacaagagcctcaaatcccatttcctctccatgaagaaattcagaaagaccttcatggactgcgctatcagccacgccagcagccccgacacgaaggtggggttggctgccagcgtggcaacgaagggacttatccgaagcttcgcgtttgcggtcacgctgagcagggccacacccaagcctccgtggtttcgacggggctgcaaagcactcacctttactcttgttggggtgcaacaagaaggaagcaatgaatttgtgtcagcattagcagctgggatgaaagcaaagcttattgtggaagtggcatctcgagcgtctccatcaacaatagcccttgcagctgctgcaagacaaactggtggcaggttggtgtctattcttccggtgccggtccttgatgagtcacaagaagttattaagaactcagggcttaaagaccaagtagaatttcgaactgaagatccatccaagatattgccttattgtgagaatattgatttctccttagttgactgcaaagatgaaaactatgcaagtgagatctctaaacatcctatagggaaaggtattgaagtgactgtgctttgcaagaatgatgaaactgataagagagttggggtcagagaaaatcgtagcagaataagcaggagcaagtgggttgccaagtttgatgaggagagtcgggaggaac

SEQ ID NO: 78633 - DNA, 1377 bp, Glycine max
  Peptide Sequence Number=SeqID_195411
atgtgggttttgcgccataaatataaatctgatggttcttttgagcgttataaggctcgtcttgtaggagatggaaaaacacaagcgcaaggtgttgattgtgatgagacgtttagccccatggttaaacctgctaccataagagcagttctcagtattgctgtctctaaatcttggcctatccatcaaatggttgtcaagaatgcttttttacatggtcatcttaatgaaacagtttatatgcatcagccaatgggttttcgagacaaaaatcatccaaatcatgtttgcctcttaaagaaatctttatatggtttgaaacaggctcttcacgcttggtatcaaaggtttgctgattttgttgctaccattgggttctctcacagtaagtcagatcactctttatttatttacaagaatggttctgacactgcttatattttgttgtatgtggatgacattatacttacgacttcatctgattgtcttcgtaagtcttttatgactcttttgggttctgagtttgctatgaaggacttaggccccctgagtttctttctgggtattgctgttactcgtcatgcccatggtctatttttatctcagaaacaatatgttacaaaaattattgaacgtgccggcatgtttaactgcagtgccaccaacgatgctccttttaacgatccaaccaaataccgcagtcttgcagaggctcttcaatatcttactttcactcggcctgatatatcttatgtcgtgcagcatatttgtcttcatatgcatgctccgacaaatgagcatatgggtgctctcaaacgtatcatacgctaccttcagggtactttatcccatggtttgcatttgtacaaatccaccattgatagactaatctcttatacagatgctgattggggtgggtgtcctgacacccgtcgttccacttctgggtattgtgttttcctcggagataatctgatatcttggtcttccaaacaacagcctattctctccaacagcaatgtagaggcgaaatacaggggtgtggctaatgttgtttctgattcctgctggatcagaaacctgcttctagagttgcattgtcccattgaaaaggctactctagtttactgtgacaatgtgagtgtgatatacttatccgacaatcttgttcaacatcaacgcaccaaacacattgagatggatattcacttcattcgtgagaaagtggctcgtggcgaagtccgtgtgcttcatgtgccgtcccgttaccaaattgctgatattttcacaaaagggcttccgcgcgttctatttaatgatttcagggacagtctaagcatacgagagcctcccgcttcgactgagggggagtgttag

SEQ ID NO: 78634 - DNA, 450 bp, Glycine max
  Peptide Sequence Number=SeqID_195412
atggaaacggaaacccgacggaaagtggaggagatggtgttggatatattgaagaaatccaacattgaagaagccactgagttcaccatccgagtcgctgcctcggagcgtctcggcatcgacctctccgactctcccagtaggcacttcgtcagaaccgtcgttgagtcttatcttctctccgttgcggccaatgaaatctccaaagacgcagagaagaaggagaacgaagatattgccgccaaaaacgacgacgatgtgaagaagggagatgtcgttgcggtgcccaaactgaagagggatgatcccgaacgcgttatttgtcaactgtccagcaggaggaacttggcggtgaaacatttcaaagggacaaccctagtctcaattagggaattctatatgaaagacggaaaactacttcctggttctaaagcttcggggagatattag

SEQ ID NO: 78635 - DNA, 339 bp, Glycine max
  Peptide Sequence Number=SeqID_195413
atggaacaagatcgatggtttgagctcatcgaccacgcaattcagaagcttgtacacgacaacaccaacaaagtccaagaatccctccataacaatgatgctcaataccaacacgctctttcccaccttctctctgtctctcagttgaaaggagaagagatacttgagcaattcgaagcttctagttcttctgagccggtcgcttctataactcaggaaacagaaagtgaaaatgaggatgctggggaaagtaagggaagtgaaaatgatgagataatcaaagaactaaagaaggtgaagaggcaaaacttcatgactcattgtctaaaaactctttag

SEQ ID NO: 78636 - DNA, 339 bp, Glycine max
  Peptide Sequence Number=SeqID_195414
atggagccatccaaaggaaacatcaaggggagaagaaagacgtcagaacaaaataaggaaacaagaagttattttacatggaatttggagatgaaatgtgtgttggctgaggctagaaattttttattcaaggcaatttcaaattgggatgatatagtagaattgtgtgctaaagatagaaccaccgatcgtggagttgaaattgttatggatgtcgatgaagtcatgagcacaagagaaaatgaagtggaattgatgggtttagaggatgccaatgtttctatagatttagaggaattggactatggttcaaaaagaaggggacaatctttaagttaa

SEQ ID NO: 78637 - DNA, 1164 bp, Glycine max
  Peptide Sequence Number=SeqID_195415
atggtcgaccttcaagaagagtgttcctgccatagaggaagctataaaaaagatggaaggaaggataagtttataagtttctgtattcttctgaatatttactgcttacttttttggctgaaaagaaaacatgttgctagattggagcctaatggtaagcaaaatggagatgcgtcaaattcagctgttgatgttgctcttgagcccaatggtaagcaaaatggagatgcgtcaaattcagttgttgatgttgctccacttgagcctcatggtaagcaaaatggagatgcatcaaattctgttgttgatgttgctgctcttgagcctgttgtccctattgaggtcatccgattggatgggaagaatttccaatcctgggctcggcagatggaattactcttgaaacaattaaaggttgactatgtgctagatgaaccatgcccgaaccctacactaggggaaagtgccaaggctgaagacattgccacagccaaggctgcagaaaggagatggctgaacgatgatttgacatgtcatcggaatatcttgagccatttatctgatcctttgtataacctgtatgcgaacagaaaattgagtgctaaggatttatgggaagaattaaaactggtttatctgtacgaggaatttggaaccaaaagatatcatgtgaaaaagtatcttgaatttcagatggttgaggagaaagcagttattgaacaaatcagagaattaaatggcatggcagattctattgctgctgctgggatgtttatcgatgacaactttcatgttagtgccatcatttcaaagcttccaccatcgtggaaggacttttgcatcaagttaatgcgtgaggaatatctaccttaccggaagttaatggaacgcatacagatagaggaagaataccgctatggagtaaaacgagtggttgaacattctaacagtatggaaggatatcaccaggcctataatggtggacataggagggctgactataagccattgggaatgtgtaggaataggtcagaaattaatgccaggagcgtaccctgtagtgtatgtggcaagaggggacatctttctaaacattgctggagaagaaatgacaaacaaactaatgagaggaaatcagaagaggatgagcgtatacccacataa

SEQ ID NO: 78638 - DNA, 507 bp, Glycine max
  Peptide Sequence Number=SeqID_195416
atggatcctaacatagttaacactgcaattacttcaagaagacgtaaaagagaagagtataagaagataatcttattagttgctgcttgtgttgttcatatgagatgtattgtagcacttgatgagactcatattctggttacagtttctcctgatgagagacctagatatcgtaatagaaagaatgatgtctctacaaatgtgttagccgcttgtggtccagatttaagagaaatcaaaggaatttggacaacaagggtgacggaggttgggaaagatagagccactggtcatggagctgaagctgctatggatgctgatgaagcgatgagtagagagacaaatgaagtggaattcatggggttaggtgctactactactatagacttagaagaaccaagctctaatacaaaagaaaaaagacaaggttcaacttcttctggcacacattcattctcacaagacaaatattggagaaaaagaaggaataacagtttctttggatag

SEQ ID NO: 78639 - DNA, 309 bp, Glycine max
  Peptide Sequence Number=SeqID_195417
tctactgtggctgggcgagtatgtccatgtgcagaattggaaatttccgaactcggtagaaccgtagaaggttgcgctagtggaattgtgtgcttctatttggcagaccctatctatgccttctcaacttcgcacaagccctcccctaaactctgctgtccaaaccactgcaaccagagcccccctctgatgtgtcagagctcttctgccccacgagtgaggtcgcctcttgttcctttgcggctttgtttgtgcggttctctctccctattttctgtgagctactgctctgtttctggcgttaagtag

SEQ ID NO: 78640 - DNA, 693 bp, Glycine max
  Peptide Sequence Number=SeqID_195418
atgagggtagtgcggtttgccggcacaatgacaaggagacaagcaagttccacgagacgtggcggtctttcaagaatcttgcattccaaatccaaatcttctcctctactctccatatcccttgtcctctttggagccatccttctcatcctttatgcttgtagcgggtcaggtgttttgggaggaagaaaggatgtggttagcagggttgaaggtgacttttcatgcacttttgaagtttcaagtgcaattcctgttttgaagaatgcatatggtggcagcatgaaaaatgttttacacgtaggccctgagagttgttcagtggtcgccaaatttttaagagaaggggaaactgaagcatggggtgtggagccatatgacatagaggatgctgataggaactgcaaggctctagtgcagaaaggcattgtacgtgttgcagatataaaattccctttaccatacagggcaaagtctttttctcatgttatagtgtcagatgctttggattacctgtctccaaaatatttgaacaaatctcttcccgagctagcaagggtatctgctgatggtattattatttttgcaggctacccaggtcaacggagagctaaaatagcacaattatccaaatttggccgcccgagcttttcaccatatttctcatatgcaaatgagcggcataggtggtga

SEQ ID NO: 78641 - DNA, 279 bp, Glycine max
  Peptide Sequence Number=SeqID_195419
atgttcctctccgtgcggtggtccggcggcaagcaacaacggctcgtggcggtcaccggtggtcgtgggtggtggaggaggagggcgttacatatgaagtttgatcatatggtgactacaataattaagtcccatgacacaaacaccatgatggtgaatctcaacaaagttgcggaaactagtgggagtgcaaaaattagagcccatgataatttcaacagtaaaggaagaggaaatttcagaggtaaaggccaaggaaattatagaggcagaggttga

SEQ ID NO: 78642 - DNA, 897 bp, Glycine max
  Peptide Sequence Number=SeqID_195420
atgccacaggcgatacaaacaccagagcaacagacacacctcgctaaattgttgggctatgattacataattcaatacaaagcaggttcaaacaatgtcgtcatcgacgttctctcccgaattcccaacaaccatttattttcactttctcttcccaattttgagtttgaggaacaactcgggaaatctttgttgggaaattcaagttaccatgaactatcggagcaaatcttcttccacgggaaaatttggctccctacgaacagtcaattcacatttctactgttggaagagtttcataaaacccctcttggtggccatatgggagtggctaaaactttgcactgccttgaggccagctttttttggccgtgtatgccaccatcacatggtttcaccaccattttagtggttgtggatcggttctcaaaaggggttcacttaggtgcccttcccccacattataccgccagcaaggtcgtcgtcctcttcatggatattgttagcaaattgcacaaattccctcacaacttggtgttcgacagggattccttgtttcctactcagtggttcaacttcttggcactcgctaaatggtcatataacacctcagttcattttggcactggtctttcgcctttcaaggcagatgactctttgctgaccaccagagccaccatttacgcctcattacaatgccatctttcaaaagctcaggtcgctatgaagcaccacgtgaatgtcaatagccgtggcgtcctattctcgatcacaactcgtgcctcgaacgggttggcggcatcgacctcagttaaggcgacgacagtggatggaagcggcgtagtcggcagcgaggtggctgcaggtggcgccgatgatggcggagacgagcagtga

SEQ ID NO: 78643 - DNA, 765 bp, Glycine max
  Peptide Sequence Number=SeqID_195421
atggaaggaccaacactctgttggtatcaatggatgcggaggaacaatttcctcacatcttggcctgcgatgctccaagcacttgaatccaggtttgctccttcattttatgatggtccacaaggagctttgttcaaactctctaagagaggctcagttaatgagtacctcattaagtttgagagtcttgcaaatagaatagtgggccttgccccaccattccttcttagctgctttgtcttaggcttgaatccaaaattgcaatatgaagttcaggctctcaagcctttttcacttccccaagtggctattctggccaagctccaggaagacaaacttcttgatcttcatcgctattccagagcccagtctcatcttccttctccaatgaacctattgttgagttcttctgcggcccctactcctaggtttccaatcaaacgcctttcaccagaggagatggttgtctttcgcgataaaggtctctgctaccattgtgaggagaaatgggtcattggccatagatgcaagccaagacttcacctcttcattgtcaacgaaaagaacctctcacattctgatccttcaatagcagtcgacgcatctctggcagctctttctttcgacgatcttccaaacaatccatcacaattaagcctgaacacacactctgggatgcttgccatcgagatgttttgcatttatggccatatccttcaccaccacgttactatattggttgatggcaaaagtactcacatatag

SEQ ID NO: 78644 - DNA, 375 bp, Glycine max
  Peptide Sequence Number=SeqID_195422
atggcggcgcgagcatacgacgtcgcagcctactgcctcaaaggccggaaggcgcatctcaactttcccgacgaggttgactccctgccgcttccgtcgtcccgctcggcccgagatattcaggccgccgcagcccaggcggcgcgtatgatgaaagcctccggcaacgatgagaaaagcggcattgcctccgacgacggcgatagctgcggggacgatttttggggcgagattgaattgccggagcttatggatggcgagtgctgctggggttgtccggccggcgcttcatcctggacttcctccggcgacctcgccgagtggccggaggaggagctttcgccgcagcaaccgttgtttatggcatgtctataa

SEQ ID NO: 78645 - DNA, 1272 bp, Glycine max
  Peptide Sequence Number=SeqID_195423
atgatctcgtcaatgaaatgcacagcctcatctctcacatgttctgctttctcaaacagaaagcttcccattgcaaggcctcaactcgtgacattaccaaccatcaacaacgttgaacaaaacatgggtccctctcagttgtgttcacagaagcctctctacctttcatccaccgagaacttggcattggtgaggagaaggagagtgacggagtgccaggcctatgaagctgacaggtcacggcctctggagatcaacattgagctgccggctgaagaggcggcgcagaggttcaagattggtgtgtattttgctacatggtgggctttgaatgtagttttcaacatttacaataagaaggttttgaatgcttttccttacccatggctcacctccactttgtcccttgctgctggctccctcatgatgttagtctcatgggccaccagggttgctgaggtcccaaaagtcaacttggacttctggaaggccttgtttcctttgtggaccgtttttcaaaatcttgatcatgattcatggtgcataaattttgtaaaggttgcggtggcacacacaattgggcatgttgctgcaactgtgagcatgtccaaggttgctgtttcattcactcacatcatcaagagtggagagccagctttcagtgtccttgtgtcaaggttcttgctcggagaagcattcccaatgccggtttatctgtcactgctgccaattattggtggttgtgcactagctgcagtgactgagctcaatttcaacatgattgagagaacacttgatgatgtttcaggcttcatgggggctatgatatcaaatttggcatttgtcttccgcaatatattctcaaagaaagggatgaagggaatgtctgttagtggaatgaactactatgcttgtctttccataatgtcactgttaattctgacaccttttgccattgctgttgagggccccaaggtttgggctgcaggctggcaaacagctgtatctcaaattggtcccaattttgtatggtgggtagctgcacagagtgtcttttaccacttgtacaatcaagtctcatacatgtctcttgatcagatttctcccttaacatttagcattggaaacacaatgaagaggatttcggtcattgtttcttccatccttatctttcacacgcctgttcagcccatcaatgctcttggtgctgccattgcaattcttggcaccttcctctattcacaggtgcattctcctctccctctaaattga

SEQ ID NO: 78646 - DNA, 255 bp, Glycine max
  Peptide Sequence Number=SeqID_195424
atggcattcacttcactaccctctcctagaagagaagagaaggcattgactcagccaagatggtacagatggatcggaggctctgtgtgcatgaatgacctttgttacagagttgaagataagtgccttattagaagaatgtgtttgtttgctcttcttaattggaaatgctatgatggaacttcccctcgcccacttcttcatgaccttcatctgtgcccttttggactcttgcatttaatcaccttactttga

SEQ ID NO: 78647 - DNA, 963 bp, Glycine max
  Peptide Sequence Number=SeqID_195425
atggaacaagaaggacatcaatggatagtgcatcctcatgaagaagaagaagaaattatggaagatggtgctttgataagaaagcaaactgtgtcacataacaagggcaattttattacagatgaattaactttctcatcttcatcttcatcttcttcttctagcaatggcagtgagcatagtaatggagtttgttcagtggtcacagcccccccagatggatatcctgttcagaaagaggaagaagttgcagagataggaggtgttggtgaaaattgcaaccatgttaatggtgatatagtagattatgcagctgttgggcttgcacaagtggcagaatttgcaggaacagaaacaaatggagaggccataagtggtgttgttatgtcacagaataagaacagtgtttactttgatgagcaacaaggaatgtggaaatgtcaccactgcacatggaccaagcgatttgacagtccttggactgtgccaaattggaatcttaagggttaccctgacttgatgactatcaaaactaggattcaacatggaccatgttttgtttgtgaaactaaagatgatgaagttaatggacttaatggagttcaaaatggtgatgcttctgtgtctgtccatctaacaaatctaggggagagagaatttgatgtacaagcagatcagctagtttttcaaaatagtctatgcagtgaaatcagtgatcaatgtatgaaaaccgtggacaacaagctcccttccactacagaaatatcccatttacataattcatctgacatacaagctacagctattacaaattttcctgaagaaacaagtacaaaggaagctcctatcctgatagaagagattgatgagcaactggaagaattcgatgttgaggcagtattggcaaaacaagagacgcatgacttgttttgtcctaactgccgttcttgtattactaaaagg

SEQ ID NO: 78648 - DNA, 203 bp, Glycine max
  Peptide Sequence Number=SeqID_195426
tcttcggaagaatcgtcgaaagctgcagaagaagaaggagctgaaatgggtggaatgtgtgtcagagatgaagaaaaagaagtgaaatttgccatggttagcagcacagtgggtcaaagaaaagaattatacaaggcagggaaagaggggaggaagcagaaaatgcagggaaaatccgattcagacgctttgatgaaatcaac

SEQ ID NO: 78649 - DNA, 1281 bp, Glycine max
  Peptide Sequence Number=SeqID_195427
atggctgaattcataagggaggcacggtgcgagaggaaaattcttgaaaggcacgcaaacacccacttcgacaatgacgatggcaattatcgttctccttcggttagtggcttgcattttgatgcaacttctggagattgtaagagttggtgtggtggtagaaataatggggcatggaaaatggatgaaaagatctcttgcttggttgatttgcagagaaggggagagtttcacaaggttgaaaggggtttgatggccttgttaagaaactgtttggagtcagatggtgaaaactcacgaagcattttgtcaggatatgttgatcatttccagagcattccgtttgaggacgttggatggggttgtggttggcgtaacattcaaatacttagctcacacttattggcacaaaggccagaagcaagagaagctatgtatggtggttcagggtttgttcctgatatcccatcactccagaggtggcttgaggttgcttgggaaaggggttttgatgctcctggctcggatcagtttaaccatgctatctatggctcaaaaaaatggattggagctactgaatgtgctgcccttttgcgttcttttggtctccgggtgagggtagtggattttggtcctaaggaatctgaatcactctatctatctgtccctagttcaagtgtaggggcaaaggagctagtgagaattaatgatgcaaggaagaggaaagcaccaaatacccatggaccaatggatagatatatgtctcgtgctgttgctcaagctagttgtagccaagatgcaaagccatgttcttctcttatccggattcgtgacactgtggataaagaaagtagtggtgatagagtgctaaacagtactgaaagacaaaatgagggtcatcgagttcttatggattttgtgtggaactacttttctcataaagacacagttcaatttggccagaggcgtgttcttattagtgacaaaacgcccttgtactttcaacatgatgggcattcaagaacaatagttggaattcaagtcaaatatcaacagtctggaattccacaatacagtctcctggttatggatcctggtcatagaacggctgctctagaaagatcacttagggagaaagttggatggcagaaattcataaaaagaggagtgcacacactaaagaagcaacaatatcagttgtgttatgttgatcctggaattgccagtgaggaggagatggaaaaactcaagacaattgatagcgtcttccttgaattttaa

SEQ ID NO: 78650 - DNA, 1062 bp, Glycine max
  Peptide Sequence Number=SeqID_195428
atgtgtggatctgcttctgtcagcaacagtgttagcacctacggaaaattctgccgtgaagttatgtgcatattcgaagaatgctgtgctgttatctcaaagtgtccaggattaagatcgttgaatcctgtcacctgttgcaaacatgaatatcatctgcattgcattattgaatggtcacaaagaagcaaagagtgcccaatctgttggcaatcacttgctttgaaagatcctgccagccaagagcttctagctgcagtggaagatgagaaatgcatgagatcaagaaacattgctaattctcgtgccccccttggacaacttaatgaaagccacgatgattcttgctcagatgactctgattttgatgatcagattatgaagcgcctagtttctgctgcaagaagagctcattttgttcagagacaggaaaggaagagatcacctagtgctggtccatcagaggctcttggtgttaactcttccatgcatgtttctgaggtgcaaacaactcttacaacttcatcatctgggggtagtttgccagcttctggtgtaccatctactgttagcattcaacctccagcactaaatactactcctgagagtgcaaggagaccaaacacttctgagatttccttccctgagtccttcaaatcaaagttttctgctgcttcagccagatataaggaatcaatttcaaaaagtacgcttggtcttaaagagaagttacttgctcataatgtctcggttaaagagctgagtaaaggtgttcagcgcgagatgaatgcaggcattgctggagttgcacggatgattgaacgccttgatcttagctcaaaacggtccagtgctcctctcattgctgtccatagtgtggctacttcagacttcccttcttcagggaagtctgttgaagagaatggcattgggggttctcctagtaaagagaatggaggtgcagttcatgatgttagttcagatgttcccccacttgttactaacatgcaatcttttcgaacaaaaactcctccatttcttcaggttaatcctaatctataa

SEQ ID NO: 78651 - DNA, 449 bp, Glycine max
  Peptide Sequence Number=SeqID_195429
atggttgttgaagttaaggactacattgttgaaggccgttgccgtcgccgtccgttcgtcttgtgcgtggtgctcgcttgcgtggcgcgctggtgcggggcgccgtcgtcgctggtgcgtggtgctagtgctgtcgtcgcactggagtttgccgtcgccgtcatcactcatgtcgtcgtcgcgctggagttcgcgtggtgccgctggtcgcactggagttcgcatgttgctgttcgtgcttgcgttgctcatcccattttcatgcgaaaatcggacgaaaagattaagctgtggctttttcttccgggccgtcattcatcagttgttgagactgctcagacagcagtatctggattaagagttgttgcttctgggctttggttggctcctggggattcagaagaggttgcagctgctctctctcaggctttaaggaattgtgtagaaag

SEQ ID NO: 78652 - DNA, 630 bp, Glycine max
  Peptide Sequence Number=SeqID_195430
atgggtgaatcccatgttaaacattttcacctcataataggaaaagaaaacacattgaaccagaagaaaagtagcaaaatcacagtgttgttaaattgcggttatgacggcgccatggcggtatggcatcacgggtttttgggaaaatgccaccaaatagcggtggcgttgcgggtttcatatggcggccgccataaccttaacagtggtggcggaatggcggttatggcagaagacacctttttttttttgaaatttttgcaacacagattgggtcgtgttggggtgacccgacccaacaccctaacccgattttcgcatgaaaatgggatgagcaacgcaagcacgaacagcaacatgcgaactccagtgcgaccagcggcaccacgcgaactccagcgcgacgacgacatgagtgatgacggcgacggcaaactccagtgcgacgacagcactagcaccacgcaccagcgacgacggcgccccgcaccagcgcgccacgcaagcgagcaccacgcacaagacgaacggacggcgacggcaacggctacagtctgcgacagcaacgtgccctcttctaaatggctgaaaattgttaaagtattatattttgtagacagctgtatgtag

SEQ ID NO: 78653 - DNA, 444 bp, Glycine max
  Peptide Sequence Number=SeqID_195431
atggaggtatatggaaattctatggttgcagctccttcaaatgttatttatctgtccagtattttgggccaaggcggtccaattcccggtcacagatgcaactggaaatgtgaaaatgaacatgtttgtggaaacatgtatcgctgcaagctaacagggctgactcacatttgtgataaaaactgtaaccagagaattctgtatgataaccatagctcactttgcctagcaagtggtcaaattttcccccttacgccggaagaggaacaagcagtgagaggtgttcgcaggaagcttgacatggagaattcgccctctgatagctgtggttttaagcgtagacgagatgctcaattccatccttctcctttcgagagatctttctctgctgtcagtcctatctgcagccaaggtctttgtacgcgacacgtttatgacacttga

SEQ ID NO: 78654 - DNA, 465 bp, Glycine max
  Peptide Sequence Number=SeqID_195432
atggtggggttcagaaacagatacatggttatggaggtttttctgaaccctaatagggacaaaggtggggatgattctgttatagttacacagtttaatgtctccaaagctgtaagagacagcatattggtgaattttggggagtgtggtttggcttcgtcattgggatcgtttcaggttaagtatgtgaatccaatcactaatgtgtgtataattagggcttcaagggaacagtatcagaaagtatggtccgccattacaatggtcacaaatattggaaactgcccggtcatgtttaacttgctggatttatctggaagtataagggcttgtaaaaatgctgccttgaaatgtgaggagtcaaaatttgagcagtacaaactcatgcttggtgatcgattctcttctgatcatactcatcgcatgaatacctatctcgacaggatcaaagttttggagcattga

SEQ ID NO: 78655 - DNA, 858 bp, Glycine max
  Peptide Sequence Number=SeqID_195433
atgcctatagtgatgacatcatggaagttcccaagttttctagctattttgtttactttgttatcttattctttctcttcaatattcaccataacaaacaactgctcccatactatatggcccgggacactctccggtgccggctcaccgccacttccaacgaccggattccggctggactcaggccaaatgatgaaactcacaagtgtgccagggtggtcaggaaggatatgggctaggactggctgcacatttgatgcaacaggaattggtaagtgccaaactggtgattgtggtggaaggctggaatgtgatggaaatggtgcagctcctcctacctcattgtttgagataacacttggtaaaggcaatgatcaagactactatgatgtcagcatggtggatggctacaatctgccactgcttgtgcaaccaagaggtgtatatggtactggggtctgtaatgccacaggttgtgtcactgacatcaatagaggttgtccaaaagaacttcaagtagttggtggagatgcataccaagatggtgtagttgggtgtaagagtgcttgtgaggcatttggatcggatcagtactgctgcagtggagaatttgccaatccaacgacatgccagccttcctattattcaacccttttcaagcaggcttgtccaaaagcctatagctatgcatttgatgatgccaccagcactttcatttgcaaagcttttgaatatgacattattttttgtcccaatggcaacaaggttaaaaaaccaaatggtgcatttccacctccaccaccatcaattggatggccagatcagaagtttcagcagcagcaaagactcagacattaa

SEQ ID NO: 78656 - DNA, 102 bp, Glycine max
  Peptide Sequence Number=SeqID_195434
atgcacttaggtcatttcatccagtatagggagagcttgcagactattgcgttgaataagccagagaggcctgtcagcaacaaagataagtatggattttaa

SEQ ID NO: 78657 - DNA, 144 bp, Glycine max
  Peptide Sequence Number=SeqID_195435
atggatggctctaggcctatctttgattctattgtaatggctccaaagaagcttctcactaaaagggcaaggaaggatgccacaggggagggattcagtgtagccccacaagcagagatcgagtttgatggacactgtttctga

SEQ ID NO: 78658 - DNA, 702 bp, Glycine max
  Peptide Sequence Number=SeqID_195436
atggtaaaaaacatggtcaaaagtcaaaacgtctccaatcctgaaagaccaaggttcaatactcaatggaagaaatttagtgtttttggtgaaataaagcttgaagtgatcatcaattataccatgagtggttcatatagttctgaacggcttgcatctggccgctcaaatgcaataaatatagccgagaggttgggactaccatctgttgttgtagatactgctcgtatgttatatggttctgctagtgcagagatagatgaggttataactgatatggaaaggttaaaacaagaataccaagaactattggatgaagcacgtcattatctgaggcactccagaggactttacaatagtctattgaacaccagaaggaagatcatagaatatagtactaatctaagatttaagaagatgagagatgtgtccgaggctgcagcgatggcaagatccatccttcacaagaaagtgagggaattggatgcatcagctaagcaaccttcacagaataataaaaccattagcagctctaatttatcagcaaccaacaaaagccaaactgttgcagagaacaaagaacccactattgctgataaaagtgcatcttctgttaaagtttttaatcgatcaagatcagataaatctgggcctcccaaggtggtgatatggtacatgtctcttccctcgggaaacaggtga

SEQ ID NO: 78659 - DNA, 138 bp, Glycine max
  Peptide Sequence Number=SeqID_195437
atggagctttacatgcagcatttggctgaccagcaagcggctaaccataggggccaggtgggggcagaggtgccaggagatgaggacagcactgaggaagacagtgacatggcagatgtgatggatttcttcctctga

SEQ ID NO: 78660 - DNA, 168 bp, Glycine max
  Peptide Sequence Number=SeqID_195438
atggagtttgatgaagtgaatttgaagccaacatacaaggttctttggggtgtaccaggacatgaacgaggggagggattctatggcaatgttatcaaaactgaactggttgttgttatgatgaaggcaccagttcctaattcaacagtaaatgaagcaataaactaa

SEQ ID NO: 78661 - DNA, 438 bp, Glycine max
  Peptide Sequence Number=SeqID_195439
atggtaaccgcacacgacgctcactatggacagtaccaagtcgtggttaatggctactaccacgtacctggtcgtggaggctggtttggctatttgtggttgtttgttcccaatttgggagattttcaaaaacgacatgtcgttggcaccttttttgctatagctatttatttcctttcatcaaagttgcgtcgtgttgtgtcttcactcttcagttaccttcgaaaaggcatgggtccaaaaccagggtcagacatgaagatgaacgcgattaggtcagggatagtggtgctgggagcgcttgcattcgggtacttgagcatacaaatcggcttcaagccttatctcgagaaagctcagaaccagaacgcgctctacgaatctgacccttcttctcaggaagaatcatcttcagctttcccagaacgcacttcgtga

SEQ ID NO: 78662 - DNA, 1903 bp, Glycine max
  Peptide Sequence Number=SeqID_195440
atgttggaaaacctgcgaaacaaacgcctagtgtttgctggggactcaattgggagaaaccaatgggagtcactattatgcatgctctcttctggagttccaaacaaggaatcaatctatgaagtgaatggtagcccaattacaaagcacaaggggttcttggtgttcagattcaagcattataactgtacagtggaatactacagagctccatttcttgtattgcaaagcaggcctcctcctagaactgatagaaagattaggacaaccctgaaattggatgaaatggattggtactctatgaaatggagagatgcagatatcctggttcttaacacaggacactggtggaactatgagaaaaccataagagggggttgttatttccaagaaggtgtggaaattaagttggaaatgaaggtagaagaagcatataagaggtccataaagacagtattgaattggatacaaagttcagtaaatcctaagaagactcaagttttctttcgtacttatgcccctgtgcatttcagaggtggagattggagaaaaggtggaaactgtaatttggaaacactgccagagcttggttcctcattggtgcctaatgataactggtcacaattcaaaatagccaattctgtgctatcagcacacacaaacaccagtgaagttttgaagctcaagatattgaatgtaactcagatgacagctcagagaaaagatggacatccatccatctattatctgggccctaatgcgggccccgcacctccccatcgccaagattgcagccactggtgtctccctggtaagttaagaaaatggtatccatttcccaagcacaccattgacttggtacagtttcgagggcgcatcatcatcaccgattcaccgatgggtgacgcgaacttcgccttctttgttctctttcttcttcccgtgtttcttctggcggtgctctacttcctggtccgtccgcgtcccgtgaagatcccgattaagaaccggcacgttttcatcacgggcggatccagcggtatcgggctggcgctggcgcaccgcgcggcggcggagggtgcgcgcgtctcgatcctcgcccggtcaccggacaagctagaggaggcgcgcaacgcgatccgcctcgccacagggatggaggtggcggcattcgcggcagacgtgcgggacttcgaggcggtgaagcgcgcggtcgacgatgcgggccccatcgacgtgctgctgctgaaccacggcgtcttcgtggcgctggagctggataagatggaactgagtgaggtcaagttcaccatggacgtaaatctcatgggaacgttgaatctcatcaaggccgcgctgcctgcaatgaagaaccgcaacgatccgctgcccgcttccattgctcttgtttcctcacaggccggtcaggtgggaatttatggttatgtagcttattcggcaagtaaatttggtcttcgtggtttagcagaatcattgcaacaagaggttatagaagataacattcatgtttctatgatattccctccagatacggatactcctgggttagcagaagagggtgttgtaatgcatagagcagagtgtggaactgaggaagatgctgaacaagatgaaaacaaaggaagaagatggaaaacatcttctaaaaacaagagaagaccggagctcaccaaaatcattacagcctcctctggttctatgaaagctgatgaagttgctcagaaagctttggatggtataaaatgtggcgattttattgtttcttgcaatttcgagggaattgcactatccctagcaactgcaggtttatcccctcagaggtctttcttaatggcgtttcttgaggttgttgctgctggaatcctacggattgttgcactag

SEQ ID NO: 78663 - DNA, 453 bp, Glycine max
  Peptide Sequence Number=SeqID_195441
atgcatttggtgatcattcatgataaaacacttctgaaaactcgtgttatagttataactggccctaatactggtggtaaaaccatatgtttgaagaccgtaggattggctgctatgatggcaaaatcaggatgtaggctcacaaaggccttgaactctgactttgagtctaatgttggtctctatgttcttgcttctgaatctgcgcaaattccttggtttgattctgtttttgctgacattggtgatgagcagtccttatcacaatctttgtctacgttctctggccacttgaagcagataagtcatccatggtggaatggcgtgacagatttttttgccaaccaccataggcaatttgtgaagggaaacccaccatggtggcaccataaggcacaatggtgtgtttatatggcggaattttggcctttgccatctgctcatgaaatttag

SEQ ID NO: 78664 - DNA, 405 bp, Glycine max
  Peptide Sequence Number=SeqID_195442
atggctattgttggaagtgatgtagaagccttgggccattatggattaactatggccctcttggttgaccatgaccctcatgagttgaccaccggaagattaaagagaagaggagagaggaggcaccatccactagagaataagccatggaaagagaagcttaaccaccaagggagagccttggataagaagcttagagaggaatcttcaatggaggaagagaatgagagagagagaaagaaagtggcacggaaaattgaaggaagaaagggaaagaagttgaactttgaagtgtgtcacacaagtttctcattcatcaaagttaccacaaatgttacacatgcatctatttatagcctaggtagcttccttgagaagctagtgttacacctcttcaatagctaa

SEQ ID NO: 78665 - DNA, 633 bp, Glycine max
  Peptide Sequence Number=SeqID_195443
gtcaaaaccgccattcaacatgcccggagaagtataccagtgagtggttatgaggcacgggccattgtggctcttctgcagtgtgctgagatcgtgcagggtgatctcaaggctgtaattaaggaagacaaagattggcataatcgtttcatgcctcttacagaagtggcacggcaacaagttcaagtgattgagagaaaggtaattcctgtttattttactatatttcatactgttggttcaggagatactggctgcatcagagatgtacaacagttaatagagagcataatcaggaatgaaaagagtgaaacatcaacccttgaagtgaataacattgatggcaggtggtgtgtaagagtagattctggacagaagaccagttttaagggtctattgttgtccagtggatccggagttggaagtactatagagccactttctgctgttcctttaaatgatgagttgcagcgagcaagaagtttggtggtaaaggctgaagcagatgtgcttttggcattaaccaaaaagatgcagctggaccttgatgatattgagaagacattgaacagtttggttgaactagatgtggagtttgcttactggttttcctttcaatggtcatcttcttga

SEQ ID NO: 78666 - DNA, 384 bp, Glycine max
  Peptide Sequence Number=SeqID_195444
atggattatgtaggaataagattggctaacccttatttggcgactcctggagcaacagttcatgaccattatgggaaaataatttttgaaggagatatattagttacatttatccttgaaaaaccaagatcgggtgatataacacaaggtcttccaaaagtagaacatgtattagaagttcgtttgattgatccaatatcgatgaacctagaaaagagagttgatacttggaatgggtgtataacaaaaattcttggcattccttggggattcttgattggtgatgagctaacaatagtgcaaagtcatatttttttgcaagttttcaagaaacggctagagttttatcaaaagccgctctccgggggcacatatattggttaa

SEQ ID NO: 78667 - DNA, 367 bp, Glycine max
  Peptide Sequence Number=SeqID_195445
atgactggcgagcggattagtccttacattcagactatcctcttgaaacgtcagccatcccgcgtcaatcaagctctataccttgtccttgaaggccacgttggtgctcatgttgggattggtgttcccggccatttaggagttgaagttacgacatgggtgtctccctccttcttcttggctccacctgttctagacctcctattgcttggcgacgcaaaggctcacgggtgcgtcttccaagaaaggaaaatgcatggagtcgccaccaacgtttattcgaggaaaacgtcggaaaaaccggaaagacgtggtctacgaactttaagtgtgaaaggttcaggagttgtatttacgcacggggaag

SEQ ID NO: 78668 - DNA, 1100 bp, Glycine max
  Peptide Sequence Number=SeqID_195446
atgggatggcctagttgtgataggacagctcccatgcctgctccagaggcatccgtctccaccataaaggaatcacaaagtccgataatcaccatatcaaagcagagctacgacgtccttcaactgttggaaagtagtctgtgcttcaggggtccattccagttatggtttgtggaaccggccattgttgaatggcaaggaccttctcctaaactattgctatctctgtcgctgacaccacatggctcagatattctatctgaggttggcaaatccaactttgaaaaccattgggcacctcccaactcgtccaatatctcatccaccattggaatcggaacccgaccgtgtatcaacaaggggcaaaaagaagcttgtgctaggtctgattatgccactcttcaacatggattccacctgaaactcgatcttctgcttctaaaaatggggatactggtaggtagtgttgttggtgtgcaaaacaggtgcttgaatttgtggagcaagttttcaatttcaagaaatagtaaagtggagaagaacgtcacagcaccaatggtgacattccaactcatactcgttacccaccatgacctagagtgggtgggtggacgacccatgaggcatacaatttctaaagctgtattgccaacgagggcgtataaactgatttgggctggaaatggcccaagtgcctctccttcgtcactactcacatcaggcggatcatcagaggggttgtcatcttcatcaacaatcaagaggaaaaacttggaggagtattcctctggtgacaatcttttgaagggaatggacagagagtgtgatggtatgggtaacaaggccgatgagggtaagggtgctagaggacgagaagaaggtggcccttgggaccctgggcgaagcgagcctcgagagcacaaaggaacccaggccatgacgacagccaaccgttcttggacatccattggaacaatgctaaggccgaaccctccatctttagacgatgagaagaaggaaatgatattgtcacaaatgggttcgttgtggacaatgttggtgatggaggtcgactttccatgtgtgctaccttctagcat

SEQ ID NO: 78669 - DNA, 690 bp, Glycine max
  Peptide Sequence Number=SeqID_195447
atgaagaagtcgatagacaagaaaaattatgttttgactcaagatttaattctaatgaataatcgaatttggttaccaaagggaattaatttcattcagacactgttgcaggaataccacaatacacatattgggggtcacatgggtattaaaaagactttggcacgattaagagataactacgtctggtctgaaatgcatgaggatgttcgaaagttcattctgacatgtattgtttgtcaacaaaccaagtacgaggccaagaaaccggcaggactcttttgtccattggcaattccttctcgattgtgggaggatctctccctagacttcattgttgttgataggttttcgaagggcatccatttgggtatgctaacaactaactacattactctaacgattgctgcacttttcatggagattgtcggaaaatatcatggcatgcctcagagccttgtgtctgatagagatcctctatttgttagcagggaagctgtgtttattagtttgcgaaagaagcttcttaaatcgcaagaaagggtgaaggccaccatagatgctcatcaaagggatgtcaattttgaactaggtgaatgggtaatggtaaggcttcgaccatatcgccaaagttcagctgctaaagtttccaattcgaaattggccaagcgcttctatggcccgttttag

SEQ ID NO: 78670 - DNA, 243 bp, Glycine max
  Peptide Sequence Number=SeqID_195448
atggagaaaggtttcaagatccgcctcgcattatattgggtcggacctggtctcaacatgacatctagggcaggcactgtttccagtcaaccctcttctgcaccgttcctcattagtgagcagaccttcattcaagattttccagaagaacatcttgaatctttctggtctgttccacttccaaattattttgaacaaaggatcaggagtggaggtagcaagcacatcttgaggtgttattag

SEQ ID NO: 78671 - DNA, 422 bp, Glycine max
  Peptide Sequence Number=SeqID_195449
atccttcccacgccacaccgttgaaactacctcttgctttcactttctatgaaggtttgggtttctggaaaggtttgggtctccaagaatcatcttgttctcacactctagtgctttgggagtgtcccaagtgtagggtatcatggtacaaagtgaaggatgacgattgtagcaatgaggaaagcacaaagaaagatcccccaacaaagaagaagctagagctttgtttagagtacatggaaaaggtgaaatctattgggctttccgagtctcatcatgccaacagatggggaagtaagggtttacggggttttgcgattgtaaccatgggtcatgaagaacggaatcaaggatatttgtatatattgaataacaacaaagtggttgacctgcatataactgctcacaaagaatttttgcag

SEQ ID NO: 78672 - DNA, 702 bp, Glycine max
  Peptide Sequence Number=SeqID_195450
atgcagtcccagatgcaatcacagggacttgaattgcctcctgaggctgaggttggtccttctgtttctcgtgttagcacaaaggaaagttgtgttgatcccttggggcttgacccagaaacggctgacttagacaaatgtggattgtatgtcaataaaatgaaggtcggtgttgaggaagtccaagatgtcgatgctcacattcctgtacccactcaaaaggttcagttagtggggcaggcacttaacatcttccttgcttggccgacacatcttgataaacagggagttgagggatcggcaaaacctgtagatatgttggatcttgatgtcaatcccctgtacctgatgacattgtccatcccacagcttttccttaagtttgttggattcaacaacaatcaaggaagtaagtctaaggctgctgctagatggattataattaaatgtaataaggataaaggaagtactgaatgtagactcggcaagtcttcgtactcggtggccaaccgagtagcttactgggaatctagagaatctgatatctataattatgtagctaatctaggtcttgggcgttttggccaaccctatcagcaaaaaagagagagtgaacttcagccgatagctatcaagaaagcggcactactggggaatggagggattatgccaaacggacttgactttcaattaagcggataa

SEQ ID NO: 78673 - DNA, 1137 bp, Glycine max
  Peptide Sequence Number=SeqID_195451
atgacgaaagaaattgccgctatagaaaagaaccacacctgggagttcacagtattaccagatggagtcaaaccaattggagttaaatgggtatttaaaacaaaattggatgcagatgggcaagtagagaaatacaaagcaaggcttgtagaaaaagggtatgcacaaaagcatggaattgactacactgaagtctttgccccagttgcaagacttgataccatacgggtaatattggctatagttgctcaattcagctgggaggtgttccaacttgatgtgaagagtgcttttctccatggggaactcaacgaacatgtatttgtactgcaaccggagggatttataaggaaaggagaggaagagaaagtttatcggctaaagaaggcattatatggccttaaacaggcaccacgagcctggtacaataagattgaagcctattttgcccaagaaaagtttgacaagtgtcctagtgaacacatattgctcacaaaatcacagggaggtaaaatcttgatagtcagcctttatgttgatgatttaatattcaccggaagtgataaaactatgtgtaatgaatttaagcactcaatgatgttgcattttgatatgtctgatctgggacaaatgcgtcattttcttggaattgaagtcaagcaatgtacaaatggaatatttatttgtcaaagaagtaagttcaataagcagatttatgaccaatcctaccacggcacactgacttgcagcaaagaaagtcttacgaaacaaacagtggttgccttgtctaccactgaagcagaatatgtggcagcaacattatgtgcctgtcaatgtgtttggcttggacgattactagagaaaattggagtcaaagagaagacgaaagttgtgattatgtgtgataacaactctactatgcagttgtccaaacatccagtgtttcacgggagaagcaaacacattgatgtcaagtttcattttcttcgggatttggtgaatgatggaatagtcaagttgagtttttgtagttctcaggaccagctcacagacatcctgacaaaacctttaaaactggaacagtttgagaaactgcaggccatgcttggagtaactagtatagatgcattggtttaa

SEQ ID NO: 78674 - DNA, 345 bp, Glycine max
  Peptide Sequence Number=SeqID_195452
atggtttcggaaacaaaacagtccaagagtgtgtgtgtaactagagctagaccctcggggctattgctagcgagggtgagaaaagaaggtcacaaggtggttgtgttggagcaaaaccatgatattggaggtcaatggctatatgacccaaatgtacaagaggaggatcccttaggaagggacccttggctaaagatgcatagcaacatctatgagtctttaacgctcacgtctcccagacaaatcatggggtcaactaatttcctctttttagtcaagaaaggtggagacacaatgaagtttccaagccatacaaagttcctttcaagccatacagatcattag

SEQ ID NO: 78675 - DNA, 1540 bp, Glycine max
  Peptide Sequence Number=SeqID_195453
atggggaggaattcgatgaaatttggaatgattgataattcattttacacctcagattaccagtatagtccacagaacaataacaataatgtacaggatatggcatataagtttatgaaaggtataccaaactttgtaaagatagttgaagttggtccaagggatggattacaaaatgagaaaaacattgtaccaacagatgtaaagattgaattgattcatagattggcatcttctgggttatccgtcattgaagctactagttttgtatctcccaaatgggttcctcagttggcagatgcaaaggatgtaatgcaagcagttcataacctgggaggcattagattgccagttctgactcctaatttaaagggttttgaagctgctatagcggctggcgctagagaagtagctgtttttgcatcagcttctgaatctttctcaaaatcaaacattaattgtagcatagaagaaagccttgtccgctatcgagctgttactcgggctgctaaacagctctctattcctgttcgaggggtgagccttggcacaacagtaaagttgctccttggtgatcggttggtcatgggcttgaatctgaaaacagccttgttgcttatgctagtcagtgttattaaaaagcggccatggcggcgctatggcggaatggcgtcgcggaatttcgaaaaaacgccaccaaatagcggtggcgttgcgggttgcgtatggcagcgccatggtggccgccatagccatgacggaaactcagagcgcgagaaggaagccaagaacagaacagcacaacagtcttcagcggcacgaccagcagcagtctccagcacacgaacggcgacgacgcagtccaacagcacgacgcacaacgcacgcgagagacccaagcaagactcatccgagagagaggacgcagacgaccaagcgacattgacggcaacggaagtgttctgctcgtcgccgccgttcgtgcgtgctgccgggggtggtgtcgcggcggcttggagttacgcaggcagagaaggttttgaagtggaaggaccaatccctccatcaaaagtggcatatgtagctaaagaactatatgatatgggttgctttgaaatctcacttggggacacaattggagttggtactcccggaactgtagttccaatgcttttggctgtaatggctgttgtgccagcagagaagcttgctgtccacttccatgacacttatgggcaatcccttccaaatattcttgtgtcccttcaaatggggatcagtgcagttgattcttcagttgctggtctaggtggctgtccttatgccaagggagcttcaggaaatgtagctaccgaagatgttgtgtacatgctgaatggacttggggtgaaaaccaacgttgatctcggaaagctcatgttagccggtgagttcatcggcaagcatttggggcgcccatctggctcaaagaccgcggtgaaagtgatatcggtcggtggtgattgttgcagtggtaggttcgatagtgacgtcgtcggag

SEQ ID NO: 78676 - DNA, 1047 bp, Glycine max
  Peptide Sequence Number=SeqID_195454
gtagaaactttgttagctagtgatttaagtaagaattctgaagaatttcatgaattaatggatgtgatggaaaaacatgagacaatggaaattgattgtgttggctgctctggatcctccaagaaagcagatgatttttccttggaatcagattattcttggattgaaagtgataaggctgagccatggtggcggactacagatagagatgaattagcttcatttgtttcacagaaatctctcaatcatattgaaaattgtgatcttcccccaccacagaagaagcatcttagagggcacccatgtgctcatgttaataatgacaaaataaagacagcatcttatgactgggaagccaaatccagaagcttttccaatttgacaggtcatacaccaggaagtttagattcaagattgatgcataagaatcatggtcattctaccaatgaaggacttctatattttgcttctgacaaatgttcaagtcatacccccaagcatgaggatgtcaaaaagagtcaacaaaattttgatggagaccccagtaaagctcaactaatggaagcattgtgtcactctcaaacacgtgcaagggaagcagaggaagcagcaaaaaaagcctacgcagagaaagaggatattgttactctcattttcaaacaggcttcacaactttttgcctataagcaatggttacaatttctgcagctggaaactctttgcattcagattaagagcaaggatcagccaatctctactctctttccagtggctcttccatggatgtcatatgaaggtagaagctcacggaagaggaagcagaaaatatccaattccaaacaaggagaaaggaaagccaattcaaaatgtgatattacaacatatgctgttgcctttgctttaggattgagtctagttggtgctggcttgcttttgggatggacagtggtgactaactactctaataaaaatgtttgggatgactctttgttgaggagcaagggcaacatcttgaaggacataacctgtggctgtggtgaaatgtga

SEQ ID NO: 78677 - DNA, 567 bp, Glycine max
  Peptide Sequence Number=SeqID_195455
caaggagctgtggagtctggtggaagaaggcattcccgcaccagcaattggattaagaccaggcagttaggctcagaagaaagccatggaggaggccaaactcaaggatttgaagaggaatccaatggcataagtgttctaactatcgatgagttgcatgggagtttacttgtacatgagcaaaggatgcaaggactacaagaggaggagcatgtgttgaaggcacctcatgaagaacacactcgccaaaacactcaagaggatcgacccatcagaggccggggtcgaggtgcgtatagaggaggacgtggcagagggagagggtgcaacaacttcatgacacgaaacaatacatggtttttagatttggaggatgaacactgcaaaacagtaaagcttaggaataacatgcacatgactgtggtagcaaagggcaatgttaggttgcaaattaatggtataactcagaaacatccatcacttgcctcagaacagatagaggaggagaatttctctcaagagaatttgaagaattttgtcaaacacggggcagaagaaggcaattga

SEQ ID NO: 78678 - DNA, 192 bp, Glycine max
  Peptide Sequence Number=SeqID_195456
atgaggcatcatcgtagactcagatgtgaagaggagagtgcgccatttcgagagtcagagtggactaatttctatgcagagtctggcgagtgccatttcgaaggcgcaaataagctacttcagggtggcggcgtcttcgaggagcttgagctccgccttgattacccagtcactggtgtggtggtagcttag

SEQ ID NO: 78679 - DNA, 315 bp, Glycine max
  Peptide Sequence Number=SeqID_195457
atgaaatttactcaaacaagcgcagacatacataagattgagaccaaaacagagaaaagagaggagagtggagtgaacgaaccaagtgagaaattgggagatcacggatcaaggctttttctctgctccgttatggacacgacaatccatgttgaggatctaaacgacgccgtttttgccattatctcttcctatttacgcagtctttgtcaaatggttggtaagtacatggcgatggtggggtccacgggaaatcaagctaaagaggattttgtgtacgcccttggtattaacacgtggcaatgggcgcagtaa

SEQ ID NO: 78680 - DNA, 540 bp, Glycine max
  Peptide Sequence Number=SeqID_195458
atgggtttccattgtgaggaaaaggatagcatacatctgcaaccttgcgcagcttgcaggatgttacgccgcagatgtgacagtaagtgcgtacttgctccatatttcccaaccaatgaggttgataaatttgctggagtgcatagagtgttcggtgctagcaacgttatcaaaatgattcagatggtcgaggaaacaaagagagaggatgctgttaaagcgatggtgtacgaggcgacggcaaggctcagagacccagtttatggcagtgctggagctatttatcagttacaaaagatgattgaggaactgaaggcacagctggagtccataaaaactcgtgtgtcagaacaaaaagaccagttgttgagtattcgtaataacaacgttaacgcttgtggccaccttgatcaatatccatttcccgtcaatgtcgaccccatctttgatcatgatcatctcatggtctcagatccatttgattttcctgtagaaggtggtggctgggtatttagcaatatgtcaacgccctccttataa

SEQ ID NO: 78681 - DNA, 309 bp, Glycine max
  Peptide Sequence Number=SeqID_195459
gtatgctttaatcaaattgctgctgagtatgagcgtgtacattatgttggcaagaatccttctcgttgtgggagactaagtttttcagaccaagggtcacctgtgccccaagtgaccataacgaaagagatggaaaccatatctaagcgatttgaggaacttgatgtttgtgaaaaggtcaacactaaaggtgcacggaagaaaccgatgaacagaaaccaaagatcaataaagtggcattctgatgcaatcctccctaggaagggaccagtcactagaaccatgagcaagaggctccaagaagattag

SEQ ID NO: 78682 - DNA, 126 bp, Glycine max
  Peptide Sequence Number=SeqID_195460
atgtggaagagaagaggccgtgcccaaacgactacacaagcatgcaatatccctgaactcctaatcaagactatatgtcagaactcagcacgtgccttacttgctcagtgggaaagagttgaataa

SEQ ID NO: 78683 - DNA, 228 bp, Glycine max
  Peptide Sequence Number=SeqID_195461
atgcatgatcagaggccttgtgctgatgtacaaggcaagaggatcttctccacattttcgccattgaagaagcaacccttggaagaggagcttgataattcaatggattcaccatcctccctgaccctatgtcagcttgttggggttactaggctgaaagaaatcgagctagatggagagtgttgggttctaaagaaatcacagggagaaagaaaagggattagataa

SEQ ID NO: 78684 - DNA, 531 bp, Glycine max
  Peptide Sequence Number=SeqID_195462
atggcagtgcttgtaactcaggcagtacgcaacttggccaacccatgcctgtatctgatatggtccttaaaactgtttggacagcttggaataggagggttgcatcgaggtctggcggtaaggccggagtcggacgtagacccaatcacctatattgaagttaatatagcattcacagcttcaacagtggatgttccggcagagtataaaggaagacccggaggctatttaccatacataacctcaaacggctcgcaagtattgttcgagtacacggttgataacctccgtttgaccgtctgtttgcggatggtaggcggtgctgaatcaaagtttggtgccactcatacagaagagctcacgccaaaatgcactgatgaatatggggtccctctccgaaacgagactacacagaaagtcatggtgggttcccttggagtaacggttgacaaccaccatgatggtggtgtatccctgagaagccggaagaccagtaataaaatccatggacaggtcatcccacaaggatga

SEQ ID NO: 78685 - DNA, 771 bp, Glycine max
  Peptide Sequence Number=SeqID_195463
atggatcaaaaccagcatgttcaaccagcacaagaagcatatggcgaaaaccaatatcaatctaaccccgtgacgacacctaccgttcttccaactcagacatctgattcttctctttcatcatcctacccaagacagcacccaaatgatccccaattggaagccatgtacgagctacgacaagaacgcttgcaacaacaactcaacaacttctgggcaaaacagtgccaggaaatccaggaggccactgatttaaggactcacagcttgcctttggctaggattaagaagattatgaagtctgatgaggatgtaaagctggtatcagctgaggctccggtggtgtttgccaaggcttgtgaaatgttcattatggagctcactttgagggcttgggctaatgttgaggaggaccaaaggaagataattaagaagcatgacattgcatcttcaatctcaagggcagatgtgtttgattttcttattgatactgtccccaggccgcttgaaaatatattggatcaacaagggtttgtaggcctaccaacaagcactgttccaactccattgaatgatgcttgctatcataatccccctcctcaggcgcttgttccgggcaatccatatggttctccaagaatagctgtgggaatgcctattcttgatcaaaatcatcctgggctgcaaatccatcattttctaactccaatggagcccacccccacccccacccccaatccccaaaacccttctcctagttcggattgttga

SEQ ID NO: 78686 - DNA, 447 bp, Glycine max
  Peptide Sequence Number=SeqID_195464
ggtgtcacgccggacccagagaaaatccaggtgatgaccgcatggcccacccctacatctcctttggacctccgaagttttatggtcctcactggtttttatcgcaaattcattcgaaattatgccgccaccgcagctccattaacgacattactatgtaaggataagttcatgtggaatcctgaagctcaggccgtgttccaacacttgaaaaccctaatgactcaggcgcccatcctcgccccagacttcaccgtgccatttactctagagacggacgcttccagcacagctatcggtgctgtcctacttcagaagtcgtgccccatcgcgtattttagtagggcacaccttcgtcatcatgatagaccaccggagcttgaaggagttgatgtcacaggtcattcaaactcccgagcagcaacgttaccttgccaagcttcttgg

SEQ ID NO: 78687 - DNA, 2445 bp, Glycine max
  Peptide Sequence Number=SeqID_195465
atggagatgtctatgcaactaaactgcaaaacggtgtttccctacagaggcggttacatatgttcaccgtgcaaagcaggttggggtgtttcgttcgtccgtgccagtgcagatttttctcggaagaggcaacagaagaaggtgtcagttgcaaggactaagggcacttctggaaagggttttgtcccaagcaaaaagaatacaagaatgaagaagggagacacgttaacttcagtagtcagtgaggtttcagggggtgataaaaagcaaacagttgaagtcaatgtagatgatactgataaagaaggggaacttgaattctcccaagaggagaaatttgaggctgtagatagaattgatgaaaatgttggggatgtgggggatttatcattgttagatgagacagtgggggagttatcgttgttagatgagagcaatcaggctaccatttctgtatttgatgaggatgtcgaggttcttgagtcatggaaggaggagtttccttacaatggaggtgttgggattgttgaagattcttcggaagaagggttgttagagagtgcagaaattgatgaaaatgttaaagatacagatactgatggtgatattactgaggaagctgttgaggaatcaagcagtgctgatgatgatagaataaacgaggaagctgctgggctgttgaagttagagttggaagcaaatcagcgcaggcaggagatagagaggattgcagaggaaaaactttctcaagggattaagctgtttgtatatcctcctgtggttaaacctgatcaagatatagaactttttctcaacaagaacctttcaacactaagtgaagagccagacattctgatcatgggggcattcaatgattggaagtggaaatctttttccattaggttgaataagttgcatctcaagggcgattggtggtcttgccaattatatgtgccaaaagaagcctacaaggtagactttgtgttcttcaatggacaaaatgtctatgacaataatgaccaaaaagacttctgcatacccgttgatggaggaatggatgcattagcattcgaagatttcttgcttgaggagaaacgtaaagaattagaagaacttgctagggcgcaagctgaaagggaaagacaagctgaagagcaaaggcgaatagaggcagacagagctgcaaaggaagaggacagggcacgggcgaaggcagagattgggaaaatgcgagaaacattgccgcaattgttgaaaaatgctgtaaagtccgttgataacgtttggcatattgaacctagcgaatttaaaggcaaggacttgatcagattatattacaacagaagctcaggtcctcttgcaaatgctaatgaaatatggattcatggggggcacaataattggaagtatggattatcaatcgtcgaaaggcttgtcaagtctgttttaaaaggaggtgaatggtggtatgccgatgttgttgtacctgaccaagctcttgtcctggattgggtctttgctgatggtccacctaagaaggcagttgtctatgataacaatcgtaaacaagatttccatgccattgtccctggggctatacctgatgaacagtattgggttgaggaagagcagctgatatacagaaaatttcaggaggagaggaggttaagagaggatgcgatacgtgcaaaggctgaaaaaacagcacaaatgaaagctgaaacaaaggaaagaactttgaaaggatttttgctttctcaaaagcatattgtattcactgaccctctcgatgttcaagcagggagtacagtgacaatattttataacccgtccaacacaaatctgaatggaaaacctgaggtttggtttagatgttcatttaatcgttggtctcaccgtaatggtccattgccacctcagagaatgttacctgcagagaatggcactcatgtcaaagcctctttcaaggttccactggatgcatacatgatggactttgtattctctgagagtgaacatggtggagtttttgataacaaatttggaatggattatcacataccagtttttggaagtattgcaaaggaaccacctttgcatatcatccatattgctgtggagatggccccaattgcaaaaacttcttttattgccaaggctggcaaattgttggaaattagaattaagaatttttactatttgtcatgtgttgttcagaaaaaggttggaggccttggtgacgttgttactagtctatcccgggctgttcaggatttaaatcacaatgtggacatcattcttccaaagtatgactgcttgaaccttagcaatgtaaaggactttgactatcacaaaagctattcctggggaggcactgaaataaaagtatggcatggaaaagttgaaggcctctctgtctactttttggagcctcaaaatgggtaa

SEQ ID NO: 78688 - DNA, 3849 bp, Glycine max
  Peptide Sequence Number=SeqID_195466
atgcctttaggttcaaattcagagtcagccaaagttgaccttgccatgaatcagaatgcactttcttcttctgatagccatggaaggactttgaaacctgaggaggataaagaagtgggggaggaaggggaggaggaagatgaagatgcagatgcagattttaacccttttttaaaggaaactctttcacaagaagcatcttcaagtttgagctctgaagttgatggtttggatggtaatgttgtcactagtgggccatctgggggttcagggttatcaaaggtaactactaaggagcaaatctatactgttgtagatactgaacatggtgaggaagaaattattttacaatcttctagtatgatttctcagtcagagattaatcaagagaagcacaatgacctaactagtgcaactgatggtaatggttctagaacagaactaagtaacaaaacaaaatcctggagtccagtaatagacatagataatgaggatgctatctgtatgcgcaccagagctcgttattcacttgcaagttttacacttgatcagcttgagacttttcttcaagagaccgatgatgatgatgatcttcaaaatgctgatgatgaagaagagtataaaaaatttttagcagctgttttacagggtggcaatggtgatggtcttttaactcatgaaaatgaaaatcttgatgatgatgaggataatgatgcagactttgagatagaacttgaagagttattagaaagtgatgccgacgacaatgcaacagtaaaaccccgaaaggagtatgatggagctggacgacgacctgagactaggcaaaataagcgccaaaaagtctctgcccaatgtgagaagaaaatattaaaagaagtcaagaggccactgcgccccattttgccttggcttaacgggcccctaccttcagggaaaggtttgattcctgatgctacactgagctttcaatcttctgcttcaggaaatggtcttgtcaatgggtttactccccagcagattggtcaattgcactgtttgatacatgagcatgtacaacttcttattcaggtattttctttatcggttcttgaaccttcccaaaaacaggttgcttctcaggttcaaggtttgctttttgagatgcttcacaaacgtgatgaaatattagctttgaaaagagtgccatatcccagtgtttgctttactccatcttttgcttgctcatctgtgttcgacggaggctcaaaattcatccaggcccagtgcaatatagaatattctcctccacaggatgcacagaatgtgtggctttctcaatccaatcagagatcctctgaaggtttgaacaggcaaagaggtttccaagttactgaaagttctttctgggttccttttgcattgtgtgaaattccttttacagctgcccaagagtttcgaaagagatatattgagtctggtagtagtgattcacctgttcaaaaggaacctctctttcctgtttcttcaccagttgctgaagctaatggtgaaatttcaaggggaaccatctctagagcagttaatgcagtctcaccttcaactgggaaacaacgacctaagaaaacattggctgctatgcttgttgaaagtacaaagaagcagtcaattgctttggtgcagaaggaggttgcaaagttggctcaaagatttttggccttattcaatccagcattattccctcataagccaccccctgctgcagttgtaaataggatacttttcactgattcagaggacgaattactggccttggggataatggaatataatacagactggaaagcaattcaacaacgttttcttccctgcaagactaagcatcagatattttccctaacatgggagcaatcttatggttctataaagaaagagaccaatatttttgtcaggcagaagaatcgttgctcttcaaaagcatcagagaatccaataaaggctgttcggagaatgaaaacctccccattgactgcagaggagatagcatgcattcaagagggacttaagctttataaatgtgattggacgttagtatggcaatatattgttccacatcgagatccatccttgcttccacgccagtggcgcattgctcttggcactcaaaagtcatacaagatagatgcatcaaaaagggagaagcggagattgtatgagtcaaacagaagaaagtcgaaggcattagaaagttggcgagctatatctgataaagaggattgtgatgctgaaattgctggttcagagtgcatgtattcagaagttgtcccgtatgtccaccaggcgtttctggcagattggaggccagacacatctactcttacttatcccgaacgcatttccactacatctggagaaggaaatgttgctcacaatgcattttctcaagaagatattcaattttataggggtactcatgattatggtttaagtggaaaagttccacatcagaatggtaatcagtctgcattaccatctgtatccaagcttcctcagccttttcataccatgtctgatttgagaaatggaatgaaaggtgttcctagcaccattaatcctaagaaacctgtttttgacgtgacctctagctccaaatactattgtcggccctatcggtctcggagggcacataatgctcacttggtgaaattggcaccagatttgccgcccgtaaatcttcctccatctgttcgtgtagtttctcaaacagcttttaaagggttccagtgtggaacatctaaggttcatcctcctggagctggtgtagctgcttgtagaaaagattattctgcatctcaaactcctcatggtgagaaatctgaaaatgttcatcctgttaaaggtgcaagacctacattggaagatagtgtcacaggctctcaattagaaagatctgaaactgttgaaggcgaatctcttgtggcagaaaaaggcaccaggaccgatctccagatgcatcctctcttgttccaggtcactgaagatggcaatgcgccttattgtccgttgaaatttagttctggtacttctagttcattcagcttcttctcaggaagccaaccccaactaaatctgagtctcttccatagctcacagcaacaaagccacattgattgtgctaacaagtccttaaagtcaaaggattccactttaagatctggaggcattgattttcatccacttctgcagaaatctgatgatacacagtcaccaacaagttttgatgccattcagcctgagtcactggttaatagtggtgtgcaggctatagccaatagatcttctggcctcaatgacaaatccaatgaacttgacttggagattcacctaagttctgtatctggaagggagaaatctgtgaaaagtagacagctaaaggcacatgatccagtagggtccaagaagactgtagcaattagtggaacatcgatgaaacctcaagaggatactgctccttattgtcagcatggtgttgaaaatctttcagctggcagttgtgagcttgcttcaagtgcccctttggttgtttctagtgataacatcaccagatatgatgtagatgatattggtgatcagtctcatcctgagatagtgatggagcaggaagagttaagtgattccgaggaagatattgaagaacatgtagagtttgagtgtgaggaaatgacagattccgaaggagaggatggttctggctgtgaacaagctcttgaggttcaaaataagggagaaaaaacatatatcttctcttgtatagttattgctgctacttcaaccttccaaataaaaatagaaactgaaagacttgtttag

SEQ ID NO: 78689 - DNA, 744 bp, Glycine max
  Peptide Sequence Number=SeqID_195467
atgatgtcattttattgtgtggtttcaatctttttgtttttctgttttccttggtccctttggcatcgcaatcattctttagcatccttatgcattttcacaacaacctctcttcttcttcttcatcaccaacaaagttatcaccaccacccccaaaatcacaacaacctcagtcacaaccctactccaaacttgaattcgaagcacaaaccaccatgctcaaaaccacaacaaccccaatcacaacaaagccatcactaccacccccaaacatctaagcttgaaatacccatcatcaaacaaccaaacatgaattcaaagcacaaatcaccaagacacgttctcaaagcagcactacgacaacaacaaccttgtcgcgtggcatcattgaacttctcgaaggccacccttcgcacaatgttgtcgaaatcatcttccacacaagttggggccctaagccattcccagttcaaggaatttcgcaaggtagtgaaggcatgcgccattgcgaggctcgctaaaggcaatgacgatgaggagaatgcacggtgcatcgctgacaagaacaaggttgttgttgttgttgtggtgatggtttatgatgagtgggcttgtgtaacccgctgggtcgagagtgagttcgatgacgtgggtggctcccaaaatgacgacattgcacttgaagtcgcatgtgaacttgttgctaaagaggttgtcgtaatggttgagggagaagtcccatga

SEQ ID NO: 78690 - DNA, 348 bp, Glycine max
  Peptide Sequence Number=SeqID_195468
atggttgtattgtatggagagaccgtgaaactagcaatatgttggagtccaagggagccatgtgcaagagaactacgagtgaaatgtgtcattgttataatgtggttagagttagggttagatttagatgatgacaaaggtgatgaacaaaaagctcaaagatcaaagaacaactcaagtgaatcaagaacaagtcaagagttcaagaatcaagaagaattcaagactcaagaagaaagcctagaatcaagattcaagattcaagattcaagatctcaagaatcaagatcaagattcaagactcaagattcaagaatgaagaaaagacccaatcaagataagtattaa

SEQ ID NO: 78691 - DNA, 477 bp, Glycine max
  Peptide Sequence Number=SeqID_195469
atggccacctctttgtcagcgcctccaagaccagatccacattgtgcttattcttcccactatcgacgccatgaggaacatcatgtcatccgcaatcatggccccaaaggagctcatcacacaaggcggcacgaagggccgctcgtggcaaagttacctggaactgatgcagagtgttctgtgaggggccctcaccgaggcgatatcggtgtcgctcacgacgttcagggcaacggggtgatcaaggttgttgcggttatgtatgatggggtttcggccacaatgaagcggattttgaaggaggaagggcaggtggggcttactcgtgtaatggggccccgagtgctacataatgcttgttttttggcattggggtattttgctttcgagacaacgaggcatttgattttgcgagagtatcttaggaggaaggagttgggtgagaggggaactcaagtctctatttccgctggttga

SEQ ID NO: 78692 - DNA, 351 bp, Glycine max
  Peptide Sequence Number=SeqID_195470
atgcgtcctccacccacgagtttggagtcatgcgtagtgcaattctccattctcaaccctttttcggagccccgtgaattgcgttttcgttcatgcatcctccacccacgagcctcctccacccacgagtttggagccatgcgtagtgattgcttagtgcaattctccattctcaacccttttcgcagccgcatgaattgcgttttccttgatgcgacctccactcacgagtttggagccatgcgtagtgattgcttagtgcaattctccattctcaaccgtttttcggagccccatgaattgcgttttctttcacgcatcctccaaccacgagtttggagccatgcgtag

SEQ ID NO: 78693 - DNA, 771 bp, Glycine max
  Peptide Sequence Number=SeqID_195471
atgcagtcatctgactatgcggtactgggcgccggattgatgggggtgggcatcgccacccactttattcgccacggccatgaggtgctgctgtatgacccggatccgcagcgcctggcggaagcgacggcggtggcgagcggcattctggccgagctgagcgacgtcgggcagtttgataacgatgagcgcgacgcggcgctggcgcggctgcgcgtgaccggcgatctgaacgacgtggcgcgcgcccggctgcttatcgaggcgatcccggaacggctcgagctgaaacacgcgctgtatgagcagttggaagggctgatcgcccacttctggcacccgccgcacctgatcccgctggtggagatcgtacccggccgcgccaccgatccgcgccatctggcggcggtgcaggtgctgctcgtcgggatggcgctggaggcggtgctgctggagcgcgccgcgccggggtttgtcggcaaccggctgcagtttgcggtgctgcgcgaggcgctgcacatcgtccacagcggcatcgccagcgccgaggtggtggatcaggtgatgcgcgcctcgctggggcggcgctacgccatggtcggcccgctggaggccgccgacatgaccgggctgccgacggtggcggacatcgcccgccacctgttcccggagctggcgatccggcgacgagatgatggcgctggtggaacagcggctgcagcgcggcgataccggccagcgcagcggtcggggattttatctttgggatga

SEQ ID NO: 78694 - DNA, 420 bp, Glycine max
  Peptide Sequence Number=SeqID_195472
atgtcttgcctagcgattataactctgatctccctctgtcgaagtgcagttggtgtatgccatcctgacgcggatgagcgtccacgtggcccatgccctggggtttccggcattgattgcggcctctgccagtcattcggggttcctgttgcccccagtaaggcggccaaccaccgggggcaggtgcagatacatgagtgtctctaccggttcaacctcagtcagcaggggcagggcttcactccttttgcatgccctactccagagcagtttggggctgaggttgcatggcccggagactggcccgaggcccaggcaggggaggagcctgtaggatccatcgatgaggcagaggaggcccggatggatgaagaaatgacagacttgctcggtttcttgggaggaagcggagccacgtga

SEQ ID NO: 78695 - DNA, 304 bp, Glycine max
  Peptide Sequence Number=SeqID_195473
aacgcttgatagcatgcagaggctgacacagtcttctgcaccttttgttcctccggggacaacaaagtcatttacatgtggaaatttcatggtcacccgcgactctcgtcagccgagaggagcgaaattagtgtcatacgctgattttcggggacctttgtttgatgacatgcgaccattctttggtccttgtgaggtgcttggcatccatcatcaggcagtttgtgaaatcctaggaacgacaagtcacagtcacccgcgactctcgtcaaccgagaggagcgaaattagtgtcatacactga

SEQ ID NO: 78696 - DNA, 141 bp, Glycine max
  Peptide Sequence Number=SeqID_195474
atgccaccgggttcaggaacaagcctgttgaggtgtcccttaacgttccgtgacatccccactcttgcatggacattcttcactgatgagaaccccaagagcagcattgaagttcgaggaatccaaataagaccagcgtaa

SEQ ID NO: 78697 - DNA, 369 bp, Glycine max
  Peptide Sequence Number=SeqID_195475
ccccatgaattgcgttttcgttcatgtgtcctccaccttcgagtttggagctatgcgtagtgattgcttagtgcaattctccattctcaacctttttcggagccccatgaattgtgttttcgttcatgtgtcctccaccttcgagtttggagctatgcgtagtgattgcttagtgcaattctccattctcaacctttttcggagccccatgaattgcgttttcgttcatgcgtcctccacccaagaggcggatcctcttgactgggaaataaaagcagaaggagtagagacgagagtcgtcatcacggaaagggcaggacggacgaaatcagtgtcttatctttgctttcctcttatctccgataaaag

SEQ ID NO: 78698 - DNA, 471 bp, Glycine max
  Peptide Sequence Number=SeqID_195476
atgaatttattgcctagcgctgttcatgcatcctccaccaacgagtctggagacccgggaatttattgcctagcgctgttcgccaattctccattctccacttttatccggagccccatgaattcattgcctagcgctgttcatgcatcctccacccacgagcctggagccccgcgaaattatttcctagcgctgttcgccaattctcctttctccacttttatctggagcctcatgaatttatttcctagcgctgttcatgcatcctccacaaacgagtctggagacacgggaatttattacctagcgctgttcgccaattctccattctccacttttatccgcagccccatgaatacattgcctagcgctgttcatgcattatccacccacgagtctggagccccgcgaatttattgccagcgctttttgccaattctccattctccacttttatacggagccccatga

SEQ ID NO: 78699 - DNA, 695 bp, Glycine max
  Peptide Sequence Number=SeqID_195477
gaaacagctatgaccatgattacgaattcgagctcggtacccctctcgtggtggcgctggcgaagaaccccgcggtggaggagtatgatttgagctccatacggttggtcatgtccggggctgcgccgctggggcaccagttggaagaggttctacggaataggttgcccaacgcaattctgggacagggatacgggatgacagaggctggaccggtgttggcgatgtgtttagggtttgcaaagtatccattcccgacaaagacaggctcttgcggaacagtagtcagaaatgctgagttgaaggtcattcaccctcttactgccctttctcttccccctaaccaccctggcgaaatttgcatccgtggccaacagatcatgaaaggtacctacatcctatatggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 78700 - DNA, 327 bp, Glycine max
  Peptide Sequence Number=SeqID_195478
atgaagtataaaggcaaaggaaacataaggaagtacattatggagatgtctaatctcggcatcaaaactcaaaataagaaaaggaagaagactaagggtgttacggaaggaacttctcagcaaaagaaacaaaataaggatgaggaattttcctgttacttctgcaaaaagttgagacacatgaagaaagagtgtcccaagtatgccgcatggcgtgtgaaggttgcctgtggagccaactaccaagtgatgatgaaagattcatctttgtgggtgatggcaagaaggttgcagtggaagctattggaacttttagattacagttaa

SEQ ID NO: 78701 - DNA, 231 bp, Glycine max
  Peptide Sequence Number=SeqID_195479
atggaaaaatacgacaaaaggaatttcaaagagaagaaagaaaagaaaggatacatcacttgggaagattatgtcataaattcttcaagtgattcagagaataaaaacataagtctgggtatcatgatgaaagactatgaaaacggagaagagcaaagtcgatacattgatagcaatttctccaaacacatggcatgcatcaaagtttattcatatttctccccaagataa

SEQ ID NO: 78702 - DNA, 231 bp, Glycine max
  Peptide Sequence Number=SeqID_195480
atgaagaacgtcgaagaacggctgaaaatcttcgtgaaaatccccatggaaacgagggctgaacaattttcctcttcacctctccccctatttataggaaaatgggggagatgcttgccacccagctcacccaagcgagctcagctcgcccaagcaagctcagctcgcccaagcaagctcagctcgcccaggcgagctaggttgcttcctccagaagcaaccgccttctag

SEQ ID NO: 78703 - DNA, 426 bp, Glycine max
  Peptide Sequence Number=SeqID_195481
atgaccatgattacgaattcgagctcggtacccctcgccggggacaacgtggggctgttgctgagaggggttcaaaagacggacatccagagagggatggtgttggcgaagcctggcacgattacgccgcacaccaagttctcagcgattgtgtatgttttgaagaaggaagaaggtgggagacattcacctttctttgcagggtataggcctcagttttacatgaggaccaccgatgtgactgggaaggttacggctatcaccaacgatagggatgaagagtcgcagatggtgatgcccggtgaccgtgtgaagatggtggtggagctcattgtgcctgtggcttgcgaacagggaatgaggtttgctattagggaaggtggcaagaccgttggtgcaggtgttatccaatccatcattgagtga

SEQ ID NO: 78704 - DNA, 162 bp, Glycine max
  Peptide Sequence Number=SeqID_195482
atggctagaagtagaaggtctaacttccattgtccatgcattagccacaaggcacccacgggaatctggggcttaggaagcaaaggtgccacagggaaagaagtgactcccgggggagaagtcttgttcctagggcattgggataggggatggccagattag

SEQ ID NO: 78705 - DNA, 651 bp, Glycine max
  Peptide Sequence Number=SeqID_195483
atgatgcaaaaagcctttggtgatcactggaaaattcagattgcttttatgcattctgatgctgaagcactagaacatacgaagaaaagagataaaggccatcaaaaggattcggtgaggaagaagggcttctacaagtcttgtcctccaccacctccgccaccgccaccaataatgtttcagaaatcagtgttcatgaagccaaggttcaatggttcatccaacgaagcaccttccttcaataaggagttgaagagaagctttacaagtgagagaaccacaccagtgggtaagaaaagtcatgaaaaaaataaatccaagcaaggcacattgtttagaaataacaagttcatggggcatgcaagtgtgcctcttgtgtcacagccagctgagaaagaaagccttcttgtggaatctaacgatgatgacgacgacgatgacacagaaatcgaggaccaagacgttgaaggaggaaggaccgttgctcagaacaatgacaggggaaagggtccacctgttattggtggagaaagttcaaaaatagatggtgatgaaggaccagatgtggataagaaggctgatgagttcattgctaagagaattgagtcaatagagaggagtagaaggagtgcaagaaactcttcaaggtaa

SEQ ID NO: 78706 - DNA, 642 bp, Glycine max
  Peptide Sequence Number=SeqID_195484
gatgtattgactgctgccattgggcgaccagaacaccctggtcgtgtgtgtgctactggagctggtgtcacaatcaagcaatactttggaccgactccaaggacctctcgcacgtcttcctccgtgactcccaaagacctccagatgcagtcccaatttcagttgcagatgcaatcacagggactcgtactatctcttgagcttgaggttgatccttcagctgctcgtgtcagtacaaatgagagttgtgttgatcccttagggaataatccagacacgggtgactcagacaaatgcgggttatacatcgaaaaaaatcctcaccgcctggttgccctaggaagactttatgagggatccacaaccgttcacaacattcctctactgcatgatcaagtcaaggttggtgttgaggaggttagagatgcaaatgctcccattcctgtacctactgaagaggttaagttagtggggcaaacacttaacaccttccttgcttgggcgacacatcttgtcaatcgtttatcagaacagggagttgtgggacccgtaaaacctgcagataggctagatcatgatgtcgatgatcccatatatttgatgacattgaccatcccacagttttttctgaagttgttgcag

SEQ ID NO: 78707 - DNA, 615 bp, Glycine max
  Peptide Sequence Number=SeqID_195485
atgatcgaaagttttcaacaacaacaacaaatgtcagttctagaattgtacgtagaaaaggatgttgctggtggttcgatgtttcatgctgcaaattctgttacgtcgtgtggacgtaatgtatctcatcatgaatcggaactgccaagaaatataagtaatttacatgatgatgaagatgatgatgatgatgattaccttgcatctaactcatacgttgaagagtcttttgatgaagatgatagtgatgatggaatatctgatacagacgatgaagtcactaacatcgttgaaccagtttcaattgttcacccaaccgaaggtgtaccacaaattcaaaatccattttggaatgatgctatgcattataataatatcaattggagtcatccggacgaggaggacatttgtggtctggacatgccaacgacttttaatgttggacaagaattatatgttggcatggattttgacagtaaagatgcggtaaaaaatgcactgaaacaatatgtcatgaaggtgcatcaaacttttaaggttgttgagacgaaatcacacaaatatatcgtttgttgccccaacaacaccgaagagtctcctgccctttttatatga

SEQ ID NO: 78708 - DNA, 129 bp, Glycine max
  Peptide Sequence Number=SeqID_195486
atggatttcttgtgtcttgttggaacaagtgcgaaaccaaccaaacacagagggcggatctgccaagacagctaccaccggactttccttgctatggtggtaggcaaggaaagcgtcgattgctgctag

SEQ ID NO: 78709 - DNA, 396 bp, Glycine max
  Peptide Sequence Number=SeqID_195487
atggataaccacttgggtatctccgcctgccacctaacttcacggttaggatcaacaaaaatcatttgtgcggataatcactggtgtatctccgcacgtcacctgacttcacgggtcaggatgacagaaggtggggtggtcgacaaaagcggggcttttgctcctatgtatcctccatttgtgatgaggaactcagacctacgtagttctttcttttgtcatgtgcagataaccggaaggtgtctcctcatgctacgagactcttgggtcatgatagcaaaaggtgggactaaaatagtgatgcaatcctaccccgcaagggcattggatagaaaactccaaatagattgggccagagatccaagggaaggccctagggttctcatgagccttagg

SEQ ID NO: 78710 - DNA, 234 bp, Glycine max
  Peptide Sequence Number=SeqID_195488
atgttactagggtatttgagtaaggaaagctgtggtattgggattgatggggacccggtgttgagaggaacgatgataagagctacgtgggagtacatgagctcagttgaaggtgggcaactggggatggtggatttatgtgtgatttgtggatgtggagagtcgacttgcaccatcacccgatcgccacctagtaccacatatgacgggtaccccataatcctacaagcttga

SEQ ID NO: 78711 - DNA, 213 bp, Glycine max
  Peptide Sequence Number=SeqID_195489
atgacaatcagaggaggagatggagaaactgcttcaagctcaggtgaagaaggtggattcaccactagagattgtgggctgtgcatgataataaactatccttggaataagctttgtagcataggaactaaagttggtgacggaggagttggagtagatgacgaagggatgtcctccgttctagctctttttcttggttccatctttaactaa

SEQ ID NO: 78712 - DNA, 1080 bp, Glycine max
  Peptide Sequence Number=SeqID_195490
atgcacacacgctttgtatcagccaaaaataaattgttgttaaccgtcggcgcgttactggttgccggcagcgtggtcgcgccgttttcagtggcgcaggcggcggataaaaccgcggtgaaggtcggtatcatgagcggcgaggacgaagacgtctggcgtgaagtaataaagcaggccgccgcgaaagggctgacggtgaaaaccgtgattttcaatgattataatcagcccaacgaagcgttacagaatggtgaagtggatgccaatgccttccagcatcagccgttcctgaataatcaaatcaaggtcaatcattacgatatcgtgcgcgtcggcgataccgccgtctggccgatcggtctctattcgaagaaagtgaaaagcgccgccgctctgaaagacggagcggtaatcggcgtgcctaacgatccgtcgaacgaggcacgcggtctggtgctgctgcagcaacaggggctgatcaaactcaaaccgggcgtcggcattgccgcgaccacggccgacatcactgacaatccccatcacctgaaaatcaaagagctggattccggcatcattggtcgctcggtgccggatcttgatgcagcagtggtcaataccgactgggcgctaaaaagcggtctgaccgcagcggatcgtatcgcgcaggagccggtgaaagacaacccgtacaacaactttatcgcggtgaaaaaagagaacgccagcgccccgtgggtgaaaaccctggtggcatcgtaccagaacgatgccgtcaaaacggtgttcgacaaggtctacaaaggcacgggcgaaaccgcctgtgcccctgaccgccgtagcgcgcggcgtgatcgaagaggctcaggtacgcgatcgcgtggcgcagcacagcaacgtggtgcgtttgcaaggcgtgtcgcgccgtttcggccagacacaggcgctgcgcaatgtctcactgacggtgcaaaaaggcgaaatccttggcctgattgggcgcagcggcgccggaaaatcgacgctgattcgctgtctcaacgggctggagcagcccgacgaaggcgtaatcgagattga

SEQ ID NO: 78713 - DNA, 174 bp, Glycine max
  Peptide Sequence Number=SeqID_195491
atgggacccggtgctgaggggaacgaggataagggctacataggagtgtgtgagctcaatttaaagagtggtacctggagatatgtcgcgggggtcaggagaccttgggaacatcaggtggggtgctattgcccaaaaccaagcttgactaatcccgacccaacccgggcatag

SEQ ID NO: 78714 - DNA, 702 bp, Glycine max
  Peptide Sequence Number=SeqID_195492
atgccgcgcagcagctatggcgaccgcgtgggcaaagcgtttgcgcaggagtggcagaagctgggcggcgcaaccgtgctgcagcagcgttttggcggcgtgggcgagctgaaacagggcatcaacagcggcgccggtattgcactgagcggcacgccattgacggtacagccggaccagccgcagggcgtggcggtcgccggtctgacgattccggcaccgcagaccagcgctccggcacctgaaagcgccagcagcagcggcagcgttgatgcggtttacattattgccactcaggacgaactgcagctgatcaagccgatgattgccatgcgcaccagcagccgcaataacatcgccctgtatgccagctcgcgcagtgcgcaggccggtgccggtccggacttccggctggagatggatggcctgcagttcagcgatattccgctgctgtccggtgccaatccaggcctgatgcagcaggcggcgcgcagttttaacaacgactattcgctggtacgcctctacgcgatgggcattgatgcctggacgctggcgaaccagtttaaccagatgcgtcaggtaccgggcttcgccattgatggcaacaccggcaagctgagcgccgacacggattgcgtgatcaacaggaagttggcatggaaccagtatcgtcagggacaaatcgttccggtgcagtaa

SEQ ID NO: 78715 - DNA, 711 bp, Glycine max
  Peptide Sequence Number=SeqID_195493
ggtggacacttgggtactagtacatgtgccttcaaaggactacacatcctcgccttcagagggctccacgccctcgccttcagagggctccacgccctcgccttcagagggctacacaccctcgccttcagaggactacacgtcctcgcctttagaggactacatgtcctcgcctccagagcgctgcacgccctcgccttcagagggctacatgccctcgccatcagaggactacacgtcctcacccttagaggactacctgtcctcacctctagagggctgcacaccctcgcctttagaggcctacatgtcctcaccttcagaggactacacagggctacacgccctcgccttcagaggactacacggctacacgccctcgcctttagaggactacacgtcctcaccttcagagggctacacgccctcgcctttagaggactacacgtcctcgcatttagaggactacacgtcctcacctatagagggctacacgtcctcgccttcaaagggctacatgtcctcaccttcagaggactacatgtcctcgccttcaaaacgctacacgccctcgccttcagaggattacacgtcctcgccttcagaggactacacgtcctccccttcaaaggactacacgtcctcgcaatcagaggactacgcgccctcgccatcagagggctgcacgccctcgccattagaggactacac

SEQ ID NO: 78716 - DNA, 771 bp, Glycine max
  Peptide Sequence Number=SeqID_195494
atggaagagggggaaacactttgtgcttactctagatttgcactcttgaggcctgatcctcaagagttagctgctaagttctgtatcccagggagattcgagcttaatgctgatgggcagtccttgaagattctgaggaagaacatgaccactcttgctcatacttggagcattctttccatttcaaaccttattcccacttcccacacttctgatgtcactcttgacagagccaaactcatttatggcatcatcatgaagatggacatgaatgtgggaggacccaggaaggccaggggtaagagatctgaggccccttccacttcggcaccattagaggcaccaacaccttcttcttctccaataccgccctcttcatccactcagattctagtcattcctccagcacctccgcagatgctttactctatgctccagagcatccacagggggaagtccatcatcatgcagagccttcagggcttgggcttgccctccattatgagcatggaggagtttgaaactcaggtggcctggccaggagaccagccctcttcttctggagggggtggggcctctgcagcccaagagcctgatactaaggagccaccagcaccaacaccagcagaggaggagactactccagatcagactccacagccatatctagcccctgcacatatacctgaggatgttgcaccagttgcagagcctgagcagcttatacaggattcatcagcagctccagcactggatttgaatgaagactag

SEQ ID NO: 78717 - DNA, 447 bp, Glycine max
  Peptide Sequence Number=SeqID_195495
atgaaagtacaaccagaggaggaggctatcgtgcagctactatgcataccggggcaagatttcacccgtgccgctgcaaagagacgagtgcggatcatacgcaccaacatgaccactcatacacagatatggatgacgttactacttagcaacattccatccagcgaccgcaataacgatctccccctacggaagtatcagttgacacccagtggacccgaagaagtccacagggccctggggtttccagtttggtttacgggcctctggatcgcgcccgcaagacacccagtggacccaaagaagtccagcagggtcttggggtttctagctctgattacgggcctttgtcagttctacgaagtgcccgtcgcccccaacaaggtcactaggccccccattaaacgggctttcatcaagaagtactgcgcccccaggcaggcgtag

SEQ ID NO: 78718 - DNA, 1260 bp, Glycine max
  Peptide Sequence Number=SeqID_195496
tatccgctgaaccgggttgccgatggcgagaccttcaccgatgtggtggtggaggttcggcaagccgacgatccggacagcttctgggtgcaccgcctgcggagcctgattatcaccgatgcgcaggggcaaccggagctgctggcgctgatcctgagcgacgcgacggagtgggccagcgccgaacagcgctttgaaaaaaccttcaacgccaatccggcgccggcggtcatttgtcggctaagcgacctgcgctacgtcaaggtcaatcaggggttcctcgatatgaccggttaccagcgtgaacaggtcatgggccgttcggtttatgaactcgacgtgttggaacaggcggagcacaaagatctggcgattcagcgcctgggggaaggcgccaccattccgcaaatggaggccgagctgaaactgcccggtggcggaagcaagctggtggtggttgccggccaaccgctggacatcaatgaagacgactgcatgctgttcacttttaccgatctcgaaccccggcgccaggcggaatcggcgctgcgggaaagtgaagagcggttcgccaaggcatttcgcctgagcccggtgccgacgttgctgtgtaccgcgcacgagcggcgcgtgctggacgtcaacgaagccttcacccgcaccaccgagtacgacaccgaagccttgatcggcaagacgatcgatgagatcccgtttattgacgatcccgaggcgaaccgccgtttgtttgccgcgctggaaaaaagcggcaacgtcgaagggctggacatccgggtgcgcaagaaagggagcgagtcgatcgactgcgtggcctcggcggatgccgtcagcatccacaatgcgccttgctacctgctggtgctcatggatattaccgaacgcaaacgctcggagctggagctggtcagcgccatcgaagaagtgatgcaggacgcctcctggttcagccaaaccctgattgaaaaactggccaacgtgaaaagcatcaaccggcccgaccaggccggattgaccgccagcgatctcacgccgcgcgagcgcgatgtgctggagttgatttgcgaggggctgccggacaagaaaatcgcggcgcgtctcaatctggcgctcaacaccattcgcaaccatgtcgcgacggtctattccaagcttggcgtgcacagccgtagcgaagccatcgtttgggccagagaacgcgggctgtttaccggcgggctggccgccaggaacggcaagtag

SEQ ID NO: 78719 - DNA, 705 bp, Glycine max
  Peptide Sequence Number=SeqID_195497
atgacgacactcgctcagacatggagtgtcctttcttattatgatcttgcacccacttctcacacatctgatgttaatcttgacagggcacgcttgatctacggcttggtgagccgcatggatatggacgtaggcagctttatatctcagcagatcagtaagattgcccagtccagcacctcgaggctcgggttcccggcattgattacagcgctgtgtgacattcaggggatggtttctgataccctgatctttgagtcactcagccctgctatcaacttggcctacatgaagaagaactgctggaaccccgccgatccatcgatcacctttccagggacccgccgcacacgcaccagagcctcgacgtcgacatctgaggcccctcctcctacccagcctccgcctcagccttcttctcagagaccgcgacctccacctacctccacctcagcatccctggacatgcatggtcagatgttgaggtccatccacatcggacaacagcttatcatggagaacatgcacaggctgtccttacatatgcagatggacccaccgctcatcactccagaggcttatcgtcagcaggttgcctggccaggagaccagccctccactgacaggggggaagagccttctggagccgctgaggatcctgcggtcgatgaagacctcattgctgacctagctagcgctgactgg

SEQ ID NO: 78720 - DNA, 168 bp, Glycine max
  Peptide Sequence Number=SeqID_195498
atggctaagcgcatggacaattctggaagaaggatgagctgtatagaggcactaagcgaaggccaactcactaagcgcaccgccttcaccttcaggctgagcgagaagcttccctgctatggagagctaaatcctcagttggttcttcctatagggtacttgatgtaa

SEQ ID NO: 78721 - DNA, 438 bp, Glycine max
  Peptide Sequence Number=SeqID_195499
atgtgggctttccttaccagtcgtcagatcgactgggctcacttggttaggtaccgaatgcataagacattacgggccaaagcacctctcccttatcctcaattggtcactctgtttctccgtcattttcaaattcctcttgatgatgaaccttttattcaagtcaagcgttcctttgctataggtgctggtgcagtcacttcatttggttaccgtaaggatcgtaatggtcaatggctgaagaaggatgcactccctccacaagacgagcgtactccttctcctcctcagcgagatgattcagcccttatgactgaagttctttcagagttacggggtcttcgcacttatgttggaatggatacccatctcacgcagcttgaagaggatgtgggttatattcgtcagagcttcaatcttccaccaccaccttcttag

SEQ ID NO: 78722 - DNA, 309 bp, Glycine max
  Peptide Sequence Number=SeqID_195500
atgcaagcacagggacttgcgctgcctacagagcctgaggttggtcccttagatgctcgtgttagcacaaaggagagttgtgttgatccctcagggaacgatccagacacgggtgagtcagacaaatgcgggttgtacattgaagaaaatcctccccgcctggttgccctaggaagagtttatgagggatccataaccgttcacaacatccctttgttgcatgatcaagtgaaggtcggtgttgaggaggttaaagatgcagctgctcccattcctgtacccactgacaaggttaacttagtgggatag

SEQ ID NO: 78723 - DNA, 546 bp, Glycine max
  Peptide Sequence Number=SeqID_195501
atggcccgcacgaaaaaatcaggtcaaatgacgtctgaggtagcaaaggaaattgcatataggattgattcccttgaagagcaggcttcacatggaagctttgtcacccatggacgtcaagatgtactgactgttgccattgggggactagagcaccctggtcgtgtccatgctactagagtcgatgtcacgatcaaatgttattttggatcggcttcaagggaatcccacacctcttcgtccatggctcttgaagacctagagcagttgacacaaaagatcagagaccagctggagaagttgatcacacaaaaagtaactcaacaattaatgatgtccttcaagaaaatgcaatcccagatgcattcacagggactcacactgcctcctgaggttgaggttggtccttctgctgcttgtgtcagcacaaagaaaagttgtgtcgatacctcggggcaggacccaaaaatgggtgactcagacaaatgtgggttgtatgtcaatgacaatcctcctcaactgattactcttggaagggtttattag

SEQ ID NO: 78724 - DNA, 210 bp, Glycine max
  Peptide Sequence Number=SeqID_195502
atggagagagcaagaggagggagtacggttgagaggttacttttccccgtgctagaattcatccaagtggtgaggagaagtgacctacgtgtagaaacagaaggagggtttagggagaagatgagaatgaggattatgatgagttttttaacagtgaaaggattctcaaaagaattttactacttctcttttgtggtagccggtaattag

SEQ ID NO: 78725 - DNA, 1911 bp, Glycine max
  Peptide Sequence Number=SeqID_195503
atgagatgctcatctttagggatgaaaattaagactgacacacctgtggcaaagaaggctagagaaggagtgatggagtttttattgatgaatcatccattagattgcccaatttgtgatcagggtggagaatgtgatcttcaggatcagtcaatggcatttggctctgatcgtggacggttcactgaagtgaagagatctgtggttgataaaaatcttggacctctggtgaagactgtgatgactcggtgcattcaatgtacaagatgtgttagatttgcaacagaggttgctggggttcaggatcttggcatgttaggtcgtggaagtggagaggagattggaacatatgttgaaaaacttttgacaagtgagctttctggaaatgtcatagatatctgtcccgtgggagctctcacttcaaaaccttttgcatttaaagcccgaaattgggagttgaagggcacagagacaattgatgttactgatgcggttggatccaatattcgaattgatagcagaggacctgaagtgatgcgcattgttcctcgtttaaatgagttattgagatcctctcattttaatttgccaaagatagggcaatgtggagagaaggctgcacagagtcccacatctactgagataaatgaagaatggatttcggataaaacccgcttttgttatgatggtttgaaaaggcaaaggttaaatgatcccatgatacgtggttctgatggacgctttaagcctgttaactggcgtgatgcacttgctgtggtagcagagattgcccaccaagttaaaccggaagaaattgttggcatagctggcaaactttcggatgctgagtccatgattgcactaaaagatttcataaataggatggggtcaaatgatgtatggggtgaaggcattggtgtaaatactaatgctgatttcagatccggatatattatgaatactagcattgctggtcttgaaaaagcggatgccttcctgttggttggtacccagccacgggtggaagctgccatggttaatgccagaatacgcaagactgtcagagcaaaccaagccaaagttgggtacattgggcctgctactgatttcaactatgaccacaaacatcttggtactggccctcaaacacttctcgaaattgctgagggtcgccacccatttttcaagacactctcgaatgccaaaaaccctgttatcattgttggtgctggggtttttgagaggaaggaccaggatgcaatttttgccgctgttgaaaccattgcgcaaaaagcaaatgttgtcagacctgactggaatggccttaatgttttacttctccatgctgcccaggctgctgcccttgaccttggacttgttccacaatctgagaaaagccttgagtctgcaaaatttgtatatttgatgggtgctgatgatgtaaacttagacaagatcccagatgatgcttttgttgtttatcaaggtcaccatggtgacaagagtgtttatcgagcaaattttattttgccagcagcagcattcagtgagaaggaaggaacctatgaaaataccgacggatgcacgcaacaaacattgcctgcagttccaacagttggtgactccagagatgattggaagataattcgagctctatctgaggtggcaggagtgcctttgccctatgatacaattggggccgttcgtgcccgaatcagtactgtagccccaaaccttgtgaacatggatgagagagaaccggccacattgccatcttcactcagaccaaccttctctgagaaggtggacaccaccccattcgggactgtagttgagaatttctatatgactgatgccattaccagggcatcaaagataatggcacaatgcagtgccatgctgttgaagtga

SEQ ID NO: 78726 - DNA, 2373 bp, Glycine max
  Peptide Sequence Number=SeqID_195504
atggcgctaaccgttttctctctcttctttttcttcctctccttcaccttccaccttccctcctgcttctcagggcaatcgagctccatggaatcagtgcctgatcttcagaacactatgtacgcttccatcgacggttatccttgcgtgcgcctgatgaatctctctggaaccatcggttgttcaaatcctggacgagataaggttgtggctccgattgtaagattcgaaaatgttgacagaatagctgagccttctgctgtattggtgtcactggatgagttcccaactctctttactagaatatcggatgactctagctttgctagtaaagttggtggtgtactggttgaaccaagcactgattttcagaagaagttaaagggattttctccagaccaaaaatttccacaagctcaattcgctctttatcataataccagctatgaatggaatccaattggttctggtattatgtggaaatcctacaattttcctgtatttttactcacagaaagtggctcaaagactcttcaagagtttgtaacaaagaatgaggacacaaagaaatcttatacttctaatgtggctgagtttgacctggtgatgcagacagtgaaatctggaacacatgattcagagtcttgtttaaaagaagaaacttgccttcctttaggtggatacagtatgtactggagaaagcatggagtgaatatggtatccactattagatcagatggattgatactatcatcaaaatgcaaaaagattaaacatcacgttgttcccacagtggaaatgagctatcctggcagtgtctggtcatctcttcctccgatcaacatttcatccttacaacggtctaagcccattttattgacagtggcatctatggattctgcttcattttttcgggacaaaagccttggtgcagactcccctatttctggtttaattgcattactagcagctgttgatgcactttctcatttggatggtcttggtgaccttagtaaacagcttgtttttgcagttttcactggagaggcatggggttaccttggaagtaggagatttttggtagaacttgacatgcactcagatgctgttcatggccttaatcagacattaattgaaacggtcattgaaattggttctgttggaaagggtctcagtcaaggtgttaaaaacttttttgctcatacaaaaggggattcttctgccacaaatcagacagtggctgccttgaaacgtgcacaggagtcactgatatctgaaaacataaagatagcatctgcaagtgcctcaaatcctgggatacctccatcctctttaatgtcctttttggaaaagaatcctgcaatctctggtgttgtcctagaagattttgactctgtctttgtcaacaagttctaccatagtcatcttgatgatttatcaaatgtaaattcgtcagctgtagttgctgctgcttctctcattgcccgaaccctttacatgctcgctagtgaaactgaagatgtacaaaattcaactttggctgctataaatgttaatgtctcacttgttgaacaacttttgggttgcttgttagactgtgatcctggtctttcttgtgaattggtgaagaaatatatttcacccatgtcaacatgtccaagccattatgtaggtgttatcttggacgaaccttcatctgcaccatatgcaggatacatcaatgacgttcccaggttcatctggaattttctggccgacagaacttctatcccaagggagaataatatctcagattgtcaacatggttgcaatggtagagatgaagtttgtgtcaaagcagagacagatggcaagggagtttgtgttctctctacaacgaggtatgttccagcatattcaacacggctaaaatttgaatcaggagtgtggaatgttttgccccctaattcctctgacaaaatgggggttgtggaccctgtctggacagagagcaactggaatacaatagctgctgagtatgaaactcctaagaattccttcaatcagatatctctatggggtggtatccttccctctaaagagcatgccaagttttggattcatacatcaaataagcaccgcttcattgaccagggaagcaatttgcgtggcaaagaatataatctgactttgcattggcatgttatgccaaaaactagcaaaatgtttgcagataaaatagtcatgccaagtttaaccttttctataacggatatagaagatgtagatcacttctcaacccctcaccctgctccaacaaatccaatggcctcatcaactatcactgtctctcccggtattaattccaaacatccaaacaagtatttagaatga

SEQ ID NO: 78727 - DNA, 459 bp, Glycine max
  Peptide Sequence Number=SeqID_195505
atggaacttatgagactccatcaacatgaagagaatgatataaagagaaaaggaataacactcagagcctcatcatcttctattcaagaagaaactgacaaagaggacttgactaaaatagaagaagatgatggtttcagattttttgtgaagaggttcaataaattgctgagaaacaaaagaaataaaaggaaatcaaatatcaatccaaagaagaaagaagaagattcctccttagccccaaaatgctatgaatgcgatcaacctgagcacataagattcgattgtcctgtctttaaaagaagaatgaaaaaatccaacaagaggaatttcaaagaaaagaaagcatacatcacttgggaagataatgacataaattcttcaagtgattcagaaaataaaatcataaatctgggactcatgttgaaagactatgaaagcggagaagggcaaagttga

SEQ ID NO: 78728 - DNA, 624 bp, Glycine max
  Peptide Sequence Number=SeqID_195506
atggaatcaaccaatgtgaagaacaagtcaagtggaaaaagaaagatgtctagtgaggacacaagaagttactttgcatggaacttggaaatggagcgtgtgctaactaatgtgcttagagatcaaagaaatttggacaataaaggtgatggaaattggagagcagtaacatacagtactgcagctcaaattttttccaagcattttggagttcatctcatgcgagataatgttaagaaccattttaagctttggagaacatggtatgaaattgcgagtgacattcttattcaaagtggatttgactgggatagcacaaagtacatgattaccgttgaaaatgaaattgcatggaatgaatatgttaagtcacatgaagaggtcaaacgatttcaattcaaagtcattcctaattgggatgatattgttgacctatgttcaaaggatagagccactggactcagagcaaaaaatgcattagatgcaaatgatatcatgagcaaagaaacaaatgaagaggaagcaattcatagtgtgagttttgacttggagggatcaagttctgccacaagaaaaaacattcgctcaagtaaaagtggagagaaagaagggatgatttcctaa

SEQ ID NO: 78729 - DNA, 279 bp, Glycine max
  Peptide Sequence Number=SeqID_195507
atgaaggaggacttgaagaaattaagagatatgaacaaagatgacatcaactctaaagctaatgtattaaaaggtgttgaagatgaagatgatgtgtacaagaggagacacttggtgttgcaaggacagaaaaataaagttaacctttgctatttggacggacaagccttgatgaggaaccatgataacaaagtgaagaagaaaataaagttttctaatgttgtaaaagtgttaggagatacttccattggaggagaaggttgttcaatttcaaattga

SEQ ID NO: 78730 - DNA, 534 bp, Glycine max
  Peptide Sequence Number=SeqID_195508
atgttgggaattttcaaggagaagttggttaaagcacccaaagagctgaacaatccagcttctttgaattcatgcactaagcctaagccaagtcatgaaatcctgaaggatttcatgccctgcaattcctccaatgctttctccatgtgctttgggaatgatgctttgctagcctattccccttcaaacaagccttccattcatcatagccttagcatggtcaataagcaatatggtctatcaaagggaacaaataaggccatgtttatcaccgaagcgtatcaaactcttcgtgacaggggtccataccctgctgatcaggtcctcaaggaacttgaaggcagtttgggatttgtgatctatgacaacaaggatggaacaatttttgtagcatttggttctaatggccagattgggctctactggggtgttgtagcttatagttccatagttatttatgaaaatatggagcttataaaagcaagttgtgctaaatcattagcaccatttccaactggttctgttcttctatag

SEQ ID NO: 78731 - DNA, 126 bp, Glycine max
  Peptide Sequence Number=SeqID_195509
atggaagcaacagcgagcgctctcctcactctacagttgcttatgagagtatcagcatgtaaaacccaaagaggtaagtacaatggtcattctgtgattgcacatttgaaaccaaaaataatatag

SEQ ID NO: 78732 - DNA, 654 bp, Glycine max
  Peptide Sequence Number=SeqID_195510
atggcccagtctaactcctctagacttgggttcctggctcttatcacagctttatgtaggtccaaaggggttgcttctgtcaggctggtcttcgaacgcttgagcccggtcattaacttggcctatatcaggaagaactattggaaccctgatgatctaatagttactattagaggggctaagagagcgagggcaaggccagttgaggctccttccacatctgcagctcctcctccagcacgtacctcagcagctccttctaccccaccttctgcagactttcaacgtcttgaagacatgcttcgaagcatacatcaggggcagattgttttattacaaagtttacagctggtagcacctccagactttattccttctgtagagcagtttaatgagtgggtagcctggcccgggactcagcctccccttcacagggaagacgaaggtcccaccactcaggtaccacaacagatggaggatgagtcatccgagacttccactccagagcccctgattagaaagaagagggtagttgaaacacaagaagctgcagccatttctgagaaatctcttgaggccactcctaagcctctagcaccaatggcagatacgacctcaccgcagcaggcaacaaactcatccactctcttatag

SEQ ID NO: 78733 - DNA, 261 bp, Glycine max
  Peptide Sequence Number=SeqID_195511
atggtgtttgagtacgagaatggggtgcaaatagtgattcccaaggagagggttctggctaccgtggagggtggggtccactgcgtagggattgcgaactctgataaattgggtgcggccagtaacattattgggaattttcatcagcagaatctgtgggtagagtttgatctggcacatgatcatgatgatgtggttgaaatcagacggtccaagagcgaggaagaaaaagaaagttctacaactgttgccatgatatga

SEQ ID NO: 78734 - DNA, 381 bp, Glycine max
  Peptide Sequence Number=SeqID_195512
atgacattaggaattagtgccagcactgtatttgctgaagatgcaacaactgaagcatatcctgataatgacccagggggcatgctgtttcttcatggaaaactagatgaagctgaaaaactcttcctttctgctatagaagaagctaaagaaggtttcggcgagaaagatccgcatgttgcttctgcatgcaacaatctggcagaattgtacagggtcaaaaaggcatttgacaaagcagaaccattgtatttggaagctatcaacatattagaggaatcttttggtcctgatgatgtacgggttggggtcgctgttcacaaccttgggcagttttaccttggacagcggaagttggaagaagctcgtgttagctatgag

SEQ ID NO: 78735 - DNA, 409 bp, Glycine max
  Peptide Sequence Number=SeqID_195513
ttcttccggaagagcgcgtcttccggaattcttccggatgaatcacttcttccggaaagttcccggaagaggttttccgggagtcttccggaagacgtttggttacttccggaagaacacttcttctggaaactttccggaaaatgttcttccggaacttccggaagaacccctaacgggtcttctgaaagacttcggcgtcagccttttccgccattttttccgacgtactctcgtcttctcccctctcgtcttctaccctaaggttactatcctaaggggaactaacctgttcgcggagaagaagaagaaagccttggcgcgcctcgcgaagaagaagcttcacgcagaagagaagaagaagctgttccgggagagaagaagaagttgtttcgggagagaagaagct

SEQ ID NO: 78736 - DNA, 675 bp, Glycine max
  Peptide Sequence Number=SeqID_195514
atgtcgctgctctcagatctcatcaaccttaacctctcagacactactgagaaggtgatcgcagagtacatatggatcggtggatcaggaatggacctgaggagcaaagcaaggactctcccaggaccagttagcgacccttcaaagcttcccaagtggaactatgatggttccagcacaggccaagctcctggagaagacagtgaagtgattatatacccacaagccattttcagggatccattcagaaggggcaacaatatcttgattaccgcgacaaccattccagaaaatactcaagacatgattcttaaagttatctgtgatacttacactccagctggagaacccattcccactaacaagaggcacgatgctgccaaggttttcagccatcctgatgttgttgctgaagagacatggtatggtattgagcaggaatacaccttgttgcagaaagatatccaatggcctcttgggtggcctgttggtggtttccctggaccacagggttgttactttacacatacaaattcatattgtccatttcacacattaactcaaattatcagttttaacacttattgggactctaaatggaacaatgattctaatcacttgacaatgtcaaaccctgtcaataaccctacctttttaaatttgttagaaccataa

SEQ ID NO: 78737 - DNA, 312 bp, Glycine max
  Peptide Sequence Number=SeqID_195515
atgacgaacgaagaacaatgtagaagtcgattatggtcgcaattcggtagcgcctcggcctcgtttttctcttctttcttcttcttctctctgatttctctccaatttctcttatcactaaaggtccaaccccttcctcagcctccctcacatctatttataggaaatgagggcacttgccctaagccattcagaggcccaggcgagctagaggctagcctaggcaagccagggcctagaaaattgcctggaatgacccttttgcccctcctcttgggtattttccacatccttgaccaaaacgtcgaatga

SEQ ID NO: 78738 - DNA, 606 bp, Glycine max
  Peptide Sequence Number=SeqID_195516
atggcacatcaaggggcaagacctgcaacggcccctggggacgacggaggagctcaagaggatgacgatatggctgacagacaatcatggtcatctgcacctctacctttccaagactattacagtctttttcgtcttccagagacaatcaagttcgttggcatgcagagacaatcatggtcatctgcacttctacctttccaagactattacagtcttctttgccttccagagacaatcaagtccgttggcacagacaatcatggtcatctgcacctctacctttccaagactattacagtcttctttgccttccagagacaatcaagtccgttggcacgtagagacaatcatggtcatctgcacctctacctttccaagactattacagtcttctttgccttccagagacaatcaagtccgttggcacgtagagacaatcatggtcatctgcacctctacctttccaagactattacagtcttctttgccttccagagacaatcaagtccattggcacgtagagacaatcatgagatagtcaagtctgttggcatgcaagacaatcatggtcatccgctttctttgtcttccagagatgattaa

SEQ ID NO: 78739 - DNA, 489 bp, Glycine max
  Peptide Sequence Number=SeqID_195517
atggtgttcaaactcgagttgacaaagttgtctaatgatgaatcaaatttagaagctatgctttgtttggatgatggtaacaaagcttctgctttccctgttgcttcggttcccgtcgcgactcggccaccctcgggttcgggtggtgggagcgcgtgcgagccacgtcgtcatggtccgagtcgcgctccgaggcgcaaccgggcctttatgaaggtgcgcgagtggtcggagctcgcggcggggcctcggtggaagactttcatccggcggttcagccggagccggagtggcgggtcgcggcacgcggcggggaagtaccagtacgaccccttgagttacgctttgaacttcgacgaggggcataacggggatttcggcgatgacggctacgacgggttacggaatttctccacgcgttacgccgcgcctcctccgattaagtccgtttcctcggattcgaatcaagacgtcgccgttttgggataa

SEQ ID NO: 78740 - DNA, 2604 bp, Glycine max
  Peptide Sequence Number=SeqID_195518
atggtggccaggtcatgcttgaatttgttggatctggtatcaggggatacactaaatttccctcggactcccagatcccttccgcgagttatgactgatccagtaatcatgtctgatggagatgttaaagaaagtaatgatgatgatttgagctttttctcttatgacgaggattcaatcttttggcagttaaaggatggtctctctcctgatgctgatgttgtttatgtgggatctctcaaggttgatgttgatgcaaatgagcaagagaaagtttcccttcagttgctggaggaattcaattgcgtgcctacttttattccttcagacctctacaaacaattccatgatggtttctgcaagcaacaattgtggcctctattccattacatgatgcccgtgtatccaggcaatcgccactttgataggtcacagtggcaggcttatgtttctgctaacaagatatttgcagataaagtcatggaggtccttaatccagaagatgattatgtatgggttcatgattatcatcttatggtccttccaacatttctgcgaaagcggtgtagtcgagtcaggcttggttttttcctccacagtccatttccttcatcagaagtttataaaactctgcctgtcagaggtgaaattttgaaagcattgcttaatgcagatttagttggtttccacacctttgattatgctcgccattttctctcctgctgcaggcgaatgctaggcttggaacatgaatccaaaaggggttacattgggcttgaatactttggccgtacaatattcattaaaatattgcctgcggggattcacatgggtcgacttcaatcaaccttagatcacccttcctcttccaacaaagtcagagaaatccaccaacaatttaaagggaaaaagcttatagttggtgttgatgatatggacttattcaaaggtatcagtttaaaattcttggccatagagcaactcctgcagcaatatccagaatggcaaggtgaattaatattgatccaaattttaaatcccccaagtagttctgacaaagatgttgaggatgcaaaggaggatgcctacattacagccaaaaggataaatgaaaggtttggtttggaaggttatgaacctatcatcatcattgattgccatgttcctttctatgagaaggcagcctattatgctttggcagaatgttgcattgtgaatgcagtgcgtgatggtttgaatttggttccatacaggtacactgtgtgtaggcagggaagttctaaactagacgaagctttagaaattgcttctgacttcccgcgtgtaagtgcacttgtcgtttctgagtttataggttgctcaccatctcttagtggggcaataagggtaaacccatgggatattgatgcagtagctgaagcacttaatttggcaatcacaatgcctgatggagagaagcagcttcgacatgaaaagcactatcgatatgttagttctcatgatgtggcatactgggctcgaagctttgagcaagatctagtgttctcgtgcaaggatcactatagtaaccgatgctggggcattggctttggcctgaatttcagaattttgtccctctctcctagtttcaggaggctatccatagaccacattgtccctgcatatgagaggtgcagttgcagggcaatatttttggattatgatggtacagttgtacctgaagcttccattgttaaagcacccagtcccgaagtcatatctgtgctaaataatctctgcagtgatgttaacaacactgtgtttattgttagtggcaggggaaaaacctcactgagtgaatggtttgatcagtgtgagaatcttggtatagcagctgagcatgtacatgtttatatgggtgtttcttcttcttatggtactgcggttgtcggttgtcgtgtcactgtcaagttctttaagctgatggtatttttatttgatctttaccataggtggggtaaacatactagttggcaaatgagtcatgcagatacagattttgcatggcaaaagattgctgaacctgtgatgagatcttatatggaggccacagacggttcctctgtagagaccaaagagagtgccttggtgtggcattaccgtgatgctgatcctgattttggatcttggcaagccatggagctgctggatcaccttgaaaatgtacttgcaaatgagcctgttgttgtaaaaaaagggcaacatattattgaagtcaagcctcagggcattactaaagggtcagttgcacaggaagttctttcttccctaaccaagaagggtaaatcgccagattttgtactgtgcattggtgatgatagatctgatgaggacatgtttgagagcatactagccgaaccttatagtgctaactccttctcagcaccacaaatctttgcatgcactgttggacaaaaaccgagcaaagccaggtactacctagatgacactgtggatgtgatgacattacttgagggtcttggtgcggcttcagggcctaaatcaagatgctctacagaaaccccttttgagaaaagagaagtatgttttgagaatgatgtttaa

SEQ ID NO: 78741 - DNA, 2403 bp, Glycine max
  Peptide Sequence Number=SeqID_195519
atggcttccttatccaatatcttgcttatgttttgtttgttgaatcttctagcattcccagtttcagttcattcagctggtgaagttccaattaatgtgaccaagcacttttctttctacaacttcagcttcagcaacaaccccagattagtccatgatatgaagctcctaggcagtgccaagttctcaaatgaaaagggtgctcttcaaatcccaaatgaatcagaagaagacataagacaccaagctggaagaggcatctattccttcccaattcgcctgctggatccaagcaccaagactccagcttcattccaaaccactttctctttccaaatgaacaattccactgcctctgagcaagctgcttatggaggaagtggcctcactttcatcattgtccctgacgagttcaccgtgggaaggccgggaccgtggctcggcatgctcaatgatgcttgtgagaatgactataaggcagtggcagtggaattcgacacgagaaagaacccggagttcggagatctgaacgacaaccatgttggcatcaacttaggtaccatagtgtctactaaagtcattaatgtttctgatgttggactgtcccttaatgatggttctgttcaccgtgcttggatcacctatgatggccctcaaagaagaatggacattcgtcttggaagggcaaaccaagaggattatgattatcctccaaaacctctcttctcagaatctatggatctctctccttttctgaatgagtacatgtttgtagggttctcagcttccacaggtaaccatacacaaatccacaacatactctcttggaacttcacttccacaagccaagcttttcttcgcttgccttcatctgaaacctgccagggtaagatcttacttgagaatagcactgcttccacagaagtaccaccaacttcacacaagtcttctaagaatgaaccaccacgaagctttttgattttcgtggctgctgtggcattggctctggctcttttccttggcttttacttcatcagcaagcacagaagaaatgctgctaagttgaatacttcagtggaggcagagcttcacatgccaaggcctcccaacaagccacgacgcttcgccttttctcaactttcatcttcaacaaggtcattcagtgagatagagttgctcggcagtgataatagaggagagtactacagagggaagctttctaatggcagccaggtggctgtgaaaaggttctcagctcagtttctcagcacacatggatcggacaagaagagattgttgaaggaaatcaaaggcgttagccacgttcgccacccgaatttgcttctggttagagggtggtgtcaagacaaccatgaaatcatggtggtctatgactttgtccccaatggcagcctagacaaatggctattcggggccggtgttcttccgtggactcgacgtttcaaagttattaaagatgtagctgatggcttgagcttcctccacactaaacaactagcccacaagaacttgaaatgcagcagtgtgtttctagatgtcaatttcagagctgttttgggtgattttgggtttgtgttgatgggtgcagaatcaaaacactttgagtcacaagtgtgccaaggtgctgatgtgtttgagtttggtgtccttgtgttggaagtgatagctggaagggtaagggatgagaaagaggagggaaatccagaagagaggaacctactggattatgcttggaacttgcatcagattgatgaaaaggtgaagctggtggacagaaggatggggtcattgatcaacttggagcaggcaattcgcgttctcgaaattgggttgctttgcactctaaatgagaacaaaggaaggccctcaatggaacaagtggtggagtttcttctcaacatggataagcctattcctgagctgccaagaactcgccctgttgccttgttcccctataatagcgccaacacaggactttatatgtctaaatgttgtgttgaaatgcacctcagtggacagtttgtgaagtcccctgtaaatgctgttgtatgggagtgtgggaagaggttgaatgttggttatgaagtggatagtgctgctaaaatcagttttggtgacactgaaaatgatgcaaatactgatgttgatatttttgacaatgttaaccagaaagcagggttgggagggaaagaaaaagctaaaagtgaaagaggatttagaagggcaagagggaaaaggaagggcaattctaagaacactcttgagtgtcacgttttcaatgaaaagcttagtgaaaccgtacctctagcaatgacagaactagaaggtgattcctctgatgaggttaaacatgtgttcaacaattggtaccataactgttga

SEQ ID NO: 78742 - DNA, 837 bp, Glycine max
  Peptide Sequence Number=SeqID_195520
atgggtggagtcattggtggtttgattcctttcatcttgaactaccatcgtagtgaggctgcttcagtcaacgatggaacctacataggcttcatgtgcttcatgtcactggggacccttttgtcattagccatcttgcctgcatgcaaggttgttcgtgatgatggtagcaggtgcaccaacatgttttacaccgatgtttccaccgagtgtgtggaggttctcaagttgttttccaattggaaggtgcttcttatggttccagcagcttggtccagcaattgtttttacccttaccagttcaatgatgtgaatggggctctgttcaatttgaggactagagggttgaacagtgtgttctactggggggctcagatgctaggctcggttgggattggttatattatggattttagttttaagaggagaagagttaggggaatggttggggttatagtggttggtgttcttgggactgtgatttgggggggtggacttgttaatcagcttaggtattcttccaatgatttgcctgaaaaattggattttgagcagtcagggtctcactttgctgggccttttgtcttgtactttagttttgggttgctagatgccatgttccaaagcttggtctattgggttattggagccctggctgatgattctcagattcttagcaggtacagtgggttctttaaaggaatacaaagtgctggtgctgcggttgcttggcaagtagatgaacacaaggaaaatgttccttcacaccgcagggattgtttacatatgaaaagttttaagagaaaagggagtgggcctttactcctccgtctctag

SEQ ID NO: 78743 - DNA, 627 bp, Glycine max
  Peptide Sequence Number=SeqID_195521
atggcagccattaaaaggaaaactcagaaaatagtgcccctggaccagaaggctatgaaggatgagctttggtgcaacggttgtggccatgtgatttggagatcacgttttcaaattttggaagcagtgtctctgcttgcagacgaaaatgggggtaacaaggatcaaatctgcgagtgtgaccacttaagctattacgtgaaaaaacacgtagaactctatacggactatgatccaaagatgttgctaccttttctccgtagcagtcaacactacacccttgagaaggcttacgaaatttgcattaaaagagacctattgagggagcaagtcttcatcctaggaaggatgggaaactcgaagcaagccctagctgttattataaacaaattgggggatgtagaggaggccgtagagtttgtcactatgcagcatgatgatgaactttgggaagaattaatcaagcaatgtcttcacaaacctaaaatgatcggtacttacacgagcaccgacttagaaagtacatatttctacgtcggtgcctacgccaacaccaattttgaaaggatgtatttctacatcggtgttaaagctaacaccgacttagaaggcctactctctatgtcg

SEQ ID NO: 78744 - DNA, 288 bp, Glycine max
  Peptide Sequence Number=SeqID_195522
atgagtcacacagaatttggtggagtaattgagggaaagatcaggatgaacactttgaagaaatggttcacttcttctcaggctatattgagcatgcttctgtcaagggttatattggttaaaggctctttcattggtgcacttattacttatcgtcatattgttgctgcaatttgtgttgctccctttgcgctttacttcgaaagaggcctcacaaagaagttcacttggaaggtttggttttggctattcattaatgcattaatggggtacgtgggcgttctttaa

SEQ ID NO: 78745 - DNA, 138 bp, Glycine max
  Peptide Sequence Number=SeqID_195523
atgacatacactacatacgacgtatggtcatggccaaaagctagtgcccaagaccctggaagaaaaatcagcatgcaacagggacaggaagatatcctcatagctaggttccctgaccctaactatggtgttaaaacg

SEQ ID NO: 78746 - DNA, 1260 bp, Glycine max
  Peptide Sequence Number=SeqID_195524
atgggaagaatttcaaggaccaagagttatgcaattgcctcttcaatagtacaagaaaaccaacaacaaacaccaccttccattacctgcacaacttttaacattcttgcacccatatacaagcgtctcaaccatgaggatcagagttgccgcgaaagcgattacaaagcgtgttggttgaccaggaatcaaaggatattggattggttgttgtatgagagatcttccataatctgtcttcaggaattttggattggaaacgacgagtttgttaatttgtatgacaagagacttggtgatgctggttatattaatttgaagcttggacgaaccaacaatcgtggtgatggtcttctgatagcagtgcaaaaggaatatttcacagttgttaaccataaggagttgcactttaatgattgtggtgatcgagtagctcaattgctacatcttgagttagcttttcccttttctcaatgccaaaacagtgatgttaggcacgaaattctcattgtcaacactcacctactgtttcctcatgattcgagtctttgccttgtacgactgcatcaagtctacaagatacttcaatatgtcgaatcttatcagaaagagtaccaacttaagcctttaccaatcatgttatgcggtgactggaatggaagcaaaaggggacatgtttaccagttcctgaggtctcaggggtttgtatcatcatatgatgcagcacatcattacactgatgctgatgctcacaagtgggttagccaccgcaatcatcttggaaatatatgtgctgttgattttatatggcttcttaatcctgacaaatatcaaaaacttctaaaaacaagttggagtgaagcagtatttggcatgtttaagagcttctttggacctatcataaagagtgtagaatttatttttggggtgccaggaggttttactattaatgtagttgtggaacagaattatgtcactgacaataaacttcacctttatcagtatctattgcgaagagcttcactgacagagagagatgcatttgcttttctaaaggttgacaatgaagattgtattacctattctggtttctgtgaagcacttagacagcttaatttaattggtcattgccatgggttaagtgctgaagagacaaaggacttgtgggttcaagcagatataaatgggaatggtgttattgattataaagaatttctggaaggaaagaaaatggaaggaaagaaaatggaaggaaagtga

SEQ ID NO: 78747 - DNA, 843 bp, Glycine max
  Peptide Sequence Number=SeqID_195525
atgaagacactgcaacaaaaattagatgtatctctcctttctaaacaatttcggtctgcatctggtggttctatctgtagctcatgcgaaacttttgcacttagtcacacatcatcatcagacttacttgtagatatagcatggttgcttaaggacaccacttcagaaaattttgacagagtgatgacagcttcacaaattcaaagatattgccatttgttggactttctgatatgcaatgattcaacaatcattttgggaaaaatattaccaaatttgataatcttgacagaaagcatgaaatccaatgttgtaattaataggacaagtgatgttgacataatgcaactcctgaatcacatacataatgctagaaatgccgtatatcagaaacatccgaaaagtgaaagtataattgtgcactctgaaatgaaaggctttatacttgctcagggctgctcccaagataacaagctatcagttgcaattaacagccagggtatccagtcgagagcagatgagaagtggggagtactgaaagtgaaaagtccaacttctaatgagaaaatggaaagaataccacttttgaagagggatattataatgagtatggaagagttgcctgaaagatacgggcgtcgatgtttgggcaggggattcttgacctttcggccagctatttttgtgttggtttcggttgctgtatgtcttggggtatgtgttgccgtccttcatcctggtagggtagtttattacattggaaagcttaatccaaggttgctaatttgtgcattaccaattttatcggatgtccagagggacttgcagttgcaggtgctgtga

SEQ ID NO: 78748 - DNA, 2850 bp, Glycine max
  Peptide Sequence Number=SeqID_195526
gctgaaatccatatatcacttgtggcaggagcagggggaagggaggcaaccaatctccagtcacattctccacacgtcgcctcaccttcctgtgacgttatcattctccctgcccgtgctgcccgcactgcccgacccctacctagggtttctggaaagcatggttgcggagctagggttttgcgcggatctagggtttcgcgggttctgagggcttcgggtgtcgaattaggagggggatttgatggtacgcgttggggaaaatgcgaggctatgcatgggcgtggaggtgagaagggtaagaggactcggcacatgtggaaatcctccacacgtggcgactcgtctctgaacgccgatgtttcttcgtcttcttcttcgtcgtcgtcgtcagtgaagtcgttctcttatttgagtttatgtggaaatgaattgtgggtttttgacgagtgcgttgtgtacaagtatgtgtctagggcagggattaagatggaaactactgaattggacggtcgcaaaattagtgttggtgaatgtgctctcttcaaaccatctgaagatcgcccaccatttattggtataattcgttgtctgacatttggcaaagagaaaaaattgaaggtaggtgttagttggctttatcgatccattgaagtaaaactcaacaagggtggaccattggtggctgctccaaacgaaatcttctacaccttccataaggatgaaattgatgctgaatcgctgctccatccatgtaaagttgcatttcttcgtaagggtgctgaacttccatcagggatttcttcatttgtgtgcaggagggtttatgacattgcaaacaagtgtttatggtggctaaatgatcaagattatattaatgattgtcaagaagaagtagatcaactattatacagaacttgtgtaggaatgcatgcagcagtgcagccaggtggccgatctcctaagccaatgagtagtccaacatcaacatcacagttaaaatctgtttcagatagtgtccagaacagtacttcttcctttccatctcacattaaggggaggaaaagggaaagggctgatcaaagctctgagcctgccaagcgagaacgatcaataaaaactgaggatggagattctggtcatttcaggcatgataacattttgaagacagagattgctaaaattacagaaaagggagggcttgttgacaatgaaggagttgaaaaattagtgcagctgatggttcctgagaaaaatgagaagatagatttagctagccgggcattgcttgcagctgtcattgcagcaacagataaattagattgtcttagtcagtttgtgcagttgaggggcttgcctgtatttgatgaatggctccaagaggtccataaagggaagattggtgatggtgttgggtctagggatggtgataaatctgttgaggaatttctcttggtattgcttcgggcacttgataagcttccagtaaatcttcaggctttacaaacatgcaacattggaaaatctgtgaatcatttgcgaacgcataaaaacactgaaattcagaggaaagccagaggtttagttgacacatggaagaaacgtgttgaagctgaaatgaatataaaagatgcaaagtctggttcaggtcccactgtccactggtctgccaaatcgcgttcttctgttgttggtcaaggtgggaatagacattcaggtgcattatctgatgttgccatgaagagttcagttacacagctttctgcatccaaaactgcctctgtgaagattgtccagggagagaatactactagatctgcatcgacatccgcatttcctgggcctgcaaaatcagtgccatcacctgcatctgcgactacaaacctaaaagatggacagccccgtattgccgctgccaatggaggttctgatcttcccatggtgaatgcaagggatgagaaaagtagtagttctagtcaatctcacaacaacagtcaatcgtgttctagtgaccatgctaaaactggaggtcattcaggaaaggaggatgccagaagctctactgcaatgagtgtgaataagatatctggaggctcttcacggcaccgaaaatctattaatggattttcaggttcaactccatccgtagggcaaagggaaactggatcaagtaggaattcccccttgcacaaaaatttaacttcagagaaaatatctcaacctggattaatggaaaaggcacttgagggagtttcttgtaagctgattgttaaaattccaagccaagttagaagtcctgctcaaagtgctagtgcaggttcttttgatgatcctacaatcatgaatagtcgagcctcatctcctgtcctcccggagaagcatgatcagtttgatcaaagctcgaaggaaaagagtgacctttatcgagcaaatattgtctcagatattaatactgaatcttggcagagtaatgattttaaagacgtattgactggctctgatgaggctgatggatcacctgctgcagttactgatgaagagcactgtcagattggcaatgattgcaagaaaacattggaggtaccaaaagccgcttcctcgtcatctggaaatgaaaataaatctggaaatttgcaggatgcttcttacacctcaataaatgctttaattgaaggtgttaagtactctgaggctgatgatgttggaatgaatcttcttgcgagtgtggctgctggagagattttgaaatctgaattgttaactccagctggatctccagaaagaaacactactgctgttgaacagtcatgcacaggcaatggtgttgttaagtcctctgaagagaatctt

SEQ ID NO: 78749 - DNA, 234 bp, Glycine max
  Peptide Sequence Number=SeqID_195527
atgggtgccgtcgtcgagtgttacccacagccgcgcacggcggtgctgtccctgaacaccttgccgttagggttccgtttccgtcccaccgatgaggagcttattgactactacctccgctcgaagatcaacggaaatggtgatgatgtttgggttattcgtgagattgatgtctgcaaatgggagccttgggacttgcctggtataaaatacttcttctctttggaaatttga

SEQ ID NO: 78750 - DNA, 411 bp, Glycine max
  Peptide Sequence Number=SeqID_195528
atgcattgctactgtgtttatgatgagcatgcagatctgcgcgaagacaggcactatatggctgatcatcctggcttggtgcccgtgactactgagcaaggtgaggaactccgtaaacatattggagctacctactatattgagtgcagctcaaaaactcagcagaatgtgaaggcagtttttgatgctgcgatcagaatggtcatcaagcctccacaaaagcaaaacgagaaaaggaagaaaaaaccacgtggctgtttcctgggaggggataagggtaaccctttttctttcacactcgcgatttccatttcaactattttatattttgacatcccattgaggtcccctcttgtggctgctctacttaatccaaaatctatccaatttagtaatcaaatattttattag

SEQ ID NO: 78751 - DNA, 2208 bp, Glycine max
  Peptide Sequence Number=SeqID_195529
atggatttgcaacaggtttctgaaactattttagaaagcaaaggaaaattaaacaaaaaatctgtatctactgcattgggtggcctttctgaaagttctgtacaagaagctagagatggtgacagaagcaagcagctccaggaggttggtcggggagtgaatgctgatgaaattgttgatgttaaggtcagttctgttgcagaagttaaggcagaagcaactgaaaaattgtcacatatagctgtggaagtggatgtacagagtgataactgtactactgaagtatcaactggtggtggacagacagctgctattcttgttcagtctgattcggcaagaggaaaagatgagaatgtactccattcttctgcttatagtgttgataaggttcctgaagacttgactgaacgggagtttgaaaaagctgatgatgttgatgctgagaatcattctagtcagtctaaaaagcaaagaaatgagtgtgaaagtgatgccttgacaatgcctgaggatagaggtttatgctctattgtgactggtattgctgctgaacatgtggaggaaaatttagaaacgaaagaggttcatgaccaacctgccagagaggaacttcccaaagattcacctagtgtcctttcacaagaaatggataagcatcttgattctaaagggtcaaaattgattgccatggaagcggaggaggctgaggagtgcacctctaccactgcagatgcttcttccatgtcttctgcagctgtgtcagatgcagatgctaaggttgaatttgatttaaatgaagggctcaatgcagatgatgggaaaagtggcgagttcaactgcagtgcacctgctggttgtttggtcagtcctgtgccgtttcctgcttcatctatgtcttgtggtattcctgctcctgtcaccgtggctgctgctgcaaaggggccctttgtgcctcctgaagatttattgagaagtaaaggggaaattggttggaagggatcagctgccactagtgcatttaggccagccgagcccaggaaggttatggaaatgcctcttggtgcactaactacctctatacctgatgctccagctggaaagcagagtcgagcaccattggatattgacttgaatgtggctgatgaaagaatacttgatgatatttcttctcaaacttatgctcgtcacactgattctgcatctcttgcaactgatgatcatgatcctgtatgcagtaaaatgtcttcacctcttcgctgctctggagggcttggtcttgacttgaaccaagtggatgaagcttctgacgtgggcaattgcttgagcagtaatcataaaattgatgtgccaattatgcaggtgaagccatcattgggtggtccaccaaatcgagaagtgaatgtccacagggactttgatttgaacaatggaccttcagttgatgaagtcaccactgaatcctcattgttttctctgcatgccaggagcagtgtgccatctcaaccgcttgtttctggacttagggtgagtactgctgagccagtcaacttctcttggcttccttccagtggcaacacctattctgctgtcacaatatcttcaattatgcctgatagaggggatcatcccttttcaattgttgccccaaatgggccacaaaggttgttgactcctgctgctggtggcaacccatttggacctgatatttatagggggccagtattgtcatcttctcctgcagtgtcatatgcatctgctccatttgaatatcctgtcttcccttttaattccagctttcctcttccatcagcttctttttcttctggatcaactacttatgtatatccaacatcaggcaatcagctttgctttcctgcggtaaattcacagttaatggggcctgctggtgcagtttcatctcattatcccaggccttttgttgttggccttgcagaaggtagcaatagtggtagtgccgagaccagtagaaaatgggcaaggcagggtttagatcttaatgcaggacctggaggttcagatgtggatgggagagacgggaattctcctcttccatctaggcaactttctgttgctagttcacaggccctagctgaggagcaagtaagggtccagctggctggtagtgttcgtaagaggaaggagcctgatggtgggtgggatggccacaaccaatcctcatggcaatag

SEQ ID NO: 78752 - DNA, 384 bp, Glycine max
  Peptide Sequence Number=SeqID_195530
atggctgctgcaactgccccaagattcatcaagtgtgtgaccgttggcgatggagctgtagggaagacctgcatgctcatttgctataccagcaacaaattccccacgaaagtaacccagttgttatcttgtgaagcttcaccattgggtttatctgattttgcttccccctatgttgatcatcaggactatatccccactgtgtttgataatttcagtgcaaatgtggttgttgaaggcataactgtcaatttaggcctttgggatacagctgcacacaatactcctgcctttttagccgctatagtaatttctcttaattgtttgaaatacattacaccatgtatccccataagaagagttattgcaaagtgtaaatcttaa

SEQ ID NO: 78753 - DNA, 171 bp, Glycine max
  Peptide Sequence Number=SeqID_195531
atgcgtggagtcgccaaacaaaggaaactggtcataaagaatattccagattcgggagttatgtttacgcttgagaaaggtcgacaaaagcggggcttttgctcctacgtatcctccatcgaagaggaaatcagacctgcgcagttctttcaaaagggacgaatcaagtga

SEQ ID NO: 78754 - DNA, 531 bp, Glycine max
  Peptide Sequence Number=SeqID_195532
atggaagacattttaaagatggaagatcattgtaagaggtggtctgagtatcttgacagcacacaatcaagggttagtcactcaccaccgataaattgtgatttttgtggaggagagcattgcaatgacaattgtcatctctactccatgaataactcttggtggggacaagagttactcccttacaatcaatatgaagaagaaataactcctaatcttgaaggtgtgcttgcggaattcatggcataccatgctagttctaaagtccatcaaaactcaatgcaaaatttggaaattcatgttggcaaaagctactccatggaaaattatcagtgggagcaagagttacaaccctacaaccaatatgaagaagaaagaagtgaagtggccaaatttgtggccacaagtgaagaaaactttgtagaggttgaagctcatgaggaaagccttgtagaagagcgtgattcaagagaaaaagatgaagaaaaaatgagaagaaaacacaacaatgggaggagtgctcacaagtag

SEQ ID NO: 78755 - DNA, 834 bp, Glycine max
  Peptide Sequence Number=SeqID_195533
atggcggacgcgcagcagcaggcggcgatcgagcagcgtaacgatgcgctggtgtcgctggaagccgaggtcgcgcgcgcgtatctgcagctgcgcggcgcgcaggcggtgctggcgacgctgcaacagcagattaacgtggcgcagcaaacctgggagctgacgcagagccagcagcgtaacggtctggcgccgctcaccgacgttgagaatgcccgtgctcagctggcctccctcaacgcgcagctgccacagtatcaggcccaggaacgtcaggcgatgaacgggctggcagtgctgctgggcaaaacgccgggcgcgctggataacgaactgatgagcagcaaagcgctgccggcgttgccgaagctggtggcggtgggcattccctcgacgctggcgcgtcgtcgtccggatatccgccaggctgaagcgaatctgcatgcgcagaccgccaatatcggcgtatcagtcgcgaacctgttccccagcctgtcgctcaccgggcaactgggcgtgcgcaacaccgatgccagctaccttgacgactggagcagccacttcttcagcgtcggcccggcgctgtcgatcccgatttttcagggcggacgtctggtttccagcgtgaaactggcgcgcgcgcagcaggcgagtgcggcgctcgattatcgccagacggtactgacggcgctgcaggatgtggaaaatgcgctagtcagctaccgcgccgatcagcaacaggttaccgcgctggatgaaaccaccggcgcactgcagcgcgcctttgacctcgccagtgacagttacaaacagggcatctccaccttccttgag

SEQ ID NO: 78756 - DNA, 471 bp, Glycine max
  Peptide Sequence Number=SeqID_195534
atggacgttgataagatccttccatctagcagcactttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccgtga

SEQ ID NO: 78757 - DNA, 1206 bp, Glycine max
  Peptide Sequence Number=SeqID_195535
atggcaattgagcagcacaaggatgtggagagtggatatttgcaagagcccttcattcaaccagaggaggttgcttgtaaagaagttggatcagataagagtgtggaaaatggatccattggaatggttttgcttagcacacttgttgccgtttgtggttctttcacatttggaaattgtgtgggctattcatcgcccactcaagcggctataagggaagatctcagtctatctcttgctgagttttccatgtttggttcattagtgaccattggtgctatgcttggggctataaccagcggccggattacagatttcattggccgcaaaggggctatgaggatttcaacgggattttgcattactggatggttagctgtcttcttctcaaagggttcttactcccttgacctgggaagatttttcacagggtacggcattggacttatatcatacgtggttcctgtatatatagcagaaatagcacccaaaaatcttcgaggaggacttgcaacaacaaatcagcttttgattgttactggagcgtcagtctcattcttattaggaagtgtcatacattggagaaaacttgcactagcggagaggtataactgttggcttggtttgaactttgaagggttagtgccttgcatttgcttgctgattggtttgtgctttatccctgagtcccccagatggctggctaaggttggccgtgaaaaagaatttcaactagctttaaggagacttcggggtaaagatgttgatatttctgatgaagctgctgaaattctggactctattgaaactcttcgaagccttcctaagattaagctgttggatttgttccaaagcaaacatgtgcgctctgtagttattggggtcgggttgatggtatgccaacaatttgttggaattaatggcataggattctacacagccgagacttttatagcagctggactttcttcaggaaaagctggtaccatagcatatgcttgtttgcaggttccatttactgtattgggagccattttgatggataagtctggaaggagacctcttatgatggaccaaagcttaatgcttgagtgcgcaccgatatttgcagttgctggtgtgttgatctacatagcagcatattcaattggtgtaggaccagttccttgggtgataatgtcagaggtaggctcttgtaagttgtag

SEQ ID NO: 78758 - DNA, 267 bp, Glycine max
  Peptide Sequence Number=SeqID_195536
atgtgggagcacgttgatgaaataaacacgatgattggtagttcaggaactctaaaaaagttcgagaactctaagtgtggctcacaagttggccatgaaaacaagaagacaaaaatggatcattatgtgaatggattttctaatgagttgcaacaatacattctaaacattgttgatgtcacaccgaatggaaattgtaattacaagataattgcagctttgttaagccaaggtagggactcttggtctctcgttgccaagatttga

SEQ ID NO: 78759 - DNA, 204 bp, Glycine max
  Peptide Sequence Number=SeqID_195537
atggtaggtaattgggttgtggcgcaatggtggatttggtgtggtgtggaggtgcattgggtggttgcggtggtgttgttgggtggttgggtggaggtggggtgcaatgattgtggaggtttgggggagatagaggtgactagggtgttgcttgggagaagaaggacgtgcactgcttcatgggcttctgttagagaaacttag

SEQ ID NO: 78760 - DNA, 1155 bp, Glycine max
  Peptide Sequence Number=SeqID_195538
atggagcatgttggtgctctcctgcgctatgatgattggcgactttggcttcttcttggaccccttcataggccattgtggctatcgtcccaccacgtggaggcaatcactgtgagcccaactgggtgggcaaatgctgcaacaatagatgtcatctatgacttactacacatgatgggtcgtgatgatatcccagtcggtctaggtgatgcatttgcaatgaatcagtcagaccccatatttccaattgttggagattgcaagtatgttaaagccattccccacggaaatggtggacttttagactctgacactctatatggtcttgctcgtgatttgccacgtagccctagaaggtatacatctgaaaattctgtgaagtttggggctcctcgaaatacagatcaccctgaacttagacagccactggtcatggaaatttgggagtccatattgcaaacaatggaaacaggatctaaaattacagtattaaccaatggacctttgactactttagcaaaagttgtatcggttaaaaacataagctccagaattgaggaggtttatgtagtgggaggacacatcaaccggaatgtcagtgacaagggaaatatattttcagttccttccaaccaatatgcagaatttaacatgtttctggatcctttagcagctgagatagtgtttcaatcagatgtcaacatcacactcattccccttagtatccaacataaagcaagttcattttctagtatgttacactggttgcgtaggacagaaaaaacacctgaagctgtgttttccaagcgtgtgttattgaggctacaacgtctgaagcatatccaccatagatatcatcatatggacacattcttgggggaaattctaggtgcggttgtcctagctaatggccatggcccctcaaatctaaatgcaaaatttgaactcaagcccattaaagttttggcccaaggggatgagtccatagatggcaaaatggtggtagatgagaaacatggaaaattagtcagaattttaagccatatgagttccaaggcttatcataaaatgtttgcaaatagccttggtgattggaaccaatcggctagggtaggaagctttgaagatcaaagaaggaaatggagtcatccttaa

SEQ ID NO: 78761 - DNA, 1518 bp, Glycine max
  Peptide Sequence Number=SeqID_195539
atgactgccagtacagatctacctctacctcgccacgccagatgcaaaccttgcgcaatggagaatggcagggtggagcgcctccatgggggagtaacaatcagcgcaaattcttggactaatgctgggcatgctgtgaatcaagtttatgacatactttacatgatgggacaagatgacataacagttggaatgggaggtgagggtggcatactcccaaatggtaccatacttccaaatgtaggtggatatctttcaattatagaacagggaatgacaacaacaagaggttgtagatacaggcaggccattcctatgggcctccgagggcttttagatattgatactaattttggcattcgaaaagctttccttccacaggggagaaggaaatatacccccttaagacaaccaactgctcaacaagtgttgattgacaaaatatctacaggccccataactttgattatgttaggagcgcatacaaatgtagctattttccttatgaacaatccacacctaaagaaaaatgtggagcacatttacatcatgggtggtagtgtggggttaagaaaccaaacgggttgtttcccccaagatgcttttacctcttgcgtacctaggcaatgtgatggttgcggcaacgtgtacacaaattataaagctaacccctatgctgagtataatatattttgtgacccctttgcaacatatcaggttattcattctggtatacctgttacccttgttcctcttgatgcaacaaacacaatcccatacactaaagaattctttgatgaatttgaaaaaagtcaacacacgtatgaagtacaatattgtttcaagtctgtgaaaatggctcgtgatgcgtggtttggcaatcaattctataagaattattttatgtgggactctttcgcaactggtgtagcaatctcaagcatgagaaactccaataaaagaaataaagaggaaaatgaatttgcagatatggagtacataaacataactgtatttacttcgaacaaaccctatgggatatcagatggctctaatccattctttgatggcctcaaagttcctaaattcaatctaaaaaaagatggggtgcatagtggtcatgttcaacaagggcttagagatccattttgctttgtgaagaatgggaaaggaagatgtcaagacggttatacagctgaggtgaatggtcctgactcaatgaaggtacttgttgccactaaagcaaagcctaaccgggaagttaggaacccacttaacagagaatatttcaaaagcttcttgaatgttttaaggcaaccacaacatgctgggaggttcaacttcactacacaatttccttactataaagaagtaacttacatgccagattttcaaaacaaaacactagggaaacatgttgtgtttgacatggacatgagtgtaggagattttcttgctctattttaccttcttaaagtggatgttgaagtgataaaccttaaggtgttctacacttaa

SEQ ID NO: 78762 - DNA, 354 bp, Glycine max
  Peptide Sequence Number=SeqID_195540
atgtttccattgaggttttgggtagttgtggtattgattatgttaacaactcttggagttgctttggataatgtgatggccaagcctcgtcgaattcttttggatacagacgttgatcttgatgatgtatttgctcttatttaccttttgaagcacaacagatcagagttccaattggagatatataacactaatggtggtgacaatagaaattgtgacattggcgacaacaacaataagagtggtgacaacaatgatgacaatggtggaagaatggtggtgggggaggttgtcatggtgataataacaacaacatcaattatgatagttgtgatactgatggtggtatggtga

SEQ ID NO: 78763 - DNA, 210 bp, Glycine max
  Peptide Sequence Number=SeqID_195541
atgaagagcgatagacatagcacgtactatgtaatgagtacaatagtttgtgatctgacattgatgagggaacagaacctttcttgtcttagagttcattcaatatggtctacatttcaagaatgtctcacattgatgtatcttgactgggggcaaaaagaatccataagagtcaaattgatatatgagtgcagtgaacgtgtgtggtag

SEQ ID NO: 78764 - DNA, 911 bp, Glycine max
  Peptide Sequence Number=SeqID_195542
ttctcgctagctctgcgatcatgttcctctccttcacctacgatatgttcctcaacttcagaggctcagacacacgctttggtttcaccggcaatctctacaaagctcttcatgatagaggattccaaacattcattgatgatgaaaagcattggctaagcatgaggaaagtttcaaaagctaagaaggaaaggattgttgagtttttctccaccaagattaatcgtgctcctttacatgttgcggattatccggttggactagaggcacaagtgctagaagtaaagaaactcttcgatattggaactaatgatggtgtccacatgattggcatccatggaattggtgggattggaaaatctacacttgctggagcagtttataattcgattactgacaattttgatgagaagaaaattaagttagcaagtgtgcaacaaggaattccaatgataaagcataggctccagcaaaagaaagttctcttgattttagatgatgttgacaaacaccagcaattacacgatattgttggaagacctgattggtttggtccaggcagcagaatcatcatcactactcatggggttaaaagaacatatgaggtcttggatgctgtagtaacatatgcttctggccttccattggctttggaagtaataggttccaatttgtttggaaaaagcttacaagcatggaaatcttcaagcaaacaatataaaagaattctttataatcaaattgtagaaatacttaaaggtgattgcatgaaaaatcatactggcgtgttggttgaaaaatctctcataaagcatagttgggatgacacccttacattacatgacttggttgaggacatgggtaaagaacttgtcaagcaagatataattcaagttttggaagacaatacg

SEQ ID NO: 78765 - DNA, 555 bp, Glycine max
  Peptide Sequence Number=SeqID_195543
gcgtcacagggttcctttgtcccccatggacgtcaagatgtcctgactgttgccattgggcgacaagaacaccctggtcatgtgcgtgctgctggagccgagcctgaggttggtccttcaactgctcgtgttagcacaaaggagagttatgttgatccctcaggaaacgatccagacacaggtgactcagacaaatgcaggttgtacatcaaagaaaatcctccccgcctagttgccctaggaagagtttatgagggatccacaaccattcacaacatccccttgctgcatgatcaagtgaaggtcgatgttgaggaggttaaagatgcagatgctctcattcttgtactcactgaagatgttattttagtggggcaagcacttaacacctttcttgtttggccgacacatctcgtcaagcgagttgtgggaccagcaaaacctgcagataggccggatcatgaggtcgatgatccgttgtatctgatgacattgaccatcccacaactttttttgaagccgttgcaggttatgtgggatgctaccatgttcagg

SEQ ID NO: 78766 - DNA, 1029 bp, Glycine max
  Peptide Sequence Number=SeqID_195544
atgggtgaggaagcaaaacaggagcaagtacaaccagtggctgaagccaagcctgaggagaagaaagaagagaaggcagaggaaaagccagcagaggaaaagaaggaagaaaaaccagaagaaaagacagaagatgagaagaaggaagagcctaaaccaccttcaccatgtgtgctgtttgtggacttgcattgtgagggatgtgccaagaaaattgagagatacattatgaaaatgagaggagttgaaggagtggtaattgacatggctaaaaatgaagtgaccataaagggtatagtggagcctcaagcaatctgcaacacaatcacaaagaaaacaaagagaagagcaagtgttatatctccattgcctgaagcagaaggagaacctataccagaagttgtcaattctcaggttagtggaccagttactgtggaactgaatgtaaacatgcactgtgaggcctgtgctgagcaactcaagaggaagatactacaaatgagagttgtaatggagaaaggacagattgccaaatcagcagcacttgatgctggaccccatctagcgtggcattcttttgtgaaaattggagttcaaacagcaatgacagagtttagcacagggaaggttcttgtgacaggaatcatggatgcaaacaaactagtagattatgtatatagacgcaccaaaaagcaagctaagatagttcctcagccagaaccagaaccagaaaagaaagaagagaaacctgcagaagaagagactaaacctgaagaggagaagccaccagaggaagcaaagaaagaagagggtggtgagaacaaagaagaaaagggtggtgaagaaagcaaagaagaagccaaaaaagaagagaataatgtggtggtggtgccttacaataacattgatgatgaaggcttaaagaggatgatgtactattatcagtaccctccactctctgtcattgaaagaataccacctccacaactcttcagtgatgaaaatcctaatgcatgctgcattgtataa

SEQ ID NO: 78767 - DNA, 192 bp, Glycine max
  Peptide Sequence Number=SeqID_195545
atggtggtggttatgacagagatattaggagagtacacagcagtgctcacaagggtcacagaacgcctccttccgcgccacggcataagttttggtggtctaaggaggaaccttcgttttgcttcttccacaacctcttcttcagattcaacttcttttctgttgcagaagcttgaagtatgtccaaaataa

SEQ ID NO: 78768 - DNA, 408 bp, Glycine max
  Peptide Sequence Number=SeqID_195546
atggccaacatgcaaattgtcccagcttacaagactattgtggaggcacagtatgttgaaatgatggttccattgtactcttatggatgcgagaagaaaataaagaaaaccttatccaaccttaaaggcatatactcggtaaatgtcgattattatcaacaaaaggtgacagtgtggggaatttgcaacaaatatgatgtgctagaaaccgtgagaagcaagagaaaagaggctcagttttggaaccaagaagacaatgttgtattagagaaatcacaatcaccctcatcttcaccaccaccaccctttcctcacaaggattttaaaccctctttagctttaaccaaggttcgatctctgagtttgaaagcatggaagaaggtcttcactagatcatattctttctag

SEQ ID NO: 78769 - DNA, 531 bp, Glycine max
  Peptide Sequence Number=SeqID_195547
atgtggattgtggcctctggtaatcgattaccaaaggtgagtaatcgattacaaggcttaaaaattgaggacaggaggctaagatggtctctgatcgtgatggcggcacagctaattcgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcatgtcggcatctgaggcagactctacggaggatagcggcccgagggagatggcgatcagcggaggctcttcatcctag

SEQ ID NO: 78770 - DNA, 846 bp, Glycine max
  Peptide Sequence Number=SeqID_195548
atgggaagcaatgatagtttcggcgacaggattttcaaaacccgttcccatctggcggacgtcacgaatcgtccggcgaaaaggccgttttctttagtttctggcgatggcggggacttgcagttcacaaagctaattcgcttaggggtagaaaatttagcaaaagagaaaaaccaaatgcaattcggagcacaggctcaccttaacaacgtggtcctgttgcaaccaaaagaaaaacaccccattttgttgccgttttctgattcgcactcgtttcaagatcccatcttccccaaggagggaatggaggagcataatacgttggatttggagaattttaaatttggggagaaaggggaaggaattgtcgccactgatagtgcggttgaaagtgggggcaaagttatttgtgatgttgagaatttgggatctcccaagcgtgggactgagcaaatgccaacaatctctgcctctaatgattctaattttctgggattgaaaccgtgctcaagttctgttactgaagctgcggacgtgaaatcttgcacttgttccttttgctccaaagctgcttatatctggtcggatctccattaccaggatgccaaaggtagattaagtgctataaagaagagtcagaaagaggcaaaaatgattattcagaagttttctggattagaggatacaatcatgcatgaccagcaccgaagtgaggagtcgttgaagttagaattttcccttgtgcatcagtggaagtctctctttcttgaaattcagaatatgtatactcaagaaagtagccaacttgtgagttttcaatgctaccacttacatacatgggcttag

SEQ ID NO: 78771 - DNA, 2031 bp, Glycine max
  Peptide Sequence Number=SeqID_195549
atgcaaacaccaaactgcgaagccgagaggcgaatccagaggctaaccctacacctaaaccccacggcgttggtcgcggcgaagcagttggagatggcaacgtgcgctcgcgggaagctgagcgtggacacgccgtccttgtctagttacatgcgagggaaacacgtggacattcaggagaaggtgttcgattacttcaacgcgaacccgcgccttcaaactcccgttgagatctccaaggacgagcatcgcgacctctgcatgaagcagttaacgggactcgtcagagaagccgggattcgacccctccgttacgtagtcgacgatcccgctaagtacttcgccattttggaagccgttggaagcgttgacatgtcgctcgggatcaagatgggggtccagtatagtctttggggtggttctgttctcaatttggggaccaagaagcataaggataagtactttgatgggattgataacttggactaccctggttgttttgctatgaccgagcttcaccatggttcaaatgtgcagggcctccaaactgttgccacctttgatataatcacagatgaatttatcattaatacaccaaatgatggtgccatcaaatggtggattggtaatgctgcagtgcacggcaagtttgccactgttttcgctaggttgaaattacctacttatgacaaaaaaggactttctgatatgggtgtccatgctttcatagttccaataagggatatgaagacccatcaaccacttcctggaattgagatacatgattgtggtcataaagtcggcctcaatggtgtggataatggagcattgagattccgctcggtaagaattcctcgagacaatcttctaaaccgttttggagatgtctcccgtgatggaaagtacacgagtagccttcctacagtaaataagcggtttgccgctactctaggggaacttgttggtggtagggtaggccttgcgtattcctcagtaagcgtcctgaaggttgctgccacaattgccatcagatattctctacttcgtcagcaatttggacctccaaaccaacctgaagtcagtattcttgactaccagtctcaacagcataagcttatgccaatgctggcttcaacttatgcttttcattttgccacgacaaatctagtggagaaatactctcaaatgaaaaaaactcatgatgatgaattagttgcagatgtccatgccctttcggcaggtctaaaggcttatgtaacatcatacactgcaaagtcactcagcatctgtagggaagcctgtggaggccatggttatgctgctgttaatcggtttggtattttgagaaacgatcatgacatttttcaaacatttgaaggagacaacacagttctgcttcaacaggttgcaggtgatcttttgaaacaatacaagggaaagttcaaaggtggaactttcgcagtgacatggaactacttgagagaatccatgaatacttatctgtcacagccaaatccggttactgctcggtgggaaggcgaagaccatttacgagatcctaaatttcaattggatgcgttcagataccgaacatctagattacttcaaagtgttgctgtacgacttcgaaagcattctaaatctcttggggattttggtgcatggaatagatgtttgaatcaccttttgacacttgcagagtcacatattgagtcagtcatccttgctaaatttattgaagccgtgcagagctgtcccgatccaagctcccaagctgctctgaagctcgtctgtgatctttatgctctggatagaatatggaatgacattggaacctaccgaaatgttgactatgtggctcccaacaaagccaaggcaatccacaagctcgcggagtatcttagtttccaagtgaggaatattgcaagggaacttgttgatgcatttgatcttccggatcacgttacacgggcccccattgccaagcggtcaggggcctactcgcagtacacacaatatgtgggattttaa

SEQ ID NO: 78772 - DNA, 1098 bp, Glycine max
  Peptide Sequence Number=SeqID_195550
atgtctgctactttcaaataccaacctacgggacttcacggttggggcgcgccgagatcttcttctagaaatctcgcaaggttcttctcaatgcgattcgcgtgcaactctcgccaccataaaatattgcatgcttccgtttctcacccttcatcactctccatttctcacgactcatctaccgagactgagagtactttgatattgattcgtcatggggagtctttgtggaatgagaagaacttgttcacgggatgttgcgatgtgcctttgaccaagagaggtgtagaggaagctattgaagctggtaagaggattagctatataccggttgatatgatctttacgtccgcactgattcgagcacagatgacggctatgcttgcaatgactcagcaccaccaggagaaggttcctattatcatccataatgagagtgaacgggcaacagcttggactcaagtttacagtgaaaaaaccaccaagcaatctattccagttattacagcttggcagttgaatgaacgaatgtatggggagttacagggtcttaataagcaggagactgcagaaagatacgggaaggagaaggtgcatgaatggcgtcggagttttgacattcctcctcccaagggcgagagcctggaaatgtgttcacagagagctgttgcatattttaaggattttattgaacctcaactaaaatcaggaaagcacgtgatggttgctgctcatggaaactcattgaggtctattataatgtatcttgacagattaacttctcaagaggtcactagtttagagttatcaactgggataccattgctttacatatataaagacgaaaagtttaacagtagaggaagtcctgtggggcctacagaagctggtgtttatgcatacactcagaggttcaatcctccaccaggtctcatctcccttcactacttatgtgcttgctctgagtgttatacacatatggaaatcttaccaagacttcctctttgcatatgcaagggtaaggctgcgtacaacatccctcccccataccttcgcatagcgaagagcctctgggcaatggggtacgaagtgaagtga

SEQ ID NO: 78773 - DNA, 402 bp, Glycine max
  Peptide Sequence Number=SeqID_195551
atggaccgctatgccaactccgtcgcaccacaggatgaccacctctactgtagtagctcatggccttacgacatcgtcacgccaaagtcgcatgagggagggggagggagtgggcgtggcgtgcatgaggtcactggcatcgcccttcactccaaccttgccacggagcgcctccacctcacgttgctcgcgtactttgctgttgccatctctatccttgacgccttcaaggcagggttggaccctgtggcgctctctgtcctcatgtccttcatggccatcgccctccctctcgtcccgctcgacgacatcatcgcaatggagtcgcacaaggctgctaagatccttgtgacggtgctagccagggatgggaagggattgggtgtggtgtggtgtgcgtga

SEQ ID NO: 78774 - DNA, 1350 bp, Glycine max
  Peptide Sequence Number=SeqID_195552
atgtcttcgtttacgggtgcacgttccaaagcaaatgctaactctgaaatgaccaaagctaacgacactaacctttgccccatcaacacaagtaccattacatcaacctcgccagatacaagtgccaagaatgataagaaaaagaagtctatccttccaaagattttcggatcaaagcgaaatgggagaggttcagacgaagagacactcaaatcatcaagtgcagaagaaggagacggagttactcttgatttggagaataaaattgagacgagaagaaaagcatttttggaagcggcccccatcatgagaaaaagtttctcagaaagggagactagtcctgggatcgaaggcctaaatttgtccaattttgaacggcctatgatgactccggaaactgaacttcagagtttcaggatcttcgttgcaacatggaatgtgggaggaaagtcaccaaattatgatctcaacctccaagatttcttgctagtggagggctccgcagatatatatgttttggggacattaggaaagtcaatgactacaacaaaacatagaaacaaatcactattgatatggttagtaatttcgagattaaaggaaatagttcctctgagtgctgggaatgttttagtaattgaagacaatgaacctgctgcaaagtggctggcattgataagtcaagcactaaacggaccaagaaatgaatatagtgattcttctgactcgggaactggctccaaaacccatagtagttcgagggagttaaagtccccagcaagtttgaatttctttcagaagccttctcttaaagttatcagtaaaagcttcagggcagagggtagtagcctccttaaggcttgcaattgtcctgtggaatctccatcgagggagagacggaggatgagaaagtttagtgaccctatgagtaagttagattctgagcttcgtggtgatgacactgtcgaagagttgctttcaattgcagaaataccctcttctcctagccaaagcagatactcccttatatcaactaagcagatggttgggatttttctcaccatttggactaagaaggagttagtgccacacattggacatcttagagcagattctgttgggagaggaatcatgggttgcttaggtaacaaggggtgtatatcaatgagcatgtcattgcatcaaacaagtttttgtttcgtctgtagtcacttggcttccggggagaaagaaggagatgagctgaaaagaaactctgatgtggctgaaatccttaaaagcacacaattccctaggatttgcaagaacccttgtcgtcgagcgccagaaaagatagttgaccatgagtga

SEQ ID NO: 78775 - DNA, 1389 bp, Glycine max
  Peptide Sequence Number=SeqID_195553
atggtggagattcacgaagaaatcgacccctttgatcaagaagaacatgaagaggaagaaaccgactatgatcagctaaagaagcggatgcagaaggatcggatcctgctgcagcagatgaaggagaaacgccccaaagaagaggcaggccaacaagaaaaacaagaagcatctaggcggaagaagatgtcaagagcacaagactctatcctcaagtacatggtgaagattatggaggtttgcaatgctcaaggttttgtgtatggtattgtccctgagaagggaaagccagtgactggttcttctgacagcttgcgtgagtggtggaaagaaaaggtcaaatttgatcaaaatgcaccaggcgccattgcgaaatacatgccactccttgaaacagatgagttggatccaagttcctacatacatctccttaatgacttgcaagacactactctgagttcactactttctgctctgatgcaacattgcatacctccccaaagaagattccctcttgagagaggcttggctccaccttggtggcccagaggggcagagaattggtggggtgaacaaggctttctggcccatgaacatggcccacctccttataagaagccccatgacctcaaaaaggcttggaaagtgtctctcttggctgcaatcatcaaacacatgtctcctaatttggacaaacttagaaggttggtgactcagtccaagactttgcaagataagatgacagccagggacacagcaacttggtccaaggtcatgaaccaagaagaaacactgctgcaattggccaataaatgcctcagaatatctccatcatcagaggaagatgaaaacgagtgcgaaagctccactgctagtactatcatccatgaaggtggcaacattattgagaaaaggaagagtgacctgtttgacttagatgctgttgttgataagctatatgcttgtcaatactatcagtgtccacaaagtttaacgggtatgggatttcttaacaaaaactcaaggatgaaccatgagtccctctgtgcttaccgcactaatgaaagccaatctgttctccttcaggattctcagtccaatgacacacaaattgcaagtgtggatgattggatgatgaacttggaggcagcaagagctaaccagaatgagaataaccaccctgttggccatccgattaacgatcagtttagagatattgcaggaaagacatcagaagaagattatggatgcttatggccaaagtcccttgaagatcttgatttgcaagctgcactgaatcagatggacatggacttgaatccaaatccagagcaagatacaccacagggccaagaagtaacctcaatttgggacttaccctacaaataa

SEQ ID NO: 78776 - DNA, 165 bp, Glycine max
  Peptide Sequence Number=SeqID_195554
atggaggtcccgtgggttcctatgaagcttttgttgagttttgaagaaaattggggaagatggggtgaaatttggcttcacccctccccccttttttattttttgtcagaccttgctcgcccaggatcccttgatgataagatgcagatgcatgcatgtttatga

SEQ ID NO: 78777 - DNA, 114 bp, Glycine max
  Peptide Sequence Number=SeqID_195555
atggcaatggctccaaaaaagcttcttactaaaagggctaggaagaccaccgcaggggagggatccagtgcagccccgcaagcggagattgagtttgacagacactgtttctga

SEQ ID NO: 78778 - DNA, 216 bp, Glycine max
  Peptide Sequence Number=SeqID_195556
atggaaaagaaaagtgtgtacgcgtggcaggagaatggagtggccaagtatgcgttgcttttgtcgccgagagtatgtgggcccaaccgtgaaaggaagagtcttgaagtccacgctccagtggagttggcgtgtggacacgctcgcaaattgttggtgggtcacggcctgacaagagtcctagggacacgtggttcaaagttaatatgggcgtga

SEQ ID NO: 78779 - DNA, 426 bp, Glycine max
  Peptide Sequence Number=SeqID_195557
atgtctccttatcgagttttctttggcgaggcatgtcatcttcctgtagagatagagcacaaaacctactgggctgtaaagacctacaacttctctattgatcaggctggagaggaaaggaagttacaactaagtaagctagatgagatccgtttagaagactatgagaattctaaattctacaaggagaagaccaagaagttccatgacaacttgatagctaagaaggacttcgtggttggacagaaagttttattgtataactctaggctcggactcatgagtgttgagatcaaaagtgaatccacagataagagcttcaaggtcaatggacaccaactgaaaccattcctcacaaatccctccttggtggatgtagtggtggaggagacctccttacttcaccctacttctcttccatcatga

SEQ ID NO: 78780 - DNA, 171 bp, Glycine max
  Peptide Sequence Number=SeqID_195558
atgcaggcactgaggaaggaacctttgaccgtttatggggatgggaagcagactaggagtttccaatatgtttctgacttgggccgaaggctacaccgtgtgttaaggcctagatcagtaccagtgagattactggtggaggggctgatgcgccttatggaaggagaacat

SEQ ID NO: 78781 - DNA, 1383 bp, Glycine max
  Peptide Sequence Number=SeqID_195559
atgaagcacaaccttgtattcaaccctgtcaaatctgaaaaactggtccattggaaccaaagtggtgattgctgtcagtggaatggagtaacatgcaatgagctggggcgtgtgattggtcttgatttaagcgaagaattcattactgaggggctagacaattctagtctgaccttccttccatctgcgatatcttttggcttgctgaaaaatttgaggtacttgaatctgtcaaatgctggctttgaggggcaaattccaattgagattgctcttctaacaaagcaggctactcttgacttatctacttcatttaatttactgcatagtctaaaacttgagaagccaaacataggaatgcttatgcagaacctcacagaaatcacagaactctatctggatggtgtaatggcatctgccactggaaaggagtggtctcatgcattatcttcaatgcaaaagcttcaaattttgagcgagtcatcctgtaacctctcaggaacaattgattcttcactatctaagctagtctcccacaattgtgcattaactgatgtttttcctaagggtatcttccaaatgcaaaagctaaagatccttgatgtgtcatataatcaggatcctcatggttccttgccaaacttcccacaagaaggatatcttcaaaccttgagtcttagcaatacaaatatctccggacagttaccaagtactatttccgatttgaagcacttggctatagtagatttatatggctgtcaatttaatggaacactcccagtttcattgtcaaaactctcccaactttttcacatggacttgtcattcaataacttctctggccctctaccatctctcaatatgtccaataatctcaagtatctatcccttttccaaaatgctctcacaggaccaatcacatccactcaatgggagaagcttttaaacctcattagcatcaatttcggcgataactcctttagtggaaaatttccctcaaccctattcacacttccatcactacaagagcttattctttctcataatggatttgatggtgtgttggatgaattcccaaaagtgtctttctccaatttacagtctgttgatttgagcaacgacaaattgcaagggcctattccaaagtcatttctccatctaaaaaatcttggttacctccttctctcttcaaatcaattcaatggcactatatggctagatatgtttcacagaatgcagtatctgcagacattaggcctttctcacaacaacttgacagttgatatcacttctagtggagatcatggcctttcagcatttcctaacatgacaaatctgcttttggctgactgcaacttaaggaaatttccatctttcttgtaa

SEQ ID NO: 78782 - DNA, 1260 bp, Glycine max
  Peptide Sequence Number=SeqID_195560
atggcagcacccttcacccaccttttgacaaaggagcaccttgagtggtcaaaggaggcccaatttgcttttcaacaattgaaggtggcagtaaacacattgccagttttgctcctatcagatttctcctcacccttcatggtcgagactggtgccttaggaacaggaatgggtgccattttgtcacaggacgaccaccctattgcattcttcaataagccattatgcataaaacttttacatgcctctacttatgttcaagaattatatgccattatcatcgcaatcaagaagtggaggcagtacttactaggtcattcctttgtcattctgatggaccatgggagccttaaggaactcatggcccagctcatgccaaccccagaacaacaaaaatatttacttcacttaatgggttacgatttcaccattcaatacaggtccagcagaaccattgtggtggcagacgtgctattgcggattcctgagttttcgtcggggatagacattaagcgtgaaatatccaaacacctagagtttatctctctgcaaaaggaattaagggacattaccgtggcttatctggaccataccctttcagaggacttgatattgcagaagggtcgtatatggttacctagtgatctgaaatttattcctttgctattacaggaatttcattcatctcctacagggggccacatgggcatcactaagacattagctaggttgcaggagaacttcacttggcaaaccattagaaagggtgttcaccaatttgtaactcattgttgtgattgccaacacactaagaatgaacctgccaaacttctagaaccttttctaatttcggctagatcgtgggaagatttgtccttagactttattgtgagactcccttcttataaaggcaacactgcaattttggtcatggtggataaatttccaaagttattgaaccgcattatagagcaatacttatggtcctttgtgcattctaaaccatcaacctggggtaagttattatcatggatagagtggtcttacaacacttccaagaacgcgagtatgggtgtttcaccattcgaagtcacttttggaaggaaaccaccagttgttcctcattacatagtaaaaactttaaacttggatgtcaccaaaactttgttgacaaacagggacaaggaatttgaaaggttgcgcaggaagcttctcaaatcacaagaacgaatgaaatattttactgatctcactcgctag

SEQ ID NO: 78783 - DNA, 270 bp, Glycine max
  Peptide Sequence Number=SeqID_195561
atggagtctaccacgactctgacgccgaacagcatgatcttgtcggagacgacggagttggcgattcttaaaatcgaaatagcggcgagtatagacagggaagagaaagaggcagagagagggaagagaaagaggcagagtgagggaaagcggaggcaaggaaggggaagaggtagagggaagagaaagaggcagagagagggaaagcggaaatgtgcactgtcggaggagagagagagagagagtcacaacaggatgaaaggtatataa

SEQ ID NO: 78784 - DNA, 1662 bp, Glycine max
  Peptide Sequence Number=SeqID_195562
aatcttaacaacagggaatctgtggagccacgctggaggcctggtaccctagggcggggagctaggggtggtcggggaaatttttcacctcataatgcatcacatgatgctgctggtagcaagaattctggtacaggaaaagataatggaactccacaagcaactgagaaagttgtgccacctttgtcagcttctcaagagaaaatatctaaagaaaaaagttctggaacaagctctgtacccattaatgccaatggtccgacaagcgtaacttctggaactactagtggtactagtccttccccttcatctgctggaactggagacagattgggtccatcttcttgcgatattaataatttgaatagtgctttgccttctgatagttcaaataaagttgcaacagttgcttcaggaagtggatcaatgctttcctccagtaaccaccctgcatctggaccagcatcttcatcggctgcccatttctcttcttcagacccagtactggttccatctgatgatttatggtttcctggtgctgttggtgctgttggtgcaattagatgtgaagtgggaaacttacaccctcctggggaattacgtgctgttagctctgctgagaacaaattaactgctgcttctgagactggtagctcttctgtgcaaggaaagattcaaggcaaatcccagggagcagcaaagaatcatgttactgagatgtcatccacttcaacagtaactcacagtagcccttcaactagtagaccttcctctaattacagtagccgatcacaacaattagttggccctcaaaaagctggttctaataaggagtggaaaccaaagccaacaaatacgattaatcagggttctggaccagctagtgcatctgaggttcttgtttcagttgactcaactgggcagttacaatctgcatctagtgctcttaactctgaagaagctacttcaaaactgcagaggaagctggaggattttcatcttccacagcgtcaacatgttatacttccaaaccatatcattgtgcctgattctgaaaagaacaagtttagctttggaagtttgggagttgctttgggagttaatacaagctatgtaagtggcccagagagcgaaaagagttctacacctgtttctgaaacatctcagactgttgaagaaactgtggaggagcaggattccagtcaaaatgctgcggttatttctgaggttggagattatcctgaccatccacaatcacccactaatggagctgagaatttgtcatccagtgaggttgatggctcatccagtgctattcaagagcataacgagtccaagcaagacactgctttgccatctggaggtcatcagtactcaggggtacttacttctccaaactacagttttggattcgtgcccccagtgttgggtactcagctaacacagtttgacaattctgagtctcaaacacgtgatgcttcccggcttccaagttttattgttcatcaacaattggatccggctagttactatgcccagttttaccgcacaggtgctgatagtgacggtcgcctttcacctttttcttctgctggggctaacaccaagtacaatggcaatgttacagtgcttcctgctccaacttctcaatctcctcaagag

SEQ ID NO: 78785 - DNA, 114 bp, Glycine max
  Peptide Sequence Number=SeqID_195563
atgaacaacctctcgcagtacaagctccttcgcgacgccgctggaaacggctctgccaacgacgcagctccgatcgactccggcaagaaccgtggctgcaagcgaggaatatga

SEQ ID NO: 78786 - DNA, 1392 bp, Glycine max
  Peptide Sequence Number=SeqID_195564
atggcagattccacacgttttaaatccaccttagatcgtctcgaagatgccatcgcaaaactcacctcctcgcaactaaaccttacggtcaaccaaaccaccatgtccactaagctcaacgacctcacacaaaaaatgtccttcctcgaaaccaaccaaccctcaccttcttcctcatcggccaaccccactttctcgcccccatcatcagccccgtatcgtatgaagctcaaagtgcctcaatttgatggctcagacccactagggtggatcttcatgatcacccagttcttcaattaccatgtgaccactgatagtgaacgtttgacgattctctcattttacatggatggtccagcacttgcttggcccttgttcactcacaaaggtaccgtcattgactatctcacggagtttgaagctttggccaaccgaatcattggtctccctcctccctttctacttagttacttcatctcgggcttgtcgccggacattcgtcgtgagatccaagctctacaacctctcaagttgcttcacgcgacagcattagcacgccttcaagaggaaaaactccttgatttgtgtcggttttttcgcggtcacacctcttcccaaggcttgttcgctcctcgactacctcgccaagccttatcttcgtccttgttgccaccaccacccttactgccaacaccacctaaatcgaccattccttataaacgctttttgctggaggaattggcaatgcaacgtgaaaaggggttcttcctcttaatcgcggacgaggacgagccaccaccaggggattatgcaccatcagaggaccataaccttgaacccgaattagatgacccatctcgagcccaaatcagctttcacgtgattttgggccatgttgctcctgacaccttatggttagtgggccgcatcactaatcaaaaggtgttgatattaattgatgggggtagcacccacaatttcactcaggaacgtctatttgaagcattgggcctgcgtacccagcccacttattcattacgattcacggtgggtaacggcaatgagctcgactgtcttcacttttgcggcaatgtctccatccatgtccatggacatgtcttcaccattgattttcacatcctgcctctgaggggagaagacctcattttaggcattcaatggttgaagtcacttggtcccattcttatgaactatagtgacttaacaatgcggtttttcacgaaagcagggttattcaactacagggcacccatgacagggacctcgactctgtcaacactaatctgcttcaacgaatggtcaagacagatagcacaagcactttcttccatattcgagtcacagagctcccttcagaccaaactccattag

SEQ ID NO: 78787 - DNA, 210 bp, Glycine max
  Peptide Sequence Number=SeqID_195565
atgatattggaaccaggttgtgttgagattgtggaaattctcattcctggtgggaggatacgatttgtatgcatgtttgtgctctctatcgtcaacatggttggtgtgcttgggatcttatgtgcagtactgttggcatctggtttggaaggtttaggttggttggtggggaaggattttctggtgccccctgtcttacctgtaaagtga

SEQ ID NO: 78788 - DNA, 459 bp, Glycine max
  Peptide Sequence Number=SeqID_195566
atgattggtagagaggctgaaaatcatgagaagtacggtactttattgtttgacatgtttgataatcttgagaatatgcgttacaataatttgctctcagtaatcaacaagtttcttgtaacgaaattgtacaaattgttagcaactgaaccttattcagtggctgatcacatgtttgcttattatatcactaataacgaatttggtggtcgctacttggattctgttacagttgtgaacaaagctttgcaaatgaatttcatcaaaattcccactatcttcacttcaatggatctctcctcctaccattttgaaggtccaaaatctcaagaagttaggtggggacttttctattggcagcatgttgatgacttgctttacatgcttgttcctcagtttggttttgtttatgaacaacatagagggcaaagatacagagctctgaggtggatagtgtag

SEQ ID NO: 78789 - DNA, 216 bp, Glycine max
  Peptide Sequence Number=SeqID_195567
atgccattgatggagaagatccaaggcctacaagctccacatggagctacatcacatggaacaccaaaaatcattttattaaaaatgagtcaaaggatgaagaattctgcatctagggcatatttatcatcatctaatccaaaaacaccggttgaagaatatgaatctgacacaccgtctccaattgtccgtccaatgggggtcaaaagggagtaa

SEQ ID NO: 78790 - DNA, 579 bp, Glycine max
  Peptide Sequence Number=SeqID_195568
atggctcaatcaaataaaagattcgtctatgaagaagtcaagaaagccattgagagagatagatcaatggtgaaggtctctgaattgtctagacatggacttatggaaataactcgaaagagggttcgaccaagcgtgacattcatggttagtgaaccatgtgcctgttgccatgccacaggccgggtggaagctttagagacgtccttctcaaagattgaacagcaaatctgtcggcttcttgcaacaatggaccaaaaggcagaccctgaaaaacccaagtcgtggccaaaatttattctgagggttgaccatcgtatgtgtgagtatctgacttcagggaaaaagacaagacttgcaacattgagcagttctctcaaagtctggattctcttgaaggttgccagagggttcattagaggatcgttggaggtcaaactatttacagatgacaaggtggaaaaaaaccagcataaagttgccatttcaatgttaagatcctcagagaccagaaccaaaaagcctggccaaaacgtgactcttgttcaagttaaaaaatcaaaggctaggggaaaataa

SEQ ID NO: 78791 - DNA, 285 bp, Glycine max
  Peptide Sequence Number=SeqID_195569
atgaaagggttgttgcataattgttggggtggtgttacaaggatgaagcatcactttgctggaacaaaagagaatgactgggtcacagcatcacgcaaaacccgacctggttttggggcacaacctgcttgcgccagaatcacacaattcatgaacagcaagcaattcatctgggattcctgcgattcatcacccaattcaagcaccaaaacgattcaggattcacagcacgatttgtatcgccaactccttgaattgaatcaaatcaaatgtatcgtattgtga

SEQ ID NO: 78792 - DNA, 636 bp, Glycine max
  Peptide Sequence Number=SeqID_195570
atgagaatccatcaaatcttctttaatatttttatactattgtgcttgataaacctgaacatcaacatcgacgtagcaacatgccactgtcttgaccatccgcaattcatgttacttcacttgaaggacaaccttgtattcaaccccgccacgtccaagaaattggttcactggaaccatagtgggaattgctgtcaatggaatggagtaacatgcagcatgggccatgtaattggtcttgacttgagtgaggaatttatttctggaggactaaataattccagtctcttcaagctgaaatatttgcagaatttgaatcctgcttacaatgatttcaattcctccattcctctggagtttgacaagctcaagagtttgagattcctgctcaggaaaaatttaacaacacttgacttgtctacatctgcctcacaacattttcttagactccagaatccaaatattggaatgtttttgcagaaccttacaaaactcacaaaactatatcttaatggtgtaagagtatctgctgagggaaagaaatggtgtcatgctttatcttctcttcaaaagctcaaagtgttgaacatgtcattgaaggaaaaagggtgttcaaaaacatattttgtgaaataa

SEQ ID NO: 78793 - DNA, 405 bp, Glycine max
  Peptide Sequence Number=SeqID_195571
atgaagaagaagaagaagaagaagacgcagttgctggtgttgggggaaagtgttatgctatggtgggtatctgatagtgtcaaggttgaacgagttcataactcgaaacagagtgagagggaaaatgaatttaaactagataaagctagacatggcaatgaaacccgtacccgtaggtatccgctcaaattcgtcccaattttgacagagaatacccgagttgatcgggatctaagccggggacgggaatacccgatacccaatgggtacggggacaaggtacaagtatatgttgaaagtcggggactaaggagacaatacctatctccgccccctgccccgttgtcattaggggtgaaaatgagcaagtcaagccaagctttactaggtttgagctcggcttga

SEQ ID NO: 78794 - DNA, 123 bp, Glycine max
  Peptide Sequence Number=SeqID_195572
atggctatgctagaaccacctgcacctactgatgtagacatgcctcaacatgcagtggagactttaccatgcaatagcaaaaaggtaggaacgcttgatcaacatgagggtagttactactga

SEQ ID NO: 78795 - DNA, 1277 bp, Glycine max
  Peptide Sequence Number=SeqID_195573
gcagtttaaagatgggttacttatgtgatttttgtggagaccagaggtccttggtgtactgccgctctgattccgcgtgcttatgtttgtcatgcgatcgaaatgttcattctgccaatgcactttctaggcgtcattcgagaacccttgtatgcgagagatgcaattcacaacctgcatttgtgaggtctgttgaagagaaaatttcactttgtcagaactgtgattggttgggtcatggtacctcaccgtcttcttcgatgcacaagaggcaatcaatcaattgctactctggctgcccttcagcggcagaattttcttcaatatggtcctttttcttagacatcccttctttgggtgaagcatgtgagcaggaactaggtttgatgagcattaatgagaacattcctccagaagggcagaatgtgtctggttcaactgaagtgactgatctacccagcaagggtaaatcttgggctggcacaccttcaatacctgagtcaagctcagaacctcgtattctggaccagccgcctggacctgccaatgaatgtgtgcccaagttgtactgtcctgggaagaaagcttctggaatatgtgaagatgatgatctatatgatgatttcatcatggatgaagttgatctagaacttgagaactatgaggaactttttgggatggctctcagtcactctgaagagctttttgaaaatggtggaattaatagcttatttgaggcaaaggacatgtctgctagtgctggtgattcccattgtcagggtgctgttgctgctgaggaagacggtgaggtcggcttcatggatcacatgatgtcattcgacccgggatcgtctgctgggttggtcaatcctatccaaccagcatgcagcaatgcagcatctgcagattcagtgatgagtacaaaaactgaaccaattgtttgttttacggcaaggcaatctcaatcaaacatttccttttctggtgttaccaaagatagtgctggtgactatcaagactgtggtgcttcttcaatgcttctcatgggagaacctccctggtgtcctccttgccctgagagttctctgcattctgctaaccgaagcaatgctgtcatgcgctacaaggaaaaaaagaagacccggaagttcgagaagaaagtaagatatgcctctcgcaaggctagggctgatgtcagaaagcgtgtgaagggccgatttgtcaaagctggtgatgtctatgactatgaccctttgaaccaaaccagaagctactga

SEQ ID NO: 78796 - DNA, 543 bp, Glycine max
  Peptide Sequence Number=SeqID_195574
atgttccacaacgccccagacacctcgccacggatcgcgcacacaagccgtcgattaacaaccccccccccccccccaccccccccgaacggccacgatgaaagcaacaaacctactctcgattcataccccgcagtctttcccgctcgaaataaataccccattcccatcatcaaactcaaaatcacaatccctaattccccaaaattttctctgaagaagaagcaacaatgtctggtcgcggaaaagggaggcaagggtttgggaaagggtggagcgaagaggcatcgcaaggtgctccgcgacaacatccagggaatcacgaaacccgcgattcggaggctagccagaagaggcggcgtgaaaagaatcagcggcttgatctacgaggaaaccaggggtgtgctcaagatcttcctcgagaacgtcattcgcgacgccgtcacctacaccgagcacgctaggagaaagaccgtcacggccatggacgtcgtttacgcgctcaagaggcagggaagaaccctctacggtttcggaggctga

SEQ ID NO: 78797 - DNA, 924 bp, Glycine max
  Peptide Sequence Number=SeqID_195575
atgatgcaattccatcgttccctaagagcacaaccagtgccaacacctattatacctgagaagaccacagaggagcctttgcctagcaaagttgcacaaagcaccgtgacatgtttctaccaagccaatgttgtgggcttttggcggaatgtatcgattttgtggtgcaaacatctcatgaaccattccttgcatgtcacagttgatagtgtaggaggtgaggtgcaatatagctgcaagattgacgtgaagccgtggcacttttggagcaaaaaagggtacaaaacctttgaggttgatggcaaccaggttgagctctattgggatctccggtcggctaaattcgccggctcccctgagccgagcagcgattactacgtggccttagtctctgatgaagaggttgtgttgttgttgggagactacaagaagaaggcttacaagagaacaaaatcaagacctgcccttgttgatgccatgttgttggtcaagaaagaaaacgtgttcgccaagaaaagtttctctacgaaggcacggttcgatgagaagagaaaagacaatgagattgttgtggacagcttaactgggggtcctagtgaccctgagatgtggattagcatagatggaattgtgctgattcatgtcaagaacttgcagtggaagtttagggggaaccaaacagtgatggttaacaagcaacctgtgcaagtgttttgggatgtgcatgattggttgtttagtggatcaggctcagggcctggccttttcatcttcaagccagggcctccagaagctgagagtgagaaagaaggtagtgctgtggagggttgtgagagtgatgatggcagtgttggatatttttcaactatgaatattgctacttttgaattctgcctcgttctctatgcctacaaaattgagtaa

SEQ ID NO: 78798 - DNA, 1377 bp, Glycine max
  Peptide Sequence Number=SeqID_195576
atgaagaaaacacctccccccaatttgcatcaatctagcaaaagtagacagaatgctaatctccaacttgttgaaacaaacaatgatgcaaagaggcacaattctaagacattgagatctttgaagtatgctgccaagaaatgtgtagctgttttttcattgattatctatggcaaaagaaaatcagcctcatatgttgttggcaatgatgacaggaagaatacatccaaaattagaggggtggtatcatcatcaactgatttatcatctgagagtaccaccaagaattcatcaaaatggaagttttcttactcctatgcatcatccagcactgcaagtggacaacttggaattggcaacttctcctttgaagaaatttacaagtcaacggcaaaattctctccagttaatgaaattgggcaaggtggctttggaactgtctacaagggaaagcttaatgatggatctattgtcgctgtgaagcgtgccaagaaggctgtgattcagaatcacttacatgagttcaagaatgaaatatacacgttgtcgcaaattgagcatcggaatcttgtgaggttgtatggatatttggagcatggagatgagaagattattgttgttgaatatgttggtaatggtaaccttcgagaacatctagatggtattcggggagaaggactagaaatcggggagcgtctagacatagcaattgatgtagctcatgcaataacttaccttcatatgtacacggataatccaattatccatagagacatcaaagcatcgaacatcctaatcacggagaacctaaaggccaaagtggcagattttggttttgctcggttgtctgacgatcctaatgcaactcatatttcaactcaagttaaaggaacagctggatacatggatcctgagtatcttagaacataccaactcactgaaaagagtgatgtttattcctttggtgtattgcttgttgaaatgatgacaggacgacatccaatagaaccaaagagaccagttgatgagagagtgacaatcagatgggcaatgaagatgctgaaacaaggggatgctgtatttgccatggaccctaggctgagaagaaattcagcctccatcaaggcagtaaagcaggttctcaagctagctctccaatgcattgcgccttcgaaacaatcacgtccgcctatgaagaattgtgcagaggttctgtgggacatccgcaaaagttttagagatgaagccaattctgatcatgctccccttccttctcaccattctgcaaactttcctcaaagagaaaagaatacgtttggtatggaagaagatgacagctataaatttgtctctgtacctaatcatattcgttcataa

SEQ ID NO: 78799 - DNA, 432 bp, Glycine max
  Peptide Sequence Number=SeqID_195577
atggatgaccctttggagaagcaatggcatattagtttaaggattcaacgctatatatcaaatcaaacattaaaaaaggaagagaaagtaggtgctatgactgatgatgttaatgagctccagcgccacgaaacacgccgtggttcaggagcagcacatcgatgggcccgcattgtccaccgcgcgcttcaccgtctcgaagtcccgcacgtccgccgccacctcgatccccgtggagaggcggatcgcgttgcgcgcctcctccagcttctccggcgaccgcgcaagaatggagacgtgcgtgcccgtgatgaacacgtggcggttcttgatcgggatcttcacgggagaaggagaaagagaacgaagaaggcgaagttcgcgtccgccattggtgacgatgcacctttgaaactgtaccaagtgaactaa

SEQ ID NO: 78800 - DNA, 1521 bp, Glycine max
  Peptide Sequence Number=SeqID_195578
atgggtatctatgccaagtatggatgtattgagcttgccaggaaactatttgatgaaatgcctgataggactgctgcagattggaatgtcataatctctggatactggaagtgcgggaacgaaaaggaagcaactagacttttttgcatgatgggagagtcggaaaagaatgttattacttggaccaccatggttactggacatgcgaagatgaggaatttggagactgcgaggatgtattttgatgagatgccagaaagaagagtggcatcttggaatgcaatgctatcaggatatgctcaaagtggagcggcacaagagactgtaagattgttcgatgacatgctaagctctggaaatgaaccagatgaaacaacatgggtaactgtcctgtcatcttgctcgtctcttggtgatccttgccttgccgagtcaattgtcagaaagctggaccgaatgaactttcgttcaaattattttgtcaagacagctctgcttgatatgcatgcaaagtgcggaaaccttgaggtagctcagaagatttttgagcaattgggtgtgtataagaattctgtcacttggaatgccatgatttctgcttatgctagagtaggtgatttatctttggcaagagacctttttaataagatgccagaaaggaatactgtctcctggaattcaatgattgctggctatgctcaaaatggcgagtcattaaaggcaatccagctgttcaaggaaatgatctctagtaaagattcaaaaccagatgaggtgactatggtgagtgttttttctgcatgtgggcaccttggaagactaggtttaggcaattgggctgtcagcatcctccatgaaaatcacatcaagcttagcatctcaggatacaattctttgattttcatgtacttgagatgtgggagtatggaagatgctagaataacatttcaagaaatggcaaccaaagatttagtttcctataacacattgatttccgggctagcagcccatgggcatggaactgaaagcatcaagctaatgtcaaaaatgaaagaagatggtattggaccagaccgcataacatatatcggtgtgttaactgcatgcagtcatgcaggattattggaagagggttggaaagtttttgaatcaatcaaagtccctgatgtagaccactatgcatgtatgattgacatgctaggtcgagttggtaaattagaagaagctgtgaaattgattcagagcatgccaatggagccccatgctggaatttatggatctcttttaaatgctaccagcatccataaacaagttgaacttggggaacttgctgcagctaaactgttcaaggttgaaccacataattcaggcaattacgtgttgctttctaacatatatgctttggctggtaggtggaaagatgttgacaaaacaaaggacttgtctgctagtgatggtgattcccaatgtcagggtgctgttgccgctgaggaactcaaatctcaccatcctttcctgtga

SEQ ID NO: 78801 - DNA, 510 bp, Glycine max
  Peptide Sequence Number=SeqID_195579
atgtcgtcgccaagcgcgtcacgcacacccctgccgatctcgccaaaaacggaattcgtgagcatgattgttgaaggaggtgtcattttagtgttggttaagcaacttcaagtgcctcctttgactctgtccaaaacaagggaatgctttcgcacttgggcttctcattgtctagggagatgggggtgttttgataatctgatgttgatggtgggaaggcatggcagatttggtgtgggaaaggttgcacccgtaagaggacctgagtccccaggatcagtgacacacgcgacggagagggaggaggtaggtggcgaagtgcagcacaaatgttgtttaatgttggcaaaagagagaattcaggatcataacgacacaagaagaaccattgacacaaaccaccatcgtttccatatggctgaagtcgaaaagaagaaaagtcaccagaagttgttgcctctttggtggaaaacccacatggttagatctgaccacaaaactcaaatctaa

SEQ ID NO: 78802 - DNA, 591 bp, Glycine max
  Peptide Sequence Number=SeqID_195580
atggctgcacctagcaacactcaagaagttaaacaatatagcaaccagcaacaagcaacccctatagatcgtcttcgtcttggtgggttggaaaaaggcaagacaaagaggatggagaaggtgagagagatgctgagactaacgcagcaagaatcggtcgctatgtcacgactcaactctgttccttccctcagagccggcgataactcctccttctacgaacacttcatcctctctggcatccgagttgaccgagtccaacccggtctcgtctcctgcactttcaaagtcccctcgcgcctcgctgacaggagtgggaagttggcgagtggagcaattgcgaatctggtggacgaggttggaggtgctgtcatccatgaagagggtctccccatgaatgtttccgttgacatgtctatttcttttctctcatctgtgagagttggcgatgaactagaaattacttctaggttgttaggaaggaaaggaggttattctgggactattgttcttcttaaaaacaaagcaactggagaattgatagcggaaggtcgtcattcactatttggtagacataacagcaaaatgtaa

SEQ ID NO: 78803 - DNA, 1308 bp, Glycine max
  Peptide Sequence Number=SeqID_195581
atggcttggggagtggccttgtggtcacttgctacttttcttaccccttgggcctctcagacctccctcttggctctacttgctgtccgtgctttgcttggcattgctgaaggagttgctcttccttccatgaataacatggttgccagatggtttccacaaaccgaacgatcaagggctgtaggaatctcgatggctggatttcagcttggatgtgcaatagggctcacgctttctcccattctcatgtcgcaaggtggtatatttggtccctttgtgatttttggattgtctgggtttctttgggtgttggtgtggttgtctgcaacgtcaagcactcctgatcggagtcctcagatatcaaaatatgagctggagtatatatcgaatagaaggcacaagtctttttcagtggagacagctaagcccaagaaagttaaagtgatccctcctttcaggcgcttgctttcaaagcggccaacatggtctctaatcattgcaaattccatgcacagttggggtttttttactgttctttcttggatgcccatatacttcagctcagtgtaccgtgtggatctcaggcatgcggcatggtttagtgcagttccatgggctgtgatggctgtcacgggttactttgctggcttgtggtcggatatgatgatacaaagtggtacaagtgtcactttgactcgtaagattatgcagtccattggttttattggtcctggactctgcctcattggcttagcaacagcaaaaaacccctcaataggttctgcttggcttactttagcttttggcctgaaatccttcagtcactctggttttcttgtgaaccttcaggagattgcaccgcagtattctggtgttttacatggaatatcaaatactgctggaacattggctgctatatttggaacagttggagctgggctttttgttgagctagttggttccttcccaggatttctgttgcttacatcgctcctttacttccttgctgctattttctattgcctattcgctactggagaaagagtaaattttgacgatcctgtaaatgttggactcctattaatttgtaaattgctgatgagatgtgtttcaaactctcttaacagttgtctgagagtgctggaaactacatactgtactgtacagttcaatttcttgtatatgaaaggagttaaggagatagctgaagaatgtcagagatggctatgtgttctaactgtcatgcttgtgaagtgtaaaacagaaactaaccatctacctagtgtaaaatcatttattgatgtatag

SEQ ID NO: 78804 - DNA, 337 bp, Glycine max
  Peptide Sequence Number=SeqID_195582
ggtttagcgtatccgaatgatcttctcaggactcacggggtcattatcccgagattttcgggcaagtattgtagctcagggtctcgtggctcgaccactgaatgtttagcagattgcttcgctcagccaaagaccaagcttgcggccccctcaaggactgctcgtcttacacctcgtgacactgatgatcctcttcttcaagaaacacggtctgagcttgcggagcgtcgatcgggtgcggtcgtaggaggacacgtagaactgtacccgtcagtcaaaggaggagtcgtcgctacctatcacgcagtggaggtgctcgccagcgcagaggatctag

SEQ ID NO: 78805 - DNA, 1533 bp, Glycine max
  Peptide Sequence Number=SeqID_195583
atgcggggctatggcgatgaaggagatggttacgatgattattatgaggatgaagatgagtatgaagaggaggctgaggaagagtatgaagaagaggaagaggcgcctaggaagccttcaaaagaagaaatggagtaccttgagttgaggcagaagttgaaagaatccattagaaagcagatgaagaaggagagtagtggtagtggtacttcgcgccgggattcaaccgatcgaagcaagaataagcttccttatgataattatggttccttttttggtccatctcaaccagttattgcacagagagtaattcaggagagcaagtcattgctagaaaatcagcatttggcatctaggttttctgacccacatcgcattaagaagaaccagaataaagtacctagtggaggatcaaagtcttcatctcataatctggcacccaaagtcagcgagatgaaagttaaagcccagaaaatcaagaatactagagattactcatttcttttatctgatgatgcggaacttccagctccttctaaagcccccccatctcagaatatgcctatacgaaattctggaaacttatacaggatttttgctgatgttgaagagggacgaccagctcaagttccagcaaggaataaactgcctttgagcaatggtggcaagcatgttcgtgccagtcatgaggaacggaatgtaggttctgcagctggccatttgcctcctaaatcaggatccagttacaggaccagttcaaccagtaaacctagtatggcatcagcagattctaggaaacagcctggtaacaacagtggtaatggaccaggccggcctgttgggccaaaaggcttgccttcaaagatttctgttggtaccactgggaataagtcttcaacacctgctataaaaaacccagtgaatggtatgcagaaatcactcccttcgaagaatcatccatccattccaaaacagattgtagaacaaagaatttcgaagcacagtgttgaacaaagaattccaaagcagagtgttgaacaaagatttccaaagcagagtgttgaacaaagaattcaaaagcagagtgttgaacaaagaattcaaaagcagagtgtggaacaaagaaaagacatacgagaactatatagacctaaaatggcaccaaaacaaccagtggcatcatcaaaaccacagataaataggccacttaaacaaaattcagtgcatactgcttcgcaagatcgtcgtcccaagcctaaggctgctaaacgaccctttgatgatgaggaggacgaagtggatgtcaggaacatgatcagaaatatgtttaattacaaccctaataaatttgttgatgatgatgacgtcgacgatatggaggcaggctttgatgaaatcttgagggaagaaaagaggagtgaaatgattgctaaaaaggaggacgaggagcaacttaggttaatcgaggaggaagaggaaagagagaggagaagaaaaatggcaaagttaaagaaacggaagcttggttattag

SEQ ID NO: 78806 - DNA, 522 bp, Glycine max
  Peptide Sequence Number=SeqID_195584
atgggacccagttacggtcacacattctttgataactttaattctatcgttgagttgttgattttgatcatttatcattttcattgctcgtttatttcctctcatggtcgcgcataccttcaacatggtatcagagctcttcctgtgaagatctctgttgtgcactcgctttccttttcgtttttcttgcaacttcattcattcgtcataagtgaaacaacacttagcaacacagaaagctttttgtatctgcatccgagcgagaatctagccattgctctcgtctctccaattttggattcaaccaactatcattcatggagcagatccatgatcacggcgttaagtgccaagaacaaggtagaatttgaagatggaagcacatcgaagccattgaagactgatagaacgtatggagcatggcgtcgatgtaacaacatggtcatatcttggatcttccattcagtagccatttcaatcaggcaaagcatcctatggatggataaagcggaagaaatctag

SEQ ID NO: 78807 - DNA, 363 bp, Glycine max
  Peptide Sequence Number=SeqID_195585
atggcttttctgaacactgttggaaatggtttatctaaagattacaaagctcaaaaaggttttaagtttgaacctatgtccttccttagagaccaaggttttgaagtttttaggatttatgtggaatcatctttcatgggtcatggaagctgcaacaatcatggtcattgctttggcggaaatccgaaaataaattatgctgacattggtgataagagcgttcttcaaccatggtatgactttctcatcgagagcgacttcgatcatggagatgaagtgtcattctattatcagcgccataaaaaaatttgggaaattgtaattagaagacaaaaggactggggtgatagcgataccgattaa

SEQ ID NO: 78808 - DNA, 276 bp, Glycine max
  Peptide Sequence Number=SeqID_195586
atgaaggttattctatggatgaatgctctcctagaacctaagcttttgaatcctaaaaaaaccctgaattgttggcagcctaaccccattacaaacctaagcttgtatacttccccaatttatggtgaaaagaggctaagttttgaattgcaaaatgtagcagttgggctaagctcagcatttgggctaagcgcatatccaccgctaagcgcagcttcagcgcgcttagcgcaaaggagaatctggcagagcatcaacatcaaagccacgcgctaa

SEQ ID NO: 78809 - DNA, 276 bp, Glycine max
  Peptide Sequence Number=SeqID_195587
atgacaaaaaagcatgaaactacccttgtttctcaatacgtgaacctctcacaacttgtgtcctttttggtccattttgaagagttggaatcgccatggatgacaacgatagaaacaaagtggggtggagtggtggctgtaccgatgaacaagttgttgagtgcatgtgagttgcaaagggtgctttcgtttgcgattagtgcgcatgagtcgaacccgagatatgaggccttgaaacacctcctaacagtgatcaacacagtcttgctaggctag

SEQ ID NO: 78810 - DNA, 1158 bp, Glycine max
  Peptide Sequence Number=SeqID_195588
atgttggatcttaatctgaatgccgagtcgactcagaacaacgagtcgctggtgctgttggacaagtttcccgaagcttcgttgggaacttcgaattcctccgtcgtgaatgcggagggatcgagcaacgaggactcgtgctccacacgcgccggcgacgtgttcgccttcagtttcggaatccttaaggtggaaggcgcgaacgaagtcgtcgccacggcgacgaaggagctgtttccggtgagctcggagaattggcaggggcagagttcgacgtcgtcgtctcaggcgaggaagaatttaatggatctcccgctggatcatcaaaacggtgaggtgaaggtggttcaggttcagccacagcctcaggtgaagaagagtaggagaggtccaaggtctcggagctctcagtacagaggagtcactttctacagaaggaccggaagatgggaatcgcatatctgggattgcgggaagcaagtctatttgggtggatttgacaccgctcatattgctgctagggcctatgatcgagctgctattaagttcaggggacttgatgctgatatcaattttgatctcgttgattatgaggaggatctaaaacagatgaagaatctttcaaagcaggagttcgtgcacatacttcgccgccacagtaccggtttctcaaggggcagttcgaaataccggggagtgacacttcacaaatgtggccgttgggaagctcgaatgggacaattccttggcaagaagtatatatatcttgggctattcgacagcgaagtagaagctgcaagggcttatgacaaggcagctatcaagtgcaatagaagagaggctgtcactaactttgagccaagtatatatgagagcgagatgaaacctgaagctattaatgaaggtggcagtcacgaccttgacctcaatctgggcatagcaaccccaggacatggtcccaaagaaaataggggccatcttcagttccagtccatcccttacaacatgcatcccggaagaagttcaaggatggagactaatgttaattcggttattggtgatccttctttgaaaaggctggttgtaactgaagagcgtccttctgtatattccactttctttcccaatctggttagttcaaatgcctgctacaactga

SEQ ID NO: 78811 - DNA, 333 bp, Glycine max
  Peptide Sequence Number=SeqID_195589
atggttatgccggataagtttccggcgaccggaaagagagaaggaggaggaagaagagaaggaaactcacagaaggaagtgtgtgaaggaagcttcgcgaggtttggaagttgcatttgttatttcctcggcgatgatttcagaaccagagagaatataaacatcgggcactaccggattccatggcaccagagagagagagagagagagtcgagttgtggtctcatcgacggaaacagccgtccaccactaaccgctgagtttcttgttatagggagtaataagggcgtttttggtagcaatgatcatatacagatattttgtacagagtag

SEQ ID NO: 78812 - DNA, 111 bp, Glycine max
  Peptide Sequence Number=SeqID_195590
atgacgtgtacagagaggcctttccggaatgtagttttacattccggatactctggaagtttaaaagggatgtataaagcaacattgaaggtgtggaaagcaacttcctaa

SEQ ID NO: 78813 - DNA, 3138 bp, Glycine max
  Peptide Sequence Number=SeqID_195591
atggctgagaaggatgacacagagggacgatgtcctgcatgtcgttctccatatgataaggaaaagattgttgggatggctgcaaactgtgagagattggtggctgaagttcatatggaaaaaaagatgaagaaccagaaagcaaagtcaaaatcttctgaagcacggaagcaactcagtagtgtgcgagtaattcagcggaacctggtttacatagtgggattgcctctcaatctggcagacgaagatctcctccagcagcgagaatattttggtcagtatgggaaggtcttaaaagtgtcaatgtctcgaaccacagctggtgttgttcagcagtttccaaacaatacatcgcgcctttacgtgatatcagaattttcatgtgatttctttgcgctaagcgagtgttgcccgctaagcgtctgcgttgtgttgggcgtgtatggtacgctgagcaagagtctccaaaccttcaacttgtctttaggggtgggaataggccagcttgattggggaatagatcttgatgaccagccttgcagcaatccagattgtctatatctgcatgggattggctctcatgaggatagtttcacaaaagatgaaatagtttcagcatacactagtcgtgttcaacaaattactggtgctgcatacaatatgcaacggcaatcagggaatgtattgcctcctccattggatgattgcacggataattcatcaggaaaatcaattgtgaaaaattcatcaagtacctctgttagcattgtaagaggttcacctcctaatggaacttctgggagacctatagctctttctgcagctgcagcatggggtatacgggctacaaattgtcagccagctgcttgtggtttattatgtccaaatggactgtccaagcttaaacctgatacaatcagcagcaccctacccttttcctctgctgttgcatgcactattcaggcttcattaaatagtgatgttacaaagaggccactgtcgagtgatgggagtcatagtatgacacctcaagtaaaaaatgaattattgaaacctgttaaacaaaatagaagcatggatatcctggatagtgctgaagaaagaactttggcttctgaagtttctctttcacccatgaaattgaacaatcaggtgtcttctctaccattagccggatatagtgatagaggcagctttactgcaacaaacacaactaattctattgacatcactcgacaaccaagcagcattggtcctgaggaagcagttatttctaccagtgaagagattgagaatttttcccaggagttgtcttctgttcacattgatagaaattcccaaaataaacaacattacagcctatccaaaactagcagatcacctgataatgtgttggttaaatctatgcaatctcaagaatcacagtataatactgacaaatttaaagatgtactaattaaaaatgcagacagtaaagctgctgcattagaaaatgaggtttgtaatttaaagcaacaatgtgatttgtcattggattctcaatctcaatctcaagtagtatcagctaatattgaagtggaagatgatgtaacaacttttgataatcagatacttaaggatccagaagttgttggttcttatttgcccgaatcggccagtttccttaatgtctcaaatcattctagtcctcatcttctgcattgtggtgaaccatgtaatgttgtaaatgctggttctttagatgccaatgataaaatcaaggataactcattattacatgcacataacttttgcaatgaatattctgataaattgatcagcaccagctcttattggttcctccatgatgcaagaaatgagcaacgcattggaagattagttagtgatgcagttaatattggaagtgacgccgctatggacaagggtgaaagcagtataatttcaaatatattatccatggagtctgatgcctgggatgactcgctaacatcacatgagagtttggccaagttgttgggtgacaacactgacaaccagaatggtcctttaaaaaaatctagttcttggaaagttcaaagtaacaatcaatctagattttcttttgcaagacaggaggaatccaaattccaagctaatgtacatccatcttctggtgccaaccagcaatttccaaagaatggctcactcatccaggattttgtggaaagagacttttctttggacaagctgggttttgcaaatggcatcccctccaataacctcgaggaatctggaaatcttggtagtggccattttattgcttcaaacaataaactttcagctgtttcaagagcacaaatttcagcaccaccaggattttctgttccgaacagggcaccacctcctggtttttcttcccttgagagaatggggcaggcttttgactccctctctgggaattcattgctcgacccttctttcttactgagaaattcatatcaaacaccctcaaatggaaatattggtgatccaggagacattgaatttatggatcctgctattttggcagttgttaaagggagaattcaaggtgcacaaaacagcccagtgctggatatgcgatccaattaccctgaacagttaaattactttgaaaatgaggctagagttcaattattgatgcaaagatctctctcaccacatcaaaaccttcgattttctgaaattgggaattccttttctcagtttggtgattcttatggcatttcttcaaggttaaatcaatcacaagttagtaatctggcttcatttcctcagttgtctctgcagcagtctagaaatgcaatcttgtcaaatggccaattggatgggtggaatgaagtgccgagtggaaatggtctgggacatttgggatttgagattgttgggtatattggccatggtaaagctaagtcagaaatatacaaacagaatttttctgcattgtcgaaggtgatggggctggctcatgacataacctgtctattaggctatgaaatgatgaaactctcaagaagggctatagctgcagctgttcttgatttgcggaagcaaaccgcgttgagatttaagaaatcaatcatggatctgaaagtggtctatttggcaggtagatgttag

SEQ ID NO: 78814 - DNA, 2562 bp, Glycine max
  Peptide Sequence Number=SeqID_195592
atggctacggagggtgcttttgttcaaccagcaatgccacgatttgatggtcactatagtcattggaaaatgattatggagaattttcctcgctcaaaggagtattgggttgtggtggaaaatggagtttctgcaacagcaaaaggtgtcattatgttcgaggcacaaaagaaaacttatgaagagcagaaattgaaagatcttaaagctaagaactatctgtttcaggctttagatcgttcaattttggaaactataattaaaaaagatacatcaaagagtatttggtactccatgaagcaaaaatatgaaggaacaaaccgagtcaagcatgctcatctccaggctttgcgaaaggagtttgaaaccgctcacatgaaggaaggagaatcagtgaatgagtaccttgctcgtgttcttgtcatcagtaacaagatgaaagccaatggtgaagatgtgaaagacattgttgtggtggaaaaggttttaaggtcaatgacaccaaagttcaattatgttgtttgttcaattgaagaatccaaggaaacaagtatgctgtcaattgatgagctgcagagaagtttgcttgtgcatgaacaacgcatgagtaatactatccatgaagaacatgctctgaaggtggctcatggtagccaatatgctagtcctactagacgcggaagagggtgttggaattttggaggtagaggttgtggacaaagtagacaaaatgttgataaagcaaccgtggaatgctataattgtcacaagctcgggcactttcaatgggaatgtaagaaatgggtgtcaaattttacagaaagtcaggcagaaagtgaagaacacatgttattaatggcttatattgaagaaaagaagcagcaaaagacatatgtgtggtttcttgactctgggtgcagtaatcatatgtgtggaaaaaaggaatatttttctgagcttgatgagaatttttcaaattcaatgaagctgggaaataattcgaacatggtggttaatggaaaaggcaacatcagacttgatgtaaatggagttatcagcattatctcgggggttttttatgttccggaattgaagaacaatttactgagtctgggacaattgcaagagaaggggctgagcattttatttcaacaaggacaatgcaaaatatatcatccaaacaaaggtttgattatgaaatctaatatgtcatcgaatcggatgtttatcttgcatgccatctcttttcctgtagcacccacttgttttaacacagttatggaagatgtagcacaactgtggcattgcagcatgctatctgaaaagaaagtgcctaaaactttatggctaaaagcagtaaattgggttgtgcacgtattaaaccgcagtccaatgctagcggtgaaggacacaacactcgaagaagtctggagcggaattaagccatcagtccaacatttcaatgtttttggttgtgtttcttatgctcacgtacttgataatttgagatctaaactagataagaaaagcttgagtagaaagcaaccagcttggctaagagactatgtgttcggtgaagggttgtcagaagaagaggctgcattttacttagcattctttgccttgtatactgttggtgtcgacccgctaaattttgaagaagttgtgcaaattgaaaattggagaaatgccatggatgcagagatatcattttactcagcattctttaccttgtatactgctggtgccgacccgctcaattttgaagaagttgtttacaagactaaactcaatgaaaagggagaagttgacaaggttaaagcaaggctggtagtgaaaggatatgctcagcagtatggtgtagattacacagaagtttttgctccagtagctcgtatggagattgtatggttggtaattgcgttcacagtagaaagagggtgggctatacatcaactagatgtgaagtctacctttttacatggagaattagctgaagatgtctttgttgagcaaccttgtggttatgtgcagaaggggaatgaagaaaagaactcgatgatgtttgagtttgacatgactgatcttggtaaaatgaagtattttttgggtcttgaaaacaactcagttcaaactccaattgttcctggttttaagatttgtaaggatgagggaagaaaacatgttgataaaatgtgcttcatgcaaatggtatctggagcatcccactcagctccatctacacctagcaaagagggtactgggggaggaagtgataaactcatagcatatagtgatagtgactatgctcgggatgtggatgataaaaaaagtacaactggaaatgtcttcctttttggatctgcagctatatcatggtgttctaagaaacaaccaattcaagagttcataactattcagtgcgatagtagttctgccatcaaactatcaagaaacccaataatgcatggacgtagcaagcatatagatcctctcaagaaggatgtctttttgaagctgcgcacaatgcttggagtatgtgcaaagaacgatgtgaactaa

SEQ ID NO: 78815 - DNA, 1205 bp, Glycine max
  Peptide Sequence Number=SeqID_195593
accattgggatagaccaaatcttgacggtgttgcttttgaaaaaatatcaagtgatgataatgatatgcttcttgggagttttgggaaagaggaaattgtggaggctatttgggattgtaggagctcaaaaagtctcaatcccgatggtatcaatgtgtcttttattgcacttattccaaaggttggggaccctcaaggagtcatcgatgaaagacaaagtgcatttttgggtgggagaaacctcttgcatagtgcattgatagccaatgaagttgtggaagatgctaggaaaaatagaaagaaatacttttactctttaggcccgcctagagaatttaagcctcaaaagggcttaagaaaaggtgacccccttgcacattttctcttcaatattgtggcggaagaccttagtgttttgataagggaagcttccttgaagagtctttccaagggatatttggtgggaaaattaggtgttgagacaacttgtgctcctaaaaatcatggtggtttgggggtgaaggatattgctatgttcaatgaggcacttctaacaaaatggaagtggaacctttttcatgatagggggtctttatggctagtatgtggtgggaggagtgatgggtggtttgacaatatattggaatggagaatagagagtggagaattagtgagagatatgggtagttggagtcttgaggggtggagattggagtttaagtggagaaaagagtggtttgattgggagttgagtgtggtggaagagtttctcaatgtattgacaaatgtcaatattgctaatcaaggggaagatcattggctagaagattcatcttcaatgtactcgatcaaatccgtatatatggctttgtatgacttgagagttggttctaatgagattgacattttcaaaagtctttggcaaattaaaatccctcataaggtagccttccttctttggagggttttttatgatgggattccaactaaaagtagaagagtatcaactcagctctacctaagtcggctcgcgagcatttctgacaatgtgctcatggtttacagggtaattggtggcaaacgggttggagtgcaattgtgtgggccatttggcagaaaagaaatgcaatgctttttgaatgaagaaactttgaggttgaacaactttggtagagaattatgtttgcgatgtggtcttggatga

SEQ ID NO: 78816 - DNA, 687 bp, Glycine max
  Peptide Sequence Number=SeqID_195594
atgagtttttcatggagtatgaccacattagctttgctactattgctagcttcatatgtcaaagttcaagctaacctttttgatataagaaaatatggtgtagtacctaatttagacataaccatggctttgcaaaaagcttggacacatgcatgtgcatcaatgactacaagcaaaattgtgattcctaacggtaaatacaagttgagacaaatagactttatgggaccttgcaaggctcctattgaggtccagaattttggttttggctttgtcaataatttaataattatggacataactttaaaggatagcaaatattttcatgtgaatatttttgggtgcaagaacattacatttacaaacttcagagttagctcaactacatataatcccaatactgatagaattcacattggaaaattaactcaagtgaagattactaactcacaaattggcactggcgatgattgcatatcactgggtgatgggagcaaagaagtaactatcctaaatgtaacatgtgggcctgaacatggtattagtgttggaagcttagaaaaatattcaaatgaagattctgtagaggatcttattgtcaagaattgtacactaaaaaacacaaacaatggtctaaggatcaaaacttggcctagtaccctaataacttctcttgcatctgattaa

SEQ ID NO: 78817 - DNA, 1722 bp, Glycine max
  Peptide Sequence Number=SeqID_195595
atgaccgaggaagatgtttacacaaaagacggaacagtagattaccgaggaaatcgtgctaacaaaaatgaaactggaacctggagagcctgcccctttattttaggaaatgaatgttctgagagattggcatactatgggatgagcacaaatcttgtgacttatttcaatactaaactaaaccagtctggtcctactgcatccaagaataatgcaaattggggtggaacatgctacatcactccattgattggagcatttgtggctgatgcctatcttggaagatatcgtaccatcctttatttttccatagtttatgttattggaatgacactcttgacactgtctgcatcagttcctggcataaaaccaagttgtgatgatcaaggtaattgccatgctactgaggcacagagtgcaatgtgctttgtggcactttacctaatagctcttggcactggtgggatcaagccttgtgtctcatcatttggtgcagaccaatttgatgatgctgatgaagctgagaaggagcacaagagctctttcttcaactggttctacttgtcaataaatattggtggtcttgttgctgcttctttgttggtgtgggtacaaactactgtaagttgggggtggggatttggcattccagcagtggccatggcaattgctgtggtgagcttcttatccggtacgaggctgtatcggattcagaagcccggtggtagccccctcactcgcatgtgtcaggttatagtggcatccataagaaagagtaaggttcaagtaactaatgatgataggtctgcattttatgagatagaacaagactcagagtcagctatccaaggaagtcgcaagcttgaacatacaaatggattaagcttctttgataaagcagcagttataagagattcagacaatgtgaaggacccaataaacccatggagactttgtactgtgactcaagtggaagagctgaaagccattataagattgcttcctatttgggccactggcatcatattttctactgtttatagtcaaatgggaagctactttatactgcaaggggacaccatggacaaccgtttgggcagcaacaagaagttacacatctcaccagctactctttctgtctttgataccatcagtgtcatcttttgggtgctagtgtatgacaggatcattgtgccggtagcaagaaagttcactggccgcgaaaatggcctaactcagctccaaagaatgggcactggccttttcatatccatatttgctatggtgtattcggtaatcttggagaatattagacttaaaatggtgagaaggcacaactactatgaccttaaccaggtccccatgtcactatttttgcagattccaccatattttatcataggttgtgctgaagtgttcacattcattggtcaattagagttcttctatgagcaagcacctgatgccatgagaagcacatgttctgctctccaactcctcactgttgcatttgggtcctacttgagctctttactcattacaattgtgactaagatcactgctaggaatggaagtcctggatggttacctgacaaactaaactatggtcaccttgattatttcttcttgctgttgacagtgttaagtgtgctgaactttgttgtgttccttctggtgtcaaagttgtatacatataaaaaaccggttggaaatcttcactaa

SEQ ID NO: 78818 - DNA, 984 bp, Glycine max
  Peptide Sequence Number=SeqID_195596
ggatttgtgatttctgactgggagggaattgatgaattatgccaaccttatgggtcagattatcgtcattgcatctccactgccattaatgctggaattgacatggtgatggttccttttagatatgaaatatttgttgaagagttgatgtctctagttcaatcaggggaaataccaatagcaagaattgatgatgccgttgagcgcattttgagagtgaagtttgctgctgaactttttgagtttcctttaactgacagatctttgctagatgtagttggtggcaagctacatagagatctggcacatgaagcggttcgaaagtccttggttctgttgaaaaatgggaaggatcctagtaaaccctttcttccattgaacaggaatgctaagagaatccttgttgctggaactcatgctgatgatattgggtatcaatgtggaggatggacaggtaccaagtatggatctagtggccggatcacaatcggcacaactatcttggatgctgttaaggaagctgtgggaaatgaaacagaagttatttatgagcagtgtccatcaacagacatcatagaatgtagcgaagtttcctttgccgtagttgtggtcggagaaggtccctacgccgagtgtgggggtgacaattcagagcttgtaatcccatttaatggagctggaatcatagacttggttgctgataaaatcccaacacttgtgattcttatatctggaagacctttgctcttagaacagtgcctattggaaaagatagatgctcttgttgctgcatggttgccaggtactgaagcacagggaatcacagatgtcatatttggagatcatgacttcaaaggtcaactaccaatgacttggttcagaagagttgaacagcttgatcaaccagttggagttagttcatgtgagcccttattccctcttggctatggactaacatatgataaggagaatttgcatgactaa

SEQ ID NO: 78819 - DNA, 1593 bp, Glycine max
  Peptide Sequence Number=SeqID_195597
atgtatgaaagcgtggtggtgaagaatgtcacaagattgtgttcaacaaagcccatagtaaccgtaaatggaaagttcccgggccccaccatctatgctagggaagatgacactgttttggtgaaggtggttaaccatgtcaaatacaatgttagcatccactggcatggagtgagacaattgaggacgggttgggccgatgggcctgcttacataacccaatgcccaattcaaccgggccaggcctttgtgtacaacttcaccctcacaggacagagagggacactttggtggcatgcacatatcctttggcttaggtcaactgtgcatggtgccttggtcattttgcctaagcttggagttccttacccttttcccaaaccccacactgaaaaagtcatcatattgagtgaatggtggaaatctgatactgaggctgtaataaatgaagctttgaaatctgggttggctccaaatgtctctgatgctcacacaatcaatggtcatccaggatccgttcaaaattgtgcatcacaagggggatacgaacttcaagttcaacctggaaacacctacttactaagaataatcaacgctgcactgaatgaagagttgttctttaaaattgctggccaccaactcacagttgttgaggttgatgctgtctacacaaaacctttcaaaactgacaccatagttatagcaccaggccaaaccacaagtgtgcttctaaaagccaaccgtgccgctggcaaatacttagtagcagccactcctttcatggattctcctattgcagtggacaatgtgactgccactgccacattgcactacactggctcactaggttccaccatcacaaccctcacttcattgcctcccaaaaatgccacaccagttgctacaaacttcactgactcactcagaagcctaaactccaaaaagtaccctgctagagtgcctcaaaaggttgaccattccttgttcttcactatcagccttggagtcaacccttgccccacttgtgtcaatggtagcaaagtggttgcagctatcaacaatgtgacctttgtgatgcctaaagtttctctcctccaagcacatttcttcaacataagtggagttttcattgatgattttcctgggaagcctccagtggtttatgacttcacagggacacaacagcctacaaatttgaggactaatagagggacaagggtttatagacttgcctataactccactgttcaattagtcttgcaagatactgggatgataacacctgagaatcatcctcttcaccttcatggattcaacttctttgtggttggtaggggacaagggaacttcaaccccaaaaaggacaccaaaaagtttaatcttgtggatcctgtggagagaaacacagttggtgttccatctgggggatggactgctatcagattcagagctgataatccaggtgtttggtttatgcattgccatttggaaattcatacaacatggggattgaagatggcatttgtggtggacaatggtaaaggaccaaatgagtctctactaccacctccaagtgatcttcccaagtgttga

SEQ ID NO: 78820 - DNA, 3105 bp, Glycine max
  Peptide Sequence Number=SeqID_195598
atggaacctactttgatggaaacaaaaaagggtttgaaggcaagggacattctacttcgtttattaagagttcttcatgtttcatttgagattagctacacttccatgcaaaggcatccatttgtttcgggtgctttgttagtcttcttcattttgtacatatttctttcttttatttacaacttgttggtcttcttgtccccatttttcgtgtgcactgccatttttgttagaatcttttggagttctgagcaaaacctcattaaaagtgtcaacaatgaggagaaaagcaatgaaccaaaatttttaccagagttgctcaggaacgagaggcgtggtttgctttataagtgtccatcacacaatgcaacaagtagaagaagaaacttcactgggaagaaattggatgtgtatggtggtttagaaataaaagccaaggatttatcgtcggtgttctgcaatgaattcacaaaaaacaacaaagagaatggaaggactaaattttacaaggaagagattggttctttggaggctcctataaagaaagttttgtttgctgaaccttcaatgctggacctggaggctcatggtgctagttttgatggtctaaagaaaaatacagaaatcaaagaggatgagaaaaaagctcaagagggtggcaacaaaggtgaattgacagaggatgaacagaaaaataaaatggttctagggacatgtgagttggagagacacaaaaggttggagagtcttatagctagaagaagagcaatgaaacaattgaagttgcagattgagaaaggtctaattgatatgaaatcagttactccaagccaaatagctccactatttgtttcaagactcaacccttttgattctccaagggagtttgatggcataaaaatgcctggttctgccccaactgctttgagaagcccatttgatattccctatgatccttttgaggagaaacccgttctcactggggacaattttgatcaagaattgaaaggtttgttaatagaacctagacaagaagaccttgaagcaagagggcacaggttggcacacccaagagtcagaaggcttcaaggtagaggaaatcatgacaagcttgaacaattattattatccaaagaagccagtgaaagagaattacaaacttctattccatcaagtgaagtagaggaaaaaacacatgaagagaatggtaaatgcaaaaatgacaaaatggctggcaacacaggtaaggaagtggacaatgctcaagcaacaaagtccatgtcataccatgcaagagttcctaagcctcaagaggaggacctcaatttaccaatatcaagaaatagtgctactaaaataaatgattctctgtatgaatctctttcacctaacaaggaaactatgtccttcactggttgccgaatcagtcacaccccttcacgctccttagcttctgacatacatgtggaggtttctgaagttggttcaccaacactgacagttgatgagaaccatgagaacactacagatggagaatccatgatatatgatggagacattgacaaagatgttacttctggcagtgaagatatgtggggagcatcactccatttgagagaagtacgtagagtaagcgagcaagatatttcagaattaaacagctggagggacatttcttcacccctttctatgcaaaacatagatgaagaaaatgcagctgatgtgagctctatgtcctcaagatctgacatgcctgatgatactccaacttatgcaatgaacagtgagcataataataataacatctttggtaatatgaaagattttggtgcaccccaaaattctcattcatcggttgtgtcagcgcgttggaagcgattgatgcggttgatggatacacgtgatagtcatttacctcatgataggcattcaaaaaaaccaggggaatggttcgacctcacagagaattcaagtaaggaacaagttatcaatgattggaaaaactcagcagcctctgagcaagataacacacataacccaagaggaaatgaagaacctggtgcatcagattcagttatgcaaccagaagtaactgatgaagtctcaatcaactcaagttcatcatcctcaccaaggcctgtattgtcaataacacagaagaccatagctgaccaagttccctcttcagctttcaatcaagagacgcaccaagatgttctgcaatctaacatgcaggatgtgtcacaagaaacattaaatggtgaaggtccacctgactccatccctcaaaatattccgccttccatggatgatccaaatgttgaatcacattacagtgacttgagtcatcctcaggaacagacttgtccactggagaattccattcaagaatcaaatatgtctagcaagatgaatgatgcagagatttttaacaaggaagatgaaaataagttcaagaatgatgagtacattggatacaaacttgctcccctaattataccagatgcttcaaaagaaccccgtagacaagcagagatgatggcttcagtggatataagtgaggaatcaagagaaagatttgatggcaatgtgccgttgatttctctaatactagaatcatccttagaaagtccaggagaggaagaggatgaagaaaattctcaagcatcagtgagacaagaggcaaccacagacacaagttctgatgaagattttgaaagaaatcgcagtgacttgaatgagaatgaagccatagtctcatcatgcttatccatagaagatagtgacaagttgagagaaacagacaagccaaagcatagttcagaagaagtgaattatttgcacagtgaatcaaagcaggtggttgaagatcatatggagaaggaaaacttggataaaggtggtgcctctgaagactctccacttccaattaccactcaggcgaccaattctgaagacaaagaaggagaatgtgacaagataaacaagaatgaagccactgaccaggaattgaacgagaacgaaactatggctatgtctgaacctgcaggagaaactgatcagatagcacacatgaaatatcctgaagaaaggactccaacttga

SEQ ID NO: 78821 - DNA, 1113 bp, Glycine max
  Peptide Sequence Number=SeqID_195599
atgcgaaaaaagtgcaagggcagttttggtattttaaaaaaatgctgggtgcacctagcaatactcagagtcaaactccgacaccctgtcttcgctgtcggtcgatgttctgaggaagaatcccaggatcctggaattggagaggttgaggtagtttctgccgcctgcggaggggtacacggagagctggtcctggaggatgaagctaccgtggtggacggcaatcaggcacttcaggaccacggcggcgttgttggtctcctgaaggcggtccatcaggacctccacagcgaccaaggcggtcgtgagccgtcgccagaggagaggagcgtggctgagtgcttcagcgtggggggcgtggaggaatcatggcccgtgacgccggcaggccctcgacggcggacttggaggccggcgggtagtaaagttagtttgtatagggttccatttgggcgtcaaatctgcatgacagaggagagaagcagtttgagaggtacattgcatttacaatacatggattgtctctacatgaatcctcaggaatccattgaagcacgtgtgaaacaccttctttctcttatgactttgaatgaaaagattggtcaaatgacacaaattgaacgctcagttgctaccccttctgccatcaaacacttctccattgggagtgtgttcagtgctccacacaatggacgttttgagaaggtactgtcatctgattcggctgatatggtggatgggtttcagaagttggcacttgagtctcggttagccataccaatcatttatggggttgatgctattcatggtaataatagtgtctatggtgctactatatttcctcacaatgttggcctaggagctaccaggaacaatgttgttgcctgtgccaagcattttgttggagatggaggtacagagaaaggtgtaaatgagggtaataccatactatcatatgaagatttggagaggatccacatggccccttacgtggactgcatagctaagggagtttctaccatcatggtctcatattccagctggaatggaaacaaactccatggtcaccattttctgcttaatgaaattttgaaagaaaagctaggcttcaag

SEQ ID NO: 78822 - DNA, 429 bp, Glycine max
  Peptide Sequence Number=SeqID_195600
atgattgcaaacatctcaactcaaggagcttgtatagaatcttggcgtggtgctgcagttgaggaatttgatctggaaaaggaagagtggatgaactcaatgcagtcctcaacagcagcagttctatgggaatcaacagaggaccctgctgattttgatcttgttaaggaagacgaacctcggtgtaaaaatctctttggagagatcaagcgtagagcattcgtgactctttctgcaagatccttcacaagttcaatgggagaggtctcagactgccaaggaattctgaacatgcagctcttcacttgcccatttctggttgatttcctattggaattctgtctcaaggacaagcctggtgaaacttgggaagttggaagcagagttgttagagaggtgggaactgtgaggaggttctcatgtgaatga

SEQ ID NO: 78823 - DNA, 1266 bp, Glycine max
  Peptide Sequence Number=SeqID_195601
atggatacaaagtttgcacgaaggactgagcgcattggtagaacaacatgctcttattggagagctggaagatgtaacagaaatccttgcagatttttgcacatagagacaccatctccacctgctgcttgtggttatggcaatactgcatatagctacggaaaaaagccccattcctcctctgagaataccccgaaatatggttcaaagaaagcattgcttagagataatggagatagaggagatgcgacaagggttgctaaggctttcaagaaatcatcaccaaggatatgtaaatactggatcaacaacaattgtgtacatggtgaacaatgcctgtatctgcattcatggttttgtggtgatgggttttccaccgtaaccaaacttcaagaacataagaaggttatcactggcatcgcacttcctgttggatccgacaaactttattctggcagcactgatgggacagttaggatatgggactgccatactggtcaatgtgctaaagtcatcaatcttggtgctgaggttacctctttgatcagtgaggggtcatggatttttgttggtctgcaaaatgctgtcaaggcttggaatatccagaccatgtcagagtttactcttgatggacccaaaggccgagtccgtgccatgactgttggcaacaatacactctttgctggtgcagaggatggtgtcatttttgcttggagaggaagctctaaagccgattctccttttgaactggttgcgtcactcactggccacactaaagcagtggtttgtctggcggttggatgcaagatgctgtactccgggtccatggaccaaagcataaaggtctgggacatggatacattgcagtgtacaatgacactaaatgatcatactgacgtagtcacatcccttatctgttgggatcaatatctgttgtcaagttcatctgaccgcacaattaaagtctgggcttgcattgaagcaggatctttggaagtgatatatacacacactgaagaaaatggtgttgtttcactttttgggatgcctgatgcagagggaaagccaatattattttcctcgtgcagagacaattcagttcacatgtatgaattgccatcattttcagagaggggacgtttatttgccaagaaagatgtggcattaattgagttaggtcctggtggcctcttcttcactggagatgagagtggtttgttgatggtgtggaaatggttggaggtacccaaggtggcatcctcttga

SEQ ID NO: 78824 - DNA, 267 bp, Glycine max
  Peptide Sequence Number=SeqID_195602
atgccaattttaaacctaaaaacattgaagtatgcagaactcaccaagaaggacaggccaaaccctgtaacagttgtcatgccagagcttaacaggttaagcgaacttgaattgactttgaacaatgatcatgcttttcttagttgtgataatacgatcacacgccctcccacacgccctcccacacctacaagaagtcaatactctgactcagacgcgctatgggatctagcaatcttggttcgtgtacggacttactcatcatga

SEQ ID NO: 78825 - DNA, 552 bp, Glycine max
  Peptide Sequence Number=SeqID_195603
atggcaacagagaattctcaagtttatcacgaaaggcaaaggttacagttctgtctcgtgcatgctctcaactccctctttcagcaaaaggacgctttcactcgagcaaaattgaatgcaatttccgaaagactcacacttgaagactccaacagtgaaacgtggaccccactatctgttcttttcaagccccatcacaatgtgttgaccggaaactatgatataaatgttctaattgctgctttggaagagaagggaaagactgtggtgtggcatgatcgtagaaagggggcatcttccattgatgttgatgcacctgaggatgttttgatggggtttgtgatcaatgtggcagtgacaaggtttgctgggatttggagaagtaggcactggattgcattgaggaagattgatggggtttggtataacttggacagtgaccttactgcccctcaacctttttttgatactgataaagttagggagttcttggattcaaccttggcccatggtggggaggttttgattgtcatgaatgagaaacagtcttga

SEQ ID NO: 78826 - DNA, 1401 bp, Glycine max
  Peptide Sequence Number=SeqID_195604
atggctgagatgaacaagaaagaagagctgatcttcttttccatacctgggagtggccacttaccttcatctctcgaattagcacaactcctaatcaagcaccacaaccatctttcaatcacaatcctctgcatgaagctcccttatgctccttattcagatgcatacatcagatcagttacagcctcacaacctcaaatccaagccattgatctccctcaggtagaaccacctccacaggaactattgagatcaccaccacactacatcttgaccttcttgcagaccctcaaaccccatgtcaaagccatagtgaaaaacatttcatcatctcattcaaacaccgttgtagggttggtcatagatgtcttctgtgcacccttgattgatgttgcaaatgacttaggtatcccttcttatttgtacatgccttcaaatgttgggtttttgaatctcatgttttcccttcagaaacgtgaagttggtgatgcattcaatgattctgatcctcagtggttggtaccgggtctccctgatccagttccttctagtgttttgcctgatgctttttttaacaaacaaggtggatatgctacttattataaacttgctcagaggttcaaggactccaaagggatcattgttaactctttttcagagttggagcagtatgctattgatgcattatgtgatggtcaaattcaaacaccccctatctatgctgttggtccattgattaatctgaagggtcaacctaaccaaaatttggatcaagcgcaacatgataggatattaaaatggctggatgagcagccagattcttcggttgtttttctatgttttgggagtaggggaagctttgagccatctcaaacaagagagatagcactagcacttcagcatagtggagttaggttcttgtggagtatgctttctccaccaaccaaagacaatgaagagagaatcttaccagaagggttcttagagtggacggaaggtaggggaatgttatgtgagtgggcaccccaagtggagattctcgctcacaaagcccttgtggggtttgtgtctcattgtggatggaactctattttggaaagcatgtggtttggggtaccaatattgacatggcctatttatgcagaacaacaactgaatgcttataggatggtgagggaatttggattggcagtggagctgaaagtggactatagaaggggtagtgatcttgtaatggaagaggagatagagaaagggctgaaacaattgatggatagagataatgcagtgcacaagaaggtgaaacagatgaaagagatggctaggaaagctattcttaatggtgggtcttctttcatttctgttggagaactaattgatgttatgacaggtagcatttga

SEQ ID NO: 78827 - DNA, 1323 bp, Glycine max
  Peptide Sequence Number=SeqID_195605
atgaacgttcccacgagaaaacgccgcaagaagaacgaagaaggatcaagatcaatccagaagaataatactcagaagaaagaacttaatagcatactcacttcgctcttgttcgttgatgcaaaagagaaaaagaaggaagacatgctcgatggttactacagcgaggtggaagaatccaataaccccaaaaagagaaagaaactcgccggcgccggcggtaattcagtgagccaccggcgagtttgggtgaaggagcgttccggagcgtggtgggaggagtgtaacaaacccgaatttccggaacaagagttcaaaaaggcgttcagaatgggaaggctcacttttgaagcgatatgccaggagctgaattcggtgatagcgaaggaagacacgacgctgagaaccgccattccggtgaaacaaagggtggcggtttgtctgtggcggttggccaccggcgaccctctgagcgtggtttccagaagattcggtttgggtatatccacttgccacaaactggttctcgaggtctgcactgccataaagacagtgcttatgccaaagtacttgcaatggccaaatgtcgttaccttaagggacatcaagggtgagttcgagaacatttctggtattcccaacgttgtggggtccatgttcacttcgcatgttcccatcatagctcctaagatgagtgtttctgcttacttcaacaagaaacacactgagaggaaccacaagacttcgtattcggttactgttcaaggtgttgttgaccatagaggggttttcactgatgtgtgcattgggtggccaggttcaatgggtgatgatcaggttttggaaaaatcatcgctttttcatagggctaacaatggagggattaatctaagtggggtttgggttgttgggggttgtgggtaccctttgttggattgggttttggtgccttatacacagcagaatctcacttggactcagcattctttcaatgagaagattggagaggttcggagggttgctaagggtgcgtttgggaggttgaaaggaaggtgggggtgcttgcaaaagaggactgaagtgaagctccaagatttgcctcttgtgcttggtgcttgttgtgttttgcataatatatgtgagttgaagaatgaggaaatggatcatgagttgttgaagaatattgatgatggtgatgatgattatgttggtgaggtgatggagccagaggttgccatgagatctgttagctccttgaaggctagggatgcaattgcgcataaccttttgcaccatggactagctggaacttcttttgtttga

SEQ ID NO: 78828 - DNA, 939 bp, Glycine max
  Peptide Sequence Number=SeqID_195606
atgttctcgttaagactccctattcctctcgttaaaacgccaccctcttcctcttcttattctccttattatctctgtcctttccatgacccttgccaaacgcggggacttatcgtctccaagcgcggctccgccaccgccaagtgccacgctgacgtgacacttcgccatgacagagtctcattcgccggagagtcgccggatccatttccggcggaactcgcggcggagatgatgccgaagcacgtggcggttataatggacgggaacgggaggtgggcgaaggtgaaggggctgccgccgtcggcggggcatcaggcgggggtgcagtcgctgaggagaatggtgaggctgtgtagcagttggggaattaaggttctcacggttttcgcgttctccaccgataactgggttcgacccaagttggagtttgatttcttgatgaggctgtttgagacaacaataaactctgaagttcaagcttttaagagggaaggaattcaaatatctgtgattggagattcatcaaagttgcctgagtctttaaaaagaatgatagttagtgtagaagaggatacaaaacataattcgagacttcaacttattgtggcattgagctacagtggcaaatatgatgttgtgcaagcatgtaaaagtgtagccaagaaagtcaaagatgatcatcttcacttggatgacatcaatgaaaacattattgaacaagaattagaaactaattgtactgagtttccttaccctgatctactaatacggactagtggcgagcttagagtgagtaactttttgttgtggcaattagcctacacagaactttatttcaaccagaaactctggccagattttgggaaggatgaatttgtagatgcattaagttcatttcagcaaagaaaaagacgctatggtggtcgacatgcataa

SEQ ID NO: 78829 - DNA, 237 bp, Glycine max
  Peptide Sequence Number=SeqID_195607
atgtctaacctgaacgctgagcttgtagtaatttggaaggggctaacagtagctagggagaggggcttgctttactgttgttatctgggaaactcaaattcgaagcttgctctcaagttggtcaatgatggagacccttttcatactcatcctcttgcacctaatttggtcaacaacatccagagtcttgtttccttgtactggtggcatcttgcctattttgatgtgctcaaatga

SEQ ID NO: 78830 - DNA, 1374 bp, Glycine max
  Peptide Sequence Number=SeqID_195608
atgaacccgctaacactagtgaagcgcactcagaacatcaatgccagagaagctgcactcggcatcggcgagcaagcctcctggcacaccaagtacaaggattccgcttacgtcttcgtcggtggcatccccttcgatctcaccgagggtgacctcctcgccgtttttgctcaatacggagaggttgttgatgttaacctagttagggacaaaggcaccggaaaatccaagggttttgcgttccttgcgtatgaggatcagagaagcacgaatcttgctgtggataatttgaacggggcacaggttttggggagaattattagggtggaccatgttgataagtataagaagaaggaggaggaggatgaagagacagagcggcagaagagggaggcgcgtggcgtttgccgtgctttccaaagaggtgaatgcactcggggagctagctgcaagttttctcatgatgagcaaagagctgcaaatacaggttggggtcgtgaggaagacaagccaaaatggggtcacgacaaatttgagggtcccaaaaaagagagaagatctggcaacaatcaatcaaatcatattccagaaactagagacagagattcacgtactagggcccgtaactttgatgctgaattagacaaccaacctaagaaaagtgatagaagagagacggcaaagcggtggcatgataataatgatgataaatttgagggaagagaaaataacagtagaagagaagaaaatagatcaagaaggcatgaagatgatgacaaatttgaggggagagaaaataacagtagaagagaagacaagagatcaagaaggcatgaagatgatgacaaatttgaggggagagaaaataacagtaaaagagaagaaaagagatcaagaaggcatggagatgatgaatttgaacacaagtcaagagaagatgggtataggagagaagaaaaaggatcaagaatggatgattatgatggtatggagcttgagccaaaagatcaacgcagaagggaagacaaaaggtcaataaagccagatgatgttgagtttgaaccaaagtcaagagattctgatataagggaagataaaaaatcccgtaggagggatgatgatgattttttaagcaagtccagagaacctcatagtaacagggaagacatgagatcaagaaagcacggtgaagatgaatctgcaccaaagtcaagagaaaattatgctaggaagcaagatgatagatcatatagaaatgatagcagtcgaacagagtcaaaagaaagatatgattttgacaggagagaagagaaaaggccaagaagcgatgctatcttctctaaaggtagcaaaaagcgaaatgctttggcatag

SEQ ID NO: 78831 - DNA, 252 bp, Glycine max
  Peptide Sequence Number=SeqID_195609
atgtccacgcgtccgtacttgggtgagggattgtgtggagatagtgggaaatttggccacgtgtcgggaaatttcttaacgaaagtagtagggtggagtgcagaaaagaaggaaagagaggggaatctgaaagtgattgagagggagggcacccccacagggaaaagggccgtcaaatgcccaacagcttgtacgtacttgtcttgcctgtcggataagaggaccaacacccttctcatgggtcaattttga

SEQ ID NO: 78832 - DNA, 570 bp, Glycine max
  Peptide Sequence Number=SeqID_195610
atggcgcgcagagacaaaaattggtcattctgcacccttttgtcatccagaggcggcgggcccgatgacatgcggagacaaaatttggtcattccgcacccctttgccattcagacacagccgtgtccgatggcgcgcagagacaaaaattggtcattctgcaccctttgtcatccagaggcggcgggcccgatgacatgcggagacaaaattggtcattccgcacccctttgccattcagacacagccgtgtccgatggcgcacagagacaaaaattggtcattctgcaccctttgtcatccagaggcggcgggcccgatgacatgcggagacaaaacttggtcattccgcacccctatgccattcagacacagccgtgtccgatggcgcgcagagacaaaaattggtcattctgcaccctttgtcatccagaggcggcgggcccgatgacatgcagagacaaaatttggtcagtccacacccctttgccattcagacacagccgtgtccgatggcacgcagagacaaaatttggtcattctgcacccttcgtcaatcgcggccgataa

SEQ ID NO: 78833 - DNA, 744 bp, Glycine max
  Peptide Sequence Number=SeqID_195611
atgccagttaataaaaggacggtgaccacaccggatgagtttgatgctgatgctttcagtcaggctgctatcgccctgcatgtgtcttcgtctggcgagtatgccgggcagagtccgcacgctcatcgtaagggtcagcttattctctctttgcgcggtgcagtaagctgtgaggttgaggatgcgctgtggcttgttccaccgggacatgctgtctgggtaccgggtgaaatccctcacagctgccgggtcacaaagaatgcagagacctgctttctgtttatcgaacccggcgcggcagcgatgccggaaacctgctgtgccctggcgattagtcctctggtccgtgagcttgttctgtttctggcagagcaggaacatgtttattcgcctgacagcaaaaccgcgaggctggcagcagtactgctggaacatattccggacgtgccggttagagcgcttcacctgcctgtatccgaccatccgaaaatccgggctatggctgaaacactttttaagtatcctgatgaccggaggacgttaaaagagtgggctgtacacctggcaaccagcgagcgatcgctggccaggctgataaaaaatgccacaggactgagctttggtcgctggcgtcagcaactgcatttaatgattgcgcttagccatctggcagaaggtcagcccgtgcagcgcgtagccggaacgctgggttatgattcggtcagtgaatcgccacggctttaa

SEQ ID NO: 78834 - DNA, 328 bp, Glycine max
  Peptide Sequence Number=SeqID_195612
atgtcctacactacgaacaagtggtcttcagtcatacttgtgaccggtatcctctttatcgccattaacctgcgtgttccttttaccgctgttgcacccgttttagagttaattcgccatgattttgggctaagtattactgccgttgggttgcttaactctctgcctttactggcctttgccgccttttcccccctgagcgcctccgtctccaggatgtacggtctggaacgcaccctttttggtgcactctccgtgatttcagccggtattctgcttcgctccacaggcagtgtctgggcgctttatggcggaaccatattgatag

SEQ ID NO: 78835 - DNA, 1398 bp, Glycine max
  Peptide Sequence Number=SeqID_195613
gtccttgtgaagagcttggatttatatgggaagttggatggtcacgaagggtgtgtgaatgcagtggagtttaactccactggtgaccttctggtctcaggttctgatgaccgacaagttatgttttggaattgggcatccaaaactagattgtttgcatacccttctggccacacagacaacatattccagacaaagattattccattcaccgatgactgccgaattgtaacttctgccggtgatggccagctaaatatatttattatgctaaaagaacatcagatggaggggttgactctagcagaatggactagtctcatagaacatggtgaatcaagatttgaatccctaccaggacaggtaaggcttggccttctctgggaggatggtagagttgacactacaatgttggggaagcaccatggttgtgtatacaagcttgctgtggagcctggaagtgcccacatattttacagttctggtgaagatggatttattcaacattttgatttgcgaagtaattctgctacgaaacttttctgttgttcctcgtcaataggaaacaataaacagactctaagcaaagtagggttgaattccattgtgattgaccctagaaatccatattactttgctatcggtggatctgatgaatatgcacgtgtttatgacattagaaaatgccagtggggttcagcaagaaattcagatcgacctgttaacacattttgcccttgtcacttaattggttcaaataatgtccatatcactggattggcttactcaagctttagtgaactccttgtttcttataatgatgagctcatctatctgtttgaaaagaatgtgcactcagattcctcaccttcatctgctacatctgaggatccgaagaatattcatgaggcccaagtttactcaggccacagaaatgcacagacaattaaaggagtgaatttttttggcccaaatgatgaatacatcatgagcggttctgattgtggccatatattcatctggaagaagaaggaagctaagctggtgagattaatggtaggtgatcaacatgttgtaaatcaacttgaggcccatccacatatacctattctcgctacttgtggtatagaaaaaaatgtgaaaatctgggctcctctagggaatgatatacctccacttcctgcgaatgtgaaagagataatggagacaaacagacagggcagagaagaccgatcacggaggcggcagacattggcgtatattgaaagaagacataatagggcagatattgtaagtgatgaagaagatgcagagggctaccttttaggattctcagatggtgatgcctcttctgaagaggattctcctggaaattccagagattgcaacattagctag

SEQ ID NO: 78836 - DNA, 1491 bp, Glycine max
  Peptide Sequence Number=SeqID_195614
atggagcagttcattgataacttgccgccgatggatctgatgcgatcggagaagatgaccttcgttcagctcatcatccccgtcgagtccgcgcaccgcgccatctcctatttaggtgaactcggccttctccaattccgcgacgtaagttttcttccagatccaacctcgcttcctctagattccgattttccttcgcttcttttcttcttcgatttcgtgtccgaggtgttctttgagctgagtgtggagttttcgcgtttgtgcatgcctgcgttactgcgtagcttatatgatgattgcagttcgggttccaacttgcatccacctagtagatcactgctctcttttgaaatttgcttaattggcttccctgtgaagttagatcttgtcaatttcttatggacaccgttttcttgtttgcagttaaatgctgataaaagcccctttcagagaacatttgtcaatcaggtaaagcgatgtgcagaaatgtcaagaaagcttcgattcttcaaggatcaaatcagtaaagctggcctaatgtcttcttctcgtactgtattgcaaccagatatagacttggaggatttagagatacaacttgctgaacatgaacatgagctgattgaaatgaactctaacagtgacaaacttcagcaatcatataatgaactccaggaattcaagattgtattacaaaaggcatgtggttttcttgtttccaaacatagccttgcggtttcagatgaaagagaactacaagagaatgtatattcaaatgatgcctatgttgagacaggatctttgcttgaacaggaaatgaggcctcagtcatcaaactcgtctggtttaagatttatcagtgggattatttgtaaatccaaggttcttaggtttgaaaggatgttgtttcgtgctacgagaggcaatatgcttttcaatcaggcaccggctgatgaactaatcatggatcctgtttcagccgagatggcaagaaccaagattctgaaaatttgtgaggcatttggtgcaaattgttatcctgttcctgaagatattagtaagcagagggaaataactagagaggggctcttttctagcaatacctttcaggattatcaggtttcatcacgtcttacggacttagaggcaactttggaagctgggattaggcaccggaacaaggctctagcttctgttgcagaccatctagcaaaatggataaacatggtaagaagagagaaggctgtgtatgatacactgaacatgttaaactttgatgtcacaaaaaaatgtcttgttggagagggctggtgtcctctgtttgcaaaaacacagaggcaggaggtactgcaacgtgcaacttttgatagcaattctcaagttggcataatcttccatccaatggatgcagtggagtcaccacctacatattttaggaccaacactttcacaaatccatatcaagaaattgttgatgcatatgggtga

SEQ ID NO: 78837 - DNA, 249 bp, Glycine max
  Peptide Sequence Number=SeqID_195615
atggcgatggagtctcttccatggaggggagggttagcgtggccttctaagggaggagaaatctcacttggagagcttgtggtagagggatttgaagaaggtgtgcggtacactctagcaatccagactcgtgggtatttgttgctctcaactctcacggaggtgcgatggttgaaaattccacctaaagtggtgtttcttatgggggctggacatggaggggagataataagaaaattgcttgagtaa

SEQ ID NO: 78838 - DNA, 240 bp, Glycine max
  Peptide Sequence Number=SeqID_195616
atggaatctctttcatggagaagggggttctatggtgtgatgtgttcagctcgaaatatgaaggtacactctagcaatgcagacttgtgggtgtgggtggacagtacatcgggatgggtcatatttgttgttctcaattctcgcggaggtgtggggttgaaaattccacctaaagtggtgtttctcatgtggagaatgttattctttattaatctttctatcctttctctagaaatgtga

SEQ ID NO: 78839 - DNA, 777 bp, Glycine max
  Peptide Sequence Number=SeqID_195617
atggcgggtaagggagtaccgttagttatagtggcgggacaggctggagagagaagggtggtgccgccattgctcgtgacgggattggatgaggtctcttacctgataccacttttcgctgtcaccggagctgttttggtttatcagactcaatgggaaaacgggtttcacgcgcaggctgcggagatcatcgcgggaaaatggttgaaaatatggattgattttggcgcggttttatctgcaattgggcttttcgaggcccaattgagcagcagcgcgtatcagatcctgggcatggcggagatcgggatattatcgaagcttttcggtgttcggtctaagtggttccacacgccgtggttggggattttggtttctaccataataacgatcggtgtgtcgtacatggacttcaccaacatcatttcctcggcgaatttcttgtacagtttgggaatgttgttggagttcgcctcgtttctttggttgagatggaaatctccttccattaagaggccttaccgtgttccattgaagcttccacttttggtggtgatgtgtttggtgccctctgggtttctggttttgattatggttattgctacgaaaactgtatatttggtgagtggggtgatgagcgtggctgggattgggtttttcttgttcataaaactctgcaagaggaagaagtgggtagggtttgaacaagagaaagatgatggctttgaaagggataatgtgtcttcgctgtgtataagtgtagtagtcttagattga

SEQ ID NO: 78840 - DNA, 204 bp, Glycine max
  Peptide Sequence Number=SeqID_195618
atggaatgtcatcgtggaggaggacgacttgatgtgcccgttatgtctccaacacctaatctttcgtatttggaaggaaagaaacacatgcatatacagggaacatatgacggattggaaggtcatgctccaagacattgtttttctggtgtgatcctagctaagttccctgctaccaaggttcaattttgtgtagtcgtgtag

SEQ ID NO: 78841 - DNA, 828 bp, Glycine max
  Peptide Sequence Number=SeqID_195619
atgtctagccagtcagtggagaagaagccaaagcctcatccagaacaagctctgaagtgtccaagatgtgactccaccagcacaaaattttgctactacaacaattatagtctttctcagccaagatatttctgcaagtcttgtaagagatattggaccaaaggaggaacactgaggaatgttccagtgggaggaggatgcagaaagaaaagatcatcatcaaagagggctcaggatcaaacattcacacccaatcttaacccactcactgcactccctcatttgtcttatgactccaatgacttaactctagcattagctaggtttcaaaaacaatcaagtgggcaattgggttacaatgaccatgatctttcaattatggggaaccccaccacaggctccttttgtgacattcttggcaattcaggcatgaatccctcctcagaaaacccttcatttttggacgaatttcaaactgggttccttcagacacaaaaccatcttcagaatttgtattgtgtgtatggaaatggggacttgggggaggtggataatggcaattctggtggggttggggttagtggagagatgatgctcccttatgatcaagtggtgatgagcaatgcaacagctcaatcggtgagtgtaatgaagcaagaaatgtgtagtggcagagaacaaagtgaaaggagggtgttggggggtttcccatggcagattaatgcagacactaacattattggtgaacttgattcaggaaaagcaattgcaagttggaacagtttcacaaattcttggcatgggcttcttcaaagtcctctaatgtag

SEQ ID NO: 78842 - DNA, 174 bp, Glycine max
  Peptide Sequence Number=SeqID_195620
atgatcacgaaccttgttcgtgggagcagaatgacagtggcagggtgtagcgacgacgaggcgggtcgttacaggggaggcgcctacagaggctcccggcgatgtagagaaggccgcatagatgaggagatgacggatttgctcggtttcttgggagggagcggagccacatga

SEQ ID NO: 78843 - DNA, 141 bp, Glycine max
  Peptide Sequence Number=SeqID_195621
atgtgtcacccaactgcatatgtttgtgtttattacaacggtcaaatctacaacactaatgagggcaccacctttgttagtaacaacacaaaaactttcatggtcaacaaggtattaggaaaaaatcacaatccaaattga

SEQ ID NO: 78844 - DNA, 99 bp, Glycine max
  Peptide Sequence Number=SeqID_195622
atgggacggtttcagtttcaccacgccaatttcgtagcacaacagcttttaacaggtggttgtccatggtgcacgatatattttcttgggattctttga

SEQ ID NO: 78845 - DNA, 567 bp, Glycine max
  Peptide Sequence Number=SeqID_195623
atggcaagtagaaatgaaaatgtctctgccctagtctactatgatgcctatgtagccgattgtgacgagggcgttgagtttaagggcggaaatgatgtacttgtttcaatgaggagaggcatcaccttgaatgccttgaaaacaaaaaatccaacttcatacacacaactgcttggtggatcatcaaactactgtgagacgactccccaactaaatgaggtctcccaaataaatgtcgacccaactactgatatccatgttgctcaatgtcacgtgactaccaggcttaaaatgggttgtcggatgaagttgttgatgacttcagtgacgatgaagatgaaattttggcgaacaacaacaacgacgacaacaaaggcaataatggcatacaattccttttccaacaaacatcatctgaaaatgtctatcgtccatatccaaataattttgatgttggtgaaatccaagtgcttgacaaccctgactataggcattttttggaccaataacaacaatttgactcgcacaatgacgagttgtatgttggtcagcaatttcgtcaattga

SEQ ID NO: 78846 - DNA, 258 bp, Glycine max
  Peptide Sequence Number=SeqID_195624
atggacaaacttcacaaaatcgatatgcgaggtcgaactgacacaaattgggcagaaaaagttgcaaagtggataagggaaacctattatagggcatgcaaggcattctcaggaatacatggcctgattgtttttcctggtgcttcaaacatggactacacttcaccgattgtccaacaagatgatttcttgagcaatgtttttggaattgattgtggcacgctagcatcagctcgtgaatacatgcatagcctatag

SEQ ID NO: 78847 - DNA, 465 bp, Glycine max
  Peptide Sequence Number=SeqID_195625
atggagttgttccagcacctcgcaggaaagcgtgtaaacctttggaatatgtgtttgaacgccagctacgaccatccctaccttcatttgctcagtgtcaagaatcgagtttgttgtatcaagcccaaatatgtgatcccagaccaagtgaattgtgctgtcatcagatatcacagcagacggataacatgcttggagttccaccccacaaagaataacatcctgttatctggagataagaaagggcaacttggagtatgggattttggtaaagtatacgagaaggtagtctatgggaacatacattcttgtttagtgaacaatatgaggtttaatcctacaaatgattgtatggtctattctgcatcctcagatggaaccattagttgtactgacttggagacaggaatatcatcttctccattgaacctgaatcctgatggatggcagggggatagtgggtag

SEQ ID NO: 78848 - DNA, 171 bp, Glycine max
  Peptide Sequence Number=SeqID_195626
atgaacggcagaaaccaatcaaggtacttaaggacggatgcaagtagggatggggtcactgcgcaagataagcagagaatgtcgctgcgaggcagccccgtatcctttgtattttgcagctttcttttactatttgtaagaataagtaatcaacgcctaattctaacctaa

SEQ ID NO: 78849 - DNA, 648 bp, Glycine max
  Peptide Sequence Number=SeqID_195627
atgctctcctcttctcaccgacaacctccgacgcaaggcaccggcaccggcaccggcaccagcaccgagaacttaatgtatgtcagaaaactcagccgctcttgctgcgaacaagtcgttaagaaagcactcgccaccaacgaccaagagaactaccgcctcctctccaccatcaaagaaggcctgataggtttgtcttattgcgtttgtctaattcacccatgtgacgataatgatgatagtaataatgttatacatcaaggcggtcatagagataccaatggtgatcatgattgcgatgacaatgatagtagcggcatcggcggtgatggtggtggtggtgacaatgacagtgatgatgatggtagtggtaacaatattggtggtaatggtgacaatgacggtcatacggtagcttttacgatgatttatcctcctcaattttgttttccctttctcctctccaaaatcttctctttttcccgtagaccatcaaacttgtctcagaaaaacaatgatctcggactcattcaccgttggatcgtcgtgaaatttaaacaccaggttcgcaacccaattccaagaattctcacaattgggaatttctgtatcatgtctagactgggagaaatacctttcgcatcgtag

SEQ ID NO: 78850 - DNA, 426 bp, Glycine max
  Peptide Sequence Number=SeqID_195628
atgaggttatacttcactgcaataagtgctttgatatttggtaccctattttgggacattggttcaaaaagggaatcaactcaagagctgtttgtggttatgggagctctttattctgcatgcatgtttcttggggtaaacaactcttcttcggtacagccaattgtttcaatagaaaggacagtgttttatagagagaaagctgctggaatgtactctccaatcacttatgcggcagcccaggggcttatagagataccatacattgctgttcagacagtagtatttggtgtaatcacatatttcatgatcaattttgaaagggcacccacgcatgattcttttggtgttcacgttgacatccatagattgattattgacaagagtcaaaacttcatcggaactagttccatccagaaattgtga

SEQ ID NO: 78851 - DNA, 1197 bp, Glycine max
  Peptide Sequence Number=SeqID_195629
atggctacattcatcagaaaattggttttcagctatgcttttctcgcactttttctctcagcaggtattggagtttttctaggtgttgaatctttcggaatcaactatggccaagtggctaacaatttgccacaaccagacaaagtcgttgaattgttgagcacccttaacctcacaaaaacaagaatctatgataccaatccgcagattctgacttcttttgccaactcaaacattgaaataattgtgacggtggagaatgaaatactaagccagttggatgatcctcaacaagcacttcaatgggtgaacagccgcatcataccgtacctacccgagacaaagatcactggggttcaggttgggaatgaggtcttcactgatgatgacatcactctcattgagcaccttgtgccagcagtggtgaacattcacaatgctctagctcaattaggttactcaaacatcaaagtttcaacaccaagttccttagcagtgcttgatcaatcttaccctccttcagctggtagtttcaagagtgaaatctctgggatcatgtaccagtttttgaacttcttgtcaagctccaagtcccccttttggatcaatgcatacccctactttgcgttcaaggatgaccctaatgggatttccttgaactatgtgatgttcaatcctaatgcaggaatggttgacccttacaccaatctccactatgacaacatgctttatgctatggtagatgctgtttcatttgccattgctaaaatggggttcaagggaatagaggttagggtctctgagactggttggccatcaaaaggagatgctgatgaggtcggcgccacgccgatgaatgctgcaacttacaacaggaacttgttgagaaggcaaatggcgggtgaagggacacctttgaatcctagaatgaggttggaagtgtacttgtttgcgttgttcaatgaagacttgaagcctggaccaacctcagagagaaactacggtctctttcggcctgatgaatccatgacttacaatgtggggttgtctgctcttgcaacctcatcagcatcaacttcctcctcttcaatttctcttgcttcctctggcactaagattaaggtagcaccatgggaataccaaagcttgatgaactggatgtttgtgtttgtcctgatttcaaccctttgcgggtga

SEQ ID NO: 78852 - DNA, 1443 bp, Glycine max
  Peptide Sequence Number=SeqID_195630
atggtcaagaccggtctcgacaacgttcctttcactctgagcaagctcctcgcagcttcgatcatagacatggactacgcagcttccattttcagttacattcaaaccccaaatctcttcatgttcaacgcaatgctcagaggctattctttaagcaatttccccaacaaagctttgccctttttcaacgaactgaggaatcgtgcaatttggttggaccagttctctttcatcacggttctcaaggcttgtggtcgagtttcagaagttggggtggggcaagggattcatggggtagcagtgaagtcagggaatagggtgtttgttgatgtgaagaatgcccttttgcatttttattgtgtttgcaagagaattgaagatgcacgtaagcttttcgatgaatttcctgagggaaatgacttggtgtcttggaacactttgatgggcgggtgtgtttctgtttctcagccttgtttggtttttggtttgttccggaagatgtgttgggttgggcttgaagccagtgttgccactgtcttgagtcttttgtcagctgcgggttacatagggaactttggtgtagggaagtctctccatggatactgcatcaaaattggatttagttctaatttgaatgacattactgcattgattgatttgtatgcaaaggtggggaattatgcaagaaatggaatggttggagaagcactggcttcattcgagcaaatgagtgttcgaggaatgaaacctaattcttctaccttgtcagggctgctctctgcttgccctgcgtctggatcagtacaagtagttcgtcatgtcgctagttttgttgaagagcagaaagtaaaactggatgcggttcttggaacggctcttgttgatgtgtatgctaaatgtggctttctagatgaggctatggacatatttgagaggatggaagataaagatgtgaaatcttggactgccatgatttcgggcctcggagttcatgggcagccaaaaaatgccattaggcttttcaataggatggaaaaggaggggtttaaaccaaatgaagtcacgtttttggcaattctgactgcttgtagtcatggagggcttgtggttgaggggatggaagtttttaagctcatggttcaggaatatgggttttcaccacaggttgagcattatggatgtcttattgatctcttgggtcgagcaggaatgctacatgaagcacataaactaattgatagcttgccaataaagggtgatgctactgcttggcgtacactgctttctgcttgcagaatctatggagatgttaaattagggaacacttatgcagttgctggaagaatcaccgattttacaagaatgcaagaaatgaagcaaaggaatgttaaagtagcaaattatggggtacatgaaaccgagggagaaagtatggtaaaggag

SEQ ID NO: 78853 - DNA, 186 bp, Glycine max
  Peptide Sequence Number=SeqID_195631
atgagggatatttggaacagcccccttacgcctatttataggaaaaaagggaaggaggttgccgcccagctcgcccagggttatgagaattttacggaagcattacagaagtcccggaagccccggaagccattttctaacaaaatgggggaggtggttgccgcccagctcgcccaggcgagctag

SEQ ID NO: 78854 - DNA, 279 bp, Glycine max
  Peptide Sequence Number=SeqID_195632
cgtttcacccgtgacacgggatatatgcttggttacgaagtgatacaggtggacgatgatgaagagaaggcagttataggattttggagtgcatttacgtggttggtgggtatgacattggtcatatctctgctttctgaatatgttgtgggaactattgaggctgcttcagattcttggggcatttctgtaagcttcattagcataattttgctgccaattgttggaaatgccgcagaacatgctggttcaatcatatttgcttacaagaacaagttg

SEQ ID NO: 78855 - DNA, 231 bp, Glycine max
  Peptide Sequence Number=SeqID_195633
atgacttcgaagagaatcacctctaagagagctaggaagagcactgtaagagaaagatctagcacagctccacctgtggaatttgaatttgatgcacaccgctttcgtagtgaggaacatcaacgccattttgaagtgatcaaagattggtctttcctcaaagaaagaaggatccaattagctgagagcgagtatattgaattccaagctgagattactaggaggcactag

SEQ ID NO: 78856 - DNA, 297 bp, Glycine max
  Peptide Sequence Number=SeqID_195634
atgaaatggatcaacaaaccaagaagaagaaaagttccaaaatcaagagagagttcatttgcaatgcttgcttccttaatgacaagtcaattaccaaccacattgcttaatccttcgattggtactaccacaactatggtgcctactattgttgctaaaagacctttaaatgtcattggccaaattggtttacctcccatgattccttttgtacctcctttagagggaactaatcaggtcatgaatgaagatgctacaatggagaattctcttatgtcaacaatgatggtggcttga

SEQ ID NO: 78857 - DNA, 384 bp, Glycine max
  Peptide Sequence Number=SeqID_195635
atgttcccaagcaagaactgctcctttcctcaagctccctatttagttcctcccatcccaggatatataaagtgttttgagaactcttacaatctaagagaatttacagaagagagcttgaagatttctttggcaagaactgtcttcattttgcgtccaaagaaggtgtatgttggtgaattaaatgcatgtccattccatgctgatacacgactatacttatcttccttgagccacactttaggagctagcttcagaggtcaaatcgactttaacatagagcagggcatttttgaggaaaaaggaaaagaggagctgcaaaactcaactcgccacgacaagcagagccaccaccacaatgagaaaaggatagagatcaagtaa

SEQ ID NO: 78858 - DNA, 231 bp, Glycine max
  Peptide Sequence Number=SeqID_195636
atgcaaaggagttttggaatctcaaggcgttacagtaaggctgccattttaatgacaattggaatcatgaggcatgacagtaagatggtttttttaatggcctttggaatctcaaggcctcacattcagacaaaagccatgtgcaagacaacctcgcatcccaagtatcattacatgcaaccgcatagtgaacaactacacacaaccaacaaaccctatgtgattgattaa

SEQ ID NO: 78859 - DNA, 585 bp, Glycine max
  Peptide Sequence Number=SeqID_195637
atgactagggcatacttatactatgcatggcaaatgacccaaaccgccagaaccagtggcgagtttggtgtccttgagaaaatcgctagcatcaatggtgatacgtgcgtgcagagaccaaatcgccagtccaaatggcgacatgcacagatgcttgggaaccgccagccaaattggcgagttccatggagtgagggtgcaggctatgttttaggcgtaaggggctgcttttcagtgttagagggacagctttttcagagaagcggagttgcaactgtcattggcgagttgcctgcaagttgcaactcccattggcgattcagggcagaaaaaatagccatcaggactggcgattttgtgcttataaatacgaaggcttctttcaattgtgtactcacaatcacaactaacatttttagctgtgttcttgaaatcacaagtagctttgagacgaagaattctttcctctttcagctgtgtgtgctcacaatcagtggctttgagttttttgaatgcacaaggagctttgagttttctgagtgtttaggaatttatctgcataaagttttaaatttgtttgcttga

SEQ ID NO: 78860 - DNA, 741 bp, Glycine max
  Peptide Sequence Number=SeqID_195638
atgtggatggaccgatttgctctcactttaaacgggagccaagaacttccccgattactggctaaggccaaagcaatggcggacgcgaaagacgccataactaagcgcgccccaaggcatccctattgcaccagatccaaatctaggatgatgggtgacctagaggaagtacaagaacagatgaaagccgacatgtcggctttgaaagaacaaatgtcttccatgatggacgacatgctggggatgaaacaactaatagagagtaacacggccaccgtcgctgccgttagctcggctgccgaggcagacccgactctcccgactgttgtgcaccatcccattccaaacatggaacctcttcaacatcctgacggggtccacgagaatcctcgagagcatgctcagggagacgtcgactcctactccccgtttcccgctgaggggttggcacccaacacactacctcaacccaacatcacgggagagcctcgaagacacccaacgcaaccaatgtttctgtccatgggaggaccacccccgatagtggaagggaaggggaaactcgatctcatcgaagaaagattgagggctgatgaagggttcggcgattatccgtttgcagacatgactgacctatgcttggtgccggacgtcgtcatccctctgaagttcaaggtgcctgactttgataggtacaaagggacaacttgtcctaagaatcacctaaaaatgtactgctga

SEQ ID NO: 78861 - DNA, 576 bp, Glycine max
  Peptide Sequence Number=SeqID_195639
atggctgacaccacgttctgcaagagctttgagaggctttttgggcttgtcgaggttttatcgacggtttataaagggtatgcttatatttccgctccactcacgacactgctaaccaaggaacaatttcagtggactccagaggcccaacaggcatttaccaatttaaagaacactatgtgtcgagcaccagtcttgggcttactagatttttctctgcccttcatcgtagaaacagacgcctccgagggcttcatcctccaaaggggtcgtatttggctacaaacaaggcttcgctttattcagactattcttgcggaatttcactcaacacctatagggggacatatggaagttactaaaacactagctcgtgtcggtgaaaacttcatttggccgggaatgaaggagggcattcatcggggttcatttgggaatgctactagcatcttatacagcttccaatgttgctcactcattcatggagatttcaggcaagatacacgacatgccttgcagtctagtctcggactgcaaccctctatttgtcagtcgcttttggcaagagttgtttaa

SEQ ID NO: 78862 - DNA, 141 bp, Glycine max
  Peptide Sequence Number=SeqID_195640
atgcctggaacgtgtattcacagtggaccttcatgtccttccactatgtggtgcagacatagtcctcagcgttcaatggctaaaatcgcttggaccagtcctaacggactacaactacttaaccatgaagtttattcatga

SEQ ID NO: 78863 - DNA, 165 bp, Glycine max
  Peptide Sequence Number=SeqID_195641
atggccatgatgtgttcgaaaggctgttttgctcatgtcggtctccttcatcagtatttggtgggtggtcgaaacaaggaagaaaattgggaggtcaaggccgttatctcgggatgggtgggttggggagtggaagttttggttgaaggaagctctcaaggatag

SEQ ID NO: 78864 - DNA, 651 bp, Glycine max
  Peptide Sequence Number=SeqID_195642
atggtggaaagggggaaatttgatcatatagaggagaggctcaaggccattgaaggaggtagagattatgtttttgctgacatggcaggattgtgcctagtgcctgacatcgtcatccctctgaagttcaaggtgtcggatttcgataagtacaaggggactacttgtcccaagaatcacttgaagatatactatcggaaaatgggggcatacttgaaagatgaaaaattacggatgcatttcttccaggaaagtcttactggggcagtgtcacctgtggagggatctggcagctcaagtagggcccctaatgacggagaaggagatgataacaatgatattagacacgttacttatgagaagatggtgggttacatgccttcaagctttgccgatttagtttttgtcgacgaaaggatcgaagtgggtctgagaagaagcaaatttgattatcctgctttgatgaatgggaagcctggggcaaatggagagaatgagaaggagggagggacccatgctacgatgccattcctacatggcccaattccttaccagcttaacaatatcaatactcggccaatattagtccttctcattacctaccaccttaccagtcaagaacacccaatcatccacaaatgccacccctaa

SEQ ID NO: 78865 - DNA, 210 bp, Glycine max
  Peptide Sequence Number=SeqID_195643
atgaagaacgaagaacgaccaaagaacgatgtagaaatcaattgcagtcgcgattcaacgcaaaacaaggcatttggggtcatgacagctcgcctaggtgagctgagcttgcccaggcaagttggttacttcaccatgaagttatttggtggcccaggcgagccagaggctagcttgggcaagccagggttcaaaaaagccttaaaatga

SEQ ID NO: 78866 - DNA, 897 bp, Glycine max
  Peptide Sequence Number=SeqID_195644
atggcatccctcaaacaagtttcacccctattattactcttccctctattgctcatttccctcttcaagtcctcccacgctgcaggaattgccatctattggggtcaaaacggaaacgaaggctccttggcagacgcatgcaacactggcaactaccaatttgtgaacatagcattcttgtccacatttggcaatggccaaaccccccaactaaacctcgctggccactgtgaacccagcaccaacggctgcaccaaattcagcgacgaaatcaaggcgtgccagggcaaaggcatcaaagtgctactctccctcggaggagccagtgggagctactccctcggctcagccgaggaagcaacacagcttgcaacctttctttggaacaacttcctcggaggacagtcgagttcccgcccattgggcgatgctgtcctcgatggcatagactttgacattgaggccggtggcggcaaccattgggatgaacttgcaagggccctcaatgggttcagctcacagaagaaggtgtacttggctgcagccccacagtgtccaatccctgatgctcacttggactcagccatcaaaactggcctctttgactatgtgtgggttcagttctacaacaaccctccatgccagtactctagtggcagcaccaacaatctcatcaattcttggaaccaatggacctcaagccaggccaaacaagtgttcttgggactgccagcttctactgcagctgctggtagtgggtttgttcctgctgatgtgttgacctcccaggttcttcctgctatcaagggttctgccaagtatggtggagtcatgctttgggacagattcaatgatggtcaaaataaatacagtgatgctattaagggtagtgtttaa

SEQ ID NO: 78867 - DNA, 294 bp, Glycine max
  Peptide Sequence Number=SeqID_195645
atggtagaatcaaaaggaaaaagcactgtcacggtggagaaaaagaaaggtacaagattcacaaagatgtcttatcagttcccaatcttaaagaaattctcaagcattggacaaatgatggagaaaagctattctcttcactttgaaggagatacttgcactatctatgataaaagtaacaaaaggcaagagattgccaaagttaaaatggagaaaggaaatagaagttttccaataagctttaagtatactactaacactagcattgccatgagagcaataattgatgcatga

SEQ ID NO: 78868 - DNA, 513 bp, Glycine max
  Peptide Sequence Number=SeqID_195646
atgaagcacttcgtagaccatcatagacgagaagtgagttttcaggaaggtgattgggtgttagtgaagcttagacctcgccgacaaacttcggtagcaggaaactcttactccaagctagctaaacgattctatgggccattccaaataataaagaagataggaccaattgcctaccaactccaactttcagccaattcacgtattcatccagtattccattgctccctgctcaagccataccttcaacccgtaaccccagttgatgccccaatagacttaccaacaacagttgtagaaaatcaacccattatctctccagttattatattgaacactaaatgggagacaactaatattggtcctcaatttctggtgctagtccaatggaaaggattatccccagatgacacattgtgggaaaagtgggaggatcttaaagttgaataccaccttaaggacaaggtcattttggaaggccatgggaatgttatgacaagaggcaataggtag

SEQ ID NO: 78869 - DNA, 240 bp, Glycine max
  Peptide Sequence Number=SeqID_195647
atgttgttggcctttgtcttgcaggcagaagttgagaaactttcttcggaggagcagggattagatgatcaaataagaccagttcatttttgcaagctgaatgaaactctaatagcaattaaagctctgcatggaaccaccctggaagtcccaaatcctgaggaagctgtagaccatcgagagagaagatataaaatcattcttagaagcacaatgggtccattgatgtctaccttatga

SEQ ID NO: 78870 - DNA, 228 bp, Glycine max
  Peptide Sequence Number=SeqID_195648
atgacttgttcaacctacacaattcttgtgctacttgaacctaaggctgatccactagctttatggaatcagttcttgttccattgcatgtggattagtactttgtgtcacttggatttctccaagttttacattcctcccattggctccattggagatgtatttcttctcaaggaatactcaagtcctagtgacaaacacttatcctcggaggtgttgtacaagtag

SEQ ID NO: 78871 - DNA, 406 bp, Glycine max
  Peptide Sequence Number=SeqID_195649
atgcctgggaccgctacgcagacaatgtccttggagttcactaacttctctggagggagcattgacatgacattagtgaaggaattctatgtcaacctttatgaccttgaagataaatcaccaaagcaggggagagcttgccctcttactccaagttctgcagacggactgcctctgaagattttgaggaaaaatcttactactctggcccaaacctggagtgttctacctttttctaacttagccccaacatctcatacttcagatattactttggatagggctaagttaatctacgggcttgtaatgcagatgaatatgaacttgggatccctcatctcaagtcagatttctctcttcacgcagcatgactcctcgaggctaggttttccagcccttattactg

SEQ ID NO: 78872 - DNA, 294 bp, Glycine max
  Peptide Sequence Number=SeqID_195650
atggaacgttatctacagcattttgttcgccagaaggcggccaaccacagtgggcaggtgcagatacatgagtgtctctaccgattcagccttagtcagcaagggcagggttctgccctttttgcttgccctactctggagcagtttggggttgaggtcgcatggcctggagactggctcgaggtccaggcaggggaggagcctgcaggatcccccggtgaggcagatgagtcccatatggatgaagagatgactgaccttctcggtttctatagagggagtggagccgtgtga

SEQ ID NO: 78873 - DNA, 1452 bp, Glycine max
  Peptide Sequence Number=SeqID_195651
atgaagattaagaataatctcatagatccttcaaataggctttggtcttggaatcataatcataccaactgttgccactggtatggagtcctctgccacaaccttacttcccatgttcttcagcttcacctcaacacttcatattatgctttcaagtatgactactataatggattctaccatagattcgatgaggaagcttatcggagatggagctttggtggagagataagtccttgtttggctgatttaaagcatttgaattacttggacttgagcggcaattatttccttggagaaggtatgtcaattccttctttccttgggacaatgacttccttgactcacctcaacctctctcagactgcattcagtgggaagattcctcctcagatcgggaatctctctaagcttcgatatcttgacttgagctacaatgattttgaaggtatggcaattccttctttcctttgtgcaatgacctccttgactcacctcgacctctcttatactccattcatggggaagattccatctcagattgggaatctctccaatttggtctatcttggccttggaggtagttatgatctgttagctgaaaatgtaggatgggtatcaagtatgtggaagcttgaatatctttatttgagtaatgcaaacctatccaaagcatttcattggctacacactctccaatctcttccttctttgacccacctatctttgtcacactgcaaactccctcactataatgaaccatccttgctcaacttctcatctctgcaaaatcttgacttgtctttcaattcattctcatcttctatacctgattgcttatacggtcttcatcgtctcaagtctttggacctaagttccagcaacttgcatgggactatttctgatgccctgggaaatttgacttctcttgttgaacttgatttgtcatataatcaacttgaaggaaccattccaacttctttgggaaatttgacttctcttgttgaacttgatttatcacgtaatcaacttgaaggaacaattccgacttttttgggaaatctccgcaacttatgggagacagatttaacatatctctatctctctattaataaattcagtggaaatccatttgaaagtcttggatcactctctaaattgtcaacgcttcttattgatggcaataattttcaaggagttgtcaacgaagatgatcttgcaaatcttacaagcttgaaggagtttgatgcatcagggaacaatttaactttaaaagtaggtcctcattggattcctaattttcaacttacctatttggatgtgacatcatggcatataggtcccaactttccatcgtggattcagtcacaaaacaaacttcaatatgttggactgtctaacacggggattttagattctattcccacttggttctgggaaccacactctcag

SEQ ID NO: 78874 - DNA, 408 bp, Glycine max
  Peptide Sequence Number=SeqID_195652
atggtgggttacacaccttcaagttttacagatttggtcttcgccagtgaaaggatcaatgtgggtccgaaaagaggcaaatttgatcatcctactaggacgactgagaaaactggggcaaataaagagggtgaggatgagggagaaacccatgctgtgactgccattcctgtacggccaagtttcccaccaacccaacaatatctttactcagccaataacaaactttctccttacccaccacccagttatccacaaaggccatccctaaatctaccacaaagtctgtctaccgcacttccaatgacgaacaccacctttagcacaaaccaaaaacaccaaccaagaagtgaattttgcagcgagaaagcctgtagaattcaccccaattccagtgtcctatgctga

SEQ ID NO: 78875 - DNA, 285 bp, Glycine max
  Peptide Sequence Number=SeqID_195653
tgggcgtcttccggaattcttccggatgaaccacttcttccggaaagttcccggaagacgttttccggaagtcttccggaagaagtgttcttccggaagacgtttggttacttccggaagaacacttcttccggaaactttccggaaaacgttcttccggaacttccggaagaacccctaacgggtcttccggaagactccgtcgtcagccatttccccattttttccggcgtctcctgctctcgtcttctaccctacggttccgctaacctaaggttcttctaa

SEQ ID NO: 78876 - DNA, 198 bp, Glycine max
  Peptide Sequence Number=SeqID_195654
atgatggaagatgatgacgcagcgattgaggtgaggaaccatgtttccccagagccagaggtggaggacgccggagttgcttcgttgtcgaatccaaaggcttgtgacaaattcggaatgcaaaatgattttaaaggttcaaaggtagcaagcaaatctgcaaatgtgagtaaatgtgaaagattttatggcaagtga

SEQ ID NO: 78877 - DNA, 225 bp, Glycine max
  Peptide Sequence Number=SeqID_195655
atgagtgagatacgaagatttggaggtttgggaatggaggaacgtcgtgagagaaaaggggctgcgcatggatttctagaaaatgtgatatttatagagcaggacgcgtggaggaggcagcctactggtaatcgattacatgaatactgtaatcgattacaggctatctgttctagtgtaatcgattacagtattcatgtaatcgattaccagaacaaggaatag

SEQ ID NO: 78878 - DNA, 504 bp, Glycine max
  Peptide Sequence Number=SeqID_195656
atgtcaaatagaaagtatgaatctggttatgaaaaattgaagaaaaaacgaaaagttgaaaagctaattgaatctcaacatggtgcccttgataaatttgctattattcataaaaatgacgcagaagcaagttcaataggtgaaaatgtgatagaacaaccactgatagatcatactgacaacgaggaaaatgttatagaacaaccacctatagataatactgacaacggtgtagaacaaccacctagagatgatactgacaatggtgaaaacgtgatagaacaaccacctataaataatactgacaatacaaatagccataatttcaatcaagaactagaagacaatattttagaaataggagtagaagggaatgttgagcataataacacttctagtgaagtacctacaaatatttatgacccagaactatggaaaaatattgatggaaaatttagaaatttaatgatagaaaagggtcctatcagacatgacaatttttaa

SEQ ID NO: 78879 - DNA, 279 bp, Glycine max
  Peptide Sequence Number=SeqID_195657
atgtggcaagaatatgaaggagatcaatggggtcctgatccaaggagaaagaggaccgcaaagggtcatctcgtttcaactcgcattcctattaagatggacaaagacgaaaatgaacgggaaagctcgattcaaaactttatttggtacacggagaagaagatgagtcagttccacgggcatagcttaagaaaaagcctcacaaaggggggtcataggaaaaggacacagaatgctgctgagtaccaagaagtgaatggaagcaccaactacttataa

SEQ ID NO: 78880 - DNA, 1621 bp, Glycine max
  Peptide Sequence Number=SeqID_195658
gtgccccacttcttccgctgcttcgtcttcttctcctctcacatctccttccgttccgccatttccttcctcgcgcaagcttcttcctgcattttggagctgcatttatgtggttgggcttgcgcaaacttcttccgtcgagatcatggttagaacgagaggtttacgtcgttcattaggtaggggtataggcaaaggccggggtggacaggatgagcatcatccagatgatgttccttggcagagtaggcctatcgcatccgtccgtaggcaacgaatgactgaggatgttcctgcagctggtgtagagggcttagttgctgatgatgttgctgcgggatcagttgctgagggattccttggtgagccacgtgacctatcagtgctgacttcctatgctgatcatgttgcacacaacatatggactggagaggaacgtcctgacttgaagttggcctcccacggtaggaaggtagagaaaattgggaggccagcacctgagatcgaaaggctagtcactgccacaggattaagccctttgatcgggtgctcagtagtcaccggcgatccgagacttatatctgtgcttgtggagaggtggcatggggagatcaacagcttccaccttccagtgggagagctgatgatcacattggatgatgtgtcgtcactcctccatctgccgatcacaggcgccttgcacagcttcgagccttttcttttggaggaggcagtcgtgttgttgatggagttgcttgaggtctcggctcgtgcttatctccttcacttggttggttgcactcttttcgctaaaaagagtgcaacacatgtccatgtagtgcatctggaggcttttcgagacctgggtgagagtgggaggtatgcctggggagctgcggtgctggtgcatatgtatgaccagttaaatgaagcttctcagagcagtagacaacaacttgctgggtacattactttattacagtgctggatatatgatcactttcctagttttcatgactgcatcattgacgatgtgtatgatgagacatccccatgtgtctgccggtggcttacgacgaagggttatatcaagggattacgagcactggcgtatcggacacgtttggatgctttgacaatcactgacgccattcctccaccgcctattagtgcctccttgtcatatgaggatatcgacgatagaaggatgcattacgaggaccatatagcagttgcgggtgagatttttgttgtgcttgggcaggcaggtgatgagcccagacatccacctgccccacagcatgaggaatacgtcgagccaggtatcccggaggttctagtgggagcagacgttggaccatcacaggcacctgcagtggatggttgtgaagcgatcacagaaaggttggagcgtgtgctcaacctaaggatggtcactgaagacacaaagttacatgagatcgtgaaagattgcctcaggatcgctaggggggtgacaactcagatggaaatgttagggcacgacgaagacgacgcacagatcattgatagatcatgttatgtcttgtatttgacaacatttttgtatttgttacattattttggttataacttttattga

SEQ ID NO: 78881 - DNA, 412 bp, Glycine max
  Peptide Sequence Number=SeqID_195659
atggtgaaggagtgcattttcttggggcacatgttatcccatgttagcacaaaggttgatcttgccaaggtggaggttattgcaaatttgccactgccaaattgtgtgagagttgtgaggagcctttttgggcatgctagattctctatgagacaccttggtatgtgtcgcaacctacccttcggtgggaaggcgaggcgaaaagccaaaggtgcatcttcgaaaaagaaaacgcatgggagtcgccaccaacgtttattcgaggaaaacgttagaaaaaccaaaaagaggtctatgaattttgaaaataagggttcaggagttatttacgcacggggaaggcgagctggttacttcaaccctaagccatttaggggcccaggtgagctagaggctagcttgggtgagccag

SEQ ID NO: 78882 - DNA, 369 bp, Glycine max
  Peptide Sequence Number=SeqID_195660
atggcagctgatccaactaagacccttatgaactacctcactcctactttggggatgttggagaataacccgttcagtggtgctacccatgaagaccctaaacaacacttggggaggttcatcaagttaatcaaaatgaatggaatcactacatggaatcagtgcacaagtgcctccttaaggaggtatttctctctcatgaagatagatcattacaccaggaacactgaaactttatgcaaagggagcaagaaagtctacctgaagttaaagttccctactgatgccatcaaaatcattgaagacatatgttctaattcctacaacaacttaaaggataaaagaattataaagggaggcgttgactag

SEQ ID NO: 78883 - DNA, 162 bp, Glycine max
  Peptide Sequence Number=SeqID_195661
atggccgatgaagatgatgttccgctaagtgacttcaccgttgcaggtccagatcagtcttcacgcctttttaggccatcttgcttcagaaaccttatgttgaagggaacttaccacctggaggacaaagtgttgcctaatgggccaaggaatgatagatag

SEQ ID NO: 78884 - DNA, 1092 bp, Glycine max
  Peptide Sequence Number=SeqID_195662
atgaagcaatactggaattatcaaagactagttggtttttcacaaacatgtgtctggaaaaactttgactggaggtctacaaatttagactcatggagtcctgagcaactaaaaacaatgagctttggaggaaacaatcgtgcacaggttttctttaagcaacatggttggaatgatggtggtaaaatagaggctaagtacacatctagagctgcagacttgtataggcaaattctttcaaaggaagttgcaaaaagtatggctgaggatggaggcttgccttcatcacctgttgcttctcagtcttcccagggggttaatgggctaccagaagtcaagaccaatgaagtgccaaaagaaaacattctggagaagccagaaaagcctgagagcacttcttcccctagagcttcacatacagtaatttcaagtaccgttaagaaacctattggtgctaagaaagcagtgaagagtggggggctcggcgctcgtaaactcactaaaaagccaagtgagtctctctatgagcagaagcctgaggaaccccctgctccagtttcatcttcaacaaacaatatgcctgctgggccatctccaacgtctcggtttgagtatgtagaaaatgtccaatcatctgagttgaacactggaggttcacatttgcttagtcatgtgtctccaccaaagtcatcaagcttctttgcagactttggaatggatagtggctttccaaagaaatctgggccaagctcctccaaagtgcaagaaactgatgaagcaagaaggaagttctcaaatgctaaatctatttcttcatcccaatattttggagatcagaacaaggctgcagatgtggattctcaagctacattgtctaagttttcgggttcaagtgccatctccagtgctgatctttttggtgactcaagagacaacaacattgatcttactgctggtgacctcatcaatcgattatctttccaggcacaacaggatctctcttcccttaagaacattgcaggagagactggaaagaagctgagctcattggcctccacattgatgacagatcttcaggaccgaatcctctaa

SEQ ID NO: 78885 - DNA, 738 bp, Glycine max
  Peptide Sequence Number=SeqID_195663
atgggtacttcgaaagttctcagcattgttttcttcgtgctattgggcgtaggcatatgctccgctgcaagaacactcctcaccattggtggaggtgtgcatggtgagataggtgttggtgttggtgtaggaggttatggtggtggtggaggttcaggtggaggtggaggatatggaggcgcgggagggcatggtgtaggtagcgacggaggagcagcggttggcggatacgggggaggcggtggtggaggaagtggaggtggtggtggtgctggaggtgttgatgggggtggatatggaggaggagcaggtaaaggaggtggtgaagggtatggtggaggtggagctcatggcggtggctatgctggcggtggcggaggcggcagtggaggaggcggtggaggtggtgcaggagccggaggtgctggtggggggtacggaggtggtgaaggaggtggagctggtggtggatatggtggtgatcatggcggcggatatggaggtggcggtggaagtggcggcggcggtggtgccggtgctggtggagctcatggaggtggatatggtagtggtggaggatcaggcggaggctatggaggaggagcggctggcggtggcggtggtggctctggtggcggcggtggtgccggttctggcggtggaggtgcacatggaggaggttatggaggtggtgctggtggtggcgaaggtggtggccacggtggatattacccttga

SEQ ID NO: 78886 - DNA, 255 bp, Glycine max
  Peptide Sequence Number=SeqID_195664
atgggttccacagtgacactgagtctggcttcttcctgcatcatccatacatcaagttcaacctcatctgcttcaacatgttctacgatagaactcgtttgcaatgtgttgaccctgttgtggttgaaattggatttgatggttttggggtggccccaacagtgctattatgacttaatggtagtcacaggcaatgacatcgtggtcgtgcacgcagcggtggacgaagatggcacgatggtgaaagctgtttag

SEQ ID NO: 78887 - DNA, 342 bp, Glycine max
  Peptide Sequence Number=SeqID_195665
atgctctattacgcagagtttgatgaattcactgaagagttggagagaagaaattggcacaaggagatgatgaattttatggatggcagtattgatgtggccattgtgaaggagttctatgctaacctttatggcccagaggataaatcacctaaatgctttgaataccttcttgaagacccctctgatcatagagaaaggggaagagctaccttcttactccatgtttgctctatcgagactgataatgaggcaagctttgaagtgttgattttcaccctctcactaagccaatctgctggcttagcgagccatccgctgagcgcatcattcctcggctaa

SEQ ID NO: 78888 - DNA, 237 bp, Glycine max
  Peptide Sequence Number=SeqID_195666
atgtgcttagctaaaggaagctcagcctcgcttagccacaggcacctcagcaagaggatgagtgttcatcctcaaaagatgaactcacttagcgcgggaaaactgccaagaaaccacattacaaacgaaacctcaaagagagttgggcttcatcctcaaaaggaaacaacaccagaaaatctagccttccatggattcaaacagaatacgcaaatgaagcatgaagcagaaacgtaa

SEQ ID NO: 78889 - DNA, 450 bp, Glycine max
  Peptide Sequence Number=SeqID_195667
atgaacgtaaaaagagcgttcctcaatggacttatgaaggaagaagcctatgtggaacaaccccttaggtttgagagatctatctaccctccttatgttttcaatcttaacaaagctttatatggtttaaaacaagctcctcgagcttggtatgaaaatttgagttcgtctttaactgaaaatggctttataaaaggaaaggtagatactactctattttgcaaagattatggatttttcccaacttgtgcaagtagagttttagatgagtatgatgaaagaattgaagttatttcttggacttcagatcaagaaaagagacaaaggcatatacatacatcaaaaagagaaatggaatacatattgcttggttactgggatgcagattttattggagataaagtggaaacaaaaagcaccagtggaggttgtgactttattggtggatga

SEQ ID NO: 78890 - DNA, 420 bp, Glycine max
  Peptide Sequence Number=SeqID_195668
atgagatggacaagtcctccacaacaacaacaacctatccctcctttccagaatattgttggtccaagcaagccatataatccaaaaaatgtgagtgccatcaccttgaggtctggcaagcaaattgaggtgcctccaccagtagcagcatctgcacttgaacctgtcaagcttcatgctacacctgaaaatgaagatgagatagttgcacaaaagaggaagtttactcatcagggagctaacaaaaattttcatgcaggtggaccttcttctagctactcatttggaaaaggagatcttggagaccttcaggaaagtagaggtgaacatacctctgctggatgccatcaagcagattccaagatatgccaagtttctaaaggatctatgcacccacaaaaggaagctcaaaggcaatga

SEQ ID NO: 78891 - DNA, 674 bp, Glycine max
  Peptide Sequence Number=SeqID_195669
atggaacaaaaatcgcgaggctcgccaggcgggcggaaggcgatcatagtcgaagcacaacaacaagccggcggcgaatcaccaggcaaatacattcagggcgccaatgcgctggccgccgtcggcgaatacgccaaatccctcgccgatcattacctgatgatcgccgacgacttcgtgatgcagctggcgggcgacaccctaatgggcagcctgcagcagcacggcgtgaaacatcatgcggcgcgcttcaacggcgaatgctgccgcaaggagatagaccggctcggccatgagctgcaggctcacggctgccgcggcgtgatcggcgtcggcggcggcaagacgctcgacaccgccaaggccgtggcgcactaccaacagctgccggtggtgctcattcccaccatcgcctccaccgatgcgccgaccagcgcgctgtcggttctctacaccgaacagggcgaattcgccgaatacctgatttacccgcgcaacccggacatggtggtgatggacagcgccatcatcgccaaggcgccggtgcgcctgctggtggccggcatgggcgacgcgctctccacctatttcgaggcgcaggcctgcttcgacgcccaggccaccagcatggccggcggcaaatcgacgctggcggcgctcagcctggcgcggct

SEQ ID NO: 78892 - DNA, 210 bp, Glycine max
  Peptide Sequence Number=SeqID_195670
gttttagtcctggttcaaggtgtgaagagagaggctgtcccaaaaggacagggcccttgccgcaacacagcgctaaaactttcgactcaccggcggctggcttcgtcttcactttcaagctggaacagaactctaccgtgtacggtagataaaggaatgcatgttcacccgggcattgagtcacagggccctatgccttatcttccttag

SEQ ID NO: 78893 - DNA, 576 bp, Glycine max
  Peptide Sequence Number=SeqID_195671
agggctacacgccctcgcctttacagggcgacatgtcctcgccttcggagggctacacactccctcgcctttagagggctacgcgtcctggctttcagagggctccacatctgcaccttaagagaatttaaggggtcgtgcccacaagacacccagtggacccggagaagtccaatagggccctggggtttccaactctggttacgggcctctatcagtcctacagggtgcccgtaccccccggcaaggtcatgccatcgcgacatagggatcgtgcccgcaagacacccagaggacccaaagaagtccaacagggtcctggggtttccagctctgattacgggcctctgtcagttctacggagtgcccgtcacccccagcaaggtcatcaggcctcctactaaccgagctttcatcaagaagtattgcgcccccaggcaggcagagggcgagacaccacaacagcctggggatggccagcaacaggcaacaaatgcaccgccgccacctccaaagcccctcagctcatccacaaaaaggttagagtattgcctacgacacatggccgaccaatag

SEQ ID NO: 78894 - DNA, 510 bp, Glycine max
  Peptide Sequence Number=SeqID_195672
atgtcatctactgtttgcaaggatcacgcccgcaagacacccagtggacccgaagaatttcaacagggtcctggggttctagctctgattacgggcctctatcggttctacggagtgtccttcacccccaacaaggtcatcaggccccctattaaccgagctttcatcacgaagtattgtgcccccaggcaggcacagggcgaggcaccacgacagcctggggacagccagcagctggcggcagactcatcgccaccacctttggaatccacctcaactcatctacaagggctagagcattgcctacgatacatggttgaccagcaggcacccaaccaccgggacaggtacgagcagcgtttcgaggccatcaaaggatggtcattcctcagacagagacagacgcaactgagggatgatgaatttccgcacttccttggaggaggcggagccattcaaaaagatgtgatctcgggcatcagctgtgcccaggttacaagctgtttttaa

SEQ ID NO: 78895 - DNA, 1303 bp, Glycine max
  Peptide Sequence Number=SeqID_195673
atgaaacgggccgaagatctggcggaacagaaagcgaatggagccaagcgccttggtgaagacaagcaaaagcccatattatacagggcgccggaagtcgctaagagggtgaaattgtcggactctttacaggacaatattgaaaatactgccggacaaatacagccttcggataccgctttggtggaatgttcgaagtcctcagcaaccaaaacttcgggaaccttaaacgccgaaagcacacgagaactaccttcaaatgaacaagaagcggacaaagctcctgtgaagaaactttcccccagatcatcattttctaatcgggcaacacggtcaatgtcgcgtcgggcaccagcaacaacagtcgtttgccaaaggctgaagagacagataagatatggcgcaattagaccgcttgtgtatccccgctttggcaagaaaaaggctgaggtcgatgcccaagaccgtgaacggctgcgtgacaatgagttcttgaatgataacctcataggcttctacatgcgttttctcgaagatcacttagagcggactaacaaggacgtagcgaagagagtctatttcttcaactcgtacttcttcgcaaccctgacaaacgttaagggcagaagaaatattaattatgaaggtgttcaaaagtggactcgcgccgttgacattttcggtttcgattacatcgtggtccctatcaatgaaaacgctcactggtacgtcgctatcatttgcaacctacccaacttacctggtattgccgacaaaagcacggaggaccgaccttcagaaaatgacaaagacaattcggctgcaccggagagtgaaggccgcgaaatccctgaaacgcctgaacctatcgaggaactaccagctgttaaagaaacgaaagtcaacaacagtcgaaatttggaacctgcgaaagacgaagcaacccggcgttcacttgagtcaatgagcttgttagacaaagaagaatccaaagacggtgcaccagagttgccccctacagagtggccggagcaagaagagaaccttgccttttctcccgccaagttctccagccctgcagctatagcagaacccacccaaaaggctagcctgaggggagctcctagactagcagcgtctccgcgtaagggctcgaagaaggcaaagcccagcggaaagcctggaggtgctaaattcgatattcgtcaagcaactataattacttttgactctttggatctgtctcgctcacccaccatcagtaatctccgcgattacctttacgaagaggccaaatctaaac

SEQ ID NO: 78896 - DNA, 486 bp, Glycine max
  Peptide Sequence Number=SeqID_195674
atgacggtgtcctcaccaccgacgttgacatactgccaaacaacatcggtgctactgacgttgtattcttgcattacaaagacgggtcctaggatgaccgatgttgttgttgtcgacatacaacgacatctggaacaaagacggtgtggggcccgtcgtagataccggttttcaaccgatgtagaagcttctttttgtagttgtgaaccagaaaattcattgccccaaaaccgcgaaaaccaaccatttccagagcagaaagatagtatggatctaacggtgaccgtgcaccttgagatgaagggggacggagagcatgttctgaagatcaaggggttcagtccaagctcaaccgaagaggataacgtggaaagggaaaagcaaatggctcaaaaggcagcggtgttgttgctttacggagagatgcttcaggaaatgggaaagaaatggcgtgcccagttccaggcttcggattctagtgaatga

SEQ ID NO: 78897 - DNA, 529 bp, Glycine max
  Peptide Sequence Number=SeqID_195675
agatgtggcttttgtattccaagtacaaccaaaatccattgaagaatgtttacttgatgtacattggttattggcaatgcaagaagaattaaaccaattgaaaaggaatgaaatttgggatcttgtgctaggaatgaatgatccacaaggtagccaagaagaatgcattgattatgatgaaacttatgctcatgttgcaagacttgaggctataagacttcttctagcttttgcttctttaatggattttatgcttttccaaatggatgtcaaaagttcttgtttgaatggatacataaaggataaagtctatgtttctcaaccccttgaatttattgattatgatttttctaatcttgtatacaaactaaagaaagcactatatggacttaagcaagcccctaggtcttggtatgaaagattgagtaatttcttactgaacaaaagtttgcaagagctacttgctaatgatggcttgtgcaagaaatttgctaagaccatgcagggagagagttcaaaatgttcatga

SEQ ID NO: 78898 - DNA, 393 bp, Glycine max
  Peptide Sequence Number=SeqID_195676
atggccgaagaatttgtgaatggctttgttcatcaaaacggcatcgctgtcataacccataatccccccaaaggtgatggggagaaaaagaccaaaatttggataatattggctgttgtggtggggctgatctgccttggaatccatatatttctggtatggaggtttaagagaaaacctaaagcaatttcatcagcttttggttataacaacaatatcgaaacttgcttttcatcgtggcatgaaactttcttttcatcgaatagccgcaaaggaaaggagacacgtgacatgaacgatgaaccacacacacaccgcgttctcctattgccattgggtcggtggtcaacttttcattcttactctaaggaatattgcatcttcctattatag

SEQ ID NO: 78899 - DNA, 413 bp, Glycine max
  Peptide Sequence Number=SeqID_195677
aatatccctaaaggaagtggtgtctggacgcctttcctttcaatcaaagcggattcgagctcgcccgctctaacggcttgtttccgaaggtctggactcgaagagggagtcgattcactcaagacagctagaggacgagagaaagccttaccagaagtgaagatcctgaataaatcgcgcatgctccaaggacttcacggaattaggaggcacacaggtagcaagagaaatgcgggcacggaagcaggaacaggcccatctgtggcatcggatttgaatgccgagaggaagaggaatccattgactgaaatccattcttggtttcaacttgctgagtctcggaatcagttccgtgggcgtcaacaagctaattggttaggcgcgttgtggtttccttggattatttacaagcg

SEQ ID NO: 78900 - DNA, 153 bp, Glycine max
  Peptide Sequence Number=SeqID_195678
atgacgacagtggtggcgcagcgcaacggcacatgggcagcaaggcttcgacgtgacagtgaggtgtttcaaggcagcaaagcttcggagttgtcaggacaaaacaacaatatctccaacttgaagtccagactcatccacaatccaaactaa

SEQ ID NO: 78901 - DNA, 192 bp, Glycine max
  Peptide Sequence Number=SeqID_195679
atgtgcatgatgatagacacgcatgagaggttgaatggagtgacttcaagaatatgcatgagtagttttgcccaagggcatgttccaaaggttggtcaagttgttgttaattgtgatggttccataaaagataatgactcttattcgagttgtggtggccttgtgacagaccattttggaagtttatggtag

SEQ ID NO: 78902 - DNA, 615 bp, Glycine max
  Peptide Sequence Number=SeqID_195680
atggactgggctagcgtattcttcctgaaaacaagccatataagcaccaacaaggtattcttcagaagagcaaagtttaaagaagttgcatcaaattcatcattaaaatatgcgaagaggcatcatccttttcgttcattagccgttgaagatgatttgaaatgccctctactatgtttaatggtgtatcgacctttgcaagcatctgctcagtttgatcttagtgttcttccattttgcacatcatccccaatgatcgtgtttttgtgcccctgggtgaaaattttttggtttggtggcctaggacagcctggatatagtgatgtaggaaagatgtatgctgctcaggattctggagccaagatgacaaatgttgtagccattgcaactgcctttgggggaggtctgcctcctggaataagtgggacaaatgacaggtgtatagttgatgtatcaaatcttaatcttgataaaattgatgaggataaactattcaacttgttctctatttataggaacattatgagcattaaacttctccaagataaaccaaatcatgcacttatccagatgagagatgattttcaagaagaattggttgtacactttctgtag

SEQ ID NO: 78903 - DNA, 306 bp, Glycine max
  Peptide Sequence Number=SeqID_195681
atgatatacctgatatggttgttggtgagcatgttcggcgtcaactatagcgggctgccggcgtcgggccctggccaagcaagggtgactgtagcagaggggcatgcaactgtgagggcgccgcaaaacatgaagggcaagtgcattctctgggcggatcgtaaagtcgttgaagaggaagatgcaaagctagtgaaccttagtcgcaaatctgacggagaagaaggaatcagacccatgtatttgcataagcgtaatcctaaccctcttcttgcactgcctccaaacatctcaagtgcgacatga

SEQ ID NO: 78904 - DNA, 414 bp, Glycine max
  Peptide Sequence Number=SeqID_195682
atggaattaaagcaactcgatgtcaaaactttctttctccatggaaaactagaggaggacatattaatgcaacaacttgaaggttttaaggtggaaggaaatgaaattttagtttgtagattgaagaggtctctttctgggaggaagcaaactccaaggcaatggtacaagagattcaatgagttcattgtctctcatgggtacatcaaaagtccctatgactcatgtgtttatcatagcaaggtggaggatggttcccgcatttatctactgctctatatggacaacatgctcatagcctctcaaaatttgttggcaattcaaaagttgaagtcactactcagcagtgaatttaagatgaaggacatgagagttgttgaaaagattttaggcatggagatcaagagggattga

SEQ ID NO: 78905 - DNA, 396 bp, Glycine max
  Peptide Sequence Number=SeqID_195683
atgtcatgtgctttatctagttactcaaattctaaccttgctgcaaacttggatgcaaggagatctgtgacaggatacacattcacaattggcaactctcttgccaattggaaggcaacacttcagtccataatggctttatccactacagaggtagagtatgcgactctgttagaagcaacaaaggaagggatttggttgaagggtttggatcaagtccatcatgagaggactaagcacattgacatcgtataccacttcattcgtattgagaagagggtccatgttcagaaagttgatacaagggagaatccagctgatatgttcatgaagcttgttccaagaagaaagttcatgtattgtctagatttacttgacatagattgttggaaatga

SEQ ID NO: 78906 - DNA, 255 bp, Glycine max
  Peptide Sequence Number=SeqID_195684
atggccagagcagctgaggtcatgcaatttgaccagttgattgtgtattgcgcactgaagtgctctaccagagtgtcgaagctatcgatggatctcgatggaagtccaccgtactgggtcaatggtgttcctttgagggacgttgagaagacacaacacatgatcacatcaacattggtgtatagattgacctgggtgaggaaagcatctaaatgctcatttggatcggtagttcatcataccgctctaggttga

SEQ ID NO: 78907 - DNA, 384 bp, Glycine max
  Peptide Sequence Number=SeqID_195685
atggttaagcattgcttcaagattaagacaaggttgcttcaacaaacaagcattgctttaagattcattcaagatcagcttttgcctcaaaacacattgtttccaacatatcaaggctctggtaatcgattaccaggcagtgtaatcgattaccagaagacaagtttgcaaataagcttcttaaaaggcacaagagagagatattctaagagaacttcattgccaaatgctctctcatcaactcttgggaaaaacacttgcaaatctactgagagtcatccaggaacatcaaattatattatccactctaaaggagagaaatctttctgtttatttcagaaaaacattattgaattgattgctgcttcttcttctacattctga

SEQ ID NO: 78908 - DNA, 459 bp, Glycine max
  Peptide Sequence Number=SeqID_195686
atgcagttttggagttgttggagagtgtatgtgtttaagaagaccggagccattgaaaggggtctcagatctgaggccagactgagtactaaccctgggtgcgaaaagagagataacgagagatcgtggggtatgttttaccgcagccccacggtgggcgccaaatgtacttaccaaaatctagaacaggtgcacgtcaggatggaagtggacgaggtgggctccaagacttcgtacgtcggacagagagaggcctttgttataagggcaagatgggggacttgtaaaacaaagaactcaaacgctcaaggttcgagggaacctggtatttatagagtggaatggagttatgagtccttatttgtaggggttgttatagcccttgcagggctgacatggaaggctgacatgtgtctcaaagtgtcacgtaagatgccacgtgtattttgtggaccctag

SEQ ID NO: 78909 - DNA, 243 bp, Glycine max
  Peptide Sequence Number=SeqID_195687
atgtcagacctcacctgcaaaaccaaaagcatgtccacctcggacaacttgacagaagtagcccggacaacacttgtccaagctcaggggctttacaagcttgacagatctataattctcacatctatcgaagttaccattctcaacactggacaacacatgtccatgcttaagggcttgatgaactcatcaccctcctactcgtcaaggctactaccctcgacatcagacaatctcctttga

SEQ ID NO: 78910 - DNA, 126 bp, Glycine max
  Peptide Sequence Number=SeqID_195688
atggaaaaggccgagggtttgcgtgttttgaaaatgaggattcgaaagttgtttacgcaagaggaagggtgttttcctcgctcttacgtattcctcaattgcgatgaggaaatcagacctacatag

SEQ ID NO: 78911 - DNA, 276 bp, Glycine max
  Peptide Sequence Number=SeqID_195689
atgaggatttcgcttcaattaaagtgttcttctctgtgtggtggtccggtggcaagcaaaagcgactcgtggtggccaccagtggccgtgggtggtggaagaggagggatctcacttagtgagctcgtctcgctaagcaggaatccacttttggcattgagcacggcctctccgcgcctgtctcgcgaagcaagttttcctctcgggttgggagttgcgcttagcgcgcttgtctcgctaagtgaattcccttctcgggttgggagttgcgcttag

SEQ ID NO: 78912 - DNA, 300 bp, Glycine max
  Peptide Sequence Number=SeqID_195690
atgtggtgtcttgtggagaacaggttcttcaaggaatcaagtgaagaagagagagagcatgctgagaagcttataaagtatcagaacattcgtggtggacgagtggtgctgcaccctatcacaagtcctccctcagaatttgagcattcggaaaaaggggatgccttgtatgccatggaactagctctttctttggagaagttgacaaatgagaaacttctgcatgttcacagtgtggcagatcgtaacaatgatcctcaactagcagacttcattgagagcgagttcttgtatgagcag

SEQ ID NO: 78913 - DNA, 429 bp, Glycine max
  Peptide Sequence Number=SeqID_195691
atggcgtcccgaagaggtggagtctcactcccagacaaacctagcaacaactcaagctccatcctcgtgaagatctcgcgctcctccatcatcacccacgacaaggaagctgccggcgatgccgcatttgtcgccaagaagctcctccgcagcaccggcaaggctgcgtgtattccttttgcctctttctttgttgttcgaatacctgaagcggaaattccgaacttgataaagacccttcggggattcaatgacacaaaaattgaattcaagctggcaaatgttcagaaaatatggcaaagattcttgtatcgtgattctgttttgcttgaagctgaaaggcaaaaaactattattggacatgttgatgattgggctgttgaattcttaaagctaacagaggatgatgcctttgccactttaatacag

SEQ ID NO: 78914 - DNA, 360 bp, Glycine max
  Peptide Sequence Number=SeqID_195692
atggggaaggtgggagtgagaggcatgtgggagaaaagggatcggaaaatgggaagagtgggagatgcgattcgacgatggcgatgttttggtttgattgagaatttgtttgtggaaattggaattgaagggtttggctttttagggttcttatatggtgcgaaaagggaggaacatggtgttatttggattcaagttcctcctggtgcagttgaacccttgttctttcccataattcgtggcaaacttcagagtcatgctagcctaaacaccaatggaccttttgttttcaatgtaaattcttttggtgtcgttggggatggtgtctctgatgatacgaaagcatttaacttggcctag

SEQ ID NO: 78915 - DNA, 270 bp, Glycine max
  Peptide Sequence Number=SeqID_195693
atgcacgctgctttaaagcagagggagcaacaatttaggggtttgagggcttccatgatgaaggagaaggaggaggaattcacattgtttctagagatgaagaagtgtgagaatcaacgcaatgaccttcttcttaacagctttgaggagttcgatgcacctctcaatctgagagccattaacaccaagcgagactacgagatgtgtttgtgtgatgtgtgtggaagaaagacgaagagggagagagagagagagagaaagagaggataa

SEQ ID NO: 78916 - DNA, 150 bp, Glycine max
  Peptide Sequence Number=SeqID_195694
atgacctctggacttcagggaattcaaggaccctttactttagccttcccacacctatttatagcaaaacaaggcatttgggatgaaggtagctcgcctgggcgagctggttacttcatcatgaagttatctaggtggttcaggggctga

SEQ ID NO: 78917 - DNA, 192 bp, Glycine max
  Peptide Sequence Number=SeqID_195695
atgtcccttcagaagaggtactcaagtattcggtcatatcagttaccaaagtacactcaaactccaagcatgccaagatgctcattcaagaaaggtacgcgagcattcggccaagccgagtacttgagtcctcaattttcttgcatctttggatgttcccttaacaaatattcagtcaatcctaataagtaa

SEQ ID NO: 78918 - DNA, 156 bp, Glycine max
  Peptide Sequence Number=SeqID_195696
atgaagattacaaaggaagatgaagagagaaaagaaataactttcattgtagcagggacacttctcgctacggtgaatgttcatctttcgcaaggtacacttcacttgaatctttatgcctctaatccactctcgctatggggagttcttgcttaa

SEQ ID NO: 78919 - DNA, 297 bp, Glycine max
  Peptide Sequence Number=SeqID_195697
atgaaatttgaacataaattgttactctgtgtagacacgagatatgggaccataggcatatgcaatgtgactaagagacacactcaccctaggtccggtgcagaccctgttttcattcatcaaggatcgttgacacctttgctacagcctcctctttctgctgtttcaagctctaacagcattttgacatttctccctttcaacaagtcccgggctcgggtgaagaaaatgcttggcaccctcaaatccaacatgatggtgaaatttcatgattacatatcgatgtatggtatttga

SEQ ID NO: 78920 - DNA, 498 bp, Glycine max
  Peptide Sequence Number=SeqID_195698
atgggaagaaagaaggggtatgttgagttcgaggagtcgccgccggacgatttcgatccggcgaatccgtacaaggacccggtggcgatgctggagatgagggagcacatcgtgagagagaagtggatccaaatcgagaaggccaagatcattagggagaagctccgctggtgctaccgcatcgaaggcgtcaaccacctccagaagtgccgccacctcgtcaaccagtatctcgagtccacccgcggcatcggttggggcaaggacggtcgccacccatctctccacggtcacccttctctcttccaatttcaatctactagggttttaggaattctcaatttggaaaattatgaaacatttgatgatttccttaatgctgtttggaatttatattcttccttgtctgttgatggattgtcacttgattgttatcaccttaaacttctcggtgcagatcctctcatttctggttatgacactagtgcagatgactag

SEQ ID NO: 78921 - DNA, 780 bp, Glycine max
  Peptide Sequence Number=SeqID_195699
atgacgatcttatcctttcgtgtaaatttacaaacaacagggagggaaaaaggggacacagacaggcacagagggaacaaactttggtgctactacgcagtaactcgggatcgatcagatatgttttgtagatttataacgggatcccaggatatccatgataaatttgttgcccataatcacggtgaatatatgtgccttgaaccggagcaactatggtgcggcgcaagcgtgggaggcctccaccggaaaattctccgtccaaacggagaagaagacgttctccgttggaatgttgtaagagataggttttctcttccaaagactcttccaattgcacgaaaagtgaatacagtttgttgtggttattttcctgccaaggaaaagagattgtcaccaaatgtaaaaagtggagaatttaatcgccagatgccattctacatattcaaatacattttggtcagtgccttctcccaaattgcagttgctttaggaggagggatgattatattgtgcttacctcatatttactattttgaacaattccatccagatctgtattctaacattccacatagtttcttggagtgggaaaggtggaaaaggctcatacttgaagagattaataactataatgccagcatactgtgtttccaggaggttgttcattttaatgatctagatgatcttttccagaacagtggctttaaaggtgtttacaaggctcgcacaggagaagcactagatggatgtgctgtattttggaaagacaatttgtag

SEQ ID NO: 78922 - DNA, 342 bp, Glycine max
  Peptide Sequence Number=SeqID_195700
atgtgtcacatctacactttcgtgccactgtgcaccaccttctcgcatcaacctagggttgccatgtggaacgatagggaagatagctctattgctgacaaagatgaagagggtggagtccacgttggggaggaggtggttggtggagtaccagcggtgggcagaggggagttcgagccaatcgcaggtgacaaaggtggtgggacaggggagaaggtgttgactttcttttcgtcgtcaagacgtcaacaggggtggggcatgggcggcaccacattcatatttcagaagagagggtgtttgcgtggggtagggaagagggagaggaggtgttatggctaa

SEQ ID NO: 78923 - DNA, 291 bp, Glycine max
  Peptide Sequence Number=SeqID_195701
atgggaaaagcaagggacaggaccgaagatttcaaagacgccgtgcgccacaccgctcgctctttgggctacgatgaggctaaattggcgtccgttatggcttctttcattattcataaaccgccgcaaaagtccccgttttccaaagctgcattgaagacgttggagagtattggagagctggatcagtttttgttgaagcacagaaaggactacacggatctgcatcgcacaactgaaaaggagagagatagcattgagcatgaagtaagccggggacacttgttttga

SEQ ID NO: 78924 - DNA, 942 bp, Glycine max
  Peptide Sequence Number=SeqID_195702
atgtcatttcctaggcaaactcagaaacaaggaatggaatgtaagagaggaaaagagaaagctccagccaaagaagaaaacataaacacattgaggaaaattaaaattgtgtacactgaccctgatgccacagattcttcaagtgaagaagatgataagtttttgagcaatggttatcggttaaatggatgctctaagcgggttgtcaaggaaatttcgcttccatgcatgccaagcaaattacatgaagagaattcttcacaagaagatgtcaatagtgaaaagatcaaagcaagtaggaggaacaggaaaccatcaagcatgtacaaaggagttcaacgtaggaaatgggggaaatatgtagcagaaattaaagaccctattcggggggtcagaatgtggcttggtacttttgatactgaagaagaggctgttgtggcatatgagagaaagaggaatgagtttgacagctctttgttggctttgagcaaaagggatgcattggcttgtgaaagttccaaagaaaaagaagtattgtttcatccatctccgtcatcagtgcttgatgtcagcactacaaaagctccactagatgttaatgaccttaatggctcagtcaaagaaaaggaaaatgtggacacaaatggtgaaggaggaggcattgatgtggaaccagtttatagtgaagacaattcaattttgcatttgctagaggagccagttgtggcatcattggctggtcgtgatgatttctatttggatgaaatagagaaagagataatgctgtttggtaatgacttttataatttcttggacaatgacatgaaaggtggttctgtgtggaatgtggaacatggggagggcaccacccttccccctgtagacagtgcttttgaagagttagcttggattgatgaaactctaaattgggaatgttcctaa

SEQ ID NO: 78925 - DNA, 288 bp, Glycine max
  Peptide Sequence Number=SeqID_195703
atgactgattttcaaatgtacatggcaagaaagaaaaggagtaaaccttcatctatgaaaacagagttagatcatttcttagaggataatttgtcgattacattagattttgagatcttagcatggtggaaacaaaatgagggcaaagtatccaactctacaagcaattacaagagatgtttaggctctaaggaaattcaagaaatagctactttagtgattgaaattgaatccgatgatgaaggtgaattgttggttaatgacattactcaacaattggataattaa

SEQ ID NO: 78926 - DNA, 1373 bp, Glycine max
  Peptide Sequence Number=SeqID_195704
gaatgaacttcacaaagaggaacactcagaagtataacttcaaggacccggatttgacaaatttaaggaagctaggatccttggtagttagtccggacgacttccgaaaacgctacgggaatttgctcagcatcctcaagacaaacgttgaagaggggatccttaataccttggtccagttctatgaccctctctatcattgtttcacgttcccagattaccagcttgtccccactttggaagaatactcctacctagtcgacttaccggtgtctgacaagttacctttcagtggcctcgaaccaactcctaaacctttaactattgccgcagctctccacctcaaaacttccgacataaccagtaaccttactaccaaaggaggcttccaaggcctaactcccagtttcctctaccaaaaagcctacacctttgccgaagccgccagtaccggtgccttcgaagccatccttgccctactcatctatggccttatactcttccctaacatcgacgatttcatcgacattaacagaatccaaattttcatatccggaaaccctgtccccaccttacttgcaaacacctaccattccattcaccacagaacacaaaagaaatgcggaattatcacttgttgtgcacctttgctatacaaaatcatgtccctcactccaactgatatcctttggtaccaaccagctagtgacattggagtaatcatcgacagttgtggagagtttcctaatgtacccctcatcagtacacgtggaggaatcacttacaaccccactcttgccagacgccagtttggataccccatgaaggaaaaacctaacaacttctccttaaccggtgaattctacctcaaccacgaggaccatgcaggcatgagattgagatttgtgcgagcctggcacactgttcgtaggcttgataggaatcagttaggaagaaggacgggttttgtacatggatcctatactcagtgggtcgtcgacagagcttcgattcttggtttaccctaccccctacccaggcacgtatcctcaaccgttccatcaccatccttacctgtgccctttgataacaaagaggaatgcaatgagcagttgattcaaatgcggcttgaaagggatacttggaagagaaaataccaggagctcgagcgtgagaatgagaccttgaagggaaagctggcacagaaagatcatgagcttttcgttcagaatcagaggataattgagaaggatgacttactccgtcgaaaggacgctttgctcagacaagattccaagaggagaaggaggtttatggattcgctctctagtgcacatccggatttcgaggacccatctactccgggagtttga

SEQ ID NO: 78927 - DNA, 1011 bp, Glycine max
  Peptide Sequence Number=SeqID_195705
atggatctaattgagcaagaaaatcagagtctcaaggaggaggttgccactttacgagaaggaatggataggttgacgaccatgatgaatgcactcctgtccgcccagaattctcaagctgctgctgctgttgtagatcagcctttcatgcctccaggttgtacatggggaatgccacctccagcctgtggaaatatccagcccgctgtatctgaagttccactttctttcgctcagcagttagcaccggttccacaacccggcacatctttccctcaagctgcaatgacttattcagcaccactgattcacactattcaacaagaggttgagccaatttaccatgctgaaagtattggagctctggacaaggtggacgaactccaagaaagatttgatggtatgcaaaaagaagtcgaagccctccgaggaagagatttgttcgggaaggatgcccgtgaattatgtttggtcccaaatgttactattccccacaagttcaaggtgctagacttcgagaagtataaaggaaacacttgtccccgcagtcacttggtgatgtacgcgcgaaaaatgtccatgtatactgataaccataagttgctcatccacttctttcaggatagcctgactggcgctgctctgaaatggtatatgaatctggatagtgcaaacatccgaacctttaatgatcttggtgaagcgttcatccgtcagtataaatacaatctggacatggccccagatcgtgatcaactccgtgcaatgacgcagaaagacaaggaaacgttcaaagagtatgcccagcgttggagggaagtggctgcccagattgtcccaccattggaagaaaaggaaatgacgaagatatttttgaagaccctgagtcaattttattacgagaaaatggttgcaagtgcaccaacagacttcaccgaaatggtcaacatgggtgtgcgattggaggaaggtgtccgagagggacgtttgaccgtggaaagtactcctgct

SEQ ID NO: 78928 - DNA, 411 bp, Glycine max
  Peptide Sequence Number=SeqID_195706
atgaagccaccattctcaccttcttcttcccttctcagaggcaaagcacgcctctctccctacctcttcaccctcatagttttcatcctctttgtcgctatcctctatggcgaagacttcatgtgcatcttcggtcaacagttccaaaactactctaattaccctcacaaactctcctccacaaccgagagggtgaagaggcagaagcttccgtttgcggtggggaaggcggaggaagggtgtgacgtgttcagcggaagctgggttcgggacgagttgactcggccgttgtacgaggaatcggaatgtccgtacattcagccacaattgacttgtcaagaacatggacgacccgacaaggattaccagcattggaggtggcaacctcacggttgcgatcttcccaagtaa

SEQ ID NO: 78929 - DNA, 210 bp, Glycine max
  Peptide Sequence Number=SeqID_195707
atgacgacgttagtatctgtgtgtcaatggacttgcttgcctctagctgacaaaaggtatctccgcatgtcatcggacttgccgtctctggatgacaaaggtgtggataaccgtaaggtgtcttcgcatgctgccggactcactggtcacaatagcaaaaagtgtgcgcggataaccatcaggtgtctccgcgtgccaccggactcatag

SEQ ID NO: 78930 - DNA, 227 bp, Glycine max
  Peptide Sequence Number=SeqID_195708
actgctcttggaacagtcgtgggtgctcaaagctcaaagctttctacactgccagctaacaagttgattgtgctttacgtggttttcaagcttgacgagagttacacgccaagcaaagtttccatccttgccggtgatggttttcacaacttgaaggagattaagaccgtggaactcgtgaagccaactgggtgggtatatctatccttgtctggagctgatcctag

SEQ ID NO: 78931 - DNA, 404 bp, Glycine max
  Peptide Sequence Number=SeqID_195709
atggcggcttatcgcccacctctttttgttgcaccgatggcctcaaagaagagccatgatggccctagtagacctcaggagggaagcccacattggactcctcctggtttatctctgaggttgcctgggtccaataccaggacaacatgcctcactcgcttgctagagaagcagatcggcgtggcattggtgaaggagttctactccaacatctatgacctggaggacagctctccaaagcagtttcgagtacgggggaaggtcgttaaattcaatgctcagacctaccctgatcaccagaccattacggctaagctatgcatgtcgggcggtcagttcactatgaacattgagggagctccatggaagattctgcaaaaggacctcaccatcctcgcccagaa

SEQ ID NO: 78932 - DNA, 1254 bp, Glycine max
  Peptide Sequence Number=SeqID_195710
cggcacgccgtcgttctttgtgcacccggcggaggcgctgcacggcgatctcggcatgatcggcgccgacgacgtggtggtgttcatctcctactccggccgcgccaaagagctggatctgatcctgccgctgctggcggagaacggcattccggtaatcgccgtcaccggcggcaaagagtcgccgctggcgcaggccgccgcctgcgtgctggatatcggcgtcgagcgcgaagcctgcccgatggggctggcaccgacctccagcgcggtcaacacgctgatgatgggcgatgccttggcgatggcgctgatgcgccagcgcggtttcaacgcggaagatttcgcccgctcgcacccgggcggcagcctgggggcgcgcctgctgaaccgcgtgcatcacctgatgcgcaccggcgatcgcctgccgcgcgtgagcgaaagcgccaacgtgatggaagcgatgctggagctgagccgcaccgggctcgggttagtggcggtctgcgacgcgcagcagcgggtggtgggcgtgtttaccgacggcgacctgcgccgctggctggtgaagggcaacagcctgcaggatccgctcagcccggcaatcacccgcccgggctatcggctgccggagcagtggcgcgccggcgaggcgctggaagcgctgcacgaacagcacatcagcgcggccccggtggtcgatatggacggcgtgctggtgggggcgctcaacctgcacgatctgcatcaggccggcatcggctgatcaacgccgggggggcgccatcaccggcgcccccagtcagatcatttccagtcgggattgttctcgaactgctgcttcagcagcgccttcatgtcgtcatccggtttgccgagccactgatacttggcgtatttcttcggatggtcgacggcttccggccggtcttccaccgccactcgcacgccccaggcctgggatttgtccgcgctgaacgccacgatcaaaaagttgttgccgcagtcgtgcggcttgcacaggttgccgaccagatactctttgcccttccagctcaggttctgcgccggcgtcgaggtgccgacgcccttgcgcgcccagcccggcatccgcgcctggcctttcaccatgttttgccagctggcctgataccccggctgctgaatcaaatccgacgtggtgacgatctgctgagcaaagctgcccgcgctgaagctgagcagtgcgccgaagagggcgcaacgcagcgcctg

SEQ ID NO: 78933 - DNA, 396 bp, Glycine max
  Peptide Sequence Number=SeqID_195711
atggtagcttggcctgggactcaaccttctcttcacagggaagatgctgggactcaaccttctcttcacagggaagatgaaggtcccacagcccaggtaccacaacatgtggaggatgagtcatctgaggccaccattccagagccatttgttgtaggggaggaggcaggtgagacacaggtgagacaggtagctgctgccactcctgagagatctcttgaggccactttaaatcctcctgcaccagtagaggacctaccctcacctcagcatgcagcagacccctccactcctaccctagagatacctgaggacctgaccacaccagtcctgactttggacacttctcctccagctactccagtacttcatctgacagatgaggaggatgtttag

SEQ ID NO: 78934 - DNA, 180 bp, Glycine max
  Peptide Sequence Number=SeqID_195712
atggaaaaggttggtcctgtctcccaggttttcaccaaaatagcagaagggatatggaatgaggaagagaaaaaattagttggaaatattggtgctgcagttttggtttgcctcttgagggagaacctaaaacaagttattttcaacgcatcctttctcacacatgtacatgaatcataa

SEQ ID NO: 78935 - DNA, 450 bp, Glycine max
  Peptide Sequence Number=SeqID_195713
atggaggaggaaggcccacaatccggcaagcccatcgagatagaaggaagccacttggagacgctcgccatcgggagtgccatggtagtcaaagaattgggaaattttgaatatccaggacatggcattgggaccattgaaacatggaacctcaacattcatgcagggtggagtttgccccaaagaatggtcgggggaactagtttagagggagttaaggagtcaatggaagcactagttgataggagtcgtggactcgaaaccttcttaaatttaaggccaggaagataccttagaattaagagaggagacaggtttctttatggtgatcaagatcgacttttcattgaagaaattcatattgatttgaagcattccaagactgaaacggttgtcatgttctgtatcactttgtgtgatgaccttgattaccttgacagaaaacacaca

SEQ ID NO: 78936 - DNA, 690 bp, Glycine max
  Peptide Sequence Number=SeqID_195714
atggcactttgccgcaagaaatgtttatgttataactacaacgaacgttacgaccccaatcataagtgtcaggcaaaattcttcctccatattgcctctgatgatgacgacctcatcattcgccctccccccaaccctggccccgaggatcctccttctgattctcaaattgatgccccatttctggcccaactgagcctctatgccttgtcgagtcacacagcttcagtgaccctacgtgtcacaagctcggttaatgggcacgatatggttgtcctcattgatgggggcaacatccatagcttcattcaggacaggatggttcatttcttgaacattgcagctcaacccacacagaggctcagtgtcatgattggtaatggcagtgaaattggttgtaatcaggtttgcaaaaatgttcccattttggtccaaggtcaccaattttatgtagacctttacgttatggcccttgggggtgctgatatggtttttggggtggcatggctcaaactcctcgtcccaattaccactgactattcacatgtcaccatgtctttcacacggaacaacaaatccataatgctacaagggtgcattgggcctggcccaacagaagctacacgtggccaagttaagcacgtgttgcacatggatcgagtggctgccctcttccacctccaactctaa

SEQ ID NO: 78937 - DNA, 285 bp, Glycine max
  Peptide Sequence Number=SeqID_195715
atggtgagggaagtttgggaaaagacatgtatggacaaatattctgatcaattatgtaagtataggaataaagtaaagaaaactgcaaattcaacagaatatgaagacttaaggtctcacgagcctagagggatgaaagatgaaatatggaacgagttgatagacatttggaaaacactcgaatggaagaagtctgatgctggaaggaaaaatagggttgcccatcataatgcaatggtgcacacaggaggctcaaggagctttgggcaacataaaagaattatg

SEQ ID NO: 78938 - DNA, 513 bp, Glycine max
  Peptide Sequence Number=SeqID_195716
atggaggaagcgcaaatttgggataagaaggtggagctgccagcattcatggggacagacccaattggttggattgctggggctgaaaaattatttgagctgcaatatgcattcatgagcatgaagggtgttgcgacacattggttctacatttggagccaaaacaatccagattcacattgggagtcattttccacagctttgataaaaagattcgaagatcaccatggtaaccacatctttgaaagattgagtatcttgaagcaagaaaattcaactaagacaaaaacccacatcaaaaaatgggagacttccacaaagttcttgaaagggaggaccgacatttcagagtggaaacacatgttgtgcaagatattgaatgaagaagttgattcccatgcctctcaacaagacaaaaatagcatggagggaaatgggacaaaattcagtgaagcaaaggctagttcttgggcaagaaaggtggaactacccaactttgatagaagcatataa

SEQ ID NO: 78939 - DNA, 180 bp, Glycine max
  Peptide Sequence Number=SeqID_195717
atgaatttgaaggacatggaacattgtctggagatgaaattgaagttgaaggtggaaaatttgaacttggtaatggttgatgagacacttcaggcatgggttgagaatggaaaaatcctcataaaaatcacattacaagagattgatatggctcggttttgtagattaaacacaacataa

SEQ ID NO: 78940 - DNA, 441 bp, Glycine max
  Peptide Sequence Number=SeqID_195718
atggcggttcactgtgactgtggcttgtgttataattgcgatgaacgatacgatccccaccacaaatgcaaggcgaagttctttctccttatcaccaataacgatgatgacctagtagatcctactctttccgatttaacttcaatggttgttgatgatccctcctccgatattggtcattcagatagttcatcccctgcccgaataagttttcacgatttatcgggacaccttacttctgccaccttgcgtgttgatggttttgttaatgggcacgacgttgtggtcctcatcgatgggggtagttcccacaatttcgtcaaggatggtgttagtcggttgatgactccccattgcagttactttttgtgcatttatctctccaggaaatttcaatggggagttttcactggaaagtgcaccgagtcgtcatgtatttaa

SEQ ID NO: 78941 - DNA, 256 bp, Glycine max
  Peptide Sequence Number=SeqID_195719
actcatcttctccttgaagtggcgtctcctctctctctcttccttctccattccgctgccattcatcttccaagaagtaaaggaatccattgatgaagaagatcctaggcctacaagctccaatgaagcttacatcagtaacacttttaatagccaacaagcagtttcacatagtttggttgaacataagttgaattactttgctgtagttgaactaggtttggctctgagttcttctaatgccattactcattag

SEQ ID NO: 78942 - DNA, 936 bp, Glycine max
  Peptide Sequence Number=SeqID_195720
atggatgtgaagaccgctttccttaatggggacattgaggaagaaatttacatggcgcagccggaaggcttcatatcttctggagatgagcaaaaggtttgcaaactccagcgatccatttatggattgaaacaagcatcccgtagttggaacaaaaggttcgacacaactatcaaagagtttgaatttgtgaaaaacccggaggaaccttgtgtctacaagaaggttagtgggagtgcagtgactttccttgtactttatgttgatgacatactactcattgggaatgatgtagggatgttgcagtcaactaaagtatggttatccacacgtttctcgatgaaggatttgggagaagcatcctacgtattgggaatacggatctatagagatagatcgaggagattgcttggcttgtcccaatccatgtacatagacaccgttcttaaacggtttagcatggaagaatccaagaagggattcttgccaatgtcccatggggttcgtctctcgaaatccatgcgtcctcaaacgcaaatggaaatcgaggagatgaaaaggacaccttatgcatccgctataggaagcataatgtatggcatgttgtgtacacgacctgatattgtgtatgttgtgagcgtcacaagcagatatcagtccgaccccggcccagcccattggaaggctgtgaaggacattctcaagtacttgcgaagaactcgagatttgtttttggtctatggggataccgagttgaaattagaaggcttcacggattctagttttcaatcggacgtggatgactcgaagtcaaactcggggtatttattcaaagtcaacgggggtgtcgtgtgttggaagagttccaaacaaggcacgatggctgattccaccaccgaggctgagatatattgcagcatcagatgcttcaaatga

SEQ ID NO: 78943 - DNA, 336 bp, Glycine max
  Peptide Sequence Number=SeqID_195721
atggagtggcaaaagaagggtttgatcgagaagattgtggacccttttattgtggacgagataaaaccgagctctttgaagaagtttggggaaacggctgagaagtgtttggctgagtacggtgtggataggccgactatgggggatcttcagacgaacgaaaggaaaagggaacatgggattgatgctgatgatggctccgaagcggcggtaacaccaccacctatgggtgttccggcaaggcgtggtggcgttgatgcggacagtgatgatggtacttcggatatatcgagcagccgtgttttttcgcagctgataaccaatgaaggcagataa

SEQ ID NO: 78944 - DNA, 477 bp, Glycine max
  Peptide Sequence Number=SeqID_195722
atgaccaagtcaccctacaaagggataatggaacgagccgaaggtcttttggatttgatccatacagacgtatgtggtccactaagtgttagtgcgaagggtggatataactacttcgctacctttaccgacgattattctaggtatgggtatgtgtacttgatgaagtacaagtctgaaacatttgaaaggttcaaagattttagacacgaagtagaaaagcaactcggacgaagtattaagaagctgcgatccgatcgtggtggggaatacttgagcatcgagttcattgactatctaaaagaaaatgggatacagtcccaatggactccaccgggaactcctcaacttaatggagtatccgaacgtcggaatcgaactttattagatatggttcgatcaatgatgggggttcacaaacttaccggcatacttgtggggtcatgcactccgtactgccgcgtatttgctgaatag

SEQ ID NO: 78945 - DNA, 261 bp, Glycine max
  Peptide Sequence Number=SeqID_195723
atgccggataggttattcctcctcgaaaatgatgaagatcatgttgatcttggacgagatccaggaacatacaatgaggccggtatggaccttggagatccacccaaaggaattgttcctataggctgcaaatggatctataagaagaaaattggagttgatgaaaaggtatcgacctataaagctagattggtagcaaaagggatacactcaaaggcaaggtgtgactatgaggaaaccttttcgcagtcgcgatgctga

SEQ ID NO: 78946 - DNA, 812 bp, Glycine max
  Peptide Sequence Number=SeqID_195724
atggcaagaatagcaaaagtggtcgagatctcggaacaagagctagaccgagtgaagcaaaataggaatggagcggcaggggtaccaaggaagcacttggaggagaaggcggaagctctaaccagccaaggagaatgggcaacattcatcgatgtattagctctgatagtgtttgggacagtactgttcccgaatgtagacgacctgtttgtcccctataaggtcatcgcatgtttctccgaaaagggtaaagcaaattgggaaaaactcttagcaagcatgatgggagcgtccattagttggttcccacagtggaaagaaggaggggcaggagtgttatgctcatgctaccctctgagaggtgttccgtcggaggaaatcatcaccactttcatcgcgcgaggaagacaagataaagagattaagggaagtagcaatggcgtcattggcggctatcacaagtggttgaagtctagaccgcaagggatgacttggctcccaaagctaaaaagtctaagtgggaaaaaggctgaaattcttgaggaaagtgaagaagtgcaagctttgaaagcagagctcgaaaagacaagagtggcgaaagagaagctaaagacgacagtcactagggttacgaaagataatgagctcaagcttaaaagggccgagaaggaagaatcaaggatggaaaacatggtgttagaggataagtcaaaggcttgtcagaggtcaaagagaagtttgacaaaacagtgttcgcactctgggatactgcttgtttgtgtggatgcgaaatctaccggcaagtgcaccag

SEQ ID NO: 78947 - DNA, 351 bp, Glycine max
  Peptide Sequence Number=SeqID_195725
atggatgctagatggatgcagttcgatgactacattgcacttgtaggggaaatttgtgtagtgtttggccaatgtttgtcagattacatagagtggttctacatgatttcacattcttttatgacttcagcacagccaggggatcctcctagagttctgctggttcagcaatatgacacatttgttgaaccagatgtgcctcagcaaccggtggcggcagcggcacctgatgaaacagacgttgatgtgcgtcgtcctcgacatgcagtggatggttatgtagcaattgctgataaattggagaggctactgaacctgaggatcctgaccgaaggaataaaaagcctataa

SEQ ID NO: 78948 - DNA, 219 bp, Glycine max
  Peptide Sequence Number=SeqID_195726
atgtgtgtagttaagaaggtgatatggaccttccgacttcccgtgacaaaagacgagaccaacatacaatggggactaccagcaacaatatgttatcaaagagaaaaactctacatgagggttcactgttatcaagcaagtcggagacccagcatgaccacagacttacctccactccttatgttcccatggactcgggtgtatatgtgcatcaaatga

SEQ ID NO: 78949 - DNA, 246 bp, Glycine max
  Peptide Sequence Number=SeqID_195727
atgccttcaactcaagaagaacaaatttcgttgaaacttctggtatacaaaaagaccaacaaagtcatacttgcagaggcagggaaggactttgtggatgttctcttttgcttcttaacaatgccattaggaaccatcgccagacttgtgcagacgtcagatttgggaccaggtggagttggttgtttaagctcattgtatggaagtgtgacaaatcttcaggagtatctgttcacagtaacatga

SEQ ID NO: 78950 - DNA, 717 bp, Glycine max
  Peptide Sequence Number=SeqID_195728
atgaacttcccttgcagctatgaccttttgagtgctttcaaaaatgaaagtttcaactgcggggatcttttagcccgttcagtttctgttaaaagtgacaaagtctacaacggatttgtaaaggatgttgcaacttttattgtcacggatgatctggttgtcattccaaatgcaatggattcaagctttggtgtcttacagaaatttggagtaaaaagctggagttctatacaggagatgactgtgaatgtcacaaagaaaaaggactatgactactatccaaatcaaagtgcaagtaattatgagaaaatcaggtgggaaggatattcttctataggaagcattgatggattgtacaatagcatagttggtttaaatgaaaacaaatatttgatagcaaaggaagtgaaaaacaggcttgttgatcctggccttgccccacagttcaaattaagcatgaaggtgtttccaattattgaacagacttcacaatatcattgttattatcaacgtagaggttatacagatagcaattatttctatttaactaatggatgtaggagttatggtaaaaatattgaaacttgtaaagtcttgaagtcatgtagtggaagtcttaaaggttatgccaagggtcagcgatgttcatggctaccgatgacttggttgtggaacgaatgtcaccctcttcaggtgtatctttactcaaccgtttaa

SEQ ID NO: 78951 - DNA, 258 bp, Glycine max
  Peptide Sequence Number=SeqID_195729
atggctaagtcattagttggagatccatatgttggtcgactgactaaggatgagaagactattattggtgatatgaaaaagtcaatggtcaagccaaagaatattcttctgacattgaaggagcacaatgccactagttgtacaacaatgaagcaatatattcattggcatagactaaaggatgaagatgttgtgcgtgatatattttggagtcatcctgatgcaatgaaattaaccaatgcctgtaatttgggttga

SEQ ID NO: 78952 - DNA, 213 bp, Glycine max
  Peptide Sequence Number=SeqID_195730
atgggtcttgcagatcttgccatgacggccttgcgcttcgtgccaccaagctctatgcctggtggcatcaaggcccacgccaccctccgtcgtggtgcctccgttttgtttcactgtcaaggtgctgctgttgcacctagggttttccaacctttcccttacttgcgggttgggccagatcactccaacccagctctaaccctagcccattaa

SEQ ID NO: 78953 - DNA, 393 bp, Glycine max
  Peptide Sequence Number=SeqID_195731
atgaccaagtcaccctacaaagggaaaatggaacgagccgagggtcttttggatttgatccatacagacgtatgtggtccactaactgttagtgcgaagggtggatataactacttcgctacctttaccgacgattattctaggtatgggtatgtgtacttgatgaagtacaagtttgaaacatttgaaaggttcaaagattttagacacgaagtggaaaagcaactccgacgaagtatcaagaagctgcgatccgatcgtggtggagaatacttgagcatcgagttcattcactatctaaaagagaatgggatacaatcccaatggactccaccgggaactcctcaacttaatggagtctccgaacgtcggaatcgaactttattagatatg

SEQ ID NO: 78954 - DNA, 489 bp, Glycine max
  Peptide Sequence Number=SeqID_195732
atggagcccgcgcttgcgaggaaatatgagtctcacttgcatgctttcgatataaaggctcatctcgatagcatgtatagtgagaatattagggcatcgaggtacgctgctacaaaggagttgatcacggcgagactgcgcgaagggacttcggtccacgagcactgtctcaaaatgatcactctccttgaaaagctagtgaatctcgatgtcaccctcccggccgagctctcgttggatttgatcctgttgtctcttcctagttcctatgaatcgttcatagtgaacttcaacatgaacaaactagatcctcccttggatgagttaatgaacatgttggtcagtttcgagtccaccattaagaaagagaagtttgttctcattgctgctacttttggaaagaagagttcttcccaaaagaagataaaggaaagagttcccttcccaaacagcaagttcgaagttggtgaaggtagtgggggcccctaa

SEQ ID NO: 78955 - DNA, 474 bp, Glycine max
  Peptide Sequence Number=SeqID_195733
atgcaggtcaacaattggtatcagagcttatttgatcttgagggactgatggagaatgttgaaccaccagctttggaagaaaatcccactgttgctcagattagatctcatagtgagcaagttgccacaagagcaaaggatcttaccatcttgcacttagttgtggatggtgatatttttataagaattttgaatttggatacaacaggaaatttgggagaagattcaagaagattttttttaaggaatgagaggaccaagcaaatgcaggttctcaatttgaatgaggctgaaagcataaacgatttcatgaacaaaatgatgaaggttgtgaatcaaatcagattgttaggggaaaaatttccagacagcaaaatagttgataaactcttggttgtcttactcgaaaggtttgaatccaagatttcttcacttgaaaagtcaaaggatctctccaagataagtttgacatag

SEQ ID NO: 78956 - DNA, 108 bp, Glycine max
  Peptide Sequence Number=SeqID_195734
tcatttgctttccttcttattgcttattcgcctcactcattatctcccaaaatctcatttccacgatcatcgttttactcgtttccacgatcggtatcagtgcttcag

SEQ ID NO: 78957 - DNA, 518 bp, Glycine max
  Peptide Sequence Number=SeqID_195735
atgaagattagtgttgtggaagtcgaggcattttgtggtgtcgatagtagcataaaagaggaaggagtggttgagttccttgtagtggttggggtactccttgcggacttggaaaatggtgatccaacggtggtcagaggacgcgttggggttgctgttagcaaggaggggaacgaccacaatgagaatgcggaaagtggaggtggagtcggcatgggcagcggagtcaacatgggtgacggagtcgacatggacagcggagtcggcaagggtgtggggcgcgactgtatgagtgcgagaagtggaggtggagtcagcatgggcggcagaggtggcatgggcgacggtggtgactgcacagaggaagaagggcatccagtgtggattcgaggcggagttgagctgcagcaagtttggccatggcggtctcgaggcgatcctcgcgagctgcagaaagttcgacatccaccattcgaggtgtgtgctgaaatggaaggaaaggtggttgctgatgaagg

SEQ ID NO: 78958 - DNA, 1746 bp, Glycine max
  Peptide Sequence Number=SeqID_195736
atgaatgacacaaggggtttgaaggaagtaagcaccacaaggtccaagaggaaggatgcacctccagcttgcttaaggaagatattccatgattgtgcttatctttttgttattgctgtcgggattttgttccctagcagaattcaaaaggaggttgttaaggagctaaatgatcttgattataaagatgaatgtcgtccattttcaacacaagtaaaagcaagaaggattgatctacatgacatgttttggcaacttggcaaaaatctaggtccaagtggttgttggaaggaaaaaaatgtcctcaaaggtctctatgtcaacaattgttcagtggaggatccgaagcaagtcaaagatgaagcaagaagtttcctcccatctagattcatagaatttggtggattgagacctactttggatggggtacattttccctccatttctcaagaggaatatgcgtctcttatttcacattttttagaagaggagatcaaggaggctgtgtgggattgtggaggatctaagagcccaagccttgttctacgtgtccccctacgcccacacccgattgatgctccacaagctcagacggtgtttcttgaagatgatcatcgacgtgagggaagagtcgcgagttcaagaatgagatttcgggaactttcaggtgaaagaaatgatgaagtcttttggatcaaggaatgcctccaatctacaaccatttcggcccttgttaatggtagcccttcaaaggagttctcccctcaaagaggcattagacaagaaggtcctttggctctgctgctcttcatagtcgtggtcgaggggttgagtggtttgatgcgggaagtggtggccaaaaacatgttcaaaggattctcagtgggtaaggaaagatcaccggttgagcttttccaatatgatgattatacgattttctttggtgaaccaaccattaggaatattatggtcttgaagatgaagcgaaacactttagaattctttgttaacattcttaattgcatgttgatgtcctttccatttgtgtaccttggcctttcgatgggagcaaatccgaggttggtggaaacttggaaatctttgctcaaaaaggtcgatagaaggttggcaaagtggaaacatagggtgctttctatggcagggagaatgggaaggaagagaatctcatgggtgaaatggtccaaggtgtgctctccaaaaattaatggcgatcttggtgttaaagatgtagggatttttaatgagacactccttaccaaatggaagtggagttgttttcaccaacggaatgacatgtgggttaaaatcataaattccaaatatggaggatgggatgcacttggaggtgtgggaagccttcagaaccaatcaatttggtggagagatatcaaaatggtgcgtgacggtgatgatggtgataggtggtttgatgtacaggtgacgtggagccttggtgatgggatgagaacaaacttttggcatgacaattggatgggtgaagagccacactttgttagatttcctagaatatatgtcaattccttgtccgtggaggctaaagtgggtaacttgggatattgggaaggtggtgggtgggtctggaattttactaggaggcatagatggtttgagtgggaaatccaaagctttaaccaatctgagcctaagattaatttgtctcggctgaatcaacaaaggtgtgatgcatggtggtggaatgctgag

SEQ ID NO: 78959 - DNA, 2070 bp, Glycine max
  Peptide Sequence Number=SeqID_195737
atgagactttcacactgtatgggacttgggagtgcatgctttggtctgcttgatgaagttgttgcgcaaagatttatcgataccatcaaattaggtgttcaagaactcggtgcaactccaacagaagtgcagaaggcaacataccaagaaaacaataagaaagatggcaaggctttattcatcattcatcaaagtgttgatgtagatatctcagagaagacaataggtgtgaatactacaaaggagatgagtgatcaggaaagtgtagcagaatacttcactcgaatgctgaccctcacaaaccaaatgaagaactatggtgataagataaaatatacaattatagtggacaagattttgagaacctcaaccccaaggttcgatcacattgttgttgcaattgaacaaggaagagacttagagggaatgaaagtagaagagctgcaagggattcttgaagcacaagatatgagactcaatgaaagaaattcattgagatcttcaaatcaagctttgcaagctcaaacttacaaagggaattctagtgataaagagtgcaaaagcaagaaggtgccaaggaactttgatgaaactcaattggcacaagatgaagattttgactttgataaggatgaccagcaaactctcatcagtgatattctctatgttcctaatacgaggaacaatctactaagcttggggcaactacttgtaaaaggcttttcaattcaaatggaggacaatcacatgaagctatttgatcagtctgtcatcacttctatgtatattttgaatagaagtcctacaaagaagttacaagggtgtactcctgaaaaagcaaggtcagggcacaagccaagtgtgagccatttcaaaatctttggctcactatgtttcaagcatgtgcttgagcaacttagaaggaaacttgatgacatggcaaaatcaatggttcttattggttatcatccaacaggtgcttacaagttgtataatcccaagatgaagaaagttctagtcaatagagatgtgttgattgatgaatcaaagagttgggattggactaccacaacaactgataatactaaaaggaatgtgattatgcattttgacaatgcagatattgaagtaaaaattgttgaatcaactaacattcaactcagaagatcacatagggaaaggcaggcaccacaagcactcagagattatgaagtttactttgatacaacaatcaatgcagagggagaattagttcatttttccttgcttgctgaatcaaaactagtaagtcaagaagaattttctcggagtacttgttggagatatgctatggaagaagaactgaagtcaatagagaaaaatgatacttgggaattagttgatttaccaaaaagaaagagaccaattgatgtgaaatgggtctataaaaccaaaatgaagccaaatggagtaatgtccagatacaaggaattcgagatgactgatctaggtgagttatcatacttcttagacattgaagtcaagacaagtgaatggatcttcatgcatcaaaagaagtatgctaaagacattttgaagaggttcaacatgagtgagtgcaaccctataatcacacttgttgagacaggaattagcgttcaactagaaggagatgaagaggaagttgatcctactttgtataagcaaattgagaagtctatggctataatgactcagattggtgtggagataaaggagataagaaaagtattattggttatgttttcaaatttgagtcaacaccaatttcttggtgtccaaggaagcaaggaagtgatgaaagaacttaatctgaagatggtcaacccaatgagattgttaattgataataggtcaattattgacttggcaaaacatccggttgtacatgggagaagtaaacatatcaataccaagtttcacttttttagagatcaagtgagtaaggagaagtttgagcttgaattttgcaaatatgaagatcaactagtagacatgttgccaaagcctttgaagtgtatcaaattcaagaaaatgagagataggatatga

SEQ ID NO: 78960 - DNA, 489 bp, Glycine max
  Peptide Sequence Number=SeqID_195738
atgaaagccaaaaagagaggcagcatcgtccgtggtggtgtaggaggcgtcgacagagcaactcaaagacagaaacttttttgtcgccgccttgctactgccattccctgctaccacagcaatgaccgcagagttgccattggcatgaccagcatcgttctcgacattggagacccctttgtcggcaagaaccttggactccgtctcaggatgtttgatagtagcaatgtcgaagtcgccagtattcttgtcgagggtgagtttgtccaggttgtggattgggccagagaactggttgtttttgagaaacaaagttttcaagcgggtgaggctgttgaaggcggtgggaaagggctcggagaagttgttgaagcccatgttcaagcgaaccaagtccaccaaatcaaacagaaaggttgggatttggtcgctgagcaagttgcactgaatgtagaggttgtagaggttgatgcaggaggccaaatctga

SEQ ID NO: 78961 - DNA, 2037 bp, Glycine max
  Peptide Sequence Number=SeqID_195739
atggataatgctagagacatttggaaggacttaaagtcaagatactcacaaggagatctgctgagaatttcagagttgcagcaagaaatggcttctatcaaacaagcaggaaacaattcatcgaattctgggccttcatgtacctattgtgggaaagataatcacattattgatagatgctataggaagaatggttttcctcagaattatgattccataggaggaaagggaactcaaagcaatcctagcaaaggaaattcaagagtaaaaggcaacaagatctgcacatattgtggtttttctaaccataccgcagatgattgttacaagaagcatgggtatccacctggacacaaactttacaaggatatgaaccaacaaaagattagtacagttgagatgatggaaggactttgtagactcaagatgattccattcaagtctaggcacaagtctggttttattagttctagcatttccaattttctgccttttcataaaagattatcatttcctaatagtgaatcacattcttcttgtgcttttcctcttatacatgttgatatctggggtccttgcaatgtaacttcattaaatggttacaagtatttccttactataatagatgattactcaaggtttgtttgggtttttctcatgcattcaaaggctgagacacaatctcatttaaagaattttgttgccaatgttgaaaggcagtttgagacaaaagtgaaagtgatcagtactctagcagctaacaaaaagaagctagatcctagggctgccacttctacatttttgggttttaagcaaaacaccaaaggattcattatatttgatcttaaagccaagtccatatctatctctaggaatgtgatcttctatgaggattgttttccattcattggaagatctctgagacaaacacacagaccaagcaagtataaggacttccatgtttcatacccatcttcaactatagccagttattctacagcttttaaggatcctgtctggatagaggcaatgaatgcagagattaaggctttagaacttaatgatacttgggttttaactgatatgcctcaacataaaaatgttatttgctgtaagtgggtgtataagatcaagcacagatcaaatgggtcagtggagagacataaggccaggttagtggccaatgactacactcaagtggaatggcaagattacctagacacattttctccagttgccaagctaaccacagtgagacttctattggccttagctgctatcaataaatggtttacacagctgctggacaatgcttttaagataaaggatttagatgacttgagatacttattaggttttgaagtagccagaaaacctactggtatcaatctatgtcaaaggaagtatgccttagacattctcagtgatgttggtaagcttggatctaagccagtatctactccatcagattatgctactaagctccatcaacaatcaggaactcctctttcaatggaagatgcttcctcttttagaaggttaattggtaagctgatctacttaactaatacaaggccaaatatcacttatgttgtgcaacatttgagccaatttgttgttgctcccacctcagctcatcaacatgttgttgttcgagttctcagatatattaagggatccctgggagcagggattttcctttctgctgcaagtaaagttcatttaaaggggtttagtgattctgactggggtggttgcattgacaccagaaggcctatcactagttatggtatgtacattggtaactcattgatttcatggaaatccaaaaagcaagtcactatagccagaagctcatcagaagtcgaatacaaagcactagccagtttcatttgtgaactacaatggcttatctatttgctagaagaattcaaagtagactttcaaaaacctgtcactttgtatcgtgacaatagcttcgaatccagtgttcatgaaagaacaaagcatgtcgagattgactgccacatagtttga

SEQ ID NO: 78962 - DNA, 240 bp, Glycine max
  Peptide Sequence Number=SeqID_195740
atgaaggtggcatgggatttcgtgatttgtgtcagggatgaaggttccttgatcatgaagcttggttgggggattattcatcaaccagatgctttttggatagttgatgctggtggtgggtggtgcaaaggtctttttgagagttacatccctttctggttgttaggagagattctcggaactcttccacctcaagatttgctaggggaggatcgtgtttttttggagtggttcttctga

SEQ ID NO: 78963 - DNA, 300 bp, Glycine max
  Peptide Sequence Number=SeqID_195741
atggcaaatataaaaaggcaaattatgggtctaggccaacaaggtcacgtgtcctcaatgctaaaccctttttttttctctttcagtagtcatttaaccttcaatagtgccgcaaaattttctttccattccttggaaggcctcggcaacgacaatgacaacaacaacaacggcaatgagtcaccgatttcagtttttgtaatccttatcatttttttgagtaccgtaagaaacaagaaacataatcccttctgggatgtttcgcacaaggttccctttattgctggctatcaggtgtaa

SEQ ID NO: 78964 - DNA, 232 bp, Glycine max
  Peptide Sequence Number=SeqID_195742
ataccctgggtttttgaaactgaagatgcagagcacgtacggggctccagttgcatttgttgatttccaggatgttggtagctcaactgacgctctaaacagtctgcaaggcacaattcttcactcctcacaatctggcgagggaatgcgtgtagaatgtttggttttatttaacacgaacctcagatatgctaaatcgcgtatgggcatgcggaagaagcccaatagataa

SEQ ID NO: 78965 - DNA, 201 bp, Glycine max
  Peptide Sequence Number=SeqID_195743
atgggtaatcctgctttcaacacgaacatgtttggttatccatctgcacaaagtcttgggaatgctgatgggagtaccatgagtggcggtctatttgcgaatctggggggctacaaactggtggggaaggaagatggtaagctagcaagagtttctattctgggattcaacagttcccaaagggacttggtgcctacctga

SEQ ID NO: 78966 - DNA, 375 bp, Glycine max
  Peptide Sequence Number=SeqID_195744
atgactgattgggagggtggatatttcccactgacaatgcacttcagtgaagattaccctagcaagcctcccaagtgcaaattccctcaaggtttctttcaccccaatgtgtatccatctggaactgtttgcttgtctatacttaatgaagatagtggatggagaccagctataacagtgaagcaaattcttgtgggcatccaggacctgcttgatcaaccaaatcctgctgaccctgcccagactgagggtactgagacatggtggtctttattgcccaattgggtggatgacaacttttcccttcctttggggatccctacgggattgccccatttgtggatagggaattggggaccatgctccctgccttag

SEQ ID NO: 78967 - DNA, 786 bp, Glycine max
  Peptide Sequence Number=SeqID_195745
atgacacgcttgcaggagcattacaagacagtcaccgggaccaaaacatggagcttaggaccagtttccttgtgggtcaaccaagatgcttctgataaggctggaagagggtatgcaaaagaagaaggttggttgaaatggctcaaatctaagcctgagaaatctgttctgtacgtgagttttgggagcatgagcaagttcccttcttcccagcttgttgaaatagcccaagccctagaagaatccggtcacagtttcatgtgggtagttaagaatagggatgaaggggatgatcggtttctggaagagtttgagaagagagtgaaagcaagcaataaaggctatctaatatggggttgggcaccgcaactgctgatactggagaattctgccattggaggattggtgactcactgcggatggaacaccatcatggaaggtgtgaccgcagggttgcccatggcgacgtggcctctgtttgcggaacagttctttaacgagaagccggtggttgatgtgctgaagattggagtggctgtgggagccaaagaatggagaccgtggaacgactttgggaaagaggttgtgaaaaaggaggacattggaaaggcgattgctttgctcatgggcagcggagaggaaagtgcagaaatgaggagaaaagctgttgttcttgccactgctgctaagacagctatacaagttggaggctcttctcatactaacatgttgggattgattcaagagctcaagtcactcagatttgaaggaaactgcctaccatga

SEQ ID NO: 78968 - DNA, 258 bp, Glycine max
  Peptide Sequence Number=SeqID_195746
atgtctggtatcgcccgtggacgtcttgccgaggagcgaaagtcatggcgcaaaaaccaccctcatggtttcgttgccaagcccgagactctccctgatgccaccgttaatttgatggtctggcattgcactattcctggcaaggctggggtacatgataagaaccttgagagaaccacactacaaaatctagccattgtagatggagtgcccgatgcctcgtcaatcccacacctaaatcccttacttccaatatga

SEQ ID NO: 78969 - DNA, 477 bp, Glycine max
  Peptide Sequence Number=SeqID_195747
atggcagaaggcatgggaaaatttgtaattcggagaaaaaatagcaaggcttcaatgattgaggaagttttgtttgtactaggtatgaagtgtaacctgatgggtattggtcagttgatagaaaaagggtttttagtagtgatgaaggagagtgacttgcaattgtttgactcaaggcaaaggttgatattgaagtctccactgtccagaaacaggaccttccaaacatcaatcaaacctgcacaagtggagtacctagccgctagaactaatgaaggtcttcctagaatcacaacacctgataaatcatgtgaatcatgcatacttggtaaacaagcaaggtcaagtttcaattcctacttacctatgagagctacaaggagaaacctgtactttgtgacatttgtggatgagtacaatagaatgatgtggctctacatgatcaagtgcaagagtgatgtgtttgagattctttag

SEQ ID NO: 78970 - DNA, 352 bp, Glycine max
  Peptide Sequence Number=SeqID_195748
atgcatcaaatagcattcccctttgtgcctatcaagggaaagcatgcccgcctcttgcaaggcttcaaggataaacctcctagagggccacacactgctcaattgaatgccccggagtacccccgtgatacggacaggtcgcgttggggttgtatcactttgggaagggggactgggcaagggtgcgtcaaagccgagtgtcgcaacctacccttcggcgggagggcgacgcgtgactcgcgggatgcgtgttccacgaaaggaatacgcgtggagtcgccaccaacgtttattcgaggaaaacgtcggaaaaaccggaaaagacgcgatctacgaacttttaagttgaaag

SEQ ID NO: 78971 - DNA, 1173 bp, Glycine max
  Peptide Sequence Number=SeqID_195749
atgaaggagattgaagaaagagctcgctcctgttatgaaggaccaatcagtataagcagcaatgagtttgcggaaatgcttgtccttgatggttgttttgtgctggagctattcagaggagccaccgaggggttcaagcaacttggatattccaggaatgatcctgttttcgcaatgcgtggatcaatgcactctattcagagagatatgatcatgttagaaaaccagcttcccttgtttgttctagacagacttctgggaactcaattgggaaaaccagacctgaaaggactagttgcaagtctatcactcaggttcttcgaccctttaatgccaacagacgaaccgttgacaaaaagtgacaggaacaaattggaatcatctcttggaggcactaacacctttgaccctttgtctgatcaagaaggtcttcactgcttggatgtgttcaggagaagtcttttgcgctcaggacctcaaccagtacctagaatatggatcaaacgccggtcaaatgctcaaagagttgccgacaaacggaggcagcaactgatacattgcgtcacagagcttaaagaggctggaatcaagttcaagaagagaaagaccgatcgcttctgggacatcaaatttaaggatggcaaactgcgaataccacggctcttgatccacgacggtaccaagtctttgttcctcaacctgattgcctttgagcagtgtcatcttgattgcagcaatgacattacatcctatgttatcttcatggacaacttgattaactccccagaggatgtggggtaccttcattatcgtggcataattgagcattggcttggtagtgatgctgaagttgcagaccttttcaaccgcttatgccaagaggttgtgtttgacatcaataacagttacctttccccattgtctgaggatgtgaatcggtactacaaccatagatggaatacttggtgtgcaagcttgagacacaattacttcagtaatccttgggccattatctctttggttgctgctgttgtcttgttactacttactcttgcacagacctattacggtatatatggatattacagaccagccaggcacagaaggtattggtattggctagatgctattgctgtagttcaacttccttttgtaatgcaaatgattgcataa

SEQ ID NO: 78972 - DNA, 174 bp, Glycine max
  Peptide Sequence Number=SeqID_195750
cgagcattcgctaagcgcgacactcagtggctaagcgcgaggaagaatccagaagaagatgagctttcaggtttgttcagcgcaccgctccaggtcatcaagcacaccgcttcagctcatccgctaagcgagagaagcacgctaagccacaatccacttatgcgcactaagtga

SEQ ID NO: 78973 - DNA, 723 bp, Glycine max
  Peptide Sequence Number=SeqID_195751
atggaaccagcttcagctgattcttcatctcaacctactcctccagcttctaatactgaagaacaacactcaaccaaagtgtctggacaacctggcaatgcacatgattcgcaattgtcgtcacccacttctggcatatcatcctgggcaagaaatctgaaattcccacaggcccttgggcttggagcacaacagaactcccagaccgaaaatgctggcatgtcagcttttgctcgcctgactggagggcttggattgcgaacgccatcaaatgaaactgctccagtcaagtcaggagccgagcaatctaacttgattgaatccgtcaccaaagggttggtggactcttccaagagtgcagtaaaggcagtgcaggtcaaagcacgccatattgtctctcaaaataaacgtagataccaggtacacgacctgaatgatactactaatgctgctgccaaccatgaaggtggatttgatttggacatgacatacatcactgaaaatataattgctatgggatttccgggtggtgattttagctctggaatttttggatacattgaggggttctatcgcaatcacatggatgaagtgatcaagttttttgaaacgcatcataagtggctaacttgttgtgtagatctcccgaggttcttatcaaaaggatggtcaaagaaatctagaacagaaacaaagagtacttatcttctggttaacagctaa

SEQ ID NO: 78974 - DNA, 1188 bp, Glycine max
  Peptide Sequence Number=SeqID_195752
atggggccctggaaaaatagacaaaaccatgatggtatgctagttgttcctcttgttggacccccccaacctctcctttgctcaaacaatacaagactacattccaatgagaactccttttattgggaaaagcttggagatatgacaaggaggatattcaaaatgtcgtggttgttcattgtaaagctgttcttcccaactgcagaggaagccattgattactttaaccataaaagatgtgtagatggaaaggctttagtcctccctagtcagattagatatgtaaaatactttgaacggactttaacacacttcaatggagaagtccaaccaggacgaaggtgcatgctaagagggtttcggcttcacaaatgcccttattgggttagaccatctattacaatttctgatcatacgggaattctttttaccacaagaaagcatcccaaaacaaaggatctaatgccagaagatttctggatcagtgtaccaaagaaaggaattgtggtttttgccctaccaggagagcctggtctagcagagttggtaggagacttcaaaattcagtttcaagatcgacagggagatttctactgttggatgaatacaacgatgacagaaaaccgaaaatttttggatggttcagattttgatggtttcgacaagagaaagatccctgctccaggattcaaggtggaagttgtgatgatagactataatggcaccctgcctgcaaatacaaaatcaaatcctgccagcaaaggatctgatggaaacacaagcaatgccctacctggtccaaagtctactacatctaattcaagtgagagtaaagtccctagaaacggagatgatgatgtattctcagacagcgacgaagaggagacccgggatacacaaagcaataaagctgcagctgagtacaaatttatggcacctcatcaagtatctgaggcaacaaatgaccatgtagggatgttgacacagaaatcggatcagttgtcactgcagcatgaggaatgcaagcaaaacgatgcttctgaagaatcacctacagataaacttcataaaaatcatacaggcaataagagtacaaacatgggatctgtaggggcaagtgacatcaaggcaatcgcagcagatgcttcagttttttcctttggagatgaagattttgacagtgattga

SEQ ID NO: 78975 - DNA, 274 bp, Glycine max
  Peptide Sequence Number=SeqID_195753
atggaacaatttctggacaaggtggcctggcctgaagcccaacttcttttgggaagagcccctgaggttgttcttcccagtcctataccaacaaggacagagcctgcaccaactgagtcacaacctccagtagtagacccaccggcttctctagaggttgagatactatctcctccactagctccaccggcaccacctttgatactcattcttgatgactcagatgctgaagctgttgctccttctaactcaccagcctactacctagaggatg

SEQ ID NO: 78976 - DNA, 795 bp, Glycine max
  Peptide Sequence Number=SeqID_195754
atgaaggcgttgtttgaatttcaagacgtgatggaggtagtgaagaatggcgtagcggcggaaccagcagaacccgctactgaggcggtgaggaatgcatacaaggatagcaagaagaaggatgcgaaggcaatattctttctacatcagagtgtagatgatgcgaatttcaatctgatcttgaaggcgacctcagcgaagcaggcctgggataaacttgagaaatgttatgctggtggagatcgaatcaagaaggtgaaacttcaagtgttgcagcgacagtttgactcaatgacgatggaagagaatgagaagatcgctgacttctttgcacgagtaaaggtagtcaccaatcagatggctacacaaggtgagactctaactgatggaaaaatttgtgagaaaattactcgatctctgttggaaaaatatgattatatagtatgtgcaattgaggaatccaaggaagtaagtgaaatgagtttagaagaattgcaaagttcactagaagctagagaacttagattgctagagagaaataagaagaaaattgctgaacaagccttattggctcaatctagtaacaagaattctggcgacagtaacaaaggaagaagtggttttagaggaagaggtcgtggtaggaacaataaaggaagaaatgactatgtttctagtagtggaagaggccataataatgttgaaaataaacctgatcagtcgcagagaggcatgggcaaaggctactatcgaggtggtagcaatggtagaggaagaggtggtaggaaaagatga

SEQ ID NO: 78977 - DNA, 498 bp, Glycine max
  Peptide Sequence Number=SeqID_195755
atgacaaaaggtgaaaaagacgacgttagtctctacgcgtcaacaggctcgcttccctcctggttgatgaaaggggcagaggacgacataaccatacggtatctccgcacgtcattggactcacaggtcacgatagcgaaaggtggggtgatcaacaaaagcggggcttttgctcctatgtatcctcaatcgcggtggggaattcagaccaacggtcctggggtttccagctttgattacgagcctctgtcagttctacggagtacggtcgcccccagcaaggtcatcgggcctcctactaaccgagctttcatcaagaagtactgcgccccttggcaggcgcagggcgagacaccacaacaaccaggggatggctggcagggggcaacagacgcaccgtcgccacctccaaggcccctttgctcatctacaaaagctggagcattgcctacgaccagtgatcgactagcaggtgaccaagtccaaagccaaaggtaa

SEQ ID NO: 78978 - DNA, 360 bp, Glycine max
  Peptide Sequence Number=SeqID_195756
atggctaaactaagatacattgtctttgtcagcacctcatcggccatcgacatgctttgttacgagaggagagatagtatgtttacttacgaacatgctaagtacacctatccttacccttgcatatgcaaagaggctgtttccggattcgaacccatgaccaacaagtcaccaaggcacaactttaccgctgcaccaggactcgccctcccaaaagataactcatatcacaaagggataattaacaacttcaaagaaatatgttgcactagaattcctccatccaagatcaattttagggctaggccgttgatggaaagaaccccggaaaatatggaattaggattgagttcactttaa

SEQ ID NO: 78979 - DNA, 192 bp, Glycine max
  Peptide Sequence Number=SeqID_195757
atgactcaaggttccttgaaactgtcattgttaagcaacggtggtgccattttctttgacgaaagtacctgcctgatcctggcctcaatgaggcaacaaggaatgacattattgcagacaaaaaacaatagttcgaatacaattaacttcccagacagtgttggcacaagtgccaactttggattctcgtaa

SEQ ID NO: 78980 - DNA, 198 bp, Glycine max
  Peptide Sequence Number=SeqID_195758
atgacaaaaggtgcagaagacgaagttagtctctgtgcgtcaataggctcgcttttcccctggttgacggaagatgcagaggacgacataaccatacggtatctccacacgtcatcggactcacaggtcacgatagcgaaaagtggggcggtcggcaaaagcggggcttttgctcctacgtatcctcaatcgcggtga

SEQ ID NO: 78981 - DNA, 1035 bp, Glycine max
  Peptide Sequence Number=SeqID_195759
atgccgccactgccaccgccaccgcaggcgaatccagattccggcgccacctccgctccgtcacaggtatttctttgtggagggaggcttatatttggacctgatgtgaaatctatatttatatcgatatttcttatcgttctccccgtggctgtgttctgtggtatggttgcaaggaaactgttagatgattttcctcatcacaccggatggtcaataatggctgtacttattgctctcacactcttcgttctgatcacccttgtagtgacctcagcaagagatcctggcattgtaccacgtaatgctcagcctccggagacagatgactatcattggactgataatagcaacaatggccaaatttcattgtcacgatttccacgaacaaaggatgtaattgttaatggtataacattgaaagtcaaatattgtgatacttgcatgctctacagacccctccgtgcttctcattgttcagtctgtgataactgcgtggagcgatttgatcatcactgcccatgggttggtcagtgtattggactgtctacttacgaaaattttaaataccggtacgacccacaaaccaacccatataacagagggatggttaacaacttcaaagaagtattctgcaccagaattcctccatccaagaataatttcaggtctaaggttctaagggagccattagattcacatcaaagaacgggtattaggcccataagcccaatgatgaaaagacgccccaggagtatggaattagtagggaattcagtttacaatgaacaagacgaggaggaaagtaattatagagatgaaattgacaatgaagcacgtagcaaagatagtggattaactgataagtccctggatttaagcaggatccttcacacagaaggagtggaggggcaagaaagttcacttagacaccatctatgggaagcaactccagaagttcaggacagcataacagaatttggggaatcaaattgggctactgcgcctagttgctcaactagagaggttgtatag

SEQ ID NO: 78982 - DNA, 177 bp, Glycine max
  Peptide Sequence Number=SeqID_195760
atggctaatgaaatggtggcaaagctgacaagtacaagctgggacaaatgcctcactggtacacctggggatgagcgtccttgtcatgaaaaggtttcagagtatgcgatgaagatcaagggccatctatgtgcttcctcagttgatggttctagttttaacttttactttggctga

SEQ ID NO: 78983 - DNA, 555 bp, Glycine max
  Peptide Sequence Number=SeqID_195761
atgtctgcaaggaattgtgatccacaagagaggcactttttcagcccgaaggaagcaaagtatcgaaatggtaatcgcatgaaccgaacgacaaagtgtggctattggaaggcaacaggatcagacaaaagaatatcatcttcaacttcaacgtgtaatggtattgttggggtacgaaagacattgatattttatgagggcaaatcaccaaaaggctccagaactcactgggtcttgcacgaatatcgtctcgtcagtgtagaaactggtgctgccaactcatcccataactacgtaaacgagataggagattgggttctgtgtcgcttatcgatgacgacaaccactaaagaaagtgatggcagcggcactcatcataagcatagacaaaatacagcagttcaaactactcgtccaagattaatgtttgattttatgatggtagggaagaccaattcttctacatcctcatcatgttcaagctccagtaatatcatggaggtctcttcaaatgcatcggaccatgaagaaacaagtggctatgcccatttttag

SEQ ID NO: 78984 - DNA, 774 bp, Glycine max
  Peptide Sequence Number=SeqID_195762
atggggattggcaattcaaagtcaaatgcagccgaaggagagaggttacctcccaaaatccgccctatgctcgttagccgatttgaggagttcagaaaacgtaggaatggagaaaccaccctctccaagaagaatctgttgaatgaagaggatgacaattctcaatcttcacacagaactgaagaagaaaataaggtttcttcttcaaaggagattgaaccacctaaagaggaaacggttgagcgagtaataaccgcagaaaaactgtccagagtggttccagtgcccaactctgaatgtgaaaatgtggaggagactcaccccaacaaagataacatagagcaggttatcaaatacatggatcccagccaagatgtatttaatcgtgctgttgagatggccgaggcagaggttaaaacagaggaggaaaagactgcagagctagtggaagagacaaaggaagaaaagaagcaaaaagtggatgcaaaaggtgatgatcatcatgaggatagtggtgatgaagatgaaagtgaaaaagttggcaggtttctatgtcctggatcgccaagtttcagaatttattgcattgaggctgagaaaagaaacgaggaagaatgtaatggtccaaccattgtgctccaaaagtcgcgcagtgtagacagtgttgaaacagctgaatcaacaaattcaaacgaggtacttcaggaattagaatcaacttcgaagagaaaaggacataagaagaaatttggtgctatgaagactctactcaag

SEQ ID NO: 78985 - DNA, 549 bp, Glycine max
  Peptide Sequence Number=SeqID_195763
atgggtttgacggtgtcacggctattgagattgttttatgcaaggaaagaaatgaggattctgatggtgggtcttgatgctgctgggaaaacaacaatactctacaaactgaaacttggagaaatcgtcactacaatacccacaataggcttcaatgtggagactgttgagtacaaaaatgtcagcttcaccgtctgggatgttggaggacaggacaagattcgaccattgtggagacactacttccagaatacacaaggtcttatctttgtggtagatagtaacgatagggaaagaattttagaagccagggatgagttacatagaatgttgagtgaggatgaacttcgtgacgctacagtattggtatttgccaataagcaagatcttccaaatgctttaagtgttgcggaaattacagataaactcggtttacattcactccgcctgcgtcgctggtacatccagccaacttgtgctacgtccggccaaggactctatgaggggctagattggttatctagtcacataactaacaagacaagatga

SEQ ID NO: 78986 - DNA, 231 bp, Glycine max
  Peptide Sequence Number=SeqID_195764
atgaacgaacaggctaagaagaatgagattgtgaatgcacaaaatggcatggaaaagaaggtggaaactgtggattatcgatcttcagcagggcaaaggcaagaagagaggaacgtgcaggtaattcaccagccccattccaccaacaccagtggtggtgtacttgctggtgctgctgctgctgttgcatccactctacagtcagcgaaggatgccatctccaaaaaataa

SEQ ID NO: 78987 - DNA, 285 bp, Glycine max
  misc_feature (235)..(235): n is a, c, g, or t
  Peptide Sequence Number=SeqID_195765
cgtttcgtttctaaacgaccatttagaggaaacactgggtccaacaaaatagaagaaaatcactcgaagtgtatcaatctcacacagtgcgaggcgaaaaagtcgctagcgcacaggcaaggatgggcattttcacccggggtcaaggtttatggtgagttgggattttggctcaaggcttgtagaatggttggacatgatatatgtcagggtaccggtttggctagcggttcanggataaaggagatgtcccacattatttccatgatacacatgcaacaatga

SEQ ID NO: 78988 - DNA, 195 bp, Glycine max
  Peptide Sequence Number=SeqID_195766
atgaagaactggatgcaaaattcaaaatgggatgtctacttaggagcctacctgaatggtgctttgaaaggacttgacgatactccacaacctaaatccaaggctggtgctaggtggattattgttaaaaccattggaagcagggagattgaaggcgcttcgcatccaatggacaaagtattatctcaaagttag

SEQ ID NO: 78989 - DNA, 261 bp, Glycine max
  Peptide Sequence Number=SeqID_195767
atgagtttttgcttgaaatgtgagctacacgaacgcgtcaaaatctggaattgccaatccaagtatcagcttttcaagaagtttcaccaaaaaccagaaactgtctccaagaaattgaaagaagtcatatttgaacagattcggggtaagtctaaggctgcaaaagacattgagaaatgtaaaaaattttgcgctcacaggggtgatggagttcttcgtgctttgaagtgcaactgcaattccattgccaagagcactgag

SEQ ID NO: 78990 - DNA, 855 bp, Glycine max
  Peptide Sequence Number=SeqID_195768
atgagtcaagaacagcctcagaaggagaatcatgaggaggaaggaatcaaatatggagatgtgttcaatgtgaagggagagatgaaaagcaagccggaggcgccggtggacgcggggatgatgcaaaaggcggagacggaaaccactggtaagacccaaaaggctggtgccgcgatgcaatcggcggcggcgaaaaatgagagaggagggatggcggggcacaaagataagaataacgttgccgctgatggtggtgttagtgtgactgagactgaggctcatctttcggggagccaggtgatatcggagtccgttgcaggacaggttgttaacagactagaggaaaagaaaaggaaagttaataagttggttgaggtggtgaagcaatttaaccaaaaggctccactgaatacgatgacgccaccttctattgttcaagaaatgggcgctggaggtgctggaagcgggatcaccataggcgaagcactcgaggccacggttctgaccgccggaaagaagcccgtcgagtggagcgacgccgcggcgattcaggccgccgaagtcagagccactggacgcaccaacatcgtccccggcggtgttgccgccgcggctcaatctgccgccacactcaatgctcgagttacaaaggatgaggagaagatcaaactcgcagatattctcgcggatgcgacttcgaagttaccttcagacagagcagcgactcggcgagatgcagaaggggtgacgggtgcagaaatgagaaatgatccaaacctcactactcatcctgggggcgtctctgcatccgtcgctgctgctgctaggcttaacaaaaccaataccaacacctaa

SEQ ID NO: 78991 - DNA, 525 bp, Glycine max
  Peptide Sequence Number=SeqID_195769
atggctccgaaacgacgtcctaagaaaggcgagtcgcgaatggaggcagcactcgacgccatgaaaccctacggcttccccaacagactcgtccgaactgccgttaatagcctcctcaaagtttacggtggcaacaatggctgggtcttcatcgaagaatccgcttactctctgttgatcgaaacgcttcttgaagaacaagccagttcttcacctcagccagagccttcaaacttgggtttgagcagagacactggtgttggtccttttaaaattcccaatagagagactcctaaccagcgagaaaattttctagccttatctggtacttctatgtacaaagggactcttggaatgaatattgatcttaacccattcaaaataaaaggaacgggcaaggcgcctgtgcattacaaaactgtggaaaataaacctcctgagcttaaaagtactcaaaacaataccgttcctggtcaatccccagtgccatccattgatgcggaagaatcatcatgcttacattga

SEQ ID NO: 78992 - DNA, 351 bp, Glycine max
  Peptide Sequence Number=SeqID_195770
atggacagagaattaagaatacgggagctggtgcaaactagactagaaccacctgtaggaggttttcccagtcttttctctgttgcctgtcataaattatggtcatccatactttctcagctccatcagctacatgcccatgattggcctacctcaagttacgacagatcaaagttttccagtagtccattgttaaaccgtttgaggttctccaacccaatacaatttatttggggcaaaacttggagagccataaatctgggaaaaacaatggagcacctgacagaattgtgtggtttaccagatattctaaagacaggaaccgctaaggaagaggaagaaatctgttaa

SEQ ID NO: 78993 - DNA, 1191 bp, Glycine max
  Peptide Sequence Number=SeqID_195771
atgttgagtcgtaacacggctcagaagcagtgggatgaaactcttgtgcttgttttgggtggaattgcacgtatattacggttgttctttccttttttcacgagcttaagtaacttctggtctggctgggaatcattgcttcaatttgttgagaatagcattttaaatggtagtaaagaggtagcacttgcagcaataaattgtttgcagacaactgttaactctcattcatctaagggaaatatgccaatgccttaccttatttcagtaattgatgtttacgagcttgttctgagaaagccttctagttaccgtggcaatgctgctgataaagtgacgcaggagattttgcatggtcttggagagctttacgtgcaggctcaaggattgttcaatgatgtcatatacacacaactaatagcaataatagatttggctgtgaagcaagccatgttaactaatgataactttgaaatggaattcgggaatgtcccaccagtgctacggactatattggaaatcttaccgctgttacgtccaacagagcacatatcttctacgtggcctgttcttcttcgagagtttctgaagtatcttcctagacaggattctcatttacagaatgaggatggtaaaatcgatcaagcaagagattctcaggtgaactatgatgcacctaatggtgctactccaatatcacccaacaaaatagcagtatccccgggttctggatcaactgcagccattcctagttacatatttgcagaaaagctagttcccgtgctagtagatcttttcttgcaggcacctgctgttgaaaagtatattatataccctgaaattattcaaagccttggaaggtgtatgacaacaagaagagacaatccagataatgcactttggaggttagctgttgaagcattcaatcgtgttcttgttcactatgtcaccaaattaaccaatggaggtccagattcaacgattagcaaacctgtcagaacacgaatatggaaagaaattgcagatgtttatgaaatattcctaattggatattgtggacgagctcttccttcaaattccatctcagcagtggtgctagaggctgatgagtcccttgagatgtccatattaaatattcttggtgacacaatccttaagttgccagttgacactccttcggatgtaagttaa

SEQ ID NO: 78994 - DNA, 1155 bp, Glycine max
  Peptide Sequence Number=SeqID_195772
atgatgtatcaccgtcgcatccttttacatggacggtccgacattaagctggtaccagtggatataccacaacgggttcaccacgtcctagcctacactgttacaaggccttgctcccatatttcttatgagttgcttcactttcgacttcacttccaagatttgacgcgaggttcaggcactgcaaccgagtctctccctcaggctatagccttagccaagctccaagaagacaagctcaacgatcatcaacatcccgtccgcaacatgtctttgttttcatccccaactccaactaccgttagtcctcattcgccctctccctcgacgacgaagtgccctgattctgctactattgaaaccacccctaacgaggaggccctgcccactccacagatcagcatgaatgccatgttcggcatgccaacactggagatgttccgcttatatggacagattgacggccaccgcatcactattctagtcgacggcggtagtacccacaatttcatccagacgcaggttaccaagttcttgaatctcccactcctctccaccttcgccttacccgtcaagagtcctcttcttcagtcccaaagcttttccatcgacctccctatgaggccgtcgaccactctactctctactcgtgaggcgatttgtgaccgtttgaagcggaaattatccaaagcacagactaccatgaagcactttgccgatagcaaacgacgggatgtgcagcataatgatggtgactgggtttatgtgaaactcaaaccgtatcgccaactctcagttgttggtgcttatcataagctttctaaacgattttatggtccttttccaattatggagagtgttgatgttgtgccctaccaccttcaacttccggcttcatcagagattcatcccgttttccattgttcgctgttgaaacctcaccacagggacattcccactaagattgccaccttaccatctaaagcaagggaccatcaccccataatcgaacccctgaccttgttggattggaaactggaccactccacttcaccccttgaccaaacagaggtgggtattgatagcaacatggcccaatcatcacagcccaagaggaatacaaggagacctctccatctacaggactttgtctga

SEQ ID NO: 78995 - DNA, 459 bp, Glycine max
  Peptide Sequence Number=SeqID_195773
atggctttcatggcggtcttggaatccgaccttcgcgctctctccgccgaagctcgccgtcgctatcccgctgttaaagacggcgcagagcacgccatcctcaagcttcgtacattgtcaagtcctagtgaaattgcacacaatgatgacatattacgaatctttttgatggcgtgcgaggtgcggacggtgaagcttagcattattggactttcgtgtctgcagaaactgatatctcatgatgctgtttctccatccgctctgacggagattttatctacactgaaagatcatgctgaaatggtggatgagggtgttcagctcaagacccttcaaacaatatcaataatatttcaatcacgtttgcaccctgaaaacgagtatataaactgtattttagctggacctggaagttgtctgtgtgacatggacttgttggctttgatctgtaaggtctaa

SEQ ID NO: 78996 - DNA, 672 bp, Glycine max
  Peptide Sequence Number=SeqID_195774
atggcttttctagtgcaaacctccacccttcagatgttaaatcctggatgtgttgatgtgactggagcatacagtgctcagaagactgagttgaacataagcttgacagcagttggacttctgtggactatgactgatttcattgcaaagggccttctcaatggaccttttgaagaaaaggaagcaggtgttggttccacagtgaagcagatagaccgcaaaaagatggaggatcaaacacgtatttcttataatgtgagagaccaggcttctgtagatggtgttgattttgagaagcttctattctctgttttctcattacttcaaaaccttggggcagatgagagaccagaggtgaggaattctgctgtcaggacactgttccaaactttaggaacgcatgggcaaaagctttcaaagagcatgtgggaagattgcctttggaattatgtatttcctacattggatcgtgcttctcatatggttgctacatcatcaaaagatgaatggcaagggaaagaacttggaactcgaggaggaaaagcagttcacatgctcatacatcatagccttagtgatgtgatatatttgtttgagaagatggggagactggaaggtggagaaaaaataagctttaccaactacatgaagttcctaatctggaaaaaataa

SEQ ID NO: 78997 - DNA, 300 bp, Glycine max
  Peptide Sequence Number=SeqID_195775
atggcgaaggggtcactcagcttgagtgtggggttgatgcaagaggcaccaccctttcatgatggtgccattgtttcgacttcaccatcattgtactcgcgggcccctccatcgctgccatgctgcgtcggatctgaccgtgtcgccccttcgagtggccccctgatgttgggtcgggttagccttgacccggttccagcctgtcgcaacctacccttcggcgggagggcgacgcgtgactcgcgggatgcgtgttccacgaaaggaatacgcgcggagtcgccaccaacgtttatttga

SEQ ID NO: 78998 - DNA, 912 bp, Glycine max
  Peptide Sequence Number=SeqID_195776
atggttttcaagagtgttcttgttgaggctacaagtgggaacacgggcattggaatggcattcgtagcaacattgaaggggtataaagtcatagtggctatgccagcttctgtgagtcttgagagaaaaattgtacttcgagcctttggagctgaagtctatctcactgaccctgccaaaggaaccgatgcagttcttaggaaggccgaggagatagtgaataacacgcccggaagttacatgctccgccagatagataatcctgctaatccaaaaattcattacgagaccactggtcctgagatttggagagactccggagggaaagttgatgctttggttgcaggggtaggaaccgggggtaccataacgggtgctggcagattcctcaaggagagaaaccccaatgtcaagctgtacggcatagaaccagttgaaagtgcagtcctcagtggaggaccgccaggtgatcacctaatccaagggattggtaatggtctcattccaagtgtactggattttaatctcctagatgaagttattcagaaaatttactcaaataatcttaatatatttagattttatgcagatatatctcagactcagttaccaataaatggctcaacactagctactgttacaaggcattttgtcaaggctaacaaggtctgtaaactgcagatatcaagtgaagaagctatagaaactgctaagcttcttgctttaaaagaaggtttgttgatgggaatttcatcaggagccgcagctgcagctgccataaaattggggaagagaccagaaaatgccggaaaactcatcgttgtggtatttcctagttacggggagcgttatttatcttcaccattgtttgaatccattcggcatgaagctgaacagatgacatttgattaa

SEQ ID NO: 78999 - DNA, 1200 bp, Glycine max
  Peptide Sequence Number=SeqID_195777
atgggagtgccagcgttttaccggtggctcgccgaccggtacccactctccatcgccgatgccgtcgaggttgacccctccgtcgccgaagacggcgttccgttgcctatcgacgcgtctaaacctaatcccaacggcatggagttcgacaacttgtacttggacatgaacggcatcattcaccattgctttcaccctgacggcaagccggcacctgctacctacgatgatgtgttcaaatcaatatttgattacattgaccatctctattcgttggttcgtccaaggaagctgctctaccttgccatcgatggtgttgcaccaagagccaaaatgaatcagcaacgttctcggcgcttccgaactgcaaaagatgtagctgaggctgaggctgaagaggaaaggctgaggaaaaaatttatgagtgagggaaaagttttgtcttctaaagacaagcctgagacttcagactcaaatgtcattacccctggaactcaatttatggtagtgctgtcagtggctctccagtattatatacacactagattgaaccacaactctagctggcggaatacaaaggttatactgtctgattcaaatgcacctggtgaaggaggaaataaaataatggaatacatctggttacaacgcaaccttcctggtttcaatcgaaatactcgtcattgtttgtatcggatggatgctgatttgattatgctctccttagctacacatgaggttcacttctcagtattgagggaggataagtgttttttgtgtggccaagttggccattttgcagctgattgtcaagctgaggatttcgatactcctgatgatagctcaattcacaagaagaaatatgagtttcttaacatctgggtgctgcgtgaatatttgcaatttgaattggagatacccaaccctccttttgagattgacattgaacgaatagtggacgattttgtatttctatgcttctttgtcggcaatgattttcttccgcatatgccaacattagagatcagggagacaacagaaattgctcttcattccaatctcaaatcttcaactttcagtacttccatacagcaaaatccacaaatgatcacactgatgagataccaggagagatacgagaatgaccatccaaaagaagtttcaggatctggaatatgccattgcataccactatcctaa

SEQ ID NO: 79000 - DNA, 189 bp, Glycine max
  Peptide Sequence Number=SeqID_195778
atggggaaaaacgggactccaacgcatggaacatgggacaccttgatagtcaaagaattaggatattttaaatatccagcccaacgggtcttgaccatcgaagtgaggcacttcgagcttcaggtggttataacaaacttctacaggcaaagtagtggaggcccaactgcactaaggatgctcacatga

SEQ ID NO: 79001 - DNA, 1570 bp, Glycine max
  Peptide Sequence Number=SeqID_195779
atgacgactcccacgacgtccttttcaaactccaacagcgactacttgacagactttgaatggctagttaaccgcattattggccttgccctgccgttcctccttagttgttttatttcagggttgaatcctgagttgcacagagtttcaagccctgcagtcgatgaagacaagcttagcaatcgccacaagggccctcgtcactcttattccaatgtcttattatttgcctctgccatcattgctccctccagtccacgcatcccatttaagcaactatcctcgaaggaactggtgttgcaccgcgatcatggcctctactaccactgcgaggaaaaatgggtgcaaggccaccattgcaagccccacctccaattgttcatcgctgatgaagacaatgatgttcttgacaaaaacccaaccctagttctgaaccacacctctttgagttcccctgacttgcccacaccccaacttagtttaaacgctatggcaggcatgccggcaccgaaaaccatacatgtatatggtaccatcaaccaccactgtgttcttatcctcgtcgatggtgggagtacccacaattttatacggtcccacgttgcgaaattcctcggcctcccgaccacttcaacacctttactgcatgttatggtgggaaatggcaccatgatggattgcacctcctcttgtccacaggtctcggtggagatacatgaccatcgtttcgtggtcgacctctatgcacttcccctcagcggcacgaacttggtgctaggggccaaacaacccacaccccctacttccgacaatccctcaccatcaccgaagctaacccaattgcttcatcttttcgtgaaaattttccaagaacccaatacccttccacctcaacgttccatcacttaccttatacaacttttacccaattttgtcctcgtcaatgggttccaccaaatccgggtttctgatgaagacattctgaaaaccgtgtttcatgcccatcaagggcactacgaatttcgcgttatgccattcggcctttgcaacgcgtcatccacatttcagggcgagttctaccttcgtcgctccaagtgcctatttgctaggaaccatcttcaaaaccttggccacatcgtttttgaaaaggaagtggcatcgaatccagagaagattcaagccatggttgcctggccgcgaccatcaacgaccaccgagttgcgcggatttctcagacttactggtttttattgtcgtttcatcaaaggctacacctctattgcaggagataatgacccaggctcccatactggcctcgtcgaatttcacaattcctttcatattggaaacagacgcttctgggcgtccatatatgtccgggacctccatgtcatcacgtcaactatccgaatatggcgtcattacctgcttggaaattcctttatcatcctgactgaccacaagagtttgaaggatttaatggcccaggtcatccaagcacctgagcaacaagtttacttgttcaagttacttggctacaactacacgatcgaatacaaatccgatgcca

SEQ ID NO: 79002 - DNA, 132 bp, Glycine max
  Peptide Sequence Number=SeqID_195780
atgtgggtcacaggacggctcgacggcaacgagcgtgcgatggcggcgagtgtgatcgactgtgtgacggcggaatcactaccagatacaaacaaaaattcgtcagaaatttcgccagacaaaaatctgtga

SEQ ID NO: 79003 - DNA, 185 bp, Glycine max
  Peptide Sequence Number=SeqID_195781
cctttgggaagagcacacttcctcgtgttgtttacgagaatcacaaacctcgttaccaacctgaggcacgaagggtggaaaggtgggatagggtggtgggtgattgtgttgttgaaattcgtgggaccgaaggaggagaagctgtgtacaagggagttgtggagggaagtgaaaatcatgtatga

SEQ ID NO: 79004 - DNA, 435 bp, Glycine max
  Peptide Sequence Number=SeqID_195782
atgctttcccggttggtttcttggatcttgtcgccctcctcttctgaagaagaagaagaaatccttgacatcatcaaagataatgacattaaccatgaaaacgaccaaaagttcaacgtagaagatgacaagaacgaccattttcttaactcatgcgatgtggacgacaccattcccattgcacttgccgttcccaatgcctcccccgccgtgacagtggccttcccggccaatgacgaaagaaacaccgtcccaaccaccgccactgtggccactatagtaacacgctcaaaagggcagcgcaacgccaagtattccggaatggtgagacaataccaaaggctgtggacgaaggaggatgagatggaactgttgaagggataccttgattacgtcaagcagcatagaaaggaaaccaacacccttcaaaacgtc

SEQ ID NO: 79005 - DNA, 565 bp, Glycine max
  Peptide Sequence Number=SeqID_195783
gttaaagagaaaacacaagttggctttggaaaaaggcaaggacaaggaggttccctttaggaacccccaggagcaggccatttttgaaatttcccacaagatttgggccaatgacacagataatataatagtccaagatgccttggatggtgatgaatcaggacacactcctgaaagtcatgatcatgttggcaacgtcaaggtgaagattgaacaagttgacaacagtgatgaaataggcaatagagtgccaaagcggttgcggctagatgatgcagacgatatgaacagaacaaatgaccagaacaatggtgatagcatacaaggcttcattgaggacaccatgaggtcctgtttctcaccattgctgaaggaagtgttggatgaagcacaggaagagtcacttcctgagttggaggcaatcccaatgccgctatgctccggggaagtggaccatgaacaatggagaaaacggaggattttggagttggaggtgtatgtgaagcggttggagttgttgcagaatcagatcaagtctagattggaagagttgcgatctagctga

SEQ ID NO: 79006 - DNA, 204 bp, Glycine max
  Peptide Sequence Number=SeqID_195784
atggttggagcattctcgcaaaatagcatgaccctgactggtctccctatgattttacctagccttggatcttcttcatcagtggagtcctttgcttctttaagattaatggcaacggaatggagaaggacgaaagatgattggagatgccactttaaggagaagatgagtcaagaacaagctcaccaccatagaaagccatga

SEQ ID NO: 79007 - DNA, 272 bp, Glycine max
  Peptide Sequence Number=SeqID_195785
cgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactctta

SEQ ID NO: 79008 - DNA, 225 bp, Glycine max
  Peptide Sequence Number=SeqID_195786
ataattggacccaaccttggcccatgggctcagaaatctacattgaggttcatgagaaccctagggccttgctcagcagctctagcccaatcctcttggagcctcttgctcatggctctagtgactggtcccttcctatggaggattgcatcagggacccccggagatgaagatggagctcaagaaggcgaggacatggccgatgtgatggccttcttcctttga

SEQ ID NO: 79009 - DNA, 246 bp, Glycine max
  misc_feature (31)..(31): n is a, c, g, or t
  Peptide Sequence Number=SeqID_195787
atgtatgcggtaccaaatgtgggacctatgncgggaatcggaaagtctttcaaaaacaagaacagtatcatgtatagtggtgcattggaatattcatacgataatgcttttgcagtaagaactggttattttcgcgaaagccctgaacagggagccagagagttcgcaacagcagctttagataacacgcttcgtttcggtttgacctggaatatcggagatgaaacttctaatgttgataattaa

SEQ ID NO: 79010 - DNA, 435 bp, Glycine max
  Peptide Sequence Number=SeqID_195788
atgtctgcatcttggcggactttggggcgggcggtttgcttgacgttcttgcccatgttgcggcagcgaggtgccggaggcggagagcaggccggtcttcgtgtaggtgaacagcttggcgcgggtgtcgacgatgtcgaggttgcgcatggtcagctggccgatgcggtcggcgggggtgaagggggcgttctcgaccttttccatcgacaggcgctcgggggcgtaggtcaggttgggcgattcggtgttcagcagcgagtagtcgttgccgcggcgcagttcgatggtgacttcgccggtgatggcgcgggcgacccagcgctgggcggtttcgcgcagcatgatggcttgcgggtcgaaccagcggccctggtacagcaggcgacccagcttgcggccgctttcgcggtactgctcgatggtgtcttcgtt

SEQ ID NO: 79011 - DNA, 207 bp, Glycine max
  Peptide Sequence Number=SeqID_195789
atggcagcgacaatgaagagggagaggaagaagaggttgaatggtggtggtggtgagcaaagggagcagagcgacgaggaggattctaaagtgttctccagaccgatctccaccattgatctgatctcttactcggtatgtcaagcttctttgcgcaatggtggaggtacttgcaaaaaggacttcaatgctcaagtcagcaagtaa

SEQ ID NO: 79012 - DNA, 198 bp, Glycine max
  Peptide Sequence Number=SeqID_195790
atggtttctttgaagaaggaaattgaagcaaaaggaccggcacaaggacaagcaggacctatgaccagagctagagctagaaaggcagaggagaccctacaacaagtggggcaatccatcacccttgtggcgtcttcctttggcttatcttgcattgctgggagtggcgccttccacctaccatcaagcgatcagtaa

SEQ ID NO: 79013 - DNA, 483 bp, Glycine max
  Peptide Sequence Number=SeqID_195791
atggccaagaagatcaaggatggactactcatcaaaggcaaggaaggagaaaatcacaaggagttgaattggagcatgttgaagattgatgaacaacacgcctgggcttattcttggaaggtcaataatgtgattcttgaatttgcatccagaacgatccgaaccaagtgtccatggcttggattgcatcacatggttttgatgatgtcaaaaagaatttgcttgataatgagtgtcatcatcaaaaagagggagaatgtgaatcatggggagaatgtgaatgtatgtatacatgattttgatgatgccaaagaagaatcaaacaaggttgcttcaaaggataagcaatgcttcaagattaatacaagattgcttcaacaaacaaagccttgcttcaagatttcttcaagatcaagtcttgcctcaaaccaaagggtttcaaagtcatccaaggctctggtaattgattaccagacagtgtaa

SEQ ID NO: 79014 - DNA, 426 bp, Glycine max
  Peptide Sequence Number=SeqID_195792
atggaaattggtagcatagtctactcaactccacttgatggcacctttatgaagagtgccaccaatgcaagtacatttgtaatattaggaatagtggtttcaacaaagtcttcattgagggagaccgaatgggtgggttccaaggttcgaggattcggtgaagaggtgttggcggtgtcttcgaacacatctgctttggtcatggtttcagatcagggtttatcgtccgacatggacaacgggtctagttatttttctactttcttgaaccaacttccagagaggatgtttgacaatatagaggtggttcctaatgtggaaactatcgtttttagggagatttcaaatcctgtggcgcggaggtctatgtaccatggggccaaggaggatgacatgcccaactccccaaacccttcaattgaatag

SEQ ID NO: 79015 - DNA, 507 bp, Glycine max
  Peptide Sequence Number=SeqID_195793
atggcggatttaggtggcggatttgcgaaaaaacgccaccgaatagcggtggcgtggcgggtttgggatggcggcgccatggcggccgccatagccatggcggtcgtggcggttatagcggggtggcggaaaatggcgggatttgcttgggttttgtccgcggtaggagttgggccgacccgatccaaccctacccggttatgcattcaattaaatgttgtccgacgccgcacctcacctcacctctgcgtccttccctcacctctgcgtccttccctcacctctgcgtccttccctcaccccgccgcacccagccgccgccgcgacaggcgacacccgcacagtccgcgcacccaaccgccgccgcccgcgacacccttacacgaagacgaaggccaacttcgcgcgagccccggcaacgcagcctcccgcgaccgcgaccgcaacacctttctgtctcgtgaagaagacgaagaagacgaagacgcagacgcggtccctttttag

SEQ ID NO: 79016 - DNA, 1098 bp, Glycine max
  Peptide Sequence Number=SeqID_195794
atggctgctgttgtcaaccccagaacttggattccatatatgaacagcaaagactgttcacaaggattttgtagcttgtactgtccacagtggtgttacattgtgtatccccctcctccaccctttgagtaccctgatgatgattcaagcccaaatttctcccctcttgtcatcgcaatcattggaatcttggccactgcttttcttctggcgagttactacactctaatatccaagtactgtggccccagagagtccgcacgtagagacccaaatgatgaaaacttacaagacgacctcaaccacaattcatatctccgcgagcatgcttcaatcgcgggtctggacgaagctatgatcaaatccattgcggttttcaagtacaagaaaggaagtattggtggttctgctggagtcacggattgttcagtttgcctaagcgagtttgaagatgatgaaagtgttaggctcttgccaaagtgcagccacgttttccatgctccttgcatcgacacgtggctcaagtctcactctagctgccccttgtgtcgtgctggcatattcaccttcacttcttcggcggcgccaccacctcaggatgaggccgaggccccttcaagaaaccaaactactcatcataatgaaagtggcggcaacgagtttggcgtggtggcgcttcaagaagaagaagaagaaagcatgcatcacgctagagcatatccaaatcctgcattgcgcgcttttagcgacttgagttgctttcagttatgtaaatatctaaatcatgatcaccaatactttcagggtaggcacagagtgattgatattagagacgaagtgtgcgaatccgtcggtaggtcggtgtctatggaccattcgtcatttcaaagtgctctttctgttgctgatgtgttgcaaatgagtgaagaggaagatgccactgaagctggcccttcaaagaggtcacgcggagagagtagcaagtgcagatacaaaacaagggtgttgcattgtgtgctgagcccaatttcaatgaagagatcatcgttttccagtggaagaagattctcggttagcaaaagtggcagaggaaattag

SEQ ID NO: 79017 - DNA, 648 bp, Glycine max
  Peptide Sequence Number=SeqID_195795
atggctatttatagagaaaaaaccactttgggggcagttgaagctcgcccaggcgatttgaaccttaaccctgaagtaatgagcttgcccaggcgagctggttgcttagccatgaagccatttgatggcccaggcgagccagatgctagcttgggtgagctggggggtaagagggctatgaaagaaagtgtggaagcaatgccttccatgattattttgatgatgccaaagaatcaagagttaagcaagttccaaagaatcaggcttcaagaatcaagtctcaaagaatcaagagttaagcaagctctaaagaatcaggagtcaaaaagcttcaagaatcaagtttcaagaatcaagaacaatcaagatcaagattcaagactcaagattcaagaatcaagagaaaactcaatcaagataaggtacttcctttgtggcacaagtagagggtacatctacttgggttgttatactgagaacaagagagggtacatctcttgtggatcagttcaagtggagggtacatccacttggttgttcaaagagaacaagggagggtacatcccttgtggatctttggcttgtaaaggattttacaaggttgaaagaaatctcaagtaccgttggttgcctggggattggatgtag

SEQ ID NO: 79018 - DNA, 264 bp, Glycine max
  Peptide Sequence Number=SeqID_195796
atgggggtaccttatggttatccgtaccttctgttaatcctgacccgtgaagtcaggtggcatgcgggggtaccttatggttatccgcgccttcatttaatcctgacccgtgaagtcaggttttactttcgtcatccaaagacactcaagcccgatgacgcacaagattcttctctgctaggcagggacaatcgagttcaatatcatgtggaaacgtcgtggttatcccgttttatcactttcaaggcactgaagttttgctga

SEQ ID NO: 79019 - DNA, 372 bp, Glycine max
  Peptide Sequence Number=SeqID_195797
atggaggccatgatagagcaaatgaccacaatgatggaagtcatgatgagtatgagaaaaatgatggaggtcaacacgactacagtcattgtcataagtaccaccactgaggtggacctgactcacccatttggcctcaatcatgtaaatcatccagtcttgggtatggcaggtcagggaggcgaagcattgggaagtacgagcggcccctattttgtgcaggtccctcaacccatgggggagacacatgaagtaccccaagacaacactctagccgacttcaagcctcaccttgaatatgctactgaagggcaagcatttggtggtgtacccccgccaaacacttcggggggccctcagtatcacccataa

SEQ ID NO: 79020 - DNA, 246 bp, Glycine max
  Peptide Sequence Number=SeqID_195798
atgtctgatatgccttttagaggcttgaaaagtgcaagaaaccagctgcattttctggaaaatgcgatgaactctctaagcgagcatgctgcgctaagcgagttcatcaatactcattggtcattcaacagtggaaactggtctgactctaaagtccttaatagtgccgggctgagttgtcgtgctttcacgaggaatcggggtgcgataagtcagttgagtatgtgtgtcttaatgcggtcctag

SEQ ID NO: 79021 - DNA, 468 bp, Glycine max
  Peptide Sequence Number=SeqID_195799
atgaggtcctttaatggtgattttccaccatggagatgcagcggaagaaaaaggagaagaggtgagaggaggcgccatccactagggaataagccatggaagaaggagcttcaccaccaagatgagccttggataagaagcttggagaggatgcttcaatggaggaaaagaaagaggacaagtcttaacgagaagtgtatgttgttaacaagtggtagaatgacaacaaatagtcaaagaaaccgtagtaacaacaacaacaacaacaacaataataataatgttgcaaatacttctactaataacattggcagcaatgaacaaaatcaaacaaatccacctttcggggtaagtaatgaaatgactataggtgttaatcatgcaaacaacgaccccaaaaatataagtggcaaagacgcgatgcgtacacaattccagatagttgctatcgaaacttctttgccataa

SEQ ID NO: 79022 - DNA, 345 bp, Glycine max
  Peptide Sequence Number=SeqID_195800
atgtataatgctataataacctatattggtctccactgcagtgaacattggccaggcaactaccttaaaggaataattaacagtgctttgaaaggacttgacgatacttcacaaagtaaatccaaggctgctgctaggtggattgttcttaaatgtaatagacaaaaaggaagcactgagtgtgggtattacgtcatacactggatgtcaactataatcttaggaactttcaagaataattgggaaatgtatttcaatgatgctagaccatgggaaccagagagattgaaggcgctttgcatccagtggacaaagttttatttgaaagttaaaaatgaaacctag

SEQ ID NO: 79023 - DNA, 345 bp, Glycine max
  Peptide Sequence Number=SeqID_195801
atgggtacaactgatattggacttgtctaccatggagacacgtcttgtgctcttgctggttatttagattttgactatgctgtagatttggatgcaaggagaactatgacaaggataagaggtgagatgaggcgccatctactagaggataagccatggaaggagaagcttcaccaccaaaagagtgccttggataagaagcttacagaggaagcttcaatgaaggaagagaatgagagagatagagtgatgcaatcctaccccttaagggcattggatagaagactccaagaagattgggccagagatgcaagagaaggccctacggttcttatgagccttaag

SEQ ID NO: 79024 - DNA, 228 bp, Glycine max
  Peptide Sequence Number=SeqID_195802
atggcgtctaggaaatatttggctttggtgaaggaattctatgtaaacctacacagctttgatggtccttcaccaaagcaagccagggtcagaggccacctagtgaagatcggcgctgacagcctcaacacattcttagagacacctgtggtgttggcagagggctgcccacagattacagagagattgaggctgccttatgcataccaggtcgagggttcattttga

SEQ ID NO: 79025 - DNA, 210 bp, Glycine max
  Peptide Sequence Number=SeqID_195803
atggagagtgtatccgcttttgtgcattatgatgtggacattattccatcagataaaggaatagtgtttgaaagccctagtgatcctaaagtcatcacaataagtgaggacatcttgtttgctgccttaaggaaaataatttttgacacaatgaaggtgatggttgtgttgcatatgactgtatggagctcaaacacgacgatgatgtag

SEQ ID NO: 79026 - DNA, 153 bp, Glycine max
  Peptide Sequence Number=SeqID_195804
atggcagcaacttcagccttgttgggagagggtgaagtagatttggtgaaggttgagaaggaagggctaaggaaggtaaaggttgacttgccttggcttgttccccctacgtctgttgaaaagattctccaaactcaagatccaaaggattag

SEQ ID NO: 79027 - DNA, 186 bp, Glycine max
  Peptide Sequence Number=SeqID_195805
atggaggccttcaaggataggttcaaccctaagatgaagaagaatcatatttctaatggaatgttcttcattgagattctaaggctagctagagtggaggatgtgcaaaagcacataaagaagaaagtgaagaaggaggtgattgagactcctctatctgatgcacatcatattgtaggaacttaa

SEQ ID NO: 79028 - DNA, 345 bp, Glycine max
  Peptide Sequence Number=SeqID_195806
atggcacctcctaggaagaatgagtcctctggcatccccaccatcgacaacgttgaagactcccttcaagcttttcctgaaggctggtttatccctgggaaatggataaacttccaaaacttgaagaaggaaggctttgacatgaagggactttttcatagggaactgctaggcaagctctatggcccttatgctctccaaccaccattgttgctacatctggatatgctatggatggaggtttttgacaagctgttctatggaaagccttacccaaacggaggtgataagaaggctctcaacaccttcttgaggacaattaacttgacctacttgtgtaggtga

SEQ ID NO: 79029 - DNA, 312 bp, Glycine max
  Peptide Sequence Number=SeqID_195807
atggaaactgaacaacatcttccacaacaaagcccaccaatcgttgccagtatgcatgatgaaggactacaaccgcatgctcaatcatatgaattcatgccacaacctcatcatcatcaagaagattatgggtacaatccgcagttcttcagtgctagcgaagaagactttatgagcaacctcatgggtacaaatcttcaaacactagactctacttatgcgtacatgcaaagtatgctcataccttcatttgcatcttttcaccaaagtattgtcggcaattcatcgactaatgacttaatccaggaataa

SEQ ID NO: 79030 - DNA, 1074 bp, Glycine max
  Peptide Sequence Number=SeqID_195808
atgtctgaaaaagagttgcagaaaacatactttgatgctagagttcaatcagccatggaaacaagtgtttatatattacctgtagtgtctgctgaaagagacgtagagctccaactagctttagtgcaagatacaatagctaaagaagaaagagaggctttggatgatccaacgcttcattttgttattgaagtttcattgcaagggtttgatgttgttgttggttcagacactattgaaacaaaccctggggttgcacctttacacccctacccagtcacaactaaagatgaagttgttgttgatgctatgcttgctcaacctatctcagaagcaaacatctcaagactggagagcatctatggggccatagagcttgttccttttcatgctaaaaaatttagattggaaatcaagaagagagttgaaattgttgtacctcaacttttaactaatattttcaataaattgcatcaacgtctgagtagactagacggagacttaattgaatggttgttgcctttaagatctcaacctcagactgaacttgagctagtgtctactttagacaaaaacgtcagtctttaccatggtttcaagggatacagattgtctgaaggtcagactagaaaccaagcttggagagagaatatggatattggcacccaacacttggacccagagatcaagtcacataagggaatttccttcaaggtgtccctctcctccaacctcaacaacatcatatttgaacacataccatctgacaggaaggtctgccctccaagaattacagtctggagaagtagagaggttgcctctgatgaaatgcctttctccactcatctagacctacaacaacttcttggtctgatggctacctttaacgtagttcttccctggaatcatgctcagtctggggaatccttatacatagaagacatctaccttgaagatcttgagatgagtccaaccttctcaaattgggactttttttactatagcccgcagttgcgtctatgcctaaaccaatataaggaagaaatcaaggcaagacgagcctctttcagatga

SEQ ID NO: 79031 - DNA, 357 bp, Glycine max
  Peptide Sequence Number=SeqID_195809
atggcttttgtatctcttctattagaagtgaccatggaactgagtttgaaaattgagttaagatcattctgtgaaaagaatgatattttccacaacttctcttcactaagaacacctttacaaaatggggtagttgaaaggaaaaatagaactctacaagagatggcaagaaccatgctctatgaaaaaaatttagttttagaagaatccatccatgttaaattcaatgatggactaacgtctaataagaagttatcagatcttgaggaagattttgcagatatgcagataggatcatttgtaactcctaaagaaagagagattaagaagtctgatgaaattcttcctcatacttaa

SEQ ID NO: 79032 - DNA, 711 bp, Glycine max
  Peptide Sequence Number=SeqID_195810
atgtctcgcggctggctgtcccggttgatcgacgagctgcgcccttcggacagccgcatcaacctggtgatccgcgccctgctctccagcgcgatcgccatcgtgatctcgcagacgctgcaggtgccgtggctggcgctatcgctgatcgctgtcttctttatcacgcagtccaatatcgtgatcacccgcgcgatcggtatcctgtttttcgtcagctccacgctggcgatcggcgccgctatcctggtgctgaagttcacctatgactacccgatgctgcgcattctgctctccagcgcgctgtttttcctcagcgtgttcctgatgcgggtgaccaaggtcggagtgctgttcttcctgatggcgctggtggtgatctacacgcaaagctttgtcgatctcactccgcaggcggaagtggtgatacggctggtgctgtgggtatgggtggcgatcaagtacgccattctgctcaccctgatcgtcaataccctactgctgccggccgaaccgctgaagcagctaaagggccggatgatcgcggtgttggacgaaacccgcgctatgttggcccacggcggcgagacgcgcgatctgagcgccatctcgcagcacgccaccgagctgcataagctactgcgcttctcggtgatgcgcagcgatcgctgccgcgccaacgagcccggttatctggcgctgatcaccctg

SEQ ID NO: 79033 - DNA, 624 bp, Glycine max
  Peptide Sequence Number=SeqID_195811
atggatgttaagaatgccttccttcaaggagaacttgaagaagaagtctacatgaagccaccaccgggtcttgaagatcataatgcacccgggaaggtttttaaactcaagaaagctatctatggtttgaagcaatccccgagagcttggtaccacaagcttagcacaaccttgctggaaagaggattcaagaagtcggaagccgacaacactctcttcactctcccaagcaaggaaggtatagtagtcattctcgtttatgtagatgatattatcatctccgggaatgacaaggtagggattcaagagactaaaacctttcttaagagtgtttttgatataaaagaccttggtgaactaaagtacttccttgggatagaagtttgtagatcaaaggaaggtctcttcttatctcaaaggaagtacactcttgatcttcttagtcaagtaggtaagcttggagcaaaaccggctaagactcccttggaagatgaatacaaggccaatcgtaagggggagcttgacaacaagcctttcgaagatgtcacacaatatcgaagacttgtaggtaagctcatttatttaaccattactaggcctgacatttgctttgctgtgaatgta

SEQ ID NO: 79034 - DNA, 432 bp, Glycine max
  Peptide Sequence Number=SeqID_195812
atggcaagacacaaggcacaagggggaggaggggcttggtcgtccgtccgcccgggcacacacctagttagcaccaggcaggcaaaacgagagagagccgacgaacgcaaggccactctgccacttacaataccccgtcgcgtatttaagtcgtctgcaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 79035 - DNA, 513 bp, Glycine max
  Peptide Sequence Number=SeqID_195813
atgacgattggaaagtttgatttttctgcacacgatgcccgccagttggtttgcaccaacaatgcggatatgaccggacgccttctgtcgattttgcttccacgatcttccaatcttgcccaagtttctgaggaagatcttattatcatgtgggcctttcataccggccgtcaacttgactgggcacatcttagatcttttttaattggtgttgttgtgattgcttcttttggttaccgcaaagaccatgatggctcttgggtcaaaaagggcgctcaacccgctgatgaagaaggcaacctaccagttgaagataattccactcttcttcgaaggcttatggacaagtttgatggacttcaaacttttgttggtgacaagtttgatgccatggaattgcaagtcgacatgcggttcgatgccatggaatcaaggatcaccaaagttgaagaagatgtctccttcatccgtacttgctttgatccaccaccaccacctccatcatcgtcttag

SEQ ID NO: 79036 - DNA, 306 bp, Glycine max
  Peptide Sequence Number=SeqID_195814
atgcccaagtggttatccgcacaaacgatcactattaaccctgacccgggaagtcaggtggcaagcgggggtaccgtatggttatccgcacctttcgtcaaccaggggaaaacgagcctgttgacgcgtaaagacttacgtcgtcttctgcaccttttgtcatccagggacagcgagttgggtggcaggcagagataccttatgaaagtccgcacttttcctcaaccgaggcgaacgagttcgatggtttttactcttgtcgtccggagacattcaagcccgacgacgcacgagattcttctttga

SEQ ID NO: 79037 - DNA, 1434 bp, Glycine max
  Peptide Sequence Number=SeqID_195815
ggcgtgaccttctatggctgccagggagctagtcccagtcactatgatcctcccacttctctttttgggagtgtgaggagagttggtggcgatggagatgagaggttatctccacgcgtgtgtcctagcatgaatgttgggtcagtgttgtgcgcccctgttattgttggctatgagtgggtgagggacagtgttgaagtacaggtccaccttgacatcgagggcgggcctggtgttgggtgtcattctacccttgactacttttcagtgtgctctgctggagcacttgaatgtggccccttcctagcttcacccaaacaattgggtgacggtgccttggctattgatgttgtggatgatggcatgccactaatgttcaatagggacatggagccccgcttcccgttctactggcagtctgatcctaccaggttcaagttgtatgatgaggatctattaacccttgtggagagggtcggcaaagcaatcttggagtattatggggggggtcaacctgttggaaaggttggccctattgctattgctgctgagatcatccctaatgctccttcctctgttttggtaaagaggaagagggatgatgctattaggtcatcgggccgtaagaatcctccggctccaccggtcgtcgattctcctattgaagctgctagtcttgctatccttgctccttcaccttcttctattgttgatgttgtgcagggggctgctgctgctactgctatggttccgccatccaccgtcgtggcacctttattaagtgtcagtgtggcaaccactagtgcttccactatgccacctctttcatcgactcttgcggctctccctgatgttgtctttgcggctatggccggagcagaagaccccgattggctttgtgttagccttcaacataaaccttataaggagtttggccattctggaagagaatggactgtgacactaggaggtagtgtagaagattgcatccttagaggcaaaggcgaaccgtcaactgccttccaaggttggcggtgctttggccaaactgttgcgcacccggccgagaagctggacctaggtggcaaagtaaagagcatgactactgagaatgaggggcttgctaagaggattgctgagttagaggcccagcttagggagtcagagtctaaattggaggatttcgagctacaggttgccaaagagaggaaggtcaacaaggagcttgaagtggaactgctcttgtataagaaggaggtcggttactttgtgaaggaccttgacttaggtctcttcgatccctttaaggatgtgaaggaggatgtcttacttgatgaggaagagattggtgtgaaagaggagaaggctgctcatgaaaggaagcaagaccttgttggtgtggaggtaggatcgtggtggtcttgtaaagagtag

SEQ ID NO: 79038 - DNA, 423 bp, Glycine max
  Peptide Sequence Number=SeqID_195816
atgtcttgggtccaaggctcgacaaaccaaaggtccacccttggtgaagccttttccattactaatttccatccccacgagaactcaaggaatacaggcttattaaaaacccaagcaactacaacgaccaccatcaagggtcccagttccactaagcgaactaccaccccattattcgataagccttttaatcaggtcgaagcccacactcactcatcaccacccgattgcatgacaagaccttcaatcaggtgcagctcacactcactccccatgaccatcagaggaggaactaagcagatcaagcaacctatccctacactggttaggcaagaccttcaaccaggggggcaagtcaaacacaactccttacaaccaccaggggagaagctctacacaacagaaggaagcaccactagatga

SEQ ID NO: 79039 - DNA, 138 bp, Glycine max
  Peptide Sequence Number=SeqID_195817
atggcgtctagggcatcaggggcttccgtaaaatttctgaaaaccttgggaattaatgaagcattgagcttaatccggattttggttgtggactttgagagggcaaataaagcaacatttaccttagttaatttctaa

SEQ ID NO: 79040 - DNA, 815 bp, Glycine max
  Peptide Sequence Number=SeqID_195818
atggctggagaatcaggcaagatttttgcaggattgcaccgggcgaaagtgccgttcggttgccacaatgatcctcagcaaccccggattaaactgcacgacggcaacatgatgccgcaactcggccttggcgtctggcaggccagcattgatgaagcgcgcaacgccgtgctggaagcgctgaaggtcggctatcgttccatcgataccgccgccgcgtataaaaatgaagaggcgattggccaggcgctgcaggaaaccgacgtggcgcgcgatgagatctttattaccaccaagctgtggaatgatgaccagcagaacgttgaacaggcgatggagaccagcctgaagaagctgcagctggagcaggtggacctggttctggcgaaaagcatcggcgtgtgtaacttccatgaagcgcatctcaagcggctgattgatgaaaccggcgtgtcgccggtggtgaatcagatcgaactacatccgatgctgcaacagcgcacgctgcatgcgtggaatgcgctgcatcagattcagaccgagtcgtggagcccgctggcgcagggcggtgaaggcgtgtttgatcaggagatcattcgcgagctggcgaagaagtacagtaagacgccggcgcagattgtgattcgctggcatctggacagcggcctggtggtgattccgaagtcggtaacgccggcacgcattcaggagaacttccaggtgtttgatttccggctggataagtcagaagtgagcgagatcgcgaagctggataaaggcaagcgactcggaccggatccggaagagtttaatgg

SEQ ID NO: 79041 - DNA, 458 bp, Glycine max
  Peptide Sequence Number=SeqID_195819
atgcggcacactgcgttttttgctgcccgagagagtgccatgccaaacgatgccctttgccgccagctggcgcagcgcgtgatcacgctgatgcgcgagccacaaaagccgctgtgtgcggtggaaaacgtacggttgatctacgcagaggaaccgctgccgcgtacgccgatgttgtatccggcgggcatcgtgatcctgtttcagggacacaaaaccggctacctcggcagcacggtgtttcgctacgacgccaccaaatatctgatgctcacggtcacgctgccggtggagtgcgaaactgacgccacgccgcagcagccgctggccggcatgagcctcaccgtggatccggccagtttgcaggatctgctgttaagcattggcgatgacgagcagtttcagccgcagccgcaaacctccggcattcactctgcgttcctgagcgaggagatgct

SEQ ID NO: 79042 - DNA, 1743 bp, Glycine max
  Peptide Sequence Number=SeqID_195820
atgctcagtcagttgcagaccgtcatcaaagcggctgcctgcgggcaatccctgatcgttgaccactatcgccacgtcggttcattgctcaccttccggttcgtcgcaccggtcatagcgcctcagtataagcaggggtattggcccacgcattgtgcaactgactggctttgtgccgcgatcggcgcgcagtttgcaatctggcggctggatggcgggttccgtgagccacgccgcagcgttatgggcaaatgccacaaaattgtgccggattggggattatcctcgggcgttcctccagtgtttcgcggcgatgctgttcctatactgattgccgttcttcaactcagagtgaatgtagcgttcgctatatttcaggagtgcatcatgaatagttacagccagacagcggcagcggtgcagaagcgcaccaacgcccgttactggattgtggtgatgttatttatcgtcacctcgttcaactacggtgaccgggccaccatttcgattgccggttcggcgatgtcgaaggagatcggtctcgattccgtcggcctcggctacatcttctccgccttctcgtgggcgtacgttattggtcagattcctggcggctggctgctggaccgcttcggctccaaacgcgtctatttctggagcatcttcctgtggtcgctgtttaccctgctacagggctttgtcgacatctttagcggcttcggcattgtggtgtcgctgttcctgctgcgcttcatggtgggactggcggaagcgccgtctttcccgggtaacagccgtattgttgctgcctggttcccggcgcaggagcgcggtaccgccgtcgccatctttaactccgcccaatacttcgccacggtgattttcgcaccaatcatgggctggctggtggccgaggtgggctgggcgcacgtgttctggttcatgggcgggctgggcatcattctcagctttatctggctgaaagtgattcatgacccgaacgatcaccctggcgtgaacaaagccgagctggagtacatggagcagggcggtgcgctgatcaacatggatgcgaagaaagccgagcgtaaagtgagctgggatgagaagtggtttcaaatcaagcaactgctctccacccgcatgatgtgggggatctatctcggtcagtactgcgttaacgccctgacctacttctttattacctggttcccggtgtatctggtgcaggcgcgcggcatgtcgattcttaaagccggcatgatcgcctcgattcccgccatctgcggcttcctcggcggcgtgctgggcggcgtgatttcagattatctgatgcgtaaaaccggctcgctaaacatcgcgcgtaaaaccccgattgtcatcggtatgctgctctccatcagcatggtgatgtgtaactacaccgaaaccgaatgggtagtggtgctgtttatggcgctggcgttctttggtaaaggcattggtgcgctgggctgggcggtgatggccgatactgcacccaaagagatcagcggcctgagcggcggtctgttcaacatgttcggcaatatctccgggattgttacgccaatcgctatcggttacatcgtcggcaccaccggctctttcaacggtgcgctgatttatgtgggggtgcatgcgctggtcgcggtgctgagctatctggtgctggtgggtgatatcaaacgcgtcgaacttaaacctgttgaggagcgtggctga

SEQ ID NO: 79043 - DNA, 285 bp, Glycine max
  Peptide Sequence Number=SeqID_195821
atgttttccacaaataaacattggtggcgactccgcgcattttcctcctttggaagacatacccgtgagcctcgcttcgctcgcccgcaaaaggcacccacgggtttgagtaaaaagggggccctatacccgggtccatgggaatctaaggagtggaggtggatctatggtcatgctaggtcttcgacttgcttgatagtagtgaaacctcgtctagagctttctctctttataatgtgttgtcgctggtattccataccgccgcaatattattatcttgagtga

SEQ ID NO: 79044 - DNA, 891 bp, Glycine max
  Peptide Sequence Number=SeqID_195822
atggaagatgtcatcgatgaatataacatctccggtgaggatgagcaacctgatgatcctcgatgtgcagctgtactatgtgaggctgttgccttcatcaaaactcaaatccttcgccttcaaagtgcatataagattcaggatgttaaatcgcttgttcgtgctgaaagagatggtttccaacgccattttcctttagagcaaagaccaaccagttctagaggaaatcaagatgtcacctggaagaatcttagaagggttcctctctttattgaggaggatgaggttgtggggctcgataacgatagagctacattgaaaaattggttgacaaagggaagagaaaaacgcactgtcatctcagtggtgggaattgcaggggtgggaaaaacaactcttgccaagcaagtttatgaccaggtgcgtaacaatttcgagtgccatgcattgatcacagtgtctcaatcctactctgcagaaggactgctgaggcgtttgttggatgagctttgcaaactgaaaaaggaggaccctcccaaggatgtttctaacatggagtcgttgatcgaagaagtcagaaaccgcttgcgcaacaagaggatattaatcacaaccagggatgagaaggttgcgggatattgtaggaaatcatcatttgttgaggtgcataagctagaaaaacctttaactgaagaagaatcattgaaattgttctgtaagaaggcatttcagaatagttccaatggagattgtccagaagaacttaaagatatatctcttcaaattgttagaaagtgtaaaggtttacctctagcaatagttgtcattggtggtctttgtctcaaaaagatgaaaatgcacctgaatggggacagtttagtcgagatctaa

SEQ ID NO: 79045 - DNA, 213 bp, Glycine max
  Peptide Sequence Number=SeqID_195823
atgacttcctatggtggtgagcttcttctagactatcttctccttgaagtggcatctccaatcatccttctccttctccattccgctgccatcaaaatttatgaagcaaaggactccattgatgaagaagatcaaggcctacaagctccagtggagctacatcatgtggttctatcatttttcagtcataatatttttgtgctgaacctttag

SEQ ID NO: 79046 - DNA, 282 bp, Glycine max
  Peptide Sequence Number=SeqID_195824
atgcgatgtctaccttggagcctacctgaatggcggacattggcagatggtggtcatcctgcccaaggaacacctagttgtctgtgtaatagacaaaatggaagcactgagtacggctattatgtcatgcactggatgtccaccatcatattaggaagtttcaggaataactgggaagtgtattttaacgatcctagaccattggagccagagagattaaaggcgcttcggatccagtggacacagtattctctcgagttagagctcagagctaggatttag

SEQ ID NO: 79047 - DNA, 384 bp, Glycine max
  Peptide Sequence Number=SeqID_195825
atgagtgaaatagaggaggtgcaagagcagatgaaggctgacctggaggccatgaaagagcaaatgaccgcaatgatggaagccatgatgagtatgagaagaatgatggaggtaaacatggctatagtcgttgccgcaagtaccgccactaaggtggacctaactcatccatttggcctcaatcaagtaaatcgtccagtctcggatatggtaggtcagggaggcgaagcattgggaagtatgggtggcctccattttgtgcaggtccagagcaagcattccttcccaccatatggcttgcctcctaactatacaccacccaatgttacacacgctcttaatgagaatgtcgataactctgttcccatacccattgagagctaa

SEQ ID NO: 79048 - DNA, 363 bp, Glycine max
  Peptide Sequence Number=SeqID_195826
atggtttttcaaaacctgatgcaaaggaaggatagatcctataagaagtatgatatgcttcgacaacttctaacttaccatctttattccaaaaatagagtttcttatgcacagtccaaggaacaacacctacccatgaattcattcttttccaagcaacatattaatgttttcttgagaagacaccataacaaatgcaataggtattcttcgatttccaacaaacacatatacacaggtgatgcaatcctctctaggaagggaccagtcactagaaccatgagcaagaggctccaagaagattgggctagagctactgaagaaggccctagggttctcatgaaccttagggtagatttctga

SEQ ID NO: 79049 - DNA, 150 bp, Glycine max
  Peptide Sequence Number=SeqID_195827
atggcaggaggcaacctccctaccacgaaatgtaagggttataggggtatgccaccaaatgcttgcccctctgtggcatatccgaggggaggttcgaatgcggctaaagtgtggtctcggggtactttatgtgtctcccccatgggttga

SEQ ID NO: 79050 - DNA, 231 bp, Glycine max
  Peptide Sequence Number=SeqID_195828
atgcctaacaccggacaacacctgtccatactagggggcttgacaaactcatcaccctctgcttgtcaagattactaccccagacatcagacagactccctcaacatgggacaagctccctcaacgtctcccctcctgtcaaaagcacttctccaagccaacgttgaagttcggaccccactcagccacgtccatcttgacgtgccacggttccgaattttgagtaattaa

SEQ ID NO: 79051 - DNA, 165 bp, Glycine max
  Peptide Sequence Number=SeqID_195829
atgaggcaagcaacgacaacttgtggtggccactggtggtcgtgggtggtgaaagaggagggcgtgtctgtctcactaagcagtttccctttcgagttgggaattatgcttagcatgcctatcttgctaagcgagtttccctctcaggttgggaattgcgcttag

SEQ ID NO: 79052 - DNA, 294 bp, Glycine max
  Peptide Sequence Number=SeqID_195830
atgactcaacctctccaaatttcacttgtttcgaataaacaacaaggaggagacaagaaggctgggagtcaaggcaagaaaaagaaagcatgcataacgtgggaggaaaatgctttcaacacttcaagtgaatctagcaatgaagaagaagcaaacctctgcctcatggtcgatggagaagctgatagcgctgctttagaagaatcttcttgtaataacaaaactatctccacaagtcctccttcccaatgtgaaatgtgcaaggcacttcgatctaaaatgagtacatactaa

SEQ ID NO: 79053 - DNA, 1842 bp, Glycine max
  Peptide Sequence Number=SeqID_195831
atgataacgtggaaagacctatacatggtcttgaccgcagtggtcccactctacgtggcgatgatcctggcgtacggttcggttcggtggtggaagatcttctcaccggaccagtgctccggcataaaccgttttgtcgcgatcttcgccgtgccgctcctctccttccacttcatctccaccaacaacccctacgccatgaacttccgcttcatcgccgccgacacgctccagaaaatcatcatgctcttcgccctagcaatctggaccaacctcaccaaaaccggttcgctagagtggatgatcaccatcttctccctctccacgctccccaacaccctagtcatgggaatccctctcctaatcgcaatgtacggcgaatattccggttctctcatggttcaagtcgtggttcttcagtgcatcatatggtacaccttgttactcttcttattcgaataccgtgccgcgaagatcctgatcatggaacagttccctgaaacggcagcctccattgtgtcgtttaaggtcgactccgacgtcgtttcgctcgacggaagagacttcttggaaacagatgctgaagtcggtgatgatgggaagcttcatgtcaccgttagaaaatcgaacgcttcacggaggtcgtttatgatgacgccgaggccgtctaatctcaccggggcggagatttacagcctcagctcgtctcgtaacccaacgccacgtggctccaactttaaccatgcggattttttttccatgatggggtaccagcctcgccactcgaatttcaccgccaatgatttgttctcttcgcgtggacccactccgagaccttcgaatttcgaagaaagctctatgcctcaggcggcgactgtagcttctcctcggtttgggttttacccgagccagaccgtgcccgcttcgtacccgcctccgaacccagagttttcctcctctactaaacatttgaagagccagagtcagaattcgctgactccagcaaatggggcccacgatgcgaaggagctccacatgtttgtatggagctccagcgcctcgccagtgtcggagaacgccggactcaacgtcttcggcaacacggaactcggaacctcccaacagcctgaccagggtggtgctaaagagattaggatgttggtggctgataatcatgcacacttgcaaaatggggaagccaacaacaaaggtggtttggaggccggacttgatgtggaagagttcaagtttccggtaaatgggggagaacaagtggaggaagaaaaagagaaagaaaaagaagggctcaataatggactcaacaagttgggctcaagctccacggcagagctccacccgaaagccgccggagctgctgaggctcccgccagtaaacacatgcctccggcgagtgtcatgactcgtctcatactcatcatggtctggagaaagcttatccgcaatcccaacacctactctagcctaattggtgtagtatggtccctcattgcattcaggtggcacgtgcatatgcccaaaataatagagaaatcaatttcgatactgtctgatgctggtcttggaatggctatgttcagcttaggtctgtttatggcacttcaacccaagataatagcatgtgggaactctgtggctacatttgccatggctattagattcctcactggtccagcagttatggctgcagcttccatagcagttggccttcgtggcaccctcctacacgttgctattgttcaggctgcacttcctcaagggattgttccatttgtgtttgctaaggagtacaatgcccatccagccattcttagtacagcgtaa

SEQ ID NO: 79054 - DNA, 288 bp, Glycine max
  Peptide Sequence Number=SeqID_195832
atggaaaaatctgacaagagaaatttcaaagaaaagaaagcatacatcacttgggaagataatgacatggattcttcaagtgattcagaaaatgaaatcataaatctgggtctcatggccaaagactatgaaagcgaagaagagggttttgatgaagctaaagtagaatcaaacaataaggttgttccaacaaacattcaaaggttaagcattacttcaagaataattcaaggtcaaagcaaacaagatcaagaaaaagataaggcctcaaacaatctcattggttga

SEQ ID NO: 79055 - DNA, 225 bp, Glycine max
  Peptide Sequence Number=SeqID_195833
atgccggaatcggagacagggacgccgacggcggcgtcggtgccggcgacgccggatactccgggaggacccttattcacgtcgctgcgagttgactcactgtcgcacgagcgagactcgttcgcaatggcacggtgcaagtgtttgccgaccaagggccatatctgcttcactgatttctcagttggtgttccacttcccaatgtttctctcactcaaaagtag

SEQ ID NO: 79056 - DNA, 126 bp, Glycine max
  Peptide Sequence Number=SeqID_195834
atggtgctaattaataaatccgagctctatagctacatgaagaaaatttctcacaagtcacaagcgttgaaattgctttcccaagacaaagtatgtctccacctagtaggagctggatgctgttag

SEQ ID NO: 79057 - DNA, 728 bp, Glycine max
  Peptide Sequence Number=SeqID_195835
gcgcagataaaccaatcacagatgaagaagccctgaatactaatttgcaggcttcagttgctgctgatattgccaacacaggagagccagttggcaatgatttacagagacagttttctgatggaaagaggttgaataggctgaattgcttccgtgacgaaaattcgactgaaaaaacggacacatcatcttctcaacaggccagtaagctatccagaatgattagtagttctgataggattggtttaagctggccagagccaccactacatctgctatctcagcgaccattggatagaccaacttcttttaaatctgttagatccttttcagcatcaaagtctttcagaacatgtcagaccttcaagcaaaccatagatgacataggattgcttgctgaaattgacctcgaggctttaatgaagcggaaaaggagatcatcatatgtaaggatagtgagcaaacagatggttgggattttcatcaccatatgggttcgtcgttgcttgcgtaaacatattcagaatttgaaggtgtcaactgttggtgttggtgttatgggctatattggtaacaagcttacgaaagaacttgagaaaggtgtatttgatggatggtcagaaggcaagttaaactttccaccaacttataagtatgagattaattcagagaaatactatggagaggacccaaaggttgggaggcgcacaccgtcatggtatgcttga

SEQ ID NO: 79058 - DNA, 225 bp, Glycine max
  Peptide Sequence Number=SeqID_195836
atgaatatcatttactcgttattgaattgtggtgaaatttttagagtatcaacatgtactacaacagaggagatgtgggatcttatacaagtcattgatgaagagtctaaagacctcacctccatcacacatgctatgttatttggaaaattaagagaatatgagatggatatgactaggatggatgaaaaggaagctaaggaaaggaagagcaaaggcttatga

SEQ ID NO: 79059 - DNA, 252 bp, Glycine max
  Peptide Sequence Number=SeqID_195837
atgaagatgaaagcaaacaaaataagaaatgaattgaaagtctcggatttgaacacttgctggtggaagactgaagaacgaacgaagaacggacaaagaacggtgaagaacgacggaaaatcttcgaggatttgctcacgaaaacgtctcgaaagcgttacggaagcacctcggcttggattttcttcacgaaacacgtttttttcacccaaaacaactgaaatggatagcataggggtcagggatccttga

SEQ ID NO: 79060 - DNA, 735 bp, Glycine max
  Peptide Sequence Number=SeqID_195838
ttcggcaagagcctgtacgaggaaactgaaggcatcgacgccattatcgccgagcgcgtcgccagcctcgccgacgaacgcggcgtttcacgcgcgcagatcgcgctggcctggctgctgaacaagccggcggtcagcgcgccgatcgtcggcgcttcacgcagcgagcagttggatgacgccatcgccgcggtcgatttgagtttgtcgccgcaagaggtcgcagaactggagacggcttacgtgccgcatcgggtagatgatgccggcagacagcacgccggcgatgatatcgtcgaccatgatgcccatgccgccatgcacgttgcggtcgaaccagcggatcggccacggcttccacatgtcgagaatgcggaagataacgaaaccggcggcgacccagcgccagtcgttgaccggcagcgccatcagcgtgatccacatgccgacgaactcgtcccagacgatgctgccgtgatcgtgcaccttcatgtcttttgccgtgcggtggcaaatatagacgccgatgcagatgctgaacatcaccgtcagcgagtagagctgccacggcagctggatcagcagcagccaaaacgggatcgccgccagcgatcccatggtgcccggcatcaccggcgacaaaccgctgccaaacccggtggccagcaggtgccacggattgctcatccgcagccggcgcttggcttcatccatgggtgcccggctccgcgttga

SEQ ID NO: 79061 - DNA, 390 bp, Glycine max
  Peptide Sequence Number=SeqID_195839
atgggccttccacctccgtttctcctcagttgtttcatctttgaattatcacttgatatcctctgtgaagtccaggctctgccaccattatcgcttgttcaagctgccgcactggcgaaacttcaggaggataagcttttttatgctcgtcatggcttgcgcttctggctacctgtttctcctataacgaaaaccaccttcaaaaagcttactcccgccgagatggcatcgcaccgtgagaagggattatgttataactgcgatgaatgctacggtcccaaccatcattgtcacgccaaattcttccttctcattgcctctaaggaagactaccccatcgatccaacacccactactgacccagagccttcctctcctattgctctctaa

SEQ ID NO: 79062 - DNA, 390 bp, Glycine max
  misc_feature (358)..(358): n is a, c, g, or t
  Peptide Sequence Number=SeqID_195840
atggttttaggggtgacatggcttaaactccttggccctattacaattgactattcacacctcacaatgtcctttgtgtggaatagcaatgttgtttcattgcaggggtgtcttgggcctggcccaacagaggccacccatggccaagtgaaacgtttactagacacggatcacgtgacttccttttcacacattcatcttcgtgacatgaccacctcttccggcacctccaccatgccaactctgccaaaactccgttcccttctcagccgttactcacctattttccaacaacatagttcccttcctcttcctcgacccactgatcacactattcatcttgtcctgaactcccaanctatgaatgtcagaccatataggtatccataa

SEQ ID NO: 79063 - DNA, 266 bp, Glycine max
  Peptide Sequence Number=SeqID_195841
ggtgcattactgtgttggttcctgatagagtggcgcaggtgttgaatctgaatctggacggtgtggtgggtggtggccacaagcagcagcacaagcctcgtttcattggggaaaatggatcggctgtttcaagggttaggagtaacaattacaataataataatcattatggttattctcatcatcagaagcgtaacaacatgaagctgcagcagccacaagtggtgaaccatgagatccagttgcctcaggaatggacttactga

SEQ ID NO: 79064 - DNA, 348 bp, Glycine max
  Peptide Sequence Number=SeqID_195842
atgaagattggaaaagttggtaccggcatgaattttattagaatatggaaattgagcattatgtttcgctatttctgtgatctgcctcaatttgaatatgcagagtggggcaaacggacacggtttggggacagcagagaggaactagctccaattgagtcaaatgaatttcttccaaggttaaggaggcaaaagtcattaacttctaggtctcagtatataaacaagaaggaactgagagtatgtgttggaacgtggaatgttggaggaaaacttccacctgatgacctagatattgatgattggttaggcattaacgagccagctgatatctatgttcttgggtaa

SEQ ID NO: 79065 - DNA, 339 bp, Glycine max
  Peptide Sequence Number=SeqID_195843
atgtgtaagaaggagcataaatctttcaaagaatacgcccaaaggtggagggatctggcagctcaagtagcgccctcaatgatagagaaggagatgataacaatgatagttgacatgttatcagtgttctactatgagaaaatggtgggttacatgccttcaagctttgtcgatttagtttttgccggtgaaaggatcgaagtgggtctgagaagaggcaaatttgattattctgctttgatgaataggaagcctggggcaaatggagagaataagaaggagggagaaacccatgttgtggttgctattcctacatggtcaaattttccattagcctga

SEQ ID NO: 79066 - DNA, 213 bp, Glycine max
  Peptide Sequence Number=SeqID_195844
gattcgattgaaggagctggagagcagaatgaagaggccataatgaaggttacttcacatctgttatcaattgctaaacgacatggatgctacaaagttatgtggacaatttgttgtgatgtgaatgactcggaattactgagaaacattatggcatttgcaaattgcaatgatgattttcttagcatatcaacccaaatattttgttactga

SEQ ID NO: 79067 - DNA, 276 bp, Glycine max
  Peptide Sequence Number=SeqID_195845
atgcgggggtccggggaatttgtccccttcttagatacgacgtctaggggtagcgaaatgccccaacgcacgtttttaagaaggcgacacggaccctccgttggtttgtttacagtagggatcaagacagaacccatatgcaatgcctatgcaaaagacacaatgcgggaatgtgcacaaggtatcatcccctttgaagaacatattgtagcagtagggactactagcaacaataggttttcaaagagaaaagctctagatgagggttcactgtaa

SEQ ID NO: 79068 - DNA, 665 bp, Glycine max
  Peptide Sequence Number=SeqID_195846
atgaaagcagcattgattgatacgtttggcaccgccgatgtgctgacgattggcgaacgtcaattacgcgccgccagtccggatgaggtgacggtgcaggttgaagcggcgagcgttaacccgctggatgtgaaaatcatctcagggcacatgcagcaggttttcccggtggatctgccttacgtgccgggcatggatttctgcggcgtgattacggcagctggcgagcgcgtgagccatttaaaaccgggcgatcgcgtgttcgggcgcacgccaccgggtgcaggcggggcttttgcccaaagcctggtaatcgccgccgatgacgtatgccttgtcccggcagcgatgagcgccgaacaggccgcggcgctgcctaccgcgtttggctccgcgcagcaggcattgttcgatgtgggccagctgcagcgcggcgagcgcgtgctgattcacgccgcagcgggtggcgtcggcagcatggcggttcagctggcgcatcaggcgggcgcttatgtcatcgccacggcgtcggcgaaaaaccacgcgctggtgaccagtctgggtgccgatgaggtgattgactaccgcacgcaggactttgcagcaacgcgcgatatcgacctggtgatagacagcgtcggcggcgaaacgctgagccgctcctg

SEQ ID NO: 79069 - DNA, 267 bp, Glycine max
  Peptide Sequence Number=SeqID_195847
gtcaggatcagcagatgttgtgtttatacggataaccacttggggtatttccgcctgccacttgacgcatgggtcaggattaacagatgttgtgtttgtacaaataaccatttggggtatttccgcctgccacctgatgcatgggtcaggatcaacagatgttgtctttgtacggactctcaggtcgctggatagcaaaagtgtgtgggcagataaccatcgagtgtctttgcatgccaccggactcacaggtcacgatagcaaaag

SEQ ID NO: 79070 - DNA, 495 bp, Glycine max
  Peptide Sequence Number=SeqID_195848
atggatcatcattgcatttggataaataactgcgtcggtcatgcaaactataaagtattcttcatttttgtcttatatgctgtaattgcctgcatctactccctggtcttacttgtgggtagtctagcttctgacagcatacaggatgaagagaaaaatggaagaagctctttccgaactgtatatgttgtttctgggctcttgctggtccccttatcaatagccttatgtgtgcttttaggttggcatatctatctcattctacataacaagaccacgatagagtatcatgaaggagtgagagctttgtggcttgcagagaaaggtgggagtatctataaacatccatatgaccttggcccgtatgagaatttgacatttgttttgggaccgaatatccttagctggctgtggcctactgcaaaccatataggttctggacttaggtaccgcaccatctacgatctccctaaaggtgcttcaacgtccaaatga

SEQ ID NO: 79071 - DNA, 183 bp, Glycine max
  Peptide Sequence Number=SeqID_195849
atgagttgggattttacaagcagcgcgagcgaagacgtgagaagagaagagatcgatatttgcaaaaacggggcgttagaaataaaaatatataaaactgaaagaatgggggagtgtggtatgcattccaaacgacaaggggacaaaggtgggaccagacatcacacgactcgggaaaagtaa

SEQ ID NO: 79072 - DNA, 573 bp, Glycine max
  Peptide Sequence Number=SeqID_195850
atggcagaagatcccttttcgtttcatccatttttcaattctttgaatccaaaggtgaaagtgagagtcccagagcaagaagaagaacttgttcatccggaaaacaatagtggaacttggatgttttcaaagttaattgagttactatactttaaagaagagaagaatcagaatcagaatgaatgtccaccctcaatttccgaaagcacaaaggcttgtactcaacatgtagaaactggagtagattttgatgatgtttcaacttccacaggattattcaagagtatcaaccgagttggtgagagtccaaaagtaaatgcaagagcttgttctgttatacgcccacgtgcagtcttatctagtcccgaaaatgatggattaattggaagcataaatgacttgaaccacagtgtatcttcagctcacagaaagaacaatgcaaaagtgaagatagaaggccaagctaaagttttgtctattcaggtgaaggaaggaaaatattcggacaaggaggaatgtgaggcattcaacaaaggcagaactccttccaaagtgcatgttagaaacttttaa

SEQ ID NO: 79073 - DNA, 318 bp, Glycine max
  Peptide Sequence Number=SeqID_195851
atggaggactctaaaccaattgcatactttagtgaaaaacgtagtggagcaacattgaattatcctacacatgacaatgagttgtatgctatggcaagaacttcacaaaatcagcactacttgtggccaagggagttcataattcattatgaccatcaaagtttgaagttttcgaaaactcaaggcaatttgcaaaagatacatgccaagtggttcaacttcattgagatgtttcaatatatgatcaagtacaagaatggtaagaaaaatgttgtggccaatgcattgtccagaaggtatgatggggttcttgagtaa

SEQ ID NO: 79074 - DNA, 1510 bp, Glycine max
  Peptide Sequence Number=SeqID_195852
atggatgactttcttatagagttcttcccctcagtatacagacagaaaaagcatgcccatgaaaacaactactgcaagtatgacaatcagggcctagcagcatttacctcttctctgtacattgctggtttagttgcatccctgatggcatcccctgtgacaagaaagtatggacgtcgagtaagtatcataggtggtggtatcagctttcttattggatcagctctgaatgcttcagctgttaacctgataatgttgatcttaggccgggttatgcttggtgttggcattggatttggaaatcaggctattccgctttatttgtcagagatggcaccaacacaccttcgaggaggcctgaacatgatgtttcaagttgcaaccacttttgggattttcacagctaacatgatcaattttggaacacaaaagatcaagccttggggttggaggctgtccctaggcttggctgcagtaccagctcttttgatgactgtgggagggatatttcttcctgacactccaaatagcttaattgaacgaggattggcggaaaaaggaaggaagctgctggagaaaatccgaggaaccaaggaagttgatgcagagttccaagatatggttgatgcaagcgagttggcaaagtccataaagcacccatttcgtaacatccttgaaagaaggtacaggccagagttggtgatggcaatcttcatgcctacctttcagatcctgactggcataaattccattctcttctatgctccagtgctgtttcaaagcatgggatttggaggagatgcatcactcatctcttcagctttaaccggtggagttcttgctagttcaacattcatttccatagcaacagtagataggttgggcaggagagttcttcttgtcagtggtggactacaaatgatcacatgccaaatcatagtggccattattctaggggtcaagtttggagcagaccaagaattgtcaaaagggttttcaattttggtggttgtggtgatttgcctatttgttgttgcttttgggtggtcatggggtccacttgggtggacagtccctagtgagatatttccattggaaatccggtcagcagggcagggcatcacagttgctgtaaaccttctcttcactttcataattgctcaggcctttcttgctcttctctgctcattcaaggaccggaacggaactcggatcgggacccaaccggttcgtggatcccaaaaccaaatcgaaaccttcgtcgtcgccgccgcgggtctcggcgctgagcgtctcgcctctcttgaggatcttgacatggcccatgacgaggttcgcgctggggcctttcaccaccatgccggagcggtcgccgtcgtggagcctccgccggcgagtctgatggagttggggacaaggcatcgtggtggccttgaagacaatcgtgggagcggagaagagaggttcccattagaaggaaaccaaggagtgatgcattacggtgggaacg

SEQ ID NO: 79075 - DNA, 309 bp, Glycine max
  Peptide Sequence Number=SeqID_195853
atggttggaggagaaaaagagtggagtcgtaaccaacgtttatccgaggaaaacgttagaaaaaccaaaaagaggtttgcaaattttgaaaataagggttcaggagttgtttatgcatggggaagcgcctcagcttcgcttttcttctttttccttcctgtcccttcatttttcttcccctctaaactttctgaacccccaaaacccttcccctacatggctatttatagaaaaaaccatttggggcaagggcagcttgcccaggcaagctggttgcttcatcctgaaggtatcagctcacctaggtga

SEQ ID NO: 79076 - DNA, 246 bp, Glycine max
  Peptide Sequence Number=SeqID_195854
atggtgagagaactcacatgcctcactttgctactcctaacgggctctgagactataatttttggagttgagagcttggggatcaatatacgttgcacctggcatcgagagtgttgttttcctggaaaaatcatattccctggttatgagcggagaactcaaccctacaaccaacatctttcaggtaccgatgttagaggagaccatgatggtctcatacttgcgaagataaaggagtacaaatag

SEQ ID NO: 79077 - DNA, 432 bp, Glycine max
  Peptide Sequence Number=SeqID_195855
atgggtgatgagaccggctataggtggggcgggaggtctattgtgcatatggaaggaagacatattcgtgttggacgaatgtttcatgggggagggatcccttggagtgagaggaatgtggaaagagatgcattctgtgaaagaaagaagaaattgaccatgtgggaagatttgaaaagaagaatgatggctagaaataccactcattgctgcctaattggtgacttcaattgtttgagaagccaacatgagacacaaggaaaaggggaatcatcttataaggtaggggaagcggtggagtttaatgagtttattgatgatatcgagttgattgatatcccactgtcataccctaatttcgtccggggacctttgcttgatgacatgcgacctttctttggtccttgtgaggtgcttggtacccatcattag

SEQ ID NO: 79078 - DNA, 1113 bp, Glycine max
  Peptide Sequence Number=SeqID_195856
atggcgtcgtgcacttgttcttcttcccttctccttgtgaatcctccgccgagcacttcccgccaccacgcgatccgccgaaacctgagaatgtcccttaacaacaacgattcaaagctgaacccttcttctctgctgaattccgtcaccaaattactatggggccaatcgctcccgccggggctcctcgtcgccaccgtccgcaccgcctggaactccacgtggcacctcatgatgtcgcagctcgccccctccgactcctcaggcggctactcccgccccgcctccaaattccgcttctcctcaaccaccccttcccagggcagcagcctccacctctacgtgggcctggcatgcccatgggcccaccgcaccctcatagtgcgcgcgctgaagggcctggaagacgccgtgcccgtctcggtggcgtcgccgggcctcgacggctcctgggagttcaaacgggccggtgggcccgacacaaatacaattgctccgagtttggatagagcgaatggatgcaacacgttgaaggaagtttataggcttcggagaggtgggtacgatggaagatccacagttccaatgctatgggataagggttctaaagacgttgtctgcaacgagagctacgatataattcacttgttcaattccgaattaaacagcgtagctcaaaacccagggttggatctctcaccccctcaattgaagaaacagactgaggaatggtatcaaatcatatatccaaatgttaacaacggagtttataggtgtggatttgcgcagagtcaagaagcttatgatagagcggtgaatgacttgttttctacattggacaagttggaggatcacttggctaattcccgttacttatgtggagacacattgactcttgtggatatttgcttatttactactctgattaggtttgatcttgcgtataacgttctttttaaatgcactaagaagaagctgtgtgagtataccaatctacatgcctacatgcgtgacatttatcagggagcattagacccgctatgccttctacttctgagcatgaaagcctttgcaggcctcatggaagggaatcactgtcatcagctacactag

SEQ ID NO: 79079 - DNA, 1800 bp, Glycine max
  Peptide Sequence Number=SeqID_195857
atgaggaactggtcaattaagaatggtgtagctggaaaacacagtggtcgtgctactgtggcatcatcacaaagcagagatggagttgtagatgaagatgttattcgtacctcaaatggagaaaggacttgtgatgtagagatagcctcatcaactcttggagaggtaaaactttctttgagctgcagcccagctctttggggatcagattttcatatgcctagtcaagatcaacttatagaaatgatggaggataaatgtctgcaatcatataaaatcactgacccaaatttctctgtgaagaatctgttgagagatatatgtgattgcatgttggaattcagaaatgataagtcacaagagggttctacgataaggtccagtgttgatgtgttgaaggaaccacatgcacctgacacactgagtgtggtaggaaataaagatttggacagatcttctcacttttcaaacggatccatcaatgttaagtcttctgatgctttggtttctccccgaagtatccttcctctagcccacccgaatggtctgagtgatgctgtactggtttccaagatggacggaacaaatgattttttgcaaagtaatgtcagaaaggatctggaagatcctatgtctccaaattcacaaagtttagtgtttgttccacagcatcagcttacagttggtgatataaggtcttttcatgatgctaatgaccttacaaaaggagaagaaaatgttgaaattccatgggtgaacgaaactactagtgatttcgcaccatcttttaactacataccccaaaaccttgtgttccaagatgcttatgttaatatttctctatcacgtattggtggtgaggattgttgttcaacttgtatgggcaattgtgtcttgtctactacctgtgcttgtgcaaataaaactggtggtaaatttgcatacaatactgagggcctactgaaggaagaattcttggaagagtgcattgcaatcagtcgcaaccctcaacaacatttctactattgcaaaaattgtccacttgaaagatccaagaatgatggttgtttagaaccgtgtaaaggacacttaaagaggaagtttattaaagaatgttggagcaaatgtggttgtgggaaacagtgtggaaatcgggttatccagcgaggaataacttacaatttgcaggcattttttacttcagaaggaaaaggatggggtcttcgtaccttagaggacctgccaaaaggtgcatttgtgtgcgagtttgttggagaaatattatccattaaagagttgcatgagaggagcatgaaatgcactgaaaatgggaaatatacatacccagttctactggatgcaaattgggattcaggatatgtgaaggacgaagaagctttatgcttggatgcagcttcttttggaaacactgctaggtttatcaatcacagatgttctgatgcaaacttgattgagatccctgttgaagttgaggatcctggtcattattactatcactttgcctttttcacttcaagaaaaatagcagcgcaggaggagctaacatgggattatggcattgactttgatgaccatgatcatcctgtcaagctgttccagtgcagatgtggcagtaaattctgcaggaacatgaagagatcaagcagcagactggcctacgaaagtaaagagttagcgttcattgtgggatttattttggtattcttattattagaggttctaactcagacaagatcaaaatggatgtttgcgaaaaagaaaaagacggatagaggttaa

SEQ ID NO: 79080 - DNA, 144 bp, Glycine max
  Peptide Sequence Number=SeqID_195858
atgaatggaacagattctggtgacagacagagagagaaagagaaagaggcgggtgtttttgaattccgtcaccggcaggctcatccacgcgccacccactcgcgtgctcaacaatctctcgatagcgtgtcgtggactctctga

SEQ ID NO: 79081 - DNA, 1464 bp, Glycine max
  Peptide Sequence Number=SeqID_195859
atggaagcacatcctactttctccattgaaagttcaaagcaactcaataacatggggatgtctggagcactttcttcatccttgtcaatccttccaatacccccagaagagttgtttcccaagctgcctgaatcacagctggattttgtagaacaagagcttatgataagaccttttactcattcaagttatttgaattccggtggagtaattgggcatattttttcgtcttcccctggatattcaactgatcttcatcactcaactctttcatctgctgaaaaacattctactaatgctcatttgatttcacaatcatcaactaacatcacccaatttccattatcatattcttcaaatattggaccaccagcttcagcaacaccaagtcattattccaaagaaaacagtgtttcctggcatacagattccctgccaggctttctggattttcctgaaaatggctctattgataataatccggtagaaagtagtgcctgccctataatggcatctgaggagtattctaagcaaaatgattggcaggagtgggctgagaggctaatcagtgatgatggcacattgacttctaattggaatgaccttcttgctgacaacattcaagatcttgagccaaaggggccattccaagtttcaaaaccactttcacagattccaggacatcaatcccaaggtcatcaacaacttcctgcttcatatggagaaaattgcgctggtgctgccctctcttcctcagcaaattctgctcctgctaagtcacgaatgcgttggacaccagaacttcatgaggcgtttgtggaggctgtcaaccaacttggggggagtgaaaaagctactccaaagggtgtgctgaagctcatgaaagttgaaggattaactatatatcatgttaaaagccatttgcagatttggcttgaaatgaagaaatacaggacagctagatatagaccggagtcatctgaaggagttatggacaaaaaaacaagttcggttgaagagatgtcatctctagatttgagaactggtattgagatcactgaagctctacgattacaaatggaggttcagaagcggttgcatgaacagcttgagattcaaagaaacctacagttgcgaatagaagaacaaggtagatgcctccagatgatgtttgagaagcaatgtaaacctggaactgaaacgttcaaggcaccatcatttaccaccattgagactccatttgggatgtcttcaaatgctacgaaagattccctttccaaaaatgaaatggaagcatcactagtactggaccattgcaggtcaggacctgatcaggttaatggcagtaccagagttgaggaaggctcattggaaaagtgtgggaagcctgattctcccaaaactcaacatgctatagctagtgaagatagtgctcaagccccaaagcgtcaaagaactgagtaa

SEQ ID NO: 79082 - DNA, 630 bp, Glycine max
  Peptide Sequence Number=SeqID_195860
atggccatgagtgcagtcttaaacactggttctcactcccgaaatggatttcgtttctcggaagaggaaaatggagatttcaaccaacagcagtggcaacacaatgatgatcaagcattctctgcggccggaagtgttgctaatgaggattttgaagggcagaaagcattctacagcaatgcagagaaacggaaagagaagagaagtttaaagagcaatgaccaagcagaagatgactacctatttgagcgtgaagggggggagccaaaccttctagcaccagttgatatctttgtgaccactgcagaccctttgaaggaaccacctattttaacggcgaacacggttagctgttatgtctctgatgacagtgcatctatgcttttctttgataccttgtcagaaactgctgagtttgctagaatatgggttcctttttgtaacaagtataacattgagccaagggcacctgagttttatctctcttggaaacttgattacttgaaagataagatgcacccaacatttgttaaggatcgcagggccatgaagagagagcatgaagaattcaaggtgaaaattaatgaattggctgcaaaggctaaaaaaaacaagaagaggagtgggtga

SEQ ID NO: 79083 - DNA, 819 bp, Glycine max
  Peptide Sequence Number=SeqID_195861
atggggggaaaagagattgggtggctttatggctcagtcacagaagacctcttaactgggtttaacatgcattgtagaggatggaaatcagtgtactgcatgcaaaagaaagcagctttcaagggatctgctcctataaatctcagaccgattacaccaagttctgaaatgggcttcagcagaaaactgaaatggctgcagagattggcctacactaattccgttgtctatcccttcacttccatcccattgtatctactgtacaattccagctgtttgtcttctgactggaaactgtcaaaccttgctagcatttggttgatggcgttatttatctccatcgtcttaacctgtgtgctagagcttcgctggagtggggttagcattcaggactggtggcgcaatgagcaattctgggtcactgggggagtttctgcacacctttttgctgtatttcaaggtctccttaaagttggtggagtacacactaatttcactgtgagagcaaaatcagcaaatgacactgcagcatttggacagctctatctcttcaagtggactactcttctcatcccaccaacgagtcttgtaatcttaaatatggtgggaattgtggctggaatctccgatgccattaacaatggatatgattcatggggacctttctttgggaagcttttcttctccttgtgggtcattttgcacttatatcctttcctcaaaggtctaatgggaaggcaaaacagaaccccctaccattgtagtcctctggtcaatagttctagccataattttctcaatgatttgggtgcgaattga

SEQ ID NO: 79084 - DNA, 2715 bp, Glycine max
  Peptide Sequence Number=SeqID_195862
atggaatcttcattgacgcctcctcctcctcctcctaagttccggttcagagataactctgagccggaatctcagaactcatcggagctgggctccgacgtcgtttctgccatgtcaccgtctatccgccatcctgatgccgaccttgaaatcgagtccatgaccggaagaggcatcatgcatctgtgtgatgaacttcgggagctaaaggaagcagcaaatgaagatttgcagaaaaacatcttcagcaaatattccactttccttagaatactagaggaagtgataggagtggaaaatgagcttgtgcaactggaaaaccatttcctatctcataaaaggcaagtaaaggatcttatagatcgaatatatccaaagatattgtccatagacataacctttgaagatcatataaattttgtcccttctccccccaccgaattggaagctcacatgaatgaatgttttgagaatttggatattctcatatcagaaaacaagatagatgaagccctgaaccttctagaatctgcagatgaacattgtcaaagccttcaattgcaacattgttcccatagtgagataatattatatgaatcagcaatttctgagaaaaagtccatgcttgtacaacaattgacacaaatagttgagaataaaagaacaccgggaccagatcttcaaagggcactagctaggctttgcagacttggtgatattcaacttgctgttaatctgttgcttaaacattaccgtttgcgtgttgcgaatggaacagataatttgcggtgggcaaaatcatcttcaattgagatatacatgagggaacttgcaaggtttgtgttctcagtgatttcacaagcggcaaggagctttgtgatgttgtgtggagaaacatctccttatgcctcagaacttatgttgtttgcatatgaagaaacaaaatcattcatcatttgttttgataaatacgtcaaaggcacctcagcaataagtggagggttgtcttctgccataaaggctgtcaacttttctgtcatgtattgttctttgttagaaaatcagaaattggtgttgcggccatacttagtgaagaatctctttccctgcatggaagaggttctaaatacacatatcaaccattttaagaaagtgatttctatcttctcagcaagtgatgcttggattttggagaagtaccttgtgtctggagtgtttgttggggctggatcttcaagtttagctgttggggaacaacatgactattgcttgttaaccaccagtggccggaaggttttgacactattgcaggtcattgtggaagatatttctcctttagtttctcttcaaatggggagtttagtcattagtggaatcacaaacctcttggcagagtatattgtcatacttgaaagagcccttacttatgaaacaagctcaacagaacaaggtagtccaagaataaagttagctgagtcactacctcaacaggtttctattttggccaatttgtcaactttagtgcagtttctcactatcatggtaaaaaatatctttagcagcagtgatcacatagaattgcaagtattggaaaatcattcaattgttcatcagcagcaaggacttgatgatttcctattgtttattgaagagggttccaataagttgagaaatatgttctgccagcaattaattctcagagaattgtctacttaccacaggcatgaaatgttttcagctagtcattgcaatgaccagtttgatgctaacactgtcccccatccaatgccctctggtatttttcaggttttatttctagaattaaggaaaatagaacaacttgaggaagaaaatgtgtttgaagtgaattggttgatgggattactaagagagttaatggagtctatgttcatttgggtttccaacaacaaagagatccttgcaactacagaagagaatgtgagctcaaaaaccgatgaagccaaacagtttattttggatgtgcaattcttggtggaaattggaatgtacggaggatatttctccagcgatcctttgctccttctcactctcatgaaatcaaccttcaattcagccggactagaccctttcaatcatcaagaggttgtcatggtattaaaagcaaccaatgtttcaaacattgactggtgtttcctttatagagatgtagatgatgatgattgggctatagatgctgctactaaaacaattcaaaagctgttggagtttgagaaaacaagtttgcatccaaaggagcctgcagttaccatcaaagaggagtcacatgagcatgagagccaaatcaatcaattagcatatgaaagtaatttttccgaggaagatgatataagttcttcagagaataacgtagtagatacatcattggatgcagagaaagatgaggttgcaaaacatgaattagaagttgctattgatgcaaaaatggcttcactagacacagtatttagccctggagagggatcattagtggagagagattattatgttgactcaaacacttcaaatttgataccaacttctatcattacttttcaattagaggatgctgattttgaagaggcagcagatacaaaaaatgatgaattgactccaacatcttctgtgggtgaggtaggactcaattctgaggaggaaactaaatcaaaatcagacgaatggccaacacttatataa

SEQ ID NO: 79085 - DNA, 927 bp, Glycine max
  Peptide Sequence Number=SeqID_195863
atgccattatgtatgagtatgacaggaggttcttttcctgcagtgaactcggtttctacgaatgtgccatttgcttcagctgaacgagctaaaatgtggttagttaaaccttcttctgggccatcttttgctcctgtgcaatctccatcttatcaagttcctattgcgactccaagaccacaacttcctcattatcaccatcgtcacaactgtgggaaaccttatgctgccgctccatccctttctaaagaccaagcttgtagccaaatctgtacagatccattaactgcaactccttttggttcaccttgtggttgtgtatttcccatgaaagtcagactagtactggatgcggctcctttggctgtttttccagtaattgatgagttagagattgaactcagttctggaacatatttgaagcagagccaggtgaggataatgggtgtcactgctgacagtcaaaatcagggaaaaaccacaattgatatttacttggttccacttggggaaaaatttgacaataccactgcagttctgttgtctaaacggttttggcacaacgaagttcctcttaataggagcctttttggtgattatgccatcttgtgtattacttatccaggtataccatcgcctcggccacctgaaaccttaactgggagaggtcacatgcccagggagagtattaatgttcttccaattactgcagacatgaacagcgagaatgagaaaatgaatcttagaacaataatcgtcattgctctatcttctgttgtactcttgttggttttggttggagcattttacatcattttgaaatggaggaaaattaggagaccatcaagtgctgttggccctgcattcacatcatgtctaaacaagagatctgatgcttatatagaattggtagaatttgtcatttga

SEQ ID NO: 79086 - DNA, 321 bp, Glycine max
  Peptide Sequence Number=SeqID_195864
atgaacagtgcgaaaacgaaggaagaaattaagagaagcgaatatatgatgatgatacctgagaaagagaaaaggagagcgaggaggaagatacgcgaagtcgacattgacatagcaagtgtgcgcaaaggcaaaaaaagcatccggcattgcagagagcacggtgatgacgcggaagcttctagatcccagaaatgcggagaagagaaaacatgcgagagaaaaaacacacaccgatatgtatatatatgcagaagaagaagaacaggaagtataacaaagcgagaaaaagagagagagagagaggaaaatggtggatga

SEQ ID NO: 79087 - DNA, 222 bp, Glycine max
  Peptide Sequence Number=SeqID_195865
atgtccaaaaattccctcaaggcctcacgagttaaggctgaggttgagtttatgatggagccggagatgctttggtcaaagctgagcaaacataccctgactgagttaaatatacaaggacaaatcgaagaggccctggacaaggttgagtcaaatatgccctttggtgaggccaaactgaagatgctttggactcagtcgaggcaaaaataccatggatga

SEQ ID NO: 79088 - DNA, 1254 bp, Glycine max
  Peptide Sequence Number=SeqID_195866
atgaagtgcctacgctccggggagtcgttgggaggagctgacgatgaagtgttgtttccttcgtcatctggatctcttgcaagtgcaatcaaggacttttcagctagtgaaaattcttgcctggctgaacagtttgataagaagccggacactggcaacatagaagaagctgaatcatccttacgtgagagtggcatcttgaactatgaggaagctagagctctgctaggaagatatgaatatcagaaagggaatatagtagctgctttgcatgtctttgagggaatagatataggtgttgtgactcctaagatcaaaatcgccctttcccgaagcagagaacgccgcaagagacattctcaaaatcatgctgaaccacaaatgtctatacattctgttggcttactattggaagctgtattcctaaaagcaaaatctttgcaggttcttgaaaggtttaaagaggctgcccaatcttgcaaagttattctggatatagtggagtcttcattgcctgaaggcatgcctgataactttggtgctgaatgtaaattgcaggagaccctcaacaaggcagttgagctgcttccagaattatggaaacttgctgattgtccacgtgaagctattttgtcttaccgacgagcactccttcatcattggaatcttgatgcagagactatagcaaagattcagaaagaattcgttgtttttcttctttatagtggaggagaagcaacaccccctaatctccgttcccaaatggatggctcatttgtgcctagaaacaacatagaagaggctatacttcttttaatgattttattaagaaaggtctctctgaatagaatcgagtgggatccttcaattttagaccacctttcatttgctctgtctgtttcaggcgatttgacagctttagccaatcaattggaagaattgcttcctgcgactatccatcgaagtgaaaggtactatgctctagctctttgttattatggagcaggtaaggacttggtagccctggatcttctcagaaagttgttgaggagtagagaggatcaacaccatgttcctggtttgttaatggcttctaagatttgttgtgagaactctactcttgcggaagaaggagtaagctttgctaagcgagtgcttcaaaacttggatggtagatgtaatcagctagaaaatcatgccaatttctttcttggtgtaacactttcaggcacattcgaaattggctgcttctga

SEQ ID NO: 79089 - DNA, 387 bp, Glycine max
  Peptide Sequence Number=SeqID_195867
atgttgctacttagcaacattctgcccaatgaccataatgttgatctccccctacggaagtatcagttgggatcgcacccacaagacacccagtggacccggtggagcccaacagggccctggggtttccagctctggttacgggcctctatcaatcctacagggtgcccgtcccccctagcaaggtcatgccatcgtgacataggtaaggatcacgcccgcaagacacccaatggacccggagaagtccaacagggtcttggggtttccaactctaattatgggcctttgtcagttctacggagtgcctgtcgcccccagcaaggtcatcaggcccttactaaccgagctttcatcaagaagtactgcgccccctgtcaggtgtag

SEQ ID NO: 79090 - DNA, 413 bp, Glycine max
  Peptide Sequence Number=SeqID_195868
atgacatcggcagaaatgcagttgagaagagaaaggggcctatgctttacttgtgatgacaagttttcccctagccatcgttgtcctaataagcaatattttgttctacagtgggaagaagaggatgaacctgcattacaaccagatccaccagacgaggttgagacagctggtgaccctagtttgcaagatcatcatttgtcttataatgctttaaaaggctcatcaggtcttggaacaatgaagtttcaaggatcaataaatggattgggagttttggtgggaaatggaaatgccttgactgctgaaggattaattctagacttggaggtgaaaatccaaggtcatacactgaagctaccagtgtacctacttccaatttctggtgctgatctagtgctcggggctgcatg

SEQ ID NO: 79091 - DNA, 1532 bp, Glycine max
  Peptide Sequence Number=SeqID_195869
ctgaggctgttgtgttgatgctggaatgtatacattttgctgatgtctctcataaacttgttaacgcccttaaaagaaccaactgtttaaagacgtatattggtttcgaaattcccagtgaatgtttcttgctggaccctgtatggggctgcatactaaatgtattcaatgatttcccggtgattgatcacaaattctatggagacaagatactcacttacaaaattgagttgaggaaaactggagtagtgattgattttgaggaggcaatcaaagcattcggccatactcgggttggtgattataggtcttccaaaaaatgcattctatttggtccagattgggaatctttctctgcaattactcgtctcccttttattggtgacagtgacaattgttatggcaagtttgtacatgagtacaaagaggagttaaagagtacgggagtaatcactgaaatcaaacatggtttgaattttgttactacttttcttaggttcccttcagatccatcctctataacccgtgagagtgtgttttcattgttggaatgcatccggtgtttgaataaaaatgattggaaaccagaaaataaagctaccaaaaggatttggattcctaaggcagttgataatggagagtgggttagtcctgaacaacgtgtcaatcatgacatgggtgatctttttggttcaagaagcatgccctcacttgatgattatattgagatatggaaggaatgggagagttctggggaacaactgtcacacgataaatgctgtaacttctgggcttatgttttgcaacatgaaagcaagaggacagtgaaaaacattgctgagagcttgacaaaactacccattacatcagggtctgatttaatcttattgttggacaaacgtgatgtttttgttgctgacaaccttcatttgcagaatctttttgagcaagagagagtatttgtctggtatcccgagtcaagcttagcatcactgccaaggtctgaattattagacttatacaagaaaattggtgtaagcattatatccgagtctgtgcttaaggaagaatcatccttactagatggtgttgaagtcaggcaagtggatccaagcaatattttcattggcaaggggttggttaaacttgtcctcagctttcttgcttgttctagcatcaaaatagaagcagagaagagacatgaagctgtccaaggtcttattgagcttactgtccatgagacgattgaacctgtcactgtttgctatagtttatctctatcatcagggaagaccattactaagaaatggagatataagcatgctaaaaatatgccacatatttctcaagcaatctctgcgggtgtattgcgtgagaatgttgacaatgttcttgcgctctctgagctgatcaagttaggcttcctggtgaagtttaatgaggaagcagttgatttcttgatggaatccaaggatttgcagattttcttagaagacgaggagttcctccgttctgccttcccatttgtctag

SEQ ID NO: 79092 - DNA, 893 bp, Glycine max
  Peptide Sequence Number=SeqID_195870
atgactgacgatggtagtcatgacagtgattatgatgttattggtggtggtgacagcgacaataacaatgacaacaatcatgttagtgatgatgaccaacggatatcagataaggttgctcctcattgcggtcttgggtatatagttcctgaatgggttgagcagaatccagcccttgaagacataaagcaaatatatcgagccggtgacgacactcttccaactacaacaattatcttacctctcaaatcagacaagcgcctttcaatcagggaagacaacgaggaccctaagcttagtaccttaggctctgtggctatttcaagtgagattaatttcatgacaaggaaaaacatcaatgcagagtcctacactctctgtctatccgaggaggagaataggaactctgaaaaggaatgtgactactacctgagcggcttcaaagggggaaaaccttacctgggggagactattatgttggatgataagtggaaccaagggatacttgactgtgttccatctgctttcatggaagcattcaaatcacttgttaaaggaatagataaagctcccctctctagtttggctaggatgttcctaggctatttgacaccccgtgaggttggtagcctgtgttcttctatccctcttgttgacaattatggacatgtagtcgagcgtagaactggggttcttgttcctgctagtgttagcaaatgggcagacttgactgtttctaatccatggagagatcaaacttctgatttaccttgtatatgtgctctggatgctgggatttctggtgtagacacgccactcactaaggaaaaagctttcctgctcttggattggattcgtgactggaagtatatgggaatgagtctacctgagaa

SEQ ID NO: 79093 - DNA, 495 bp, Glycine max
  Peptide Sequence Number=SeqID_195871
atggatgtttgcgtaaaagaagaagtgttggagactccgattgtcaccgagaggaggccaagaaccggcgtcgtttcggcgccccctccgggttcggttattgaactcagcgattccgacacggacgaagacgagggccatgatttggacagtgcagtcgccaacgcagtgaacggtgcttcttcttcggtagagagtccgtccaagaagcgaaggacgagcgaggctggaggagtggttttgccggttggattcctcacccctctccctccggctccggcgccgacacctcctcccactgcggtgctgtccttgccggcgccggaatgggcatctaattcgacggcatcgcgcgccaacgcgagtaagagtttgagtctgaatagctccaagcagttctggaaggccggggattacgatggtgctccgctcggaggctctggatcttcaacaggtgaagtagagattatttttggggagggaaaacctgcttga

SEQ ID NO: 79094 - DNA, 1230 bp, Glycine max
  Peptide Sequence Number=SeqID_195872
attgggcaagggacttatagcaatgtgtacaaagcaaaagaccttgtgagtgggaagatagtggctttgaagaaggttagatttgataatgtggaggcagagagtgtgaagttcatggctagagagattcttgttttgaggaggcttgatcaccctaatgttgtgaagcttgaggggttggttacttccagaatatcatcgagtctttacttggtatttgagtacatggagcatgatcttgctggtctttcagctgctgttggtgtcaaattctctgagccacaggtcaaatgctatatgaagcaattgctatctggccttgagcattgccacagcagaggtgttttgcaccgtgatattaagggttccaatctgcttattgacaatgaaggaatacttaaaattgcagattttggactggcaactttctttgatcctaagaaaaagcatcccatgactagtagagtcgtgaccctttggtaccgtccccctgagcttcttctggggtctacctcctatggtgttggcgttgacctttggagtgctggctgcattttggcagaactacttgctggaaagccaaccatgcctggccgaacagaggttgagcagctgcacaaaatatttaagttatgtggctctccatctgatgaatactggaagaaatatagattgccaaatgctacactctataagcctcagcaaccatataaaagaaacattttagaaacattcaaggattttccatcttcttcattacctctgattgaaactcttcttgcaatagatcctgatgatcgtggcactacctcggctgctctaaatagtgaattctttaccactgagccctatgcttgtgaaccatctaatttaccaaagtatcctcccaccaaagaattggatataaaactgagagatgaagaagcaagaaggcagaaagctctaagtggaaaaactaatgccgttgatggtgccagaagggttagagtacgcgagcgaggtttggccattccaggccctgaagccaatgtagagatccaaaataacgtagataggtggagagttgtgacccatgcaaatgcaaaaagtaagagtgagaaatttccacctcctcatcaggatggagctgttggatatccgctggatgattcaaacaaaagagctgtttcatttggagccactgaaacttcctctgcctctaccatatttgattcaaaatcttggggatcg

SEQ ID NO: 79095 - DNA, 159 bp, Glycine max
  Peptide Sequence Number=SeqID_195873
atgagatttgtagaagtgatcattggagactgtggaggattgtcggacggagggaaactgccggtgaaggcatcatgggaggtggttaaggggtgggttgctggaggggagggacttgtgaaagcaataatagggtgtggtaactgggaagcaaaataa

SEQ ID NO: 79096 - DNA, 174 bp, Glycine max
  Peptide Sequence Number=SeqID_195874
atgaggaaagaaagacttataaccaccaagcagtacaatcaagaacagaggcaacttataagttgcacatgggaaagaaaggcgaaagctaataagcaaagacctaattgtttcacaagcaatgggaaaatggccattttctcactgcaaatgccagaaacaaacaggctataa

SEQ ID NO: 79097 - DNA, 258 bp, Glycine max
  Peptide Sequence Number=SeqID_195875
atgacctcaacactcctctcaagctctgcactcccttgctttacgacaattgttggggaaggagaagacgacagaggaggagaggaggcccttgacaacgaggccaactttggcgtcgtcgtcgagggagaggtggcaaagatgtgtttgaggcaggttatgagggcgggagagttgaagaggcaacgtcggaagaggaagttggagtgggagaggtgcgtagagtttggagggaagaggaaaagaagggaattgtag

SEQ ID NO: 79098 - DNA, 537 bp, Glycine max
  Peptide Sequence Number=SeqID_195876
atggtgaagaagtttggaaaatttctcaaacgattcaaagacagaaaattctctaaaccttcaaagaagatagaaagcaacaacaacaacttcacatgcttcaaatgtgggaagcaagattcaatgaatgacttctcaaccattgaagaaactgaggtaaattcacaatttgaagaatttttggaagcatttaatgaaatgtgtgatgaagcccaaaggcttgctgtttcaaacaacaagctgagaagtgaacaaaacttcatatcactaaattggcttcaacacaaatggttgtgtttgtgcgcatctacttctcttaatatggatgattacaaatctttgcaaattgagtttgaaaagttccaaaaggatcactctgaagaatgtatgaagtttcaaactgagctttcctatcttaaagatttgcttagaaaattgaacaaaggaaagagtaatcttagtcacttcctgagtgtgcaaaagcacactaccgataagaccggtttggggatacaacaagcaaactaccttttctaa

SEQ ID NO: 79099 - DNA, 222 bp, Glycine max
  Peptide Sequence Number=SeqID_195877
atggagagcaaacgtcttataaagagatggaaattatatgatagtgattattacaactattgtaaccagcttggagacaaggatcagaagtacagtccaagtggaggagtgcaattcaattcacttgaccattccattccaaattctaaacaagattcaaacagatttgttatccggtcatccatcttgtgtgaaatattgcttgattataataaaggctag

SEQ ID NO: 79100 - DNA, 168 bp, Glycine max
  Peptide Sequence Number=SeqID_195878
atgaaggtcaaactagtaaagttgattgacattaccaacgaagggaaggacagtccaaataggaagctaggttcggataagaacacaaagaaaaatgaacaagatgttgcattaattgcggcaaattctatctgtccaagaatccgcaagaatcccgtgagtgggtaa

SEQ ID NO: 79101 - DNA, 213 bp, Glycine max
  Peptide Sequence Number=SeqID_195879
atggtagccataacccctgctaggtttcctcaacctccatttttccgagggtacgactcgaacacaatgtgtgcttatcatggaggagccccggggcattccattgagcattgtatgaccctgaagcgtaagcgacctgcgctcttgagtgttaacttccaagaccgttcaatcagagattgctcgtcctgcacgttggtgggggtgccgtaa

SEQ ID NO: 79102 - DNA, 642 bp, Glycine max
  Peptide Sequence Number=SeqID_195880
atgggcaccagcatgaccaccttgacccagatgtggatgacattgcttctcagcaatgtcttgcctagtgatcataactctgatctccatctaccgaagtgtatgccaaccaccaggcaccctctagacccggataagtctaacagggccctggggtttctggcattgatcacgggcctctgccagtcgttcggggttctcgtcactactagtaaggtgatccgaacgccaatcgcccaggccttcattgagaagtattgcacgcctaggcaggcacagggtgatgcacctcaggccgcagacgcaccgctaccacctcatcaggctgatcccgctgggtcactaggcatggagcgttatctacagcacttggttcgccagcaggcggccaaccaccgggggcagttgcagatacatgagtgtctctaccagctcagcctcagtcagcaggggcagggtttcgctccttttgcatgccctactccagagaattttagggctgaagttgcatggcccagagattggcccaaggcccaggcaggggaggcgcctgcaggatcccccgacgatgcagaggagacccatatggatgaagagatgatggacttgatcggtttcttgggaggaagtggagccacgtga

SEQ ID NO: 79103 - DNA, 276 bp, Glycine max
  Peptide Sequence Number=SeqID_195881
atgtccggcaacaaggtgaagggcattcttaaaggctttagatacctaactcaaatatttgagaatgaaaaagaacaagaaatacagattggatttcccacggatgtagagcacgtggctcacatagggtctatgcgggatgaatcctctgtaaacttacccagctggatgaaagagtttaaaactgctccaggattttcatcagtacctctagatgttcaaaataaaggacagcacagtgccaaatgggtctctgaagttgttttagattggtaa

SEQ ID NO: 79104 - DNA, 507 bp, Glycine max
  Peptide Sequence Number=SeqID_195882
atggagcatgtgattggtggcaagtttaaattgggaaggaaaattggtagtgggtcttttggggagctctatttagctgtcaatgtacaaactggagaggaggtggctgttaagctgttcctaacaatcccatcttgttctgccaaacaattccaggaacctgtgaagaccaggcatccacagcttcactatgagtcaaaactgtatatgcttcttcaaggaggaacggggattccccacctcaagtggtttggagttgagggagactacaatgtcatggttatcgaccttcttggaccaagtctggaagatttattcaattattgtaatcggaagttcacattgaagacagtgttaatgcttgcggatcaattgattaacagagttgaatataggcattcaagaggtttccttcaccgtgacataaagccggacaattttctaaggggtctaggacgaaaggcaaatcaaagtgaaacagaaagaaagggagctccaaagatgtaa

SEQ ID NO: 79105 - DNA, 171 bp, Glycine max
  Peptide Sequence Number=SeqID_195883
atgggcattctgctcgaaagggtgatgggtcgaacctcaagtactttatctcctagacacaggcactttactgcccagactttaagctgcaaaggtcagatagcgtgtgctagagataaaacctttcatggtcaacttttgggaaaccatgttatgcagttgagaaaataa

SEQ ID NO: 79106 - DNA, 726 bp, Glycine max
  Peptide Sequence Number=SeqID_195884
atgatgagtctcgagagagatgtccaagagtctcgattttcttctatagatttctctaaaaagctgcaagatgcagtattcgatgttcagaatgagatagcacaacatctgcagaatttgaaagtttctaactttagaatgattcctgttaagagggaatttgcatttgaacgatctgaaattcctgcagattctaaaccttgttcagaccaaaaaaatgcaaggcataagataatcgttggagtgggatttggagttacagctctatgccttgtctttataatagttggaatcttttggtggaagggctacttcaaacgaataattaggacaataaaaggtactgaaagacaagattcacagaaggggatatttacgttaaaacaaattagagatgccacatatgatttcactccagataatatgattggagaaggtggttttggtcatgtctacaagggtcaattatctgatggaacattgatagcagtcaaacaactctcatcaaagtcacggcagggaaatcgtgaattcttaaatgagataggcatgatatcttgtttgcatcaccttaatcttgtgaaacttcatggatgttgcatggaaagggatcaattgatattggtgtatgagtacatggaaagtaatagtttggctcgtgctttattcagtgagtttctacccaaagtgcaaactattgtatttgtcttttaccttgtcatctaa

SEQ ID NO: 79107 - DNA, 447 bp, Glycine max
  Peptide Sequence Number=SeqID_195885
atgacgaatggcaaaaatcgttgttcaagagaacatggtgacagtgttgtaattaagttcattgacaacaaagatgattttcaaataattgttttcgaattagcctctgcttgtgcgagacacgctcgaactccttgccgtgtaaggtcacatgcgcgaggtatggcgaagtgtgaagctacacctctccttgagcgagtcctgtgcagtctccacgtggtgcgtccatgcgacgcggtggccacggaaggggtgttgtttgacgcaacaatgaaggagatgcggtttgattacgacaagcgggagagagttaatcagtggcatgcagttgggggcgtggttcgtggcattgaggtaaaggtgtgtgtagtggtaaaggtcgttgaggttgacacctcagtagccgctgaacttaggaatctcaaaatacgaatacggagaaagtag

SEQ ID NO: 79108 - DNA, 456 bp, Glycine max
  Peptide Sequence Number=SeqID_195886
atggtggaaagaaaagataaggagcttaggggaagtagtaatggtgtcatcagtggctatcataaatggttgaaggctcggacgcaagggataacttggctcccgaagctaaagagtccaagtggaggagaagctgaagtccttgaggagagcgaagaagtgcaagccttgaaagtagagcttgaaagaatgagagtggtcaaggaaaagctaaagatgacagtcaccagggtcaggaaagagtgtgacgagctaagggatatcaacatgactacgaccaaagggctctatggggcaacaacaacgagcttaagctttgaagggccgaaagggacgagtcaagggacagaagagaatatgttgacaatcattgaccagtataaagagaagctaaacctagctgttagccatgggcagagactagagaatgagcatgaaaaggtatcggctcagtaa

SEQ ID NO: 79109 - DNA, 891 bp, Glycine max
  Peptide Sequence Number=SeqID_195887
atggctttgaagaagcttccaaccaagaggtccaggaaagatgccgttggagggggttctagtgcggccccacaggactttgcccggagcataacggggagacaggtgcggatcatggacaccagcatgaccaccctcaagcagatttggatgacattgctactcagcaacgttctccctagcgacaatacctcagaactccccctgccgaagtgtcaactggtctacgccatcctgactcaggtgagtgtacatgttgcccagctaatatcagatgctatgtaccattttgtagaggtagcgcctcctagacacccagtggacctagagaagtctaacaaggccctggggtttcttgctttgatcacaggcctatgccaattctatggagtgtcggtcaaccccaccaagcttataaggcctcccatcagcagagccttcattgagaagtactgcatgcccaggataaagctccaaatgcacacatacatgcagcatgtgactagccaacaggtggttaatcataggggccaggaccccaatcctttcccttggcctacccccgagcagttcggggccacagttgcatggctcagagatgaggccaattttgagacacgggcaggatctacaggggccctgggaaggacggaggagcttaggcggatgaagatatggatgacatgctggatttcttcacttaaggaggcagagctgcacgggcctctcggatgggccaagggtgtgtcttctgttgaaggaaaacgcatggaatcgccaccaacgtttattcgaggaaaacatcagaaaaaccaaaatggaagaggtcgaaagtttgcatattttgaaaatgagggttcgagagttgtttacacacggggaaggtattag

SEQ ID NO: 79110 - DNA, 516 bp, Glycine max
  Peptide Sequence Number=SeqID_195888
atggcagctttttcatcccaatactaccattcctttgtggttgactccgcatgcttctcaattactcctcccattataaacacttctagtaactttcttccttctcctcattatcttcacaataataatattcaggaaacgtcttatagtgtcactgataataaggaaacaagctgttttgaacaaagctccaaggttaccatcagtgacattgaactttctgtggtaaaaaaccatagtcctgagacttccatggtagtggacaagcttgaaaaaggtgaacaggtcactcagaaggtggtgacccgcatggagaagaagagaagagcaagaaatggatcttcctcgagtgaccctttatcaaaggagtcaacagaagggggaaagaagaaacaaaagaagccaaaagaagtgacgaaggacaagaaaataggtgctgaagatcctccaactgggtatatccacgttagagcaagaaggggtcaagcaaccgatagccacagccttgctgaaagg

SEQ ID NO: 79111 - DNA, 165 bp, Glycine max
  Peptide Sequence Number=SeqID_195889
atgggtgacgatgaagccatcacatcacggcttgtgttcttagaggcagtgaagaagcgaagatatgtggcaatgatggggtgggatggttggagacttggaagggagaagagagatggtgataaggtgtcagatcctatttggagggcattgtctctagattga

SEQ ID NO: 79112 - DNA, 315 bp, Glycine max
  Peptide Sequence Number=SeqID_195890
atgaaactcaagaaagtgaaattgcaaatgttcactgtttacttgaagtgttcaaactctctagccagatatcacgtactgcagaaacgggagaaaattttacattttctcaattacaaaatctcaaatgacggcaatggctttggtggtggcgaaaacagttgcagtgacggcagtgggagtgatagtgacagcggtagtggcgattgccacaatagtggcaatgacaacaacaggagtggtggtggtggcagcagtggcaggggtggcgatgacaatgacaaaagtggtggtggcaatggggagagggagtaa

SEQ ID NO: 79113 - DNA, 2931 bp, Glycine max
  Peptide Sequence Number=SeqID_195891
atgatcaccggagaagaaggaatgaatgaatctggagagatccctctagcattcagtgtagagtccatcaccgtcactaataataaagttcctcagctcagctggcatggcaaaggccaagagagggaattggaactcgaaagtgacgagtctcaggctgagattgaagccccattgcctctcactgtgacttctcgggttttgtatatgttgggagatatcactgcagggcctgcgtttaggttcacgcaatggctccaattggttcgtaaacgcaccgcaaagtatcgttcttctggcttccctcaccgcacttccaccaccatgccttctagctcttgcatcagagaatcgttggagaattcaaaattggacctgcatcctgatcagacagaaattagcttgtgggagaggcttgggaaggctgcaatgttggacattgaatctggctccttttcctgggacatgctctcttcactgcaccacactgaacacagcagtagcaatgaacattccgaggatgagatgaacaaagctctcgaggttcatcgcattctacaattgttctgtacaagtacaagcattacttccatagcaatcagggttgatgttttagtgcaacttgtaactgtaaattctggaggagttgtcttctttgcctttttcaatatctctggaaatgctgatgcttgcccaaaagaagcagcagctgttataaagatagcatcatcaagaatggcaacacagtctgaacgccttggctatgaatttgccaagtggatgggagtccaaactccacagggtagagtcattcacaatacctgtttagaatggcaacaaataaaggaggctgcagaaaaagctagagaagcagcaaattctgagggtgatgaaattggtgaagtgacatgttttgaacttttggaagcacttgagcttagccgatgtctattttttatgagttatgtacatggttcacccttgcttgaaaattccagtgcatttgagtcaagggaatctgcagaaagaacatcagaagctcttggcagggtactgatgttggaccttgtcatcagaaacgaagatagacttccttgccatgagcttaaatggcgaggaaatcctgcaaatttgttgttggctggaaagaatatctgtgcaaatacagatgcactagaatcagcttttgattctgcagttaaccgatatagaccaaaggtgatcagggcatttcagaaagaaagaaggtcaacttcagtagattgcagactcaattctcataatcccggcttgatatcacaatcttatgatctctcagacatcacagaatcaccaagatctgctgacatgagctttcaaacatcaggagaatcactgtctcccgactttaacattgtagctattgattctggtgttccttggcgacctcctgctggaaaacgtgcaaatgatcaggttaattatcctaagttggttgagttgctggtcaatagttctgaatttgcctctaacctgttatatgatataactggggggaaattaggatgtcccccaccggaagacatggaaaaaacttatgtacatacaagtgacacaatgtttgtagttcacgcattccgtaatggtttccgtgctgctcttagagatctgcagggattccatatattcctactcacacttcaccaaagacttgatactttgttacgatcatttatgaacattattagcaaaatatctttgggggaatttgacaaagaagattctgtggttcctgactcactttcactgactgctggcgggagttgttcctctccaacatgtaaggaaaggcttgctaatgataaccatcaagattttattgattcagaatcacagagaactgcttcaagagcttcatcttcaggcaatagagattgcagtgactctactcctatgtcaagagaaacttggcatggaaagttctataaaggaaatggggaaccacttcgtagtctccgtttgactgctaagctccgtgacttccataaatttgccaaggttgatgctgaatccagtaaagaattggaacagtggaatgaaatgcttaaaagcgatgccatcaaactatgccaggagaacaatttcaacccaggattttttgagggtagtgataataactgtgtcgttgatgcatatgaacttaaggttagacttgagcatattctcgagagaattgcattgatatcagatgctgcaagtactgagaaaccttcagcagtgacaagtagtctgttcattggtggagcactggctgcaagatctgtatacacactgcaatacttgggaatcacaaatattttgtgtttgtgtaccaatgaaattggacagtcagaaactcagtatcctgatctatttgagtacaagaatttctctgtatgtgacagtgatgattataacatcagcagcatatttgaagaagcgtgtgatcttatagactttgttgaacaaacaggtcaaaaagttttagttcattgctttgaggggagaagcagaagtgtcacgttggtcctcgcttacttaatgctcaggaagaagtatactttatcacaagcatggcaagctttgaaacgagttcaccgtcgagcacaacccaatgatggttttgcaaagatcttgttagaactggatcagaaactacatggaaaggtttcgatggaatggcatcagcggaaaccagtgatgaaagtctgccccatatgtgggaataatgctggactaagcagcagctcactcaaactacatctgcagaaatcacatagaaagctatcatctgggagtgtagatagtgccatgactatggaaatccagaaagcattaacagctttgaagattagccgtggtgggagtgtcagccccacacaaagatcatctcatccactgatagatcaatag

SEQ ID NO: 79114 - DNA, 1080 bp, Glycine max
  Peptide Sequence Number=SeqID_195892
atggctccctccgaccaatctcatcattctcttgtccctggattcctgtactcatcaaaaacactgtcccatttgaataataacaccaatcatgggttgccaccatcatcctccattgcatcatcatcattgccacaaggtcggacaaagagtcctatgatcctttcacccaaagagggaatccgcatgttttctcctgcttactatgctgcatgcagtgccggtggcatcttcagctgtggccttacccacatggctgtcactcctctcgatcttgtcaagtgcaacatgcagattgatcctgtaaagtacaagaacatcacatcaggatttggagtgttactgaaggagcagggcgctaaaggtttcttcaagggatgggttcctactctgctaggctacagtgctcaaggagcatgcaagtttgggttttatgagttcttcaagaagtactactcagaccttgcaggacccgagaatgcaatcaagtacaaaacgatcatatatctagctggttctgcttcggcagaagttattgctgatgttgccctttgccccatggaggctgtcaaagttcgtgtacaaactcagcctggctttgctcgaggtttgtcagatggattacccaagtttatcaaggctgatggtgtttctgggttgtataaagggcttgtccctctttggggccgtcaaattccatacacgatgatgaaatttgcttcctttgagactattgtggagaagatttacaaatatgcgatcccaacccccaaggagcagtgcagcaaaactaagcagcttggagtgagttttgcagctggatacatagcaggcgtactgtgtgcaattgtctcacaccctgctgacaacctcgtttcttttctcaacaatgcaaagggagccactgttggtgatgctgtgaagaagattggagtagtaggtctttttactcgtggccttccacttcgtatagttatgattggaacactaacaggagcccaatggggactctatgattcatttaaagtatttgtagggctgcctactactggaggaagtgctcctgctcctgttaggtag

SEQ ID NO: 79115 - DNA, 228 bp, Glycine max
  Peptide Sequence Number=SeqID_195893
atgagcagtggtggaagggctgtgaagcccaaagaggaggagcaagatggcatgtctgtccactctccttgcaaacctcctccttcctctgcttcctctctccccaaggagcagtcacaggttgaattggagctgagattgttggaagctcttgagatttaccctccaatgaaactacaaggtattttaatagacacatgcttgcacacatacacacataattcttga

SEQ ID NO: 79116 - DNA, 2820 bp, Glycine max
  Peptide Sequence Number=SeqID_195894
atggctagggttttagttcagtctactggtatgcctggcctactgagtgggcaaaggcacgggaagcataagggatcaggaaaatcgaaaagatctgtcaaaatgatgagcaccttacgaatgcctgctttaagaatgtcgagtttctccggattacgtactcttaatcctatggattctctgtcgagaccacgccacacttttccgttgaatacaacttctaggcgcgagagggctaaaagatgtgtacctaaagctatgtttgagcgtttcacagagaaggcaatcaaagtcattatgctagcccaggaggaagcaagacgactggggcacaattttgttggaacggaacagattctattgggtcttattggcgaaggaaccggcattgctgctaaggttctgaagtcaatgggaattaatcttaaagatgctcgggttgaagtggagaaaattattggaaggggtagtggatttgttgccgttgagattccgtttactccccgggcaaagcgtgttttggaattctcactggaggaagctcgccaacttggtcataattatattggatctgagcacttgcttcttggtctccttcgagagggtgagggtgtagcagcacgtgttatccgcatggttggtgagggtgctgacagtgttggtgctactgttggccctggaagtagtaataacaataagatgccaactttggaggagtatggcacgaatttgaccaagctagcggaagagggaaaattggatcctgttgtgggtaggcagcaacaaattgaacgtgtcactcaaattttgggtcgtcgtaccaaaaataatccttgtcttattggggaacctggggttggcaagacagctattgctgaaggtcttgcccaaaggattgcaaatggtgatgttcctgaaaccatagagggaaagaaggttataacccttgatatgggtctactggtggctggaactaaatatcgtggagaatttgaggagagattgaagaaactaatggaggaaatcaaacaaagtgatgagataatactttttattgatgaagtgcacactctaattggagctggagcagctgagggggcaattgatgctgcaaacatattaaaaccagctcttgccagaggtgaactgcagggggtgggagaaagaattgagtttgtattgctcttgaactttgtcattgaaactaaaaagcaaaaggataaaaaacttgttctcttctgtgttgttgccttggtgtgtataggagccacgacactagatgaatataggaagcacattgaaaaggatccagctctggagaggcgattccagccagttaaagtgccagagccaactgtcgatgaaaccatacaaatactgaaaggacttagagaacgctatgaaattcaccacaagctccgttatacagatgatgctctcgtagccgctgctcagctgtcacaccaatatattagtgatcgatttttgcccgacaaagctatagatttaattgatgaagcaggttctcgagtccggcttcaacatgcccagttacctgaagaagcaagagagcttgacaaggaggtcaggcagattgtgaaggagaaagaagaatttgttcgcaatcaagactttgaaaaggctggagagctaagagacagagaaatggatcttaaggcccagatatctgcacttatagaaaaaggcaaggagatgagtaaggcagaaagcgaggcaggagatgaaggtcccatggtgactgaagttgacatacaacatattgtctcctcctggactggtattcctgtggagaaagtctcaactgatgaatctgatcgtctcctcaagatggaagagactttacacaagcgagtcataggtcaggatgaagcagtgaaagccataagcagggccatccgtcgagccagggttggactgaagaaccctaaccgtccaattgccagcttcatcttttctgggccaactggtgtggggaagtctgagttggccaaagcattggctgcatactactttggttctgaagaagccatgattcggcttgacatgagtgaattcatggaaaggcacacagtctccaaactcattggttcacctcctggatacgttggttacactgagggtggtcaactgaccgaggcagttcggcgtcgtccctacactgttgtactctttgatgagattgagaaagcccatcctgatgtattcaacatgatgcttcagatcctggaagatggaagattaacagacagcaaaggaagaactgtggacttcaagaacacgcttcttataatgacatcaaatgttggaagcagtgtgattgagaaaggaggccgtaaaataggatttgaccttgattatgatgagaaggatagcagttacaaccgaatcaagagcttggtgactgaggaactgaagcaatacttcaggccagagttcttgaataggttggatgaaatgattgtcttccggcaactcacaaaattggaggtaaaggagatagcagacataatgttgaaggaggtgtttgatagactgaaagccaaggaaattgatctctcagtaacagaaagatttagggagagggtggttgacgaaggatataatccgagttatggggctaggcctctaagaagagctataatgcgacttttggaggacagcatggctgagaagatgcttgctagagagattaaagagggtgactcagttatagttgatgctgactccgatggtaatgtgattgtgctcaacggtagtagtggtgccccagattcattagaagaagctcttcctgtgtaa

SEQ ID NO: 79117 - DNA, 561 bp, Glycine max
  Peptide Sequence Number=SeqID_195895
atggcctctgtttcagccacttctctcaggttccaaccctttctcaagttgtctacaaggactactacccagagaaatcaattcaaatttccaaatattaatacaagtgagaaaaaatttagaaggtgtagtgaaatgtatcatgatttggagggtcggtccaatggttggaaaagggtgacgaaagaagggagggatcaggggtgttacaaaacttcaagtttgggggcagtttctgtgggatggaataggagaacctttccctctttgagatcctcccgtttacgcatttgtgcagtcaaggcacaaccggagacagtgcagaaggtctgcgatattgtgaggaaacaacttgctctgcctgctgaatctgagcttaccccagacaccaaattttcagcacttggtgctgattcccttgacacggtggaaatagtgatgggtttagaggaagagtttggcataactgttgaggaggatggctctcaaaacatctcaaccgttcaagaagcagctgatttaatagagaaactgattcaagacaaaagtggagctagttag

SEQ ID NO: 79118 - DNA, 1593 bp, Glycine max
  Peptide Sequence Number=SeqID_195896
atgaaggggacacgtaagagaatccatgaagattctggtttgaacatgttgcatagcttcaaaaagaaggatcttacagataatggtggtggaatggatcctgaaaaaatgcgtcaatgcatgtcgctggggtattccgtgaaaagcaaaatggcaaatacaattgggcaatatggaaatggctttaagacaagtaccatgagactcggggctgatgtaattgtattctcccgctatcctgggaaagatatgaaaagctcttcacaaagcatagggttgctgtcttacacatttttgaggagtactgggaaggaagacattgtagtacccatgctggactatgaaagaagaggacaggaatggaataagataatacgaacttctctggatgattgggataaaaatgttgaaacaatagtacagtggtcaccattttctaatgaggctgatcttcttcgtcagttcaacttggtgaaagatcatggtacacgagtaattatatacaatctttgggaagatgaccaaggtcagctggaacttgatttcgacgaagacccacatgatatccaaataagaggtgtaaatcgagatgagaaaaacatacagatggctaaagagtttcctaattctagacatttcttgacctatcgacattcactaaggagttatgcctctattttatatctgagacttcctcctggcttccgaattattcttcgtgggaaagatattttgcatcacaacatagtgaatgatatgatgatgtctcaagaggtgacctacaggcctcaagctggagttgatgggcttcttccgaaggattcaaatatggttgccgttgttactattggatttgtcaaggatgcagtacaccatattgatgtttcaggttttaatgtttatcataagaaccgactcattaagccattctggaggatctggaatccagctggaagtggagggcgtggggtcataggtgtgttggaagccaattttgttgaacctgctcatgataagcagggctttgagcgtacattagttttatccagactggagtctaaattgatacaaatgcagaaaaaatactggagcactaactgctataaaattggttatgcttccaatcgaagtaaaatacaaatcagagattctgctgataaagaggcatctgccgattattttcctgaatcatcacaatcaaaaaggaaatattctaccacggatggcaaggctccaccgttgacatcagacaaattgcattcatattcgaatcagaaacggatacaaaaacaaacagaaaaatatagggtatatattaatggtcaatcttcagtctctcctaaacggaaagtgcaaagttcatctgagcaatcatcatccgatgacgaagtcagtgaagtcttgcctaagaaaaaaactcaaaagctatctacagccgaaaaatcatttgaaaatgagaatggatgttttcaacataccacatcaaggggaaaaacctcacagtacacacgaggatccaagctagagtcaatagcggatagcagaaagaaacagccaccccttgaaaatgctatagctggattactgacttag

SEQ ID NO: 79119 - DNA, 297 bp, Glycine max
  Peptide Sequence Number=SeqID_195897
atggatcatgtcagagttcaccccaagtttttacactctaatgccacaagtcataagtgggctcttggagctttggctgagcttttggacaattcattggatgaggtctgtagtggggccacatatgttaatgtagatatgcttacaaataagaaagatggcactaggatgttgctgattgaagaaggaagtggaggatctactttaagtgctgtgattctatcatttatcccgctatttgtggaagctatcccaccacacaatagtttctccatcaaaatgcagagcaaaccttag

SEQ ID NO: 79120 - DNA, 822 bp, Glycine max
  Peptide Sequence Number=SeqID_195898
atgagaaaagcttccagaaagtgtaacagttatctggtggggctgaaatcattggttatcaattttctaggccctgatctgaaagtacaacgttctcatgtacccaaatttggcaattgggatagtggagagaatgttccttatacagcatattttgacaaggcacggaaaggtcgaactggcacaaggataataaatccaaatgaccccgaggaaaatgctgatttaagttttgataatccatcatctgataacctacctcctaccagacctagaactaattcagaggatcaatccggaaaaggatcactgcatttggaagatgatcccaagaattttatcgaatctccagctcgtcatgacaatgtaagcagtaggagtggcagtagaagccatggagtaggttctgctgataaccgtagaagacattcaacgcaaagtactgggtctgagtacagcattgaacgttcaccgcttcatcgccaggctagagccccaggcagagacagtccccagtgggaaccaaagaattcatatgacagcagtcagggaacaccaggaaggtctcggttaagaccggctaatcgaggagatgaaacaccagataaaggtgcagctgttccaaagtttggtgactgggatgtgaataaccctgcatcagcagatggctttactcacattttcaacaaagtgagggaggagagacaaggcgggccaggacaagtgccaggaacgcctaatgagagaccacaacctattaatggcctatctaatgatgacaaagtccagtgttgctgctttgcgtggggtgggaaaaaatga

SEQ ID NO: 79121 - DNA, 161 bp, Glycine max
  Peptide Sequence Number=SeqID_195899
atggcagaatcgtcgaagaagggaaagggaacgtcctccaccaccactgctactggccatcgccgccatggaccatctgaagcacccacaacaccaattcatccttccttatcatctccacgatcatctactctattttctttagatgatcaacgtctacg

SEQ ID NO: 79122 - DNA, 414 bp, Glycine max
  Peptide Sequence Number=SeqID_195900
atggaagagattagtgcaaggaacggtggaaacagctcaaaagccaatagcaccgtcaccggcagcggcgtggatcaaaagggcaagaagaagacaggaatacctgcaaagaatttgatggctgaacgccgtcgaaggaagaaactcaatgatagactctacatgctgagatccgttgttcccaatattagcaaaatggacagggcttcaatccttggggatgcaatcgagtatttgaaggaacttctgcaaaggatcagtgagcttcacaatgaattggagtcaacaccagcaggtggctcttcaagctttcttcatcatcctttgacacccactactctaccagcccgtatgcaagaagaactttgtctcagctcgttgccaagccctaatggccatcctgctaatgctagg

SEQ ID NO: 79123 - DNA, 876 bp, Glycine max
  Peptide Sequence Number=SeqID_195901
atggagacttattcactattccactgtacatatactgggaaggaagacccagttaaggagatttttccagaggtgtcgcaatgggtatcgggtgcatcagattacactataggaaatgcatctgcatctgattatgtggaccttgaatcaactgaaacatggcttgcggattactttaatgatgctgtgatggatttcagtcctgaggaattgaatttttcagtggcagacggtgttcaaattgatgatggtacagaggttagtgccatcacaccatcacatgaacaaaatgtggttcaacaaacgcatgtccctcgaaccacttgtaatattatcttcaaaggccaatgtgggttggcacaagtggtcaaggatccagagttaattctcatcctttccatggacgtgcatttgatttcctctaatgccactgaaatcctgttgggttggataaccatcatcacccttagcacccaagggctagcggatctcaacattgccaatggcaccctgcctggtagtattgggggtgtctccccattctaccacatattttattccaaaaaaacgcatgtatacagtaatgctccgagaagatgtaggaaatcttttatacatatgccgacgaagttggcttcttctgtggcctatccatttgccttcattaaaccaagtggtgctcatggagatgtaactctgaaggaaataaatcagcgcattcaaacaccatctccttcgaaatcaaaccaaagcattgatgatgatccatctgcttaccccaagtcagccttctctgggaagcctgtggttggtaaaacaaaaattcgcactgaaggtggaaaaggtagcataacaattaccagaactaaaggttag

SEQ ID NO: 79124 - DNA, 444 bp, Glycine max
  Peptide Sequence Number=SeqID_195902
atgttggctactggtaatcgattactgccttctgaatttagtgatcttgcaaaaggatcaatgctccttggaaacaacaagcctggaaagattgctggaattggatctataaggttcaggttacatgatggggttgaaaggctccttcctaaagtaaggtatgtactagaccttaaaagaaatttaatctctcttggcgagtattataaaaaaggatatgtgttcaagggtgaaaaaggaatgttggaagtagcgaaaggatctatggttgtcatgaggggaattaagaaaaatggcatctactccttagaaagtgacatagtaattggctctacatctgttgtatctaagaaattggtgtctaagattgagccatggcacatgaggctaggccatttaagtgagagagggttaattgatcttggtaaacaaaatctactatga

SEQ ID NO: 79125 - DNA, 195 bp, Glycine max
  Peptide Sequence Number=SeqID_195903
caatgcagcaccagaaccactgtcggagggggtgacttaaccagagtggtcaaaacagcgtgcaatgatttcaaccgcggtcaattcttaaccactcttagcaaccggctacacccggtgggcatcttttcccagccagggaaacgcaaacaaagcgatccccttggcggctcctcgtacactgaaaggtgttag

SEQ ID NO: 79126 - DNA, 531 bp, Glycine max
  Peptide Sequence Number=SeqID_195904
atggaagtacaattccattgtactatttcaatggaatcatatttccgttattacttcaatgatggtggtgtgtgccctggatgtagttacaaaggtggttttgtggcagagcagtggtggctgcatcatggtagagggggttgtgagcgcatgggaaaggaaaggagaaagagggtggcacgcatagggaaggggaagggtaatgagggtcgcattcgtagggaaaggggaaggggaaaaaggtggcatgcgcggggaatggaaaggggaaggaaggttaagtgcccgacgcaggggaaaagggagaagggttggtggcataggggaaggggaaaggggaaaaaggaaggtttgcacggagggaggccaatagtagttcttggaagtcaaagggaccaacctagtgagtcattatacaatacaattgaaaatatggagtttgggccaggaaaggagatgcacgtgggcctagacagtaaggctcatgaagtcaataataataataagaagaaagttgttattggcccttaa

SEQ ID NO: 79127 - DNA, 1080 bp, Glycine max
  Peptide Sequence Number=SeqID_195905
atggagtgtgcagtggcaatctcagttgacaacctaggtgaggctcataggatgttactagagctaacacaagtgtcctcaccctacaaagcatcatgtgctgaacgtgttgttgcttattttgcgaaggccatgactagcagggtgatgaattcatggcttggagtgtgttcccctttggttgatcacaaaagcataaactcatcattccaagtgttcaacaacatctcccctttcatcaaatttgctcacttcacttcgaaccaagcaattctagaagcagtgagccattgtgacagcatccacataattgacttggacatcatgcaagggcttcaatggccagcttttttccacatcttagccacaagaatggagggtaaaccacaggtaacaatgacaggttttggagcctcaatggaactccttgttgaaacaggaaaacagctcacaaactttgcaagaaggcttggcatgtcactgaaattcctccctattgcaacaaagattggtgaagtaattgatgtgtccacgcttcatgtgaagcctggtgaggcagtggcagtgcactggcttcagcattcactgtatgatgcaactggacctgattggaaaacattgaggctccttgaggagttggagccaagaatcatcaccttggtggagcaagatgtgaaccatggaggaggagggtctttcttagaccgttttgttgcttccttgcactactactccaccctctttgattcccttggagcatacttgcacaatgatgatgaaaaccggcaccgtgtcgagcatggccttctctccagagagatcaacaatgtgttgggcataggaggacctaagaggagtgaagacaagtttaggcagtggaggaatgagcttgctaggcactgttttgtgaagcaggttccaatgagtgccaattcaatggctcaagcacaattgatattgaacatgttttcacctgcttatgggtatagccttgcacaagttgagggaactttaaggcttggatggaaggatactagcttgtacacagcttctgcatggacctgcagtaattctagctag

SEQ ID NO: 79128 - DNA, 1326 bp, Glycine max
  Peptide Sequence Number=SeqID_195906
atggcccccaccctcacctcatctttcacacaaccgtatcgcttctcacaacatcgacgctccacgtacctactcctccaatctcagccgtccacgtctccctcactagaatccaacccactgttctttccttcgttacatgcaaaaacgactatgaagacgccaaaacgccaatcgtcgccggcaaacgctgctcgaccagtggagtctgattccggcgagatcgtcacgaggttcaagaacggtggccggagaaggatcaaaatcaagcgaatgaagtacacttgccagacgaagatccgcgtcaggaatgacgccggcgctggcggcgtgtctcaaccgccggcggtggattctgaaggagagaagagagagattgacgagcacgtggagatatcgctgtcgctggcttcctcgtcgtcggaagaggaagagcgattgtcgtcgaagcaaagcgacggcgttttgtcgtacggttcggcgtcggtgatagggagcaggacggagatggaggacgcggtgagctcggagatagggtttgcagcgaagtgcgacttctttgcggtgtacgacggccacggcggagctcacgtggcggaggcgtgcaaggagaggctgcaccggctggtggcggaggaagtggtggggagtagtgagagtcacgtggaatgggactggcggggagtgatggaagggtgttttcggaaaatggacagcgaggtcgccggtaacgcggccgtcaggatggtgggttccacagcggttgtcgccgtcgtggcggtggaggaggttatcgttgctaattgcggtgattctagggccgtgttgggaagaggaggtgaggccgtggacttgtctagtgatcataagcaaaaattgttgctggcagtgaatgtctggactttggggccccacaggcccgatgagttgatgagaatcgaagaggctggtggaagggtcattaactggaatggccagcgcgtgcttggtgttcttgccacttcacgatccataggagatcagtaccttagaccttatgtaatatcaaaaccagaagtgacagtgacccagcgaagcagcaaggatgaatttctcatactagcaagtgatggattgtgggatgtgatgtcaagtgaagttgcgtgccaagttgtaaggaaatgcttccaggggcagattaggagagtgtgcgatggagttgggaatcatcaaaaccgtgctaccgaggctgcagacctcttggctgagatagcattggcaaagggaagtagagataacaccagtgtcattgtagttgagctaagaggaacagtaacaactgattga

SEQ ID NO: 79129 - DNA, 1320 bp, Glycine max
  Peptide Sequence Number=SeqID_195907
atgaccgcccagatcctgcttcatccttcgctcgcgccgctcgacggcggcatcaatttccgcgacttcggcggcaacggcgtggccgacgggcgccgcatcaagcgcggcctgctgttacgctccggttccctcgagcggctgacggaaaacgactgcgcctttctcgccggcgtgccggtgcgctcggtgctggactaccgtgatgccgacgaggtgcaggccaagccggatattctgtggagtggtgccgactatcaccacgtgccggccaacccgctgagcagcgaagtcaacgccaacctggagaagctcaccaacgagacgctggccgccttcgacgcccgggcgttcatgctggagctgtatcgccgcctgccgttcggcaatgcggcctatcagcggctggcgcagctgttgagcaatcctggcggcggcgccatcgtgcagcactgcgcggtcggcaaggatcgcaccggggtcggttcggcactggtgctgttcgcgctgggggccgacgaagcgacggtgctggaagactatctgctgaccgaaaccacgctggccactttccgcgagcagatgctggatcaactgtctatcaagctgaatgcggcggcgctggagcaattcgcctacgtgctcagcgcgcgcgaggagttcctgatgacggcgttgggctgcatccgtcagcaatacggttccaccgaccgctggctggaagcggaatacggcctgggcgcagcccagcgcgaagcgctgcaggcgttctacctcgagagccccgcattgagcctcaatgacgttatcaactgggtcagcgacgtcgtgcgtcaacacgaaggctgggccattcccatcatcttcttcctggcgttcggcgagtcgctggcgtttttgtcgctgctgctgccggccacggtgatcctgctggcgctgggcgcgctgatcggcgaaagcggcatcgccttttggccgatttgggccgccgccgccgtcggggcgtttttcggcgactggctctcttactggatcggctatcactatcaggatcgcgtggcccatatgtggccgctgtcgcgcaatccgcagctgctggtgcgcggccacgcgttctttgaacgctggggcgtgctgggcattttcatcggccgcttcttcggcccgctgcgcgccgtggtgccgctggtgggcggcatttgcggcatgccgcagcgttatttccagttagccaacgtcacgtcggcgatgatctgggcgttcggcattctggcgccgggggcattcggcatcaagtggctcagccagtggctgggctga

SEQ ID NO: 79130 - DNA, 1008 bp, Glycine max
  Peptide Sequence Number=SeqID_195908
atgccttatcttctccgacgaatgaaggctgatgtgaatgcccaacttccaaagaaaactgagcatgttctattttgcagccttacatcagagcaagtatctgcttatagagcatttttagctagcactgatgtggagcaaatattggatggacgcaggaattctctttatggaattgatgtgatgcgcaagatctgcaaccaccccaacctacttgaaagggatcatgcctttgatgatccagattatggaaatccaaaacgtagtgggaaaatgaaagttgtagctcaagtgcttaaagtttggaaggaacaggatcaccatgttctcctttttactcaaacccaacaaatgcttgacatttttgagaattttttgacaacttctggtcacatttatcggagaatggatggtctcactcctgtaaaacagagaatggctttaatagatgaatttaatgattcaagtgaaatatttattttcattttaacaaccaaagttggggggttggggacgaatcttacaggtgcaaatagggtgatcatctatgaccctgactggaatccttcaactgatatgcaggccagagagcgtgcttggcgtattggtcagaagcgggatgtaacagtgtacaggttgattacgcgtggaactatagaggagaaagtgtatcaccgtcagatttacaaacattttcttaccaataagatattgaagaacccacaacagaaaagtcaaatatctgaagaagccaatatcattgggacacacaaagaaaataaggataagtataaacatagccaacctgctgaactggattctgaagatgttgcagttggtaatgatgacaaatcagagagaggttctttaagaggaaaggggaaagagaaggttgaacataatagtaataaggttgatgaggaaacaaatatattgaaaagcctttttgatgccaatgggatacatctaacacatcccatttttcatgcatcattacttcctatttga

SEQ ID NO: 79131 - DNA, 1881 bp, Glycine max
  Peptide Sequence Number=SeqID_195909
atggattctgcaaggagttggcttcagaagttccagcctcgagataaaaccagggctgctgggaagaaaaaggaggaggatggtaatggaggaaaccaggattcgaatgaagccatagatgaagcattgctttccagtgtcacgaagcagaaggtggcagcagcaaagcagtacattgaaaaccattacaaggagcaaatgaagaaccttcaggagaggaaggagcgcatttccattgcacttttccatcaccacgtagatacgagtcataccgcaagatatgttaaattgtttgcacttggctgcactgatttaactgggatttccaagaatacagtcaatggggttcgaaccatcttggaaaagaagttggctgatgctgatgtctctgaggaggatcaaaacaacctgcttaagtttttagagaaaaaggaaacagaatatatgcgccttcagaggcataagatgggtgttgaagattttgagttattgacaatgattggaaaaggcgcatttggggaggtcagagtctgtagggagaaaactagcggtcacgtatatgcaatgaaaaagctgaaaaaatcagagatgcttcgcagaggccaggttgagcatgttaaagccgaaaggaatctccttgcagaggttgacagcaattgcatagtcaagctttattgttctttccaggatgatgaacatttgtatcttattatggagtatctaccgggtggggatatgatgactctacttatgagaaaggatatcttgactgaagatgaagccagattttatgtaggagaaacagttttagctattgaatctatacataagcacaattatatacatagggatatcaagccagacaacttattacttgatagatatggacacttgaaattgtcagattttggactttgtaaaccattagattgtagtacacttgaagaaaatgatttttctgtgggtcagaatgtgaatggatctacacaaagctcaactcctaaacgctcacaacaggaacaactgcaacactggcaaataaacaggagaacacttgcttattccacagttggtacaccagattatattgctccagaagttcttttgaagaaaggttatgggatggaatgtgattggtggtcacttggagctattatgtacgaaatgctggtgggatatcctcctttttattctgatgatccaatgttaacatgcaggaagatagtaaattggaaaacttacttgaaatttcctgaagaagctaggctatccccagaagctaaagatcttattagtaaacttttgtgtaatgtcaatcaaaggctggggtcaaaaggtgcagatgaaataaaggctcatccattcttcaaaggtgttgaatggaataagttgtatcaaatggaagctgcatttattcctgaggtcaatgatgagttagatactcagaattttgaaaagtttgatgagtctgacagccaaactcaatcatcttcaagatctggtccatggaggaagatgctttcatctaagaaggatttgaattttgttggatacacttacaagaactttgaaattgtaaatgattatcaagttcccgggatggctgaactgaagaagaaacagtccaaaccaaagaggccaaccatcaagtcacttttcggtaggctttctcatgctttgggaccattatattccttccagctcttctcgtttagtttgtgttacacctttgtgtttcttgcatattgtgaatcagaaacaccagaggcgtccgatacgtctgcaaatgatcaacctgctcaaggaagctttttgaagctcttgccaccccagttagaggtatctcctcatcgcgacaagaatcttcctcccaggtcctaa

SEQ ID NO: 79132 - DNA, 492 bp, Glycine max
  Peptide Sequence Number=SeqID_195910
atgcgacttcatcacaccataccaccacccacaaaatcattacagatttgccacctttcccaaccacctagtacctatcacaaccaatatgtgtcatcacccatacccatctcacctgcaattgcaatagctgccttcgctgagccctcaacatctcacacttcctccattgtcgtcgctcctctagcacaatctcactactgcaaccgtcattcctctgcaggttgttctctttttcactttttctttgacagccacaccacaatagatttcataaatttcttcacgttaccatggtttttccctttcccaaccaccttgtaccatgaaggagagaaagaaaagaaagagaaggagaaggggttggacagcgcggtggtaacgatcgacagcacgatgggcggtggtggcaaagtggtggtggtagtagtttttattggagaaggagaagaaggaaaagaagatgatgatgtagtgttgactaggcattga

SEQ ID NO: 79133 - DNA, 453 bp, Glycine max
  misc_feature (139)..(139): n is a, c, g, or t
  Peptide Sequence Number=SeqID_195911
atggcgcgccggcacgttgcccagcagcaggctggtggtcaacacatgatcgtaccaggcgaaatcgccgaccggcacaaatccacccggcctgctgttgctgttgccaatgacgagcgcgcagctcgcggccaaccgncaacagctcttcctgcgttgagttgccggccccagccctgcgcaacagcggttcgttggcgggggcggcggcccaacttcatcagacgcagtctgccctgtcgcaccagttcagcgatcttgagcaacgtctgggcttcaagctgttcgtgcgcaagagccagcccctgcgcttcaccgcccagggcgagatcctgctgcagctggcggagcaggtgctgccgcagatccagcaggcgctgcaggcctgccacgagccgcatcagaccacgctgcgcatcgccatcgaatgccacagctgcattcagtggctga

SEQ ID NO: 79134 - DNA, 2037 bp, Glycine max
  Peptide Sequence Number=SeqID_195912
atggccacgcacgtgagtcacgtgatagtagcggcagcatttcttctacttcttctccctttctctttctccttctccatctcccattctcaccgatccgctgcaatcaacctcttcgctgccactcccacaagcttagaagacgcgtacgaggcgcttagagtttttcagattctcggaatcgaagagaagaatactcctgtgaacgaggacacgtgtcagaaagtagttgaaagtctagcctcgtcttctcctctcaaggatttgttctatgccttgaaagttaacgccattttaaaatgcaatgtcaatgggaacgtttttaaggatattgcttcaagacttaaagccactgttcatgatgcgagtgctttgcttgacatctactattcaattggaggtttggttgttataaaggatcaggattctaatgttgatgtgcttcttgctgatgttgatggggttttccaatcaatcaaggttctcagtcaaagtgacggaagatggcgctatagttctgataatccagagtctagtacctatgctgctggattagctcttgaatcccttgctggattgatctcactagcttcttctgaatttgatcaatctaaggtcaacgtagtgaaaaatggcatagtaaagctttttgatggcattgagaaatatgaggatggaaccttttattttgatgagaaatatgttggtggacatgagcaacggggttctctttccacaacttcttcagttgttagaggggttactgcatttgctgctgtaacttctggaaaaataaatcttccaggggataaaatattgggtctggcaaaatttttcttgggcattggaatccctggagatgccaaggacttcttcaatcaagttgagatttccattccattgatattgtcactcccagaaacagcttattcattgaccaagaaaggccagcttaaggtcaaggtgaatacagtgcttggttcagctgcaccaccgttaacagtgaagcttgtccgtgcttttagcacaggtgcaaaagattcagctattattgacagcaaggagctccggtatgaccaagaaagtggatttcatgtcttggatgctttgccgaagaatgtggatgtggggacatatgtgtttgtttttgagattgtgcttcatgattttggcagtgaaaaagtttatgcaactggaggccaaattcatgtaccaatatatgtcactggaattattgaagttggtaatgcagaaatcacagttcttgacagtgatcttggaagtgctgaaacccagaaaaagctagatttggctggaaatgatgccgtttcactctcagctaaccacctgcagaagttgaggttttctttccaattgacaactcctcatggtcatgtttttaagcctcatcaggcgtttttcaagttgagacatgagacaaaggttgaacacatctttgtggttggaaataccggcaagaagtttgagaaagattttcttggcttggtggagaaacttttctatctctcgggaaaatatgaaattgagctgactgttggtgatgctgtcatggagaactctttcttacggctacttggccatgttgaattagatcttccagaagcacctgagaaagcaccccgtcctccaccaccacctgttgatccttactcaagatatgggcccaaagcagagattacccatatattcaggtctcctgaaaagagacctcaccaggaactctctcttgctttcttgggtttgatccttttgccattcattggctttttggttgggttattgcgcttgggggtgaacctaaagaatttccctggttcaacagtacctgccacatttgggatccttttccatgttggtattgcggcggttttgttactttatgtacttttctggttgaagctggacctgttcactacactcaaagcatttggtcttttgggagctatactgatgtttgtggggcacagaattctttctcatctcgcttttacatctgccaagttgaaatctgcatga

SEQ ID NO: 79135 - DNA, 433 bp, Glycine max
  Peptide Sequence Number=SeqID_195913
caaagcatctaacgaattacccaacaagggaactaacaagatcaatggatttgctgctggggaatcttctggtaaagcattatcttccgccgaactattggctcaaattcgaggtaaccaagagaaagccattggtgccgggcttgaacatcagtttggtgtgttgtcaagttccactaatcaagcaagatctgtagatgctagatcttccatggctactgaaaattcatccgtacaacctgaagtattgattcggaaaatctgtacttttatacaacaacgaggtggtagttccgattcagccagcatagttcagtatttcaaggaccgtattccctcaaaagatgttgtgctgtttaagaatctgttaaaggaaattgctactctgcataaaggatcaaattgggttctgaaaccagactaccaattctga

SEQ ID NO: 79136 - DNA, 312 bp, Glycine max
  Peptide Sequence Number=SeqID_195914
atggaggagcttgactttgtcccttttgtaaaggggaagaagaacccttactacactccttattttggtgtagccatgctttggaagtgtggcaattgtgttataagtggtgtggtgtgcaagaggaaaaaagcgagtgagagatggatttatgtttggattggtgtcgtgtggtccctatggaaagctaggagcaatatcattttgaggggttctaacttcgacaagcaaaagctcattcaagaagcacatgcaatttcatatttggacacggttaaaaagcttgggtacagggttacattattcatgtga

SEQ ID NO: 79137 - DNA, 1529 bp, Glycine max
  Peptide Sequence Number=SeqID_195915
atgaagacagaagggttactcgcgcagcgcatcgttaacgtaaaaagttcggccatccgtgaattgcttaaacacagcaagatggaacacgtcatttcgctggcgggcggcatcccctctgatgcgctgttcgatttcgaaggattgagcatcgccacccagcaggcgatcaccgaacagccgaaaagcgcgttccagtatggcttgaccgagggcagcccgctgctgcgtgagcgcatttgcgcgctgtgcgccgagcgcggcgtcaccgcgcgcgcggaagaggtgatggtcaccgccggctcgcagcaggcattggatttggtgatgcgcgccatcgtcaaccccggcgacgtgttcgtggtggagcgcccgacctacctggcggcgctgcaaacgctggagctggcggaagccaacatcatgtcggtctcgtcagacagcgacggtatggtggtggaagagctggccgagctgctgaaaacccagcgcatcaagggcgtgtacgtggtgccgaacttcggcaaccccagcggcatcaccctgagcgccgcgcgccgcgaactgctggtgaagctggccgccgaacataacttcctgatcatcgaagacgatccgtacggcgagctgcgtttcaccgaagagcgccacccgacgctgcatcaggtgtcgcagcgggtgctgggcaacaccgaccacatcatctatacctcgaccttctccaagatcctggcgccgggcctgcggttgggctgggcgattctgccgccgttcctgctgcataaagtggcgatcatcaaacaggcggcggatctgcacgccagcgcgctgtcgcagagcatcgtcgaatgctacctcggcctggatcgcctgccggcgcagatcgacaagatccgcaccgcctacaagcaaaagggcgagatcctggccgggcggcatgttcctgtgggcgcgtttccgccagccgttcaacgccaccgaatggctgaataccacgctgcagcagggcgtggtgttcgtgccgggggaatacttcttctccgacaacccggatcgttcgaccttccgcctgtcgttcgccaccgccaccgagcaacaaatgcaggaagcggtggcgcgcctgcgccgttcgctgtaatccccgcggcggcggagggcatgcccgccgccgacatcaaactgccatcttcacttcactctcctgagttaggcatgctcacctacgctattcgcaaaaccacgctgtgcgtcgcgttgaccctggcggtcagcactcaggcgctggcggcgaccgagatcccgttctggcattcgatggaaggcgaactgggtaaggaagtggactccctggcggatcgcttcaaccagtcgcacagcgacgtcaagattgtgccggtttacaaaggcaactacgaacagagcctggcggcgggcatcgccgcttaccgctccggcaaggcgcccggcgatcctgcaggtttacgaggtgggcaccgccaccatgatggccagcaaggccatcaaacccg

SEQ ID NO: 79138 - DNA, 372 bp, Glycine max
  Peptide Sequence Number=SeqID_195916
atggtgccaaaaacttgttcgcaaccggcaagtgtaccggatcgtacaagtagtataaaacggactttagaatcacaccagtttccactgttgaatgaccctaacaaagcatgcatctatgtgatcagggatctcacaatcactcacaaacacatctcaagctctcataacggcttccgcttcgaactcgcatctctgcagatcttcacacaacaaaatctctcagaactttctggaagttggacctttctctctctagaacttcctaaacatgcaaaagcttcaaaccaaggccagacactcgtgcatgcagaggcttcttcaagaaaaattccaaaatccctttgcaaatctgatttcaagcttaaatag

SEQ ID NO: 79139 - DNA, 531 bp, Glycine max
  Peptide Sequence Number=SeqID_195917
atggcagattcaatggatgactcctcagccattgaagaaactaaggtaaattctgaatttgaagaagttttggaagcatttaatgaaatgcatgaagaagcgcaaaggcttgctgttttgaacaataagttgagaagtgatttaaaattgcataacactaaattggcttcaacacaaagtgagttggataaattgagacaagaaaatgaaaatcttgtttcaagttataaagccactggttgtgtttgttcttctgcttctcttaatatggatgattacaaatcttggcagattgagtttggaaagttaaaaaaggatcactatgaagaacaggacacatatcttataaatgctatgttaggagatttgatgttcctagaggtgtgcctaaaagcaagagactcaccatggtacttggacaatggctgctctaggcacatgatgggtgacaagtccagacatactgactttgtgtcaaaggaaggaggatatgtcacttttggagataataataagggaagaattgtgtga

SEQ ID NO: 79140 - DNA, 885 bp, Glycine max
  Peptide Sequence Number=SeqID_195918
gtaagatcactgacacttgatgttaaagtgtgggatccctctgttttaagtatgcttaagtcactgggcaatctttttgcaaactcagtttgggaggagctgctgtatccaccgagtaatttgcaaactgttgacacccctgcgagttcatccaaggaaaatggagaggagttctttcatgcaagaaaaccaaaacatgacgattctatttcattaaaggaaaggttcattcatgcaaagaaagatgggggaagcttgaatcccccaactttgagaagtaaagaattcatagcctatattttccaacttcgaataacatattctgagaaaatatttattccccggacaaagaaatatcaccctctcttttcacccgcacaactggtgctggaaagcatctatgccaatgataagaaagcagtctaccagcatattatcaagtcagattttgacatcaatgccatcggttggcaagcatcgtctggtatgtcttattattccagaagtctaaactccagtgaagtttttggtgttggaaaaccacccattgaggccatacaagatggttctagcgtgcttcaccttgcatgcctaactagtgacattggcatggtggagctgctcctacaacatggggcaaatataaatgcttgtgattctagaggtcagacaccactacattattgtattattaaagggaagaccgcagctgcaaaagtgcttatcatgagttgtggtttactttggaaaattgacatagaatgccaacattacaggggagccaatacatatgtcgcagataaagaaggcaaaactcctgttaagcttgcatcagaatctggctgtggtgatgatgaaattctcgctctcttgacaagcagatga

SEQ ID NO: 79141 - DNA, 291 bp, Glycine max
  Peptide Sequence Number=SeqID_195919
atgggacgcatagaagataggcttctctctgagatgcagaggctgtttggacttggaagagattgctggaggaagacgagagttgcagcctcaaggaaggaaattctatctgtcatggcagtcaagaagatagaattagtcagttttaatggagaatatccttatggatgggtctaccatacattagttcaacttgttgagatcaactggagaaacactcacttgagacaagttgaaggtgttagtggctcggttcagggagatacgtcgaaaatccttatcaagaagtga

SEQ ID NO: 79142 - DNA, 1233 bp, Glycine max
  Peptide Sequence Number=SeqID_195920
atggtagagacattccaggagttgcaggatgcaagagcatcatttgaggaagcccgtttcaatctggttggcactcttaataacattgagttcaagaagagatttgaggttttaaaggctgtaactggaattatggatgctcatcttcgatactttcaacagattatggattatgtaaaacagtcaaaagaaagttacaatcaggagcagatttcactttatgaaagaatgcaagactacaaaaaacaagtttatgaagaaagtaggttgtccttgaatggtccttatggttctcctagtagagactctgcacctccgttttctaggatatcaaatgaagtggcagatgtagtgatggaatccgctgcaaatggaaaggttcaaatcattcgacaaggatatctttctaaacgatcctccaatttgagaggtgactggaaaagaaggtattttgttgttgacagtcgaggaatgttgtactactatcgcaatccatatggcagcaatcaaccatctccaaagaggaatagtggcactgaaaatggttctgggcttctgagtcgatggctttcttctcattaccatgggggtgtccatgatgaaagatctgtagcacgtcatacagtaagcctgctgacatcaacaatcaaggttgatgctgaccagtcggatttaagattctgcttcaggattatttcgccatcgaagaactatacgttgcaggaagcaatgcaggcagaaaatgcagtggatcagatggattggatggaaaagataaatggagtaattgcctccttattgagtgtccagacactgggaatgcctctctcagctgactcagaaaacggcgactcttactctgatgacaatattgataagttagaaagctctccagatgatgatcacactgtgactgtgaagtctgcatccaagaatcccacccctaaaaaccagtttcgttcatctagaagtttgcagttgcataaacacagtatgagaattgaaaaaccaattgatgttcttaggagggtgagtgggaatgacaaatgtgctgattgtggtaaacctgaaccagaatgggcatccttaaaccttggcatccttatatgcattgagtgttctggtgttcatcgtaatcttggtgtacatatatcaaaactagagacagggttagaggacctggtacctggtacctcaaagccctcacttctagctaacaattgttactcttaa

SEQ ID NO: 79143 - DNA, 1122 bp, Glycine max
  Peptide Sequence Number=SeqID_195921
atggcacaagattcagagaaaatttgtgaaggtgcttcggagtctccaacgaccccagttggaacacaagcaccagcaccagcaccagcaccagcaccaccagagagtgaacccaaaagcacttcaactcaaagaatcaaagccacaaggcaccctagatggacaaggcaagaaacacttgttctgatagagtccaagaaaatggtggaaaatggagaacaagtttgccgattcagatcagcatcagggtgcgttcaaaccgatccgaaatgggacatggtgtcatcactgtgtcagcagagaggggtgaagagaggggctgttcagtgcaggaaaaggtggggcaatcttctcactgatttcaggaagatcaagaagtgggaatctggtgtaaaagaggtggagagtgagtcgttttggataatgagaaatgatgtgaggaaggagaagaagttgcccgggttctttgattctgtggtgtacaatgttttggatggaggggtgtgcaccactgttgcatttcccttgacactggttaagatggtgccaaagggtgagaatggtgttgttgttgagggagtgtctcatcatcaggaacagtgtaaggagaacgaggaggaagaggaggaggaggaggaggaggaggaggaagatgaggcgattgttgatgctgagaaaatgggttggagcactgaggaggaaaacatggagactaacatcaatggttttcttaaaacaccaacaggtcttcttattaaggaaaaaggtattgcagggaggctcaagaggacacccatactcacattgcctactccagagaaactacagcagcagccatcttaccaagggaactacgatcctggttttcagaaggaacctatgttccaagagggatacaagagaaagaggttaccgttggatagtagtgaggactgcacagatttcaacagcaacattaccaatctactaaggaggaacagtgacatgctaaaagcccatcttggggctcagaacataaattaccaattggccagggaccagcagaaacaacaaactgatattatagttgcagcccttggcaagctcacagatgccctcacaaaaattgctgacaagctgtaa

SEQ ID NO: 79144 - DNA, 1974 bp, Glycine max
  Peptide Sequence Number=SeqID_195922
atgggaaaggagagccaaacgtccgctatggaaatcgacgctccaaaatcgatgaattccgatctgatcgttccaaaattctccatcaacggtttgttttctccttcgttgtgcattggtgttccattccgcgctattcctttcaccaacgaaatggaaaataatacagcatttaacgtgctgcagctcttaaaatctgcgcaaatgcagcatggcttgcgtcatggagactacactcgctataggaggtattgcacagctcgtttgaggaggttatataaatcgttgaagtttacccatggtcgtggcaaatatgcaaaaagggccttaactgagtctactgtcaccgaagtaaggtttcttcatgtaattctctatacagcagagagagcttggagtcatgccatggagaaaaggcagcttccaaatggcccaaatgcacgtcagcgcatatatttgattggtaggttgcggaaagcagtaaaatgggctactttgttttcacaattgtgtgcggtcaaagctgattctagaacatccttggaagctgaggcttatgaatcctatatgaaagggagtttgttgtttgagcaagatcagaattgggacgtggctttaaagaacttcaaaagtgctagcatactagcttctggcatgcttctgtttttcttgttcaccctgttcgagtttttaaccatgtccttatttaatagggctgtatatgaggaattggggaaatatggagatctggataaccaagttttgtgtcgtgagcgagttgaggaactagaacctagtatccggtactgccttcacaaaattggccagtcagatttacaggcctctgaacttttgcaaatcagtgatgtggaaggtcccgcattagacctttttaaagctaaattagaggctgccatggctgaggcaagatctcaacaagctgcttccatgacagaattcctttggcttggccacagatttccaatatcaaatgccaaaacaagggtttccatcctgaaagctcaggagctggagaaagatatacatggtcccttggcagactcaattccagcagacaaaagacttgttatttttgacaaaatcttttctgcatatcatgaagccagaggctatattcgggctgatttggccactacaggaagtacagaaagcgtgaaagatgatttgaatggtcttgataaggctgtcagtgctgtcctaggagaaagaaccattgatcggaacctcttgttggttaaggttgcaaaaagcaaacttgcaaagcgtcatgatgataaaaatgaaaaactcaccaaacctgaagagcttgttcgcttatatgatctcttgctgcagaatacaggtgatctatctgatttagtcagttctggaagggataaaaagccagaagaagttatctttgctgaagtgtgttcatgcaaaagtttggcttttcgagcccaaaggtgcttttatgttgcaaagtcatacagtgtggctggaaagagggctgaagcatatgcattgtactgtcgtgctcgcaatttggcagatgatgccttaaaaaagttccaaatgttggatggtgataataagactatgatgaaagagttggaggatttgtgcaatgagtgccgatctaacagttgtatagagcatgcattggggatcatggaggagaaaaagactcaagaaaatctatctgaaagggtctccaatatatcattgactggaactgagcggttggagaagttccttcttgagaaactagatgtttatgaatctgctgtgggtgattcaaatgtgaagtgtacaccacgcattgcaggcttccccccggctttccaggcaatttcccgtaatcctattgtgctggatctggcttataacatgattgaattcccacctattgaaaacaggatgaagaaggatagaaaagccaagggcggctttatcagtagaatatttggatga

SEQ ID NO: 79145 - DNA, 273 bp, Glycine max
  Peptide Sequence Number=SeqID_195923
atgtctcctaaaaaagagttaatttttgagctgcagggaaaagatgtaaatggtggtgagcaaccactatctgacaaagatttactaactctcgagcaattcaaaaaagagaatcgtgagttgaaggagagattgcaaaggaaggaggaggacattttaggggaagtgttgcatgctctgcagcatgagaaagacaggtgtaaatctcttgaaactcaggtttggaccatgatctcaacgctttacagcttaatacttggtttcattaagtga

SEQ ID NO: 79146 - DNA, 843 bp, Glycine max
  Peptide Sequence Number=SeqID_195924
atgccctcacctttagaggactacacgtctttgcgatcaaagggttgcccgccctcactttcagaggactacacgtccttggcatcagagggctgcacgtcctcgccatcagagggcagtactccctcacctttagaggactacacgtccttgccatcagagggctccacgccctcatcttcaaaggactacacgtcctcgccatcagagggatgctcgctgtcaccttctgaggactacacgtccttaccatcagagggctgcacaggactacacgtcctctccatcagaggaatacacgtcctcacaatcagaaggctatacgccttcaccttaagagggctacacgccctcaccttcagaggactacaagtcctcgccatcagagggtcgcatgccctcatcttcagaggactgcacatcctcaccatcagagggtcgcacggcctcatcttcagaggactacacgtcctcacctttagagagctgcagttcttcaccatcagagggctgcacgtcctccccttcagagggctacacgtcctcaccatcagagggctacacgccctcacctgcagaggactgcacgcccttcctatcagagggctacacgccctcacctttagaggactacacatccttaccatcagagggcttcacgccctaacctgcagaggactgcacgtcctcaccataagagggctgcacgccctcacctttagaggactacacgtcctcgccatcaaagggctgcaggccctcaccttcagaggactacatgtcctttccatcagagggtcgcaccccttcatcttcagaggactacacgtgctgaccttttag

SEQ ID NO: 79147 - DNA, 189 bp, Glycine max
  Peptide Sequence Number=SeqID_195925
atgtcgcttgcggagcttggtgcgctccttctccttctccttctccctctccttattctcattgtcgtcgatattggtggcagagatgtggtggacgaggtggcggtagcgggggcggaagtggtagagacgaagactagggttgccctaacccaagtaattggaactggagatatattatacacatga

SEQ ID NO: 79148 - DNA, 882 bp, Glycine max
  Peptide Sequence Number=SeqID_195926
atggaggctcaactcccacctagaaggaaatcgttgaatatcgatcattacaatgaactctcggactcagatgaacacatggatgcatttgtcacacagatgaatctgttcacgaatgatgacgcaatcatgtgtcgagtgtttcctataatgttgaaggttgagagcaagggctatcagattcatttagatggaagagaaaaccatgttctgagagaaagtgcagggataatcctcaaggaagtcggtgaactgagaactaagaatcgaccttcaccaggagctgataggtccaagtactaccaatatcatcaagttgctggtcacaacactgaagattgtactagcggcaagaatccccaacccaaaactcggcttcaaggtgtaatcaacccaatagtcggaggattcacaaggggaggaaattcaaactcaacacgcaagggctatgtctgcaaccttaagcttgttaacccggggataaaccaatgtcactacgatcccatggtggccaagatagaggttgctaacttcttaatgtggaaagtcctacttgataatggaagtttggccgatgacctatactggttggcctttaaacaactaggcataccagaaaagcatattgagtcattctcagagcaactcataggtctttcattgaacgagttaggggccatcatttcaactccttatctggcaatgaagttcctgagtaaggatgggaaaattatcagtcatacatgcacctctctcaatagcaacttgggagaaaccaaacttgatccaagaaaagctgagaagaaattggaacccactaaagaggttaagtccttccaactcagcaacgagccatctcaatgcaccaaactcggatgctag

SEQ ID NO: 79149 - DNA, 605 bp, Glycine max
  Peptide Sequence Number=SeqID_195927
gttatttcagggataggattttgttcctgactgtgttgcaatcaccgaatgtggagcaactaaggacgaatatttgggggtatatcataggcaacgagaggttggatgcgaattacgtggttccccaatggatgccacagtttgattgcagaagtgaagctcaaactctgattgttttggatgatgtgtggacactctttgtggccaatcagcttgtgtgtagaataccaggttgcaagtttctcgtggtgtcgaggcctaaattccaaatggtgttgagttatgaagtggaattttttattgaagatgatgccatgtatttcttttgtcaccatgcttttggacaaaaatcaattcctttagctattaatgagaatttggtcaagcaggttgtgattgagtgtggaaggtttcctttggctcttaaggtgattagagcttctttgcgagatcaaattgagatgttttggttgagtgttagaaataggatatctcatggctcaagtattggggaatcccatgaaatcaatctaattgacaaaatgacaattagtatcaattaccttctagagaagatcaaggagtgctacttggacctgtgttga

SEQ ID NO: 79150 - DNA, 273 bp, Glycine max
  Peptide Sequence Number=SeqID_195928
atgggagaggaggaccaaacaaaaggagttccaggtaaaactgtcgtgccaaagtcagctaatgaagtgaaattgattagctctggtaaaatcttggaaaacaataagactgttggtcaatgtaaagtaccgtttggtgagactgcagggggtgttataataatgcatgttgttgtacagccatctctatcaaaaactaaagctgagctcatgtcagaaccaacttccacgagtttgcagttggatctgcatgatgacatattggcttgctaa

SEQ ID NO: 79151 - DNA, 537 bp, Glycine max
  Peptide Sequence Number=SeqID_195929
atggctgccttcgcttcttccacgtccattacagaccacatagacgctgccattgtgaaactcaccttcgatcaattccacttcatcgctactcaaaactccatgtccaccaaattggacaaaattcttcagaggttgacccttcttgaaatccactatcagttttccaatgtgctcttgccttcttcgatcccttcatttgagaaacccgtcgccggtgtggttcctcagtcgaatactgaagacagagccgcgaagtttgaatcgagcttcatggaagagtcgctgaactcggtttctagtcaaggaagggttgccagaaaatcaaaccatggaagtggaatgttcagacgaggctacggattcggcaaccacgactgcacagtgtttcatcgccacatgcccttcaaacttgaccattcagactcagaggatacaaatgttgtttcattcgaagtcatgaaggagaaccctttttgggtgtacgacagagaagcacttcggctcttcagaaagttaggcaaaggtcacttgtaa

SEQ ID NO: 79152 - DNA, 384 bp, Glycine max
  Peptide Sequence Number=SeqID_195930
atgacggagacaaaagcgacgaatgtctatttcatctcggggaatcacacgacatggaaacttgccccgcggtggaagagctacttcaacagctcatggactaggggcagctcgaagtgtccgagagagatagggaagaaccgcagatttgcacacagtcggcagaaaggaaggctcccccaacccccaaagccctacaataagaccaacccatggaaatatacccctccagcttttagagaaggggctgcaaccgaggttgactccttgtcagccaaggagaccaacattaccggccttagtggcttaacccgcagtggctgggtgttcgctccccctcactcggcagaatttacctccaaggggaaagcacccatgacctaa

SEQ ID NO: 79153 - DNA, 285 bp, Glycine max
  Peptide Sequence Number=SeqID_195931
atgacgggtcaaattgaaagtgactgtcatgggtcaacttctgctagtacttctcaaaatgctgctaatgaagatctcaggaggaagcttgaacactttcaatcaaaagtcaaggaatctcttgcagttcttaagcctcattttaaccatgaaagtccagtcattgcaattgctacaattcaagggttagaagtactgggaactatggacctcaatgcaccactaagggatgaaacacttccacaacaagaggagctgccatcaccgcagccaccagtgcagtag

SEQ ID NO: 79154 - DNA, 835 bp, Glycine max
  Peptide Sequence Number=SeqID_195932
gactacacgtcctcgccttgagaggactacacgtcctcaccctcgagagggctacacgccctcaccttgggtactagttaccctcaccgttgagaggactacacgtcctcgccttgagaggactacacgtcctcaccatcagagggctgcacgccctcacctccagaggactacatgtcctcgccttgagagggctaaacgccctcaccgtgggactacacgtcctcaccatcagagggctgcacgccctcacctccagaggactacatgtcctcgagagggctacacgccgtccccttgggtactagttaccctcaccgttgagaggactacacgtcctcgccttgagaggactacacgtcctcaccatcagagggctgcacgccctcacctccagaggactacatgtcctcgccttgagagggctacacgccctcaccgtgggactacacgtcctcaccatcagagggctgcacaccctcacctccagaggactacatgtcctcgccttgagagggctacacgtcctcaccttggagaactgcatgtcctcaccttcgtagggctacacgccctcacctttagaggactacacgtcctcgccaacagagggctgcacaccctcaccttgagaggactacacgtcctcgccaacagagggttgcacgccctcaccttgagaggactacacgtcctcgccaacagagggctgcacgccctcaccttgagaggactacacgtcctcaccaacagagggttgcacgccctcaccttgagaggaatacacgtcctcgccatcagagggcttcacgccctcacctccagaggactacac

SEQ ID NO: 79155 - DNA, 246 bp, Glycine max
  Peptide Sequence Number=SeqID_195933
atggatggttactgtcaactaggatgttcttacactggtagtgcaccctttgaacttgcatttgtttggaggtttttgacaagtccccctaaatggatcaaagtgaacgaaaggagaacactccacgatgttctcaaagagcctaatttcatcattcctgggatcccagtcttctatgttgtttcaaagcaatccagcttttatggcaagttcaaagctgggaagtgggcacctccaagtatatga

SEQ ID NO: 79156 - DNA, 201 bp, Glycine max
  Peptide Sequence Number=SeqID_195934
atgaagaagcccaaaaggatgaaagataaaggcttaaataagtcaagagatgttgaacttgccttaaagaagaatgaagatgaacacatgattgaagaagaatgccagagaaaaaatggacgaaaagaaggcaaccaagcatggacaatggtaagcatgctgttagcgtggggcagtacatatggtggctgtagtgaatga

SEQ ID NO: 79157 - DNA, 975 bp, Glycine max
  Peptide Sequence Number=SeqID_195935
atggcgctatggatggaaaagggttcagagccattaaccgaaagcgaaaaagcagaccttgaagccattgctgcactcaaagagtctgctgcttttgaattcaaggaaaagggtaaccaatatgtgaagatgggtaagaagcattactctgatgccattgattgctacacaagggcaattgatcagaaagccttgagtgactctgagacctctattctttttgcaaatagagcacatgtgaatttgcttctagggaatcttagacgtgctctcacagattctaatgaggccctcaagttgtgcccttcaaatattaaggcaatttatagagcttccaaggcttctctttcgctagatatgttggctgaagctagagagtattgcttgaagggtcttcagtttgatcccaataatgaggacttgaagaagcttgaccggctgataggtctcaagatatcagagaaggagaagcacgaggctgaattctccaaggccgttgcggagacaaaggaacttgcgtctgtgatagaacatagaggcttgaagattggaaaggcaatgtatcgggaacttattggattacggaaacctgtgttggataaaagtaatatccttcactggcccgttgttcttctgtatgcagaggttatgtccagcgacttcattgaggatttctgtgagactgacatgttttcggttcaccttgatatgatatccttttctgtgaagtggtttatggtatatgggttgtatctatcaaacgtatttgcagaagatcagccgttgtcatgggatgttgaaaccaactacaaacgtgaatttgttgaattatactatgaggctggttctggagttagtctatcaaaggaaaaacttattcattgtctattagagggaactgcagctgctcacagggaaggtgttggtgatgaagagaaagacacaattgaggattataagcaacacacgggttag

SEQ ID NO: 79158 - DNA, 1131 bp, Glycine max
  Peptide Sequence Number=SeqID_195936
atgtcacaaaaattgtacaaggtcttcaagaacttgggacaaatctcaatgaggcgcaaatggcagcttatcatgatgcaaaacaagaaagatgagagtgtggttgagtatttcactcagattctgacccttagaaatcaaatgaagaattacggcgagaagctcgaagatgtgatggtcattggcaagatcatgagaaccttaactccaaggtttgattatatagtggttgcaatagaacaaggcacagatcttgaagggatgaaggtggaagagccgacagggatacttgaggcacaagagttgaggctcaatgaaagaaactcaatgagatcctctgatcaagcccttcaagctcagacatataaaggaaattctaacaatggtggcaagaacaagaaaggaaaggaaaatggaagaacaaagggaagaactctggtgaagatccaagcaattggaaccagagtcataatgaagaaaacaacaagaagaatggtggaaaaaataagggtggcaagaagaaattcaacaagaaagggatccagtgctataattggcaagaaagtgccaagaaaggaagatgaagctcaattggcatatgatgagggttctgattctgatgataatgtattgctaatggtgactaccaattcagaagatgataattctaatctctggtatttagacacaggatgttccaatcacatgattggctatagagagtggtttgtgaatcttgatgaaaaggtgtttgacaacataggaagactgatcttgaagtctcctctttcaaataatagaaccttcaagattgagattcaaattatggagcaccaatgcttagccacaacaatcaatgatgggagttgggtgtccatcatagatggtataattcatgaggtgacatctccttacacacctcagcataatggtgttgctaagagaagaaataagacaattctggacatggtcataagtataatgaacgggaaaaagatgtctcatcacttctggggggaggcagtatctactactacctatatcttgaacagaagtccaactaagagactgaaaggaattacacctgaagaagcttggtcagggaacatgcttgatgttagtaatttttga

SEQ ID NO: 79159 - DNA, 3048 bp, Glycine max
  Peptide Sequence Number=SeqID_195937
atgcagatgaaaactcagtttttcttctacttctgttgcatttgctgtttctcttatggctatgcagctgcagcaaatgatgaagtagctgctttactttctataaaagaaggactcactgatccactgaatagcctgcatgattggaaattggtggacaaagcagaagggaagaatgcagctcattgtaactggactggtgtccggtgcaactccattggagccgtggagaagctcgatctctcccgcatgaatctgagtggcattgtgtccaatgagatacaaaggctaaagagtctcacttctctaaacttgtgttgcaatgaatttgcctcatcattgtcatccatagccaatctcaccacactgaagagtcttgatgtgagccagaatttcttcactggtgactttccattaggtcttggaaaggcatcaggactaataactttaaatgcatccagcaacaatttctctggctttcttcctgaggattttggaaatgtctcttctttggagactttggatctcagaggcagcttctttgaagggtcaattccaaaatccttcagtaacttgcacaaattgaagttccttggtttatctgggaataatctcaccggggaaatcccgggagggctgggacagctttcatcactggaatgcatgatcattggatacaatgaatttgaaggagggattccacccgagtttggaaatctcaccaagctgaagtatcttgatttagcagaaggtaatcttggtggtgaaattccagctgagttgggaaggctcaaattgttgaatacagttttcttgtataaaaacaaatttgaaggcaagattccaccagcaattggcaacatgacttcattggtgcagctggatctctcagacaacatgttatcaggaaatattccaggtgaaataagtaagctgaagaatttgcagcttctgaacttcatgcggaactggctatcgggtcctgtgccttctggccttggtgatttacctcaacttgaggtgcttgagctatggaacaattccttgtcagggacattgcctagaaaccttggcaagaattcaccattgcagtggttggatgtatcatccaattcactctctggtgagattccagaaactctttgcaccaagggctatctcaccaagctcatacttttcaataatgccttcttgggtccaattcccgcaagcctatcaacatgtccttcacttgttcgtgttcgaattcagaacaattttcttaatgggacaattcctgtgggtctgggtaagcttgggaagcttcagaggttagaatgggctaacaatagtctcactggtggaattcctgatgacattggttcttctacatccctttctttcattgatttttccagaaacaacctccactcttctcttccttcaaccattatttccattccaaatctgcaaactttaattgtctccaacaacaacttgggaggtgaaatccctgaccaattccaggattgtccctcacttggtgtccttgatctctcatcaaatcgattctctggaagcattccatctagcattgcatcatgtcagaaattggtaaacttgaacctacagaataaccaattgactggtggaatcccaaaatcattagcaagcatgcctacattggccattcttgatcttgccaacaacactctgagtggtcatatacctgaaagctttggtatgtctccagctctagaaacattcaatgtctcacacaacaagctagaaggtcctgtcccagaaaatggcgtgctaagaacaataaacccgaatgatcttgtgggaaatgctggcttatgtggtggcgttctccctccatgtggccaaacctcagcatatccattaagtcatgggagctcacgtgcaaagcacattcttgtaggatggatcattggagtatcatcaatactagcaataggggttgcaactttggtagcaagatctttatacatgaagtggtacaccgatggattgtgctttcgagaaagattttataagggtaggaaggggtggccttggagattgatggcctttcagaggctagattttacgagtagcgacattttatcttgcattaaggatacaaatatgattgggatgggagcaactggggttgtttacaaggctgagataccacaatcaagtacaattgtggcagtaaaaaagttgtggagatcaggatctgatattgaagtaggaagcagcgatgaccttgttggagaggtgaatcttttagggaggctaaggcataggaacattgttagactactaggatttctttacaatgacgccgatgttatgatagtttatgaatttatgcacaatggaaaccttggagaggccctgcatggtaaacaagcagggagattgcttgtagactgggtttcccgatataacatagctctaggaatagcacaaggacttgcttatcttcaccatgactgtcatccacctgttatccatagagacatcaagtctaataatatactcctagatgcaaatctcgaggcaaggatagcggatttcggattggccaagatgatgttccaaaagaatgaaacagtttccatgattgctggatcctatggatacattgcccctgaatatggatactccttgaaagtggatgaaaagattgacatttacagttatggagtggttttgttggagcttctcactggaaagcggcctttaaattcggagtttggagaatctatagacctagtagggtggattagaaggaagatagacaacaaatctccagaagaagcattagaccccagtgtaggaaactgcaagcatgttcaagaagagatgctattagttctcagaattgcacttctttgcactgccaagttccccaaggatagaccctccatgagggatgttatgatgatgctcggagaggcaaagcctcggagaaagagtggtaggagcagtgagacattttcagcaaacaaggagatgccagctattagctcatcaccagttaatggccttctgtag

SEQ ID NO: 79160 - DNA, 453 bp, Glycine max
  Peptide Sequence Number=SeqID_195938
atgagagaagaggtcattagtctcattccaagactagtgtatgctgatcctcgctccaaattagaaactcttaaagatgcatttgatgttgcggtgcaagcagtaattgacaaggttacaaatttgaggaaggatattattgaaggccgtacagatgacaacttcattgaggagaacagttggaaatatgctttgctgcctgagggagagcacgaggtaggacctcatgaatgggatcctttcttctccaaaccaaaggatggtttttctgatttctgcttcatgtatttctcctcactacttagtggttccaagaatgatttgggaggaaatataaacaaaattattacagttaatggcaccagaacaagtttaaccattgaagtcatggatagatcagttgaagtttcatttctccgatacatcagcctgccatacacgaaaatgcgttga

SEQ ID NO: 79161 - DNA, 1122 bp, Glycine max
  Peptide Sequence Number=SeqID_195939
atgaaggaaccgcacgaaccagaccagacatgtggacccacactgcctaatgccctttccccttctctctcacacttccatcagcattcccacctaaccgtcccgcttatcatactcttcttctttttctgccctcaaaactattcaattcaattcaattcccttctaattcttccactaccccttttcgttattcttcttcaattctcccaaaaatcatatttttacactctgagtggtttttcagcttgtgggtcgatgtcaactgtgtcaaaagatgacaacttggcgctttcttcggaggactcttcatgcccagaagagtctgagcttgaattgggtcttgggttgagcctctcctctggctcttcatcaaaatctcatcaccaccatcatgctagaatttacactgctaaggattttccttcttctgcagcagcagcagcagcagcagcatcatcaccttcctcttcttcttcctctcccaacaacatcactgctggcaccaagagagctgctgccgattctcttgttgccaataaccgtcccagtcaagtagttggatggcctccacttcgaacatatagagtgaatagcttcaatagccatgcaaaatcaactgaagtattcaactctgtggctgagaaaagtaagaccgataatactgtggccaggaagactaatgacaatggcaatgataataacataaatgccaaagagaaaagacacctcaggagttccctgtttgtcaaggtaaatatggatgggataccaattggaaggaaggttgatttgagtgctcatagttcctatgaaaccttagcgcaaacattagaggatatgtttaatgaatcaactacagtcaccacttgcaaaggatcaaatggtgaggattatggctttattatcggaggagaaaggcattcaaaattattagatggatcttccaagtttgtgctcacttatgaagacaaggaaggagattggatgcttgttggggatgttccctgggggatgttctttagctcagtgaggaggctaagaatcatgaggacatctgaggctaatggacttgcaccgagattggaagaaaacataaaaaagagatgcaagcccatatag

SEQ ID NO: 79162 - DNA, 486 bp, Glycine max
  Peptide Sequence Number=SeqID_195940
atgactaccctgacccagatatggatgacactgctgctcagcaatatcttgcctagcgaccacaactccgacctccctctacctaagtgtcagttggtgtatgccatcctgacacggataagcattcacatggcccaagtggttgctgatgccatttattggtttgcaggaatggggcctactaggcaccctttggacccagagaagtccaacggggccctggggtttccagctctaatcacgggcctctgccagtcctacagagttcttgtcacccccagcaagtattgcacgcctaggcaagcgcagggtgacgcacatcaaaacgcgggcgcaccgccaccacctcagcaggccgattcggctaggtcattgggcgtggagtggtatctacaacatttggttcgccagcaggcggccaaccaccatggaaaggtgcagatacatgagtgtctctacctgttcagcctcagtcaacaggggtag

SEQ ID NO: 79163 - DNA, 201 bp, Glycine max
  Peptide Sequence Number=SeqID_195941
atgtggtatatgttagtgaaaaacctcattggatgcctaggagtacatgacaagacagaccacacattggtaaatcaggttactctcactaggcttcaaggaacattcaaaccgagtgtatttatcctcaaggtctacactccgaagagtctgtcagggcctctctctccttattcaggtccaacccaaaaaatattttag

SEQ ID NO: 79164 - DNA, 441 bp, Glycine max
  Peptide Sequence Number=SeqID_195942
atggttgatcttgttgaatttcagaaagtggttattcgtaccaaaagtgtagagttcatgcctattactctgtcactcctcctcacagtaagtgcaacgatgtggatggcatacggtattctcctcagggacatctatgttacacttccgaactttgtgggtatcacatttggaacgattcagatagtgctctacttaatatatagaaagagcaagcccgttaaggatcaaaagctgccagaacacaaaaaccatgttgttaacgatgaaaacgccagcacagctgtgagtggtgagaatcagggaccaaacactactggattcgttgatattgagattggagagaagaagcaagttcaggaacaagcagagaaaaaacaggaccagcagtttgttaatgctcgtgaccaaacagaacacaacaaaacaagggaaagttga

SEQ ID NO: 79165 - DNA, 150 bp, Glycine max
  Peptide Sequence Number=SeqID_195943
atgggggcagttacgtgcataaccgagtggtctcgacgaactctgcatggtttgctaagtgagagtgttgtgtggactcacttaggctatttcctgggatttggttgttgtcttgattggatccatggatggatgatgagtaattgttga

SEQ ID NO: 79166 - DNA, 258 bp, Glycine max
  Peptide Sequence Number=SeqID_195944
atggtagtcattctgcccaaggaaaaccttgttgtctggttttgttccttgcataacaagccagacaactaccttacaagaataattaacagtgctttgaaaggacttgatgataatccacagcctaaatccaaggctgctgctaggtggattgtcgttaagtattttaacgatgctagaccattggggcaagagagattaaaggtacttcgcatccagtgggcacaatattatctcggacttagagatcaaacttag

SEQ ID NO: 79167 - DNA, 150 bp, Glycine max
  Peptide Sequence Number=SeqID_195945
atgcagaattcacagagagatgtgtacctaggagcctacatcaatgggcctgataactgcttgaaaggaattattaacagtgctttgaaaggattcaacaatagtcaaggaagtaaatccaaggttgctgctagatggattgtagttaaa

SEQ ID NO: 79168 - DNA, 285 bp, Glycine max
  Peptide Sequence Number=SeqID_195946
gagagcatcatccacagaagatggttcaaggaaaatttttcccaaatttgggggaggtattatcaaggtatggaagctaagtgcttaagaaaaaagggcaagtatggggaaggaatgaatgaaaaagtgaaggttattctatggatgaatgctctcctagaacctaagcttttgaatcctagaaaaaccatgaattgttggcagcctaaccccattacaagcctagaaagtctttcggattcatttttgtgtgtccattgttgtatgatagaagatgaaatgtaa

SEQ ID NO: 79169 - DNA, 672 bp, Glycine max
  Peptide Sequence Number=SeqID_195947
atggagaacttgtttcgcctagttgactatgaggacatgttctcaaaacgttgcatttgggtgaacggtccagttatagtaggagcaggtccttcagggctagccacagcagcatgcctgaaacaacaaggggtacccttcatggttctcgaaagagcagaatgcatagcttccctatggcaaaaacgcgcctacgacagattaaaactccaccttccaaaacagttctgccagctccctaaccttccattccccaaagacttccccgaataccccaccaagaaacacttcatagactacctcgaatcctatgctcaaaaattcgagatcaacccacgtttcaacgagtgtgtccagtgtgctaggtacgatgagaccagcgggctgtggagggtgaagaccgttgccacgtgtggcgccgcgaagagcgagtttgagtacatttgccggtggctcgtggtggccaccggcgagaatgcggagtgtgtgatccctgagattgaagggcttggtgaattcaaaggtgatgttatccatgcctgtgagtacaagtctggagaaagcttcaaggggaagaaagtagttgttgttggttgtggcaactctggcatggagctctcgcttgacttgtgtaaccacaatgcttctccttccatggttgttcgtagctcg

SEQ ID NO: 79170 - DNA, 303 bp, Glycine max
  Peptide Sequence Number=SeqID_195948
atgacaatgatagtagacacattaccagtattctactatggaaaatggtgggctacgcaccttcaaagctttgaggatttggtctttgccagtgaaaggatcgatgtgggtccgaaaagaggaaaagttgatcatcctactaggacgactgagaaaactggggcaaatgaagagggtgagaaagagggagaaacccatgctgtgactgccattcctatacggccaagtttcccaccaacccaacaatgtcatgactcagccaataacaaacctcctccttacccaccaaccagttatccataa

SEQ ID NO: 79171 - DNA, 555 bp, Glycine max
  Peptide Sequence Number=SeqID_195949
atgggtgaagtggaagaggtgcaagagcaagtgaaggctgacacggaggccttaaaagagcaaatggccacaatgatggaggccatgatgagcataaaggagataatggaggtcaatgcggttgcaatagccgctaccagcaccattgccgagtgcaaaaacaagcatgccttcccaccatatgacttgcctcccaactatacaccacccaatgtggcatacactcccagtgaggatgtcaataactccgctcccatactctttgaaagccgacaacctcaaactgatcatgcacatgtctctcaaaccatgggggagacacatgaaattccccaccacaatctagccgacttcgagccttgcctcggatatgccactgaagggcaagcagttggtgaggaaaggctaaaggtcgttgaagaaagtggaggttatgcctttgctaacctagaagagttgttcctggtacccaatgtcgtcacccctcccaagttcaaggtgtcggactttgacaagtacaaggagactacttgccccaagaaccgtctaaaagat

SEQ ID NO: 79172 - DNA, 459 bp, Glycine max
  Peptide Sequence Number=SeqID_195950
atggcactccaacgcacacgtcaaccctccatgtcagccttgacacaggagcacaaacacatctcccttgaactcagaaagctaaaggctggtcacgaccaattggaggctcgtgtgagatgcccccagggtgacaagcactctgctcacacaatgcatgaatgcactcaagaggaatcacacacccaacacactatcaacaccctagatgatcccaatctcttgcacattcacatccatgaagggctggcaacttgtcgatatccctttgtcgatcgtctcatggaatccaaccagttcttaggttggaaaccgctcaacctagagcactacgatggaactacagatccagatgaacatctagatgcattcttcaccgaggataatctctacaacaatagtgatgcaatcatgtgtcaagtcttcccaacatcccccaaaggggaaacattgccatga

SEQ ID NO: 79173 - DNA, 999 bp, Glycine max
  Peptide Sequence Number=SeqID_195951
atgttactttcccaggaaaacaaaggaaagcggtcactgagtagtgtaaataaaatgattgataatacccaaatgcattttggagaggtatctactgtttctatgaagtttgagtcattcagggcacagcatttttgtttgttaatggataacctatttgttttagaagaaacgtttgctgattatgaagcactgaggttggaaaaggctattatattgcaactagaaaagcttggtgctcttaagttattcaatgtttgtctatcaagatcacttggaacctcacctgtgtcagactatgctgacaaagaagatctattaggtttctcagcttcagttgtgaaaagagtgccgaatactaaaaataaaagaataatagttgctaaaagggaggcagagatatcaaaaggtttaaaggtgctagcagagttagagaaaattaggacagctatagaagaggataccaagcaagtagcaagcttgagtaacggggcagaagcatctggagttgatgagaaggtgctacagcagctattgcatcatggctattattgtcgggatgaactcatacaaagtactcattccttagttctataccttgccagaaaatacatgggtatgggaatagctttggatgatttacttcaggcaggatatgtaggtgttcttcaaggagctgggagatttgacagttcaaggggctacaaattctcaacctatgtgcagtactggataaggaaatcaattttaagagtggtggcacgatatgctcgaggaattgtaattcctccgttgaacagggcaataaatcagatccagaaagctcgaaaagccatgaaatgcatgcacaagaaatgcccagatgattatgaaattgcaaagatgacaggtctttcactggataaaatcaaatcagctagcaattgtctgagaatagttgcttcacttgatcagaaggtggggaaccaccttggtgtagaatatatggtaagactatga

SEQ ID NO: 79174 - DNA, 600 bp, Glycine max
  Peptide Sequence Number=SeqID_195952
gttcatgtgttgcctagagaggtgtttgggaagtcaacgttcgaattggcggttttgatgctgcaatgggtgccactttggttggttgacaagattctattggtgttggcatggttggtgctgggtaacatggagagattcgggctcaaaaggccttcggagggtccattgttgctgaagaacacaaaggggaagacccctgttttggacattggtaccttggagaaaattagatccggtgatatcaaagttgtgccagagattaagaggttcaccaatggctgcgttgagtttgttaatggtgaaaagcaacatgttgatgcagttgtgcttgcaaccgggtaccgtagcaatgtcccttcttggcttcaggaaggtgaatttttctccaaaaatggattcccaaaatctccattccctaatggttggaaaggaaatggtggactctatgctgttgggttcacaaggagagggctctctggtgcctcatctgatgctatgaaaattgctcaggatattggccaagtttggaaacaagagactaggcaaaagaaacaacgcaccaatgcttgtcatagacgttgcatttctcagttctaa

SEQ ID NO: 79175 - DNA, 216 bp, Glycine max
  Peptide Sequence Number=SeqID_195953
atgacgatttactcctggaaattctgtgtgggttccagtgaaggctctcatgcgattcaggtctacgatttgccagaagagtcctccaatattccagtggcgtttgggtttggttactatgattggagtgacacttacaaggtggtggcagtgttttctaatgccgaatcacagaaaatagaggtgaaagttcactgcttgggtgacccttgttag

SEQ ID NO: 79176 - DNA, 522 bp, Glycine max
  Peptide Sequence Number=SeqID_195954
atgaagatgatcgagtctctgaaagtttgctacgaagaaatgaaaaacgggtggataaaggagaagggatccaaatcagtgctaattcctgagaatgggccagaagaagcagttaaaaaacaggacttgggatatgttggggacaacaataattgccaaactgaaactaaatatggaagggagtcaactgtggtgcatagagctaaggcacaaagcgaatcatcatcctccttcaaggtccacaacaaattcaaaaaatcctcgttgggcagaattttgaagaagggcaggaatggtcagaattcaaaaccaagtagcaccaactttagcaattctatctcaaagaatggtgttaaaaactgcaatagaattttttggataaagaatgcactggctgaatccaataatgcatgggacttggggacatcaatgggggtgacatatggtggagataataaagtgataataaagggagaagtgggaaaaaggagcggagtggggtgcaaagaaaggtttccatga

SEQ ID NO: 79177 - DNA, 327 bp, Glycine max
  misc_feature (327)..(327): n is a, c, g, or t
  Peptide Sequence Number=SeqID_195955
atgttccattcaaagcctctcagtgcttgtgctgctcttgtcctttttcctcgcttaagatcacccaagagagaacctaagacacacaacacagactcacacaaagagttacaagagaaatcatcatggcatcagcagcatctggatgagcctgcagcggcggcacccgccaccgccacacccccagctgaagctgaagctaaaccaaagccaccacctattggccccaagagaggtgctaaggtgaagattcttaggaaggaatcttactggtacaaaggcaccggttcagtggttgctgttgatcaggaccccaacactcgctan

SEQ ID NO: 79178 - DNA, 1624 bp, Glycine max
  Peptide Sequence Number=SeqID_195956
accgagcggctgacgcgtgccagccagcgcctgctgggcggccagcggctggcaccggagttcagcgaggccgatatttcgccgctgttccgcgccaacggcacgcaaatgcctgactccgacgaatatgcgcgtttgctggcgaacgggtttgccgactggcggctgcgcgtcaccgggctggtgcaacagccgctgagtttatcgctcagcgatctgcagcggttccccagccgcacgcaaatcacccgtcacgactgcgtggagggctggagcgcgattggcaaatggcagggcgtaccgctcggactgttgctggatgcggcgcgcctgcggccaggtgcccgctatgtggtattcctgtgtgccgacgagctggagcagacgctggacggcagcgggcgctactacgaaagtatcgatctgcaggatgcgtggcatccgcaaacgctgctggcctaccgtatgaacgatcagccgctgccggtcgcgcacggtgcgccgctgcgtctccgggtcgagcgccagctcggttacaagcacgccaagtatctgatggaaattaaagtggtggattcgtttgcccagctgtggggcggacgcggcggctactgggaagatcgcggttacgagtggtatggcggcttttctaaatctggctcctctgactggactcgaaccagtgacatacggattaacagtccgccgttctaccgactgaactacagaggaatcgtttggaacggggcgcatattatcgggcaggctgtggcttcactgcgcctgattgtgagagatgtcaccaatgctatgcaaaattacattctgatttgtcgcttctgtcagatacctcgcatgtgcagcatgaacaaagtcagaatcggtatgattggcagtggatatattgggcgttgtcacgcgattgcctatgcgcaggcacccacggtgttcgccctgaagggcgagattgtgcgcgagatgctggcagaggtgaatccggcgctggcggcgcagcaggcggcgacgtttggctttgcccgttcgacgggcgactggcgcgagctggtgcgcgatccgcacatcgacgtagtcgatatctgcgcgcccaatttcctgcacaaagagatggcgctggaggcgattcgccacggcaagcacgtctactccgaaaagccactgtcgctctcggtggccgatgccgaagagatggtgcaggcggcagagcaggcgggagtgaaaaccctggtgggcttcaactacatgaaaaaccccaccagccagctggcgcgggagattatcgcgcgcggtgagatcggcgaagtggtgcacttttacggcacccataacgaagattacctggcgcgcgcggagacgccgctcgactggcactgccagaaagcgctggccggtctcggcgcgcttggcgatctggcggcgcatatcgtcaacatggcgcactatctggtcggtgatattgatgaggtgagcggtgacatgatgacggtgatcaaacagcgaccagatcccaaggcgccgtcacgtctgctgccggtggaaaatgaagatcaggccagcgcgctgctgcgcttcaagaatggcgcgcacggcgtgattgaaacctcgc

SEQ ID NO: 79179 - DNA, 226 bp, Glycine max
  Peptide Sequence Number=SeqID_195957
atgaggatcaaaaggtcttttaaggttgtaatggggccaaggacaaggtacctggtggatcaacgttgcattcaggcactatgtgatctcttggcttatccaaactcagagattgtgtcaaactgtctcgaggggctagagaacattttggtggttggagaagttgacaaggatattgatagaggcaatagctttgctgaaagggttgatacgtgtgatggatggg

SEQ ID NO: 79180 - DNA, 183 bp, Glycine max
  Peptide Sequence Number=SeqID_195958
atgacctgtgggtccggtggcaagcggagacgccctataggactcaagagtccggtagcacgcagagaccaatgtggtcatctgcacctttcctggagatgtcagcgtcttccggtcgagactgcgaaaaagtctcgtttgctatccgttagaatcaagggtccggtagcatgcagtgactaa

SEQ ID NO: 79181 - DNA, 705 bp, Glycine max
  Peptide Sequence Number=SeqID_195959
atggtgtgcatgtttatgagcggctgggagatctataacgcctcgccgctgttcgatttccgctttccgccgcagatgacgctgggcggttggctgggcggcgcgattggttggcatttggcgcggccattttcgccgcgatctgttgccgcttcgcgtcggcgcgctgcggcaggatatctggctggcgctgacgctgcgcctgcgccaccggcatggccactacaacgccattcaaaagctgatgtatctcggcgtgctggcgctgggcctattgctggtgctgtccggcctggcgatttggaagccggttcagctgcagggattggtcgccctgtttggcggcttcgatttcgcgcgctacgtgcatttcttcgccatggtcggcattggcctgttcgtggcgatccacgtctttatggtgatcgtcgtgcccaaaacgctcgccgcctgatgctgcgctccggcctgacgctgggcggcatcgccatgctcaccggttgcaacctgcaagacggcgatcgggtggataaggtgctgtgggccatgtcgcgctggaacgaccgggtgcaggcctggctgttcagcggccagcggctggcgcaaacttaccggcccgatcagattacccagcctttccccttcaacgcgttttacccggaatacaacgtccccgagatcgatctggccggctaccggcttgaa

SEQ ID NO: 79182 - DNA, 106 bp, Glycine max
  Peptide Sequence Number=SeqID_195960
atgccaacgtcatcacatcagctcggcggctcctcaccagaatcttactccctagaccctgctgctgtcattctgctcccacgaacaatgtttgtgatcatcacag

SEQ ID NO: 79183 - DNA, 249 bp, Glycine max
  Peptide Sequence Number=SeqID_195961
atgggcttagaaatctaccctgaggttcatgagaaccctagggccttctttaggagctctagcgcaatcctcttggagtattctatccaatacccttggggtgtaataatgagtttggagcggagtgcatatttgtggcttagaacgatgcatgtggtagtggtgggagatggatgtcggtgtggtgttgggtttgttgcagtggtggtgttgggtacgacgatggtgttgggtggaggtggagtctag

SEQ ID NO: 79184 - DNA, 861 bp, Glycine max
  Peptide Sequence Number=SeqID_195962
atgtgtcctcctccttcgagtctggaacccctgcgaattgattgcctagcgctgttcgccaattctccattctccaattttattcggagccccatgaattcattgcctagcgctattcatgtgtcctccaccttcgagtctggagccccgcgaattgattgccttgcgctgttcgccaattctccattctccacttttattcggagccccatgaatttattgcctagcgcagttcatgtgtcctccaccttcgagtctggagccctgcgaattgattgcctagagctattcgccaattctccattctccacttttattcggagccccatgaattcattgcctagcgcttttcatgcatactccaccaacgagtctggagccccgcgaattgattgcctagcgctgttcgccaattctccattctccacttttattcggagccccatgaattcattgcctagcgctgttcatgtgtcctccaccttcgagtctggagccctgcgaattgattgcctagcgctgttcgccaattctccattctccacttttattcggagccccatgaattcattgcctagcgctgttcatgcatcctccaccaacgagtctggagccccgcgaattgattgcctagcgctgttcgccaattctccattctccacttttattcggagccccatgaattcattgcctagcgctgttcatgtgtcctccaccttcgagtctggagccccgcgaattgattgcctagcgctgttcgccaattctccattctccacttttattcggagccccatgaattcattgcctagcgctgttcatgtgtcctcccacttcgagtctggagccccgcaaatttga

SEQ ID NO: 79185 - DNA, 887 bp, Glycine max
  Peptide Sequence Number=SeqID_195963
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagtcattggtattcttgtcgcattatggtgccattacacagtatttctacacaaatcacaccctgatgctacgcttccaatttcaataagcaattatataaagaaagagtctttcaaagtcatttcaacatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 79186 - DNA, 327 bp, Glycine max
  Peptide Sequence Number=SeqID_195964
atgatagaccaaggccggcttgaggtcggcagtgaggaggaggaggaacaacatgtatacatgcagtcggcagatgaggaaggtcctaaaaggcctaaacctttgaggtatgcccctccgggcggtaggaaggaagaagttaccaatattagttcactatcggccaaagtgaccaatatcactgggctgagcggcataacccgtagcgttcgcatgttcgcaccccctagtctgctgatacagccctcaaacactaaaaggaaagcaaagatgaccgaaggacaaaatggcaaggtgatccccgcaccggcgaggatgttccgatga

SEQ ID NO: 79187 - DNA, 258 bp, Glycine max
  Peptide Sequence Number=SeqID_195965
atgtcttgggctacaggaactcgccggcctcctcgagtgatacctctttcttgccgcagccctctcttccctcggcaaaatccttcatcggaacatcctcgccgactagggggtgcgaacatgcgaacgctacgggttatgccgctcagcccagtgatattggtcactttggccgatagtgaactaatattggtaacttcttccttcctaccgcccggaggggcatacctctacggaactgcgcggctgtcatggtaa

SEQ ID NO: 79188 - DNA, 558 bp, Glycine max
  Peptide Sequence Number=SeqID_195966
atggcccgcaccaagaaaactgggcagataatgtttgaggcagcaaaggaaatcgttgacaagattggatcagctggaggatcgatcatagaaaaagtgactcaacagctgatgttatccttcaaccagatgcagtcccagttgcaatcacagatccaatcacagggacttgcactgcctccggagcctgaggttggtccctcagctactcgtgtgagcacaaaagggagttgtgttgatccctcaccgaccgatctagagacaggtgacctagacaaatgcgggttatacatcaaagacaatccttcccacctggttgccctaggaagagtttatgagggatccatagtggttcacaacatccctttgttgcatggccaagtcaaggtaggtgttgagcaggttaaagatgcagaggctcccgttcctgtacccactgacgaggttaatttagtggggcagacacttaagaccttccttgcttggccgacacatctcatgaagcgtgtatcagaacaagtattttactcttattatatgcttctttttttcaattga

SEQ ID NO: 79189 - DNA, 282 bp, Glycine max
  Peptide Sequence Number=SeqID_195967
tttgaagaaatgcataaatgccccaagtgtagggtatcatggtacaaagtgaatgatgatgacgagtgtagcaatgacgaaagcataaagaaagaccccccaatgaaggtgttatggtatcttctgatcattccaaggtttaagcatttctttgctaatgaagatgacacaaaagaccttacatggcatacagatgggagaaactgcgatggaatgctctgtcatccagctgattcctcccggtggaagaagattaactgtttgaatctaaattttggctaa

SEQ ID NO: 79190 - DNA, 752 bp, Glycine max
  Peptide Sequence Number=SeqID_195968
acgtcctcgccaacagagggctacacgctctcaccttcagaggactacacgtcctcgccttcagaggactgcacgtcctggccatcagaggactacacatccttgccaacagaggactacgcgccctcaccttcagaaggctacacgccctcgcctttagaggactatacgtcctcaccatcagagggctgcacgtcctcaccttcagaggactacacatcctcgccttcagagggctgcacgcccccgccttcagaggactacacgtcctcaccatcagtgggctacacgccctcacctttagaggactacatgtcttcaccttcagaggactacacgtcctcgccttcagagggttgcatgccctcgccttcagaggactacacgttctcaccatcagagggctgcacgtcctcaccttcagaggactacacatcctcaccttcagaggactagacgtcctcgccttcagagggctgcacgcccttgccatcagaggactatacgtcctcaccttcagaggactacacgtcctcaacttcagagtgctgcatgtcctcgcctttagagggctatgcgtcctcactttcagtgggctccatatccatgccttaagggattgcgaccacaaggcacccagtggacccggaggagcccaacagggccctggggtttccagctctggttacaggcctctgtcagccctacagggtgcccgtccaccccagaaaggtcatgccatcgtgaaataa

SEQ ID NO: 79191 - DNA, 294 bp, Glycine max
  Peptide Sequence Number=SeqID_195969
atgatgaaggaaatgtgtgaggatttcaagatccaacaccaaaattctacgccttacaggcctaagatgaatggggcagttgaggctgctaataagaatatcaagaaaatagttcaaaagatgactatgtcatacaaggattggcacgagatgctcctgtttgctgtgaattatgaaggaccttttgttgtgaagaaggcgcttttgagaggggcattgttgcttgcccgcatggatgatgaagaattgccttcgcccgtgaattctgatatcgtcaaacgatattatgcataa

SEQ ID NO: 79192 - DNA, 390 bp, Glycine max
  Peptide Sequence Number=SeqID_195970
atgtcgccgaggtggacaatatgggtacgcatattccagacaaccggttacactgataatagcggagcacgcgaactgatgtgtattcgaatcctaggagctagtaatcgacgatatgcttatattggtgacattgttgttgctgtaatcaaacaagcagtaccaaatacgaacttagaaagatcagaagtgatcagagctgtaattgtacgtacttgtaaagaactcaaacgtagcaacggtataataattcagtatgatgataatgctgcagttgtcattgatcacgaaggaaatccaaaaggaactcgaatcttttgtgccatcgcccgggaattgagacagttaaatttcactaaaatagtttcattaagccccgaggtattataa

SEQ ID NO: 79193 - DNA, 114 bp, Glycine max
  Peptide Sequence Number=SeqID_195971
atggtgatgctgcaaaagcacaatgcagaagcacataagattcagtataaaaatggatggcattgcactgctaggatattgaagactgaaggagtatggctaattgacctttaa

SEQ ID NO: 79194 - DNA, 141 bp, Glycine max
  Peptide Sequence Number=SeqID_195972
atggcttcaaagcacatccttaaggagctcaaggacttgcagaaagacccaccaacttcttgcaggtcaagttcaaggtacaaggaatatgtgactggcttgttcactggtgttgtcgtagtagccactaccaccctttga

SEQ ID NO: 79195 - DNA, 277 bp, Glycine max
  Peptide Sequence Number=SeqID_195973
acaagacacccagtggacccggagaagtccaacagggtcctgggtttccagctctgattatgagcctctgtcagttctacagagtgcccgtccccccagcaagttcatcaggccccctattaaccgggctttcatcaagaagtactgtgcccccaggcaggcgcagggcgagacaccacagcagcctagggatggccggcagcgggcaacagatgcaccgccaccacctctagagttcacctcagctcatccacaaaaaggtagaaagataccttag

SEQ ID NO: 79196 - DNA, 204 bp, Glycine max
  Peptide Sequence Number=SeqID_195974
atggcttctaccaattcatctcatgctttttattctcagtgttgtcgctatatgtttatgaatgctattgaatcctttcactctgtcactttaccgtctgcgaatgatgccaccgatgctgacccacctccattgaccgcggatactccatcgcggtttgctcgattgttcaccaaaacatcttttcaggcaaccatgaatgat

SEQ ID NO: 79197 - DNA, 276 bp, Glycine max
  Peptide Sequence Number=SeqID_195975
atgcatgaacgaaaacgcaattcatggggctccgaaaaaaggggtagagaatggagaattgcactaagcaatcactacgcatggctccaaactcgtgggtggaggatgcatgaacgaaaacgcaattcatggggctccgaaaaaagtggtagagaatggagaattgctctaagcaatcactacgcatggctccaaactcgtgggtggaggatgcatgaacgaaaacgcaattcatggggctccgaaaaagggttagagaatggagaattgcactaa

SEQ ID NO: 79198 - DNA, 297 bp, Glycine max
  Peptide Sequence Number=SeqID_195976
atggcttcaagaaaaaggaaaagcacttcttccaggccccaacctaactatgatacacgaaagtttacctcagaagaagcctggaacagatatgccgacaacatcctcgaccggaacatccttcaggagaggaacgccaagctctatatcacggagtttgaagagtttagaagggagttggagaggcacaacccgcacaagtgtctcaccaacttagctgatggcagtattgatgttgcagtggtcaaggaactctacgcgaacctctataaccctgaagataacttaccaaagtag

SEQ ID NO: 79199 - DNA, 297 bp, Glycine max
  Peptide Sequence Number=SeqID_195977
atgctcctcagaatttctgctcagcccatattcctccttgcgggcccttttgctgatttgaacttctccttggcgagtcttgccttccctagctccaattttagagctcggtggagtcgcgaactgtcgcaacgtgcccttcgcgggcgagcgagggcgaggctcacaggtgcgctttccaaaggaggaaaggtgtgcggagtcgccaccaacgtttatttgtggaaaacgtcggaaaaatcgaaggaaaccggtcaaaatgaaaattctaagttcgggagttgtatttacgcttga

SEQ ID NO: 79200 - DNA, 651 bp, Glycine max
  Peptide Sequence Number=SeqID_195978
atgtcctcacctttagaaggggctagacgtgctcaccttcagaggactacacggccttaccttcagatggtacatgccctcaccttaaaaggactacaagtcctcgcctttagaggactacatgtcctcacctttagagtactacacgtcctgaccttcagagggcaacacgtcctcaccttaaaaggcccacacgccctcgccttcagagggctacacaccctcaccttcagaggactactcgtccctgccttcaaaggactacacgtcctcactttcagaggactacacgtcctcaccttaagagtgctacacacccttaccatcagaggactacacgtccccgacttcagagggctacatgtcctctcctttagaagactacacgtcctcactttcaaaggctacacagtactacacgtcctcgctttccgaggactccacgtcctcgctttcgtggggctacacgccctcccctttagaggacaacatgccctcaccttcagaggactacacgtccccgccttcagatggtacacgttctcaccttcagatgactacatgtgctcacctttagatggctacacgcccccgccttcacagggcttgatgccctcaccctcaggggactacatgtcctcgctttcgtag

SEQ ID NO: 79201 - DNA, 483 bp, Glycine max
  Peptide Sequence Number=SeqID_195979
atggttagaacacgaggtttaggtcgtgcgttaggagctggtaaaggtagaggcattagtgaggatacgcatgaggctgatgttcctctgtgtcgcagacctactgcttcagcacgtaggcaacaggttcgtctgcgtgaggacgtgacagagagacctgaggatgtgcctcagttgcatgaggatgttcctcatgtgtctgatgccaccccagagatgacaggcgccgctgatgctgttcaaaccgaaggagtggctactgatgggagcttggggtcacctgctgcagatgaaggtttccccggtggaccacgcgacccatcgattttgaccgattttgctgagcatgaacaacccgatctgaagttggtctcccacggtagaaaagtagataaaattgggagaccagcgcctgagatcgaaagggttggttgctggcaccggattaagtccactgatcaggtgttctgttatcaccactga

SEQ ID NO: 79202 - DNA, 183 bp, Glycine max
  Peptide Sequence Number=SeqID_195980
atggagattgctgggtgcacggggaagaaacaagcgcggaagcaagatgagagggaacctatttcttttcttacaaaaatgtggggggtgaagatgagagggaagagggaagaggggagtgaggggcgtaaaataggcgagttgagtcaagataaatacttcaaatttaggtttggcttgtaa

SEQ ID NO: 79203 - DNA, 459 bp, Glycine max
  Peptide Sequence Number=SeqID_195981
atggaacctatgagactccatcaacatgaagagaatgataaaaagaggaaaggaatagcattcaaagcctcatcatcttctattcaagaagaaagtgacaaagaggacttgaatgaaataaaagaagatgatgatttcagattttttgtgaagagattcaacaaatttctgaaaaacaaaggaaatcaaaggagatcaaatatcaatccaaagaagaaaggagaagattcctccttagccccaaaatgctatgaatgcaatcaacctgggcacttaagattaaattgtcatgtccttaaaagaagaatggaaaaatccgacaagaaaaatttcaaagaaaagaaagcatgcatttgggaagataatgacatggattcttcaagtaattcagaaaatgaaatcataaatctgggtctcatggcgaaagactatgaaagcgaagaagagttggcacattga

SEQ ID NO: 79204 - DNA, 938 bp, Glycine max
  Peptide Sequence Number=SeqID_195982
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccattcaatcagtggtgctctcgcccgaccaccgcaggaaaccactgttatgcagtgcgtgaccctcacgatattgcagtggttgccatcgctatcgccggagcgtgttttgggtttctgtggtggaatgctaagcccgcccagatctttcttggcgacaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 79205 - DNA, 384 bp, Glycine max
  Peptide Sequence Number=SeqID_195983
atgattatgaggggccaagacatttatagtagccaagataaggctactacttcaccttcctctagtgaaagtgaagaagcaaaaggggaagaatctagtgaagaaatctacccccaagaagatggacaaccattagcgattaaagagaagtgtaaggaggcacttgctagcattgccacacctcttgggcttgagtttattcctcaagtaaagttgttggatgagggtttggttcgcaagagcttaaatccttgtgctttgttggtgcccaaaataggtattattaggcaccaagtccctaaaataggtggtatgatgaatgttttgagtggtgcaaccctcttttgtaaaatcactcgtacacctaacatcttcatggaataa

SEQ ID NO: 79206 - DNA, 612 bp, Glycine max
  Peptide Sequence Number=SeqID_195984
gaactgcgcaacggcgacaccatcgaggtgggcaaatacaagattcgcttcttgcaggatgcagacgcccagaacttcgagaagaccatggtgttcaagccggggatggctccggcgctgaatgcggcggcaaggcccggtggtgtggccgcgcctcctgctcctatgaatgccgttatccgggtgctctcgggcgcagcggctggccgtgaagttgccttgcacaaggtggtgacaaccatcggcaaacccggtgttgctgttgcgtccatcaccaagcgcattcagggcttcgtgctggcccatgtggaaggccccgacatgcccttgctcaatggtttggcgattggctccagccctgtcccgctcaaaagcggcgacaagctggaactcgcgggcaccgagatgcacggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 79207 - DNA, 444 bp, Glycine max
  Peptide Sequence Number=SeqID_195985
atggaggccataaaagagcaaatggccacaatgatgaaggccatgatgagcatgaagaagataatggaagccaatgcggttatagttgccgctattagcgctgtcgctaaggtgaacccgatgctcccatctggcctcaagcaaatgaatcatccaacctcaaatatgccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggtggatcatctaaaggaaaggctcagggccattgaaggaggtgaagattatgcctttgctaacctagaaaagttgttcctaatacccaaacatggtcattcccaagttcaaggtgccggactttggcaa

SEQ ID NO: 79208 - DNA, 314 bp, Glycine max
  Peptide Sequence Number=SeqID_195986
gggataacatagcaagtcaacaagaagatgctactgtagcaacaacaggggtacaccaaccaaacaaagaggtgcaattagtgagtaaaactaaaaagaggattgcaaagtttgatatcgcagaagctacgaaggtgaagacgaaggttatgtcaacagtagcgacgagatggcggcaatttaagtccacattgactagcaaatttgtgtttgctaagagtgaaggtcaacaaacgcaggatgttgtgacaaaatatggactagatcctgaagcatggaaacaatttgaagaaacccggctcacacctaactag

SEQ ID NO: 79209 - DNA, 795 bp, Glycine max
  Peptide Sequence Number=SeqID_195987
atgaagtgtccacaatcattggatggttgcttggtagagttattagtgaaaatagaaatagaaaatattttccttatgtcaaacaggctcctgattttcagtttcctcagacttgtgttgtcatgtgcgataagcaacatgctctctactatgacatttgtcatggctgctattttcaggatggagaagttaaacgtgagaaaagtaagatgccaaccaaaggtgattggaactgtagtaacagttgttggggccatgttgatgacattgtacaaagggcaagtaatcagtttcttcgggtctaagtacatgcatcacccaacaaactatgtacctgaaaacaacactgattctggtgaaaaggattggttcaagggttctgttcttctcgtacttgccaccctttcatgggcttcttcatccttcaggcaagcagtgacattaaggaaatacactgttcagctctccctcacagcacttgtgtgtgccttagggaataatataatcaggtatcacctactatgttcaagggattgtcatgcagaaaaaagggcctgttttcgttactgctttcagccctttgatgatgattatcgtagccatcatgggtgccttcatccttgcagaaaaaatatatcttggagggtgctagggacaccgacgttgacatactggcaaacaacgtcgggcctttctaacccgacgttgaaatggaagcatacaacgacgtgtcttgggctacccgacattgaaatgggacaaaacaacgacgtgttttgggctacccgtcattga

SEQ ID NO: 79210 - DNA, 237 bp, Glycine max
  Peptide Sequence Number=SeqID_195988
atggaggatagggtcacgactgaccgatcgtcgtcccttcccgcgctggacgagcagagaacgtcgctgcaaggcaccctaatttcgtccggggacctttgcttggtggcatgcgactttcatttaaccattttgagaaataggggtgcaaatagcaaccaggcccacctaggccctccagaagattcctcccgaaggcggttgcttctggaggaagcaccttgctcgcctgggtga

SEQ ID NO: 79211 - DNA, 189 bp, Glycine max
  Peptide Sequence Number=SeqID_195989
atggcgactccactagggatggagtggaggtttatctgtggtcatgttgggtctccgactcgcttgataacaatgaaggctcatctagagttttcttcctttggtgatgcactgtcattggtagtccctaacgccacaatgttgttacctaagaggatgatatctttagaggccgataaagctacatga

SEQ ID NO: 79212 - DNA, 407 bp, Glycine max
  Peptide Sequence Number=SeqID_195990
atgattcctaggcgtaagtcatgctcctttgtattgagattaaaagcttcggttcctaggcctagaatcgcattcgggcacttattttatcctcaacgtgctgtcctcatacatataaatcagccccgcggtccaaagctcaaaaaaccatgctcatatatcgttgaggcatttcaccgagcacttggtgggcgcatgtttaggcatgaatatcaagagaatgggggcaatgtggcatgccccattactttagaatgcaccctaggcctaaggccatcccttacaacccctcaattcaacaaaaacaagcgacaattcaaggataaatccctcacgttttttagcaaatacaagcaacttagagcaccaaaatacatcaatggaaagctagagagcccaagaatgag

SEQ ID NO: 79213 - DNA, 1043 bp, Glycine max
  Peptide Sequence Number=SeqID_195991
cgtcgtacgcgtattccggccaccctcggtgcgctgctgtccgtactggcaacgccttttgtgcctgccgcgcaaagatgctaaatagtttagtgattgccggcatcacgctgctggctgcagggacgtatgcgattcgctttgccggttaccggctgggcagccggatgcacatgtcggaacgtgtgcgcaacatgctgtccgacgcggcaacggtgctgctgctggatgtctctgtcaccaccgcgctgtttgagggcaccgatttcgccggcgttgcgcgactgaccggcgtgttgttcgcggtgtttctcgcctggcgtcgcgcgccattgatactggtaatcatcggtgcggcggtgatgacggcgctgctgcgctattttggcgtgccggatagtgagtacaacaaggacaacgcgaaaatggtgattaactgcgtggtgtatcgccacggcaaacgcgaagagcatgtcgaagtcgatcaaatcagcgaagtgctgaaagaggagaaatcgttcgtctggcttggcctgtatcaacccgatccggcgttcatgcaaacgctgcaggaggagtttagcctgcatgagctggcgattgaggatgcgctggtggcgcatcagcgtcccaagattgagcagtacggcgaatcggtatttatcgtggtgaaaaccgcacacatggaagatcgccagcgcatcagctttggcgaaacccacttttttctcggcaaaaatttcctgattaccgtgcgtcacggttcggttgagggctataaagcgattcgcgctaaagccgagaaaaaccatgccatgctgtgccagggacccggctatgcgctctactgcatcctcgattttatcgtcgacaattacagcaaaatcaccgaatcgctgagtgaacgtattgctgacctggaagacggcatgttcaccacccgctttgacagcgtcacgctggagaatgtttaccatttgcggcgtcagctgctgtcgttgcgcaatgcggcgatgccggtgacagagatctgcccgcagctg

SEQ ID NO: 79214 - DNA, 138 bp, Glycine max
  Peptide Sequence Number=SeqID_195992
atgtgcaagtgcagaacactagatatatggaagacacgagctcaacgagaaacttctgagaatgagcagtacggaactcaaaaccaggtgcgaccattggaattttgttatttgtacacggactttcaagaattctga

SEQ ID NO: 79215 - DNA, 2107 bp, Glycine max
  Peptide Sequence Number=SeqID_195993
atgctggtgtttatggtgacctcgctggaaaccatcggcgatattaccgccacctccgatgtctccgaacagccggtcagcggtccgctgtatatgaagcgtctgaaaggcggcgtgctggccaatggtctcaactcgtttgtgtcggcgctgttcaacaccttccctaactcctgctttggtcagaacaacggggtgattcagctgaccggcgtggccagccgctacgtgggctttgtggtggcgctgatgctgatcgtactcggcctgttcccggcggtgagcggctttgtgcagcatattccggaaccggtactgggcggtgccaccatcgtgatgtttggtaccattgccgcttctggcgtgcgtatcgtgtcgcgcgagccgctcaatcgccgcgccattatgatcatcgcgctgtcgctggcggtgggcctcggcgtatcgcaacagccgctgattctgcaatttgccccggactggctgaaaaccctgctgtcatccggcatcgccgccgggggtatcaccgctatcgtgcttaacctcgtctttccgcaggaaaagctgttgagctgtaacggtaattcaggcataacaaccactcaccggataaatatcgggatggatggatgcgatgaaatttttaggcaagtttttccttaccttgttactgctgattctgctggcgctggtggttctctatgtgctgctgcaaacccacacaacttctcctcgccttcccacatcatcctggatgacttcagcttcggccacgacggccagccggcggtactggtggcgaagcgcgtcgatctcggtctggcactggtgcagttcagcgatccgctgcatttcgacagcattgaagtgcgcgacggcgacatcaacctcgctaaccagtcaccacaaaccacgctgccgattcaggccaaccggctgcagctcaataacgtgcagatcgaaagcccgcacagcgccctgccgctggcggcgcagcgggtaaacggcggcattgtgccgtggaagcccacgcctgacgatatgctgggcagcgatgcgcagtttcagatgagcgcaggtgccatgacgctggacggcgtcgccggtaacaacgtgctgctgcagggcaatatcgccaaacgccggctggtgctgagcaatatcggcgccgatctggcgcgcggctcaatgaccggacgtgccgagcgcgacgcgcagggtaattggcaaatcaaccagctgcgtcttaacgatattcgcctgcaaacccagcagagcctgagcgagttcctcagtccgctgcgtgacgtgccttcggtgagcattaaccggctggatatgaccgatgcgcgcctgcagggcccggactgggcggtgaccgatctcgatctgaccctgaagaacattacgctgcgcggcgatgactggcagagcgacgacggttcgctggccatgaacgccggcaactttattaacggcagctttgaactcaacgatccgatcgtcaatgccgaattttcaccgcagggcattcagctgacgcagttcagctcccgctgggtcaacggcgtgattcgcgccagcggcagctggacgcgcagcgataagcgcctgacgcttgacgatttagccattgccggcctggaatacacgctgccgcaaaactggcgcgatcgctggcagcagacgctgccgggctggctggatagcgtgctggtgaagcgtgcgaccgctaaccgtaacctggtgattgatattaatccggccttcccgttccagatgaccgcgctcgacggtaatgcagaaaatctgctgctggcgcgccagcatcaatggggcatctgggccggtaaagccagctttaacgcggcggaagccacctttaaccgcaccgatttgcgccatccgtcgattagcctgaacgccagcgatcggcagattgaggtcagcgagatgagcgcctttaacggcagcggattgctggaaggcacggcaaccgcagggcaggaagcacagcgtccgtttacgctgaacctgaaaggccaggcggtgccggcaaacgtgctgcaaaactggggctggcctgcactgccgctgagcggtagca

SEQ ID NO: 79216 - DNA, 213 bp, Glycine max
  Peptide Sequence Number=SeqID_195994
atgatgattcctgactgccgcaagcgccttgaggccgctttggcagacttgaaaggaatattggctgagttggaggagtcagatgagaaggccagtcttgagattgatgaagctaagaacaccattgtagaagttgaaaaagttgatagcaatccactttgtcaaggagctaaaaaactcacacaacacttccacctctggttatggtcatag

SEQ ID NO: 79217 - DNA, 1209 bp, Glycine max
  Peptide Sequence Number=SeqID_195995
atgggttatgtttctatgaaagtggttctaatctccaccggggttttatccatggcaatgggtttgaaactcacactccctttgctctcgcatttcctcctcaaccaagcccctcacgtgtggaccttcctcctcacgtgcttcactcccccttacctctacatccttctcaacttcatcatcctcaccatcgtcgcttcctccaaactcaacaaccaccaccactctccgccggataccaccgtcctcctcccctccgaccccgtcatctacgccctaccacccgccgcagtccagatcctcgctccggaaaccgtcaacatctctgccgctgtacaaacggactacaacgccgtcgcctctgagaaatacctctacgaaacgaaaccgactctcagctacgacaccgttacggaaggtaacggctctgtcggctacgtttacgacgagaacacgccggtgaaagcgacggttaacaacgacgacgaagccgttggcgttgtctctccaagcctgcagaggaaagactcctcggacttcgcgttcgcaaatgaaaacttgaaaccgccggtttccgccagattcagccaccggaaatccgttagagccagtcccgaagatataaatagagaagaagatgcaatcgtatcagcagtaatgcattggattttattagaactccgcaaagtgtttgaaatgagggaaggtggtggcgttgggagtggcgaaggcgaagaagcaggagacgttggagagcacgtggaggacgataacggaggggagagcgatgccgttaacgcggcatctgaagaaggcggagacgtgggagagggagacgccgttacgggacttgaacggagggggcaaattgatgaagaagtcggagacgttcgcggggagggagaagaacgcgtcgacgaggctgaggaaggagccgtcgctgagtcaggacgagttgaaccgccgagtggaagcgttcatcaacaagttcaatgcggatatgaggctgcagaggcaggagtcgctgaggcagtacaaggagatgatgaatcgaggagctcactgactcacacaagtcacaaaacatttgctccaataatcaaattggggggaaagaaagaaaacgtgattaaacaaggttttcttgtgttgcattgcattggttttttgttcaggcaaatgatgaacgaaacacagtttgggatatag

SEQ ID NO: 79218 - DNA, 231 bp, Glycine max
  Peptide Sequence Number=SeqID_195996
atgaagatgaaacacttcttggggtccgggagaccgcttcaacgattgattatctctaagcaaaaatttgcagagcttgaggaagttccctttcagccaattgatctttcgattagatcaatgccgaagttgatggcattaaacggtgcaaaaactagtgtttcagaaaagttgttatatggtgcagctgcaaaaacaatgagacataaggctgctgttatgaaaaattaa

SEQ ID NO: 79219 - DNA, 228 bp, Glycine max
  Peptide Sequence Number=SeqID_195997
atgccgatgttggatcaatttcatccatgcattcatgatttcattgaaaacattgttgatgtcaaaactgatggtatgagtgaagattcatggtcattggtgtgcaaccagttgcttaaagaacttacaaaatggtttgatgagtacatcaacctgcttggtggcatagacagatttgaggaatcaaagcggtccgattatccatggtttccatggacaagcggatga

SEQ ID NO: 79220 - DNA, 729 bp, Glycine max
  Peptide Sequence Number=SeqID_195998
atggttagaaccagaggtttgggtcgggctttaggcagagttataggaagagccctagggagagaagaacgtcctaagctaaagttatcctcccatggaaggaaggttgataaatttggcatgcctgctccaaagattgaaggcttagtggagaggtggcataaggaaactactagtttccatcttcttgtaggagaggtgattatcaccctcgacgatgtggcatcgttgctacatcttccgattacaggggccttccacaacttcgaggctctgcatgtggacaaagttgtcttgctattagttgaattacttgaagttagtttagaagaagcaagagctgagataatacaataccatgaggcatattgttggatctatgaacactttccttttgttgcttattctattgctgtcaaagattaccatgaaaggaaaccacctgtctgtcgttggaagtctgggaaggcattaccagtttcgacatatcacaagcgtttggatagattgatgtctaatgttacgtgttggattccctatggtgaccaccgtgcattcagagagtttgagattatctctttattttccagacatatcagatggggtccatctattatcatacatcgaccagagagggttgtacgacaatttgggtatgtgcagaccattcctccacaccctgttgcttcttctctatgtattgaagacatcgatgatagatggatttag

SEQ ID NO: 79221 - DNA, 270 bp, Glycine max
  Peptide Sequence Number=SeqID_195999
atgagtctggcacaaccaggggatcctcctagacattcgcccatggtgcacaataacacatttgttgaaccagatgttcctcagcacccgatggcggcaactattatggacaaagcacttgcagatgcacatgttgatgtagaccagactcaacatgcagtggcttgcctatccatagttgaaaggttagaaaggttgctcaacctaaagatagtgatcgaagggacaaaaacatacactgtcattgaagactacctaaggatcgcatga

SEQ ID NO: 79222 - DNA, 207 bp, Glycine max
  Peptide Sequence Number=SeqID_196000
atggagcaagacggtgtcgtttcgcagccagttgcgttaatggcgtgcatagcaatggccctgttctacgtggccatcctctacgctcccaccgtgctcattcgtctcccacctcctccttccttcaaagcctacatgatccgtcgcttcctatgcgccgtcgtttcctccattctctcactcttcatttccgctctcatcctcccc

SEQ ID NO: 79223 - DNA, 243 bp, Glycine max
  Peptide Sequence Number=SeqID_196001
atggtgcagccaagattggtgaggaagacatacatgctgccattgttaagttcgaaggtctctggtttggggctctcatccgccattggaattagggagagagaggatatgaatgtcaatgaatgttctgatgcgattaagtcaacgctacctcaatcaatccttcctttctctgggtttgttgattttgtagcaatgattaagagaatggcagaggagagggatatcgtacctattttttaa

SEQ ID NO: 79224 - DNA, 261 bp, Glycine max
  Peptide Sequence Number=SeqID_196002
atgtccatgaaaacctgtctgaaagccttcctaacctcagattcagaggcacctcgttgtattcttaaggtcttcatcggcgccggcggaggaggattattttctggcggcgagcaatcccaagaaatcgccgggaggaagaagttccgggagacgcgccacccggtgtactgccgcgtgaggaggagggactccgacaagtgggtgcgcgagggttttgttgagtggaagaacgatgagagggtttcagatgagagttaa

SEQ ID NO: 79225 - DNA, 216 bp, Glycine max
  Peptide Sequence Number=SeqID_196003
atgaacaaccaacacaatgtcaaaaacactattgaatccaaccaaaacactgttgaaaacaaccaaaataaccagaaccatgattttactgtcgaaaaaagcttcaagagaaaaacatatcgtgagagcaagagtgacaatgatatatacaccgttagcaagagtgagttcaacagtgacgacactgtgagtgacacgacagtggtttcaccgtga

SEQ ID NO: 79226 - DNA, 420 bp, Glycine max
  Peptide Sequence Number=SeqID_196004
atggctaacacaatgatgaagactaacaaaaaagcagaggaaatgtttaatactgttcatgttattgatcaggatgcgccgagtatcatgtatccatttataaaagttgcaagattcacccatttgaacttggaagggactacagagtgtaggatagtttataatcatcataggaagactgtaaaaattggaaatgaatggcgagcgaggcgaggctcacgggtgcgctttccaaaggaggaaagatgcgcagagttgccaccaacatttaattgtggaaaacgtcggaaaaaccgaaggaaaccggtcaaaacaaaaattctaagttcgagagttgtatttacgtttgaggaaggtcgactaaagcggggcttttgctcctacgtaccctccatcgaagaggaaatcagacctacgtag

SEQ ID NO: 79227 - DNA, 344 bp, Glycine max
  Peptide Sequence Number=SeqID_196005
aggttgaagctcataaggaaagcctcgtagaagagcatgattcaaaagaaaaagatgaagaaaaaagtgaggagaaaacacaacaatgggagaagcactcacaagtagaaattcaacaagaaagtattctccaagtcaatacccctcctcatcaactgattgtcaaggaagaaaggcatggaaaacatgagaaagccttaagtgtcattctttccttgatcgttaccacttctcttgcaataatgtggaaggtgcttccagaatacacaagtttcaaggtgcttccaaaatgtgttctttgtgaccttcatgccaccttgaagacatttgacctgtcaagctaa

SEQ ID NO: 79228 - DNA, 540 bp, Glycine max
  Peptide Sequence Number=SeqID_196006
atggacgatgaagcaataaaattatctggttcaaataggagaccacattctgaaataactaagaactccaaaagaggaaatgcgaaagccaatatggaaactgataatttagactctgttcaggaaccaaaatcagaaacgcagttgaatactgtaccaaggaagaggggccgaaacaaaacctgggaaatcagccaatccagaaaggctcgcaattgcagctctccttatccatcttctgaaaaacctacttctagaaaggataagttgcatagaatgcctaaaactgttagtgaaactctagtttgtatgcagaaaagtgagaacatagcaaaagctgtccaatccagaaggactcaaaatattggcactgattttctagctaatgatacaagcaaagttcatgaagctttagcttctaagcctaaagctgatgagaatacaaatactgcttctgtaaataataactatcctgatgcaggtgctatctcaagtgctatctcaagtaaaaccagatcagaaaaacaagttcataaatga

SEQ ID NO: 79229 - DNA, 336 bp, Glycine max
  Peptide Sequence Number=SeqID_196007
atggtcattgaccaatcccttttccataacttaacccaattgtccagtgacggtgtaccatttgaagagcatgatggctcttgggtcaaaaagggtgctcaacccgctgatgatgaaggcaacctaccaattgaagataattcctctcttcttcgaaggcttttggacaagttcgatggtcttcagacttttgttggtgacaagtttgatgccatggaattgcaagtcgacatgcggttcgatgccatggattcaaggatcaccaaggttgaagaagatgtctccttcattcgtacttgctttgatccaccaccaccgcctccatcatcatcttag

SEQ ID NO: 79230 - DNA, 165 bp, Glycine max
  Peptide Sequence Number=SeqID_196008
atggtggtggaggacagaactgcatgtggatcagaaggaattgaaaatgaaacggaagaaggcaaaattgtggaagttgaaaatgatgaagattatagtgaggcagaagatatgattgtcaaggaaggttttcttgaagataatgtggtgaatctttacacgtga

SEQ ID NO: 79231 - DNA, 450 bp, Glycine max
  Peptide Sequence Number=SeqID_196009
atgaccacactcgtgcaattctctatcaaatgttcgaacttgaagcccaacttcttccaccatggcatatacaagagacccactcgctctttctctcggatagagacaaagtttggttcttttaatggcaataacttgaaactgacggcaggcagggtgagcttgttcttcttgggaggtgaagtgtttaaaaatggggttttgtgggaagagaaggggtgcaagaggaaaaagagggtggtgttggtgaagaataatcaggggtttggcttcaatggaggaggtggtggtggtggaagagatgatggtgccactgctaggattttgggaaaccttgctttagctattggattgacttacctttctatgactgggcaacttggttggattttggatgctattgtgtccatttgggtattgttcaatattccctctcgtggtttgctttaa

SEQ ID NO: 79232 - DNA, 114 bp, Glycine max
  Peptide Sequence Number=SeqID_196010
atggagccaattgatgcagcaactatatcttccgcgggtgcacgttatgcgctcccaacctttaggttacgagtgatattgtttagatggcatgtacgtgattgggttggatag

SEQ ID NO: 79233 - DNA, 300 bp, Glycine max
  Peptide Sequence Number=SeqID_196011
atggccttaattatgaaagtgcaaagatcactgattgatcatcatggacctccaaaggtgaacttttggcaagaccctactagtccatctaagtggaaagaagagcattttgtgattgtttctttgactggatggggtgtactcttctatatcggttacaagttcttcactagaggcaagggcaaaaatgaagagggctccttcttacactctggagtctggaactttcttatgaattctagtttggcatgtcttgctgcagacaattggagaatcaaacaaggcttgaggttgctataa

SEQ ID NO: 79234 - DNA, 717 bp, Glycine max
  Peptide Sequence Number=SeqID_196012
atgaatctggtattgcttgaagttgaaaagttgttaaaagccaatcaaagttcacttaaagactatccttccatgccatatcctgagaatgcaaatttactaacacatgcagacaacgacctctttttgtctgagctgaatttcaacaatgaagaacttagatctaaattccttaaccttttttctcaaatgacagaccaacaagcaaaaatttataaccaaattattcaggctgtcaataaaaatgaaggtggaatgtttttcttatatggatatggaggaacaggcaaaacatttatttggaagacacttgcagcctcattgagagctgacaataaactagttattatggttgcttctagcggcatagcttctttgttattgcctggaggaaaaacaacacattcaaaattaaaaattctcgttccgatatttgaagactcgacgtgcaatattcatcaaggaacacaattggctgaattattgaatgaagcaagtcttgtcatctgggatgaagcccccatggctcacaaattctgttttgaagcacttgatcgaagtctgagagatgttattaaggcgaaattaagttctgataaaatctttggtggcaaagttatggtatttggtggagatttccggcagattctaccagtcattcctaggggtagctgctctgatattgttaattcaactattaattcatcttatctatga

SEQ ID NO: 79235 - DNA, 738 bp, Glycine max
  Peptide Sequence Number=SeqID_196013
atgactattttgactaaaaactttgtgctacgaatcaacttcacttttgtgagctatactaatgccaatccctatgtgttcaaggagcatgctattaatgtcaatgcaaagacattgaccctcacctttgttccttccaaaaactcagttgcatttaatgttcacattccaagaaacgctcctctatcaaaacaaggcttggcagaattccaaaacgagattcatttgttatccaaactccaacacctccatattgtgcctcttattggctattgccatgaaggggaggagatgattctggtgtatgagtatatggccaatggttctttgagcaaatggctctatgaacatagtgagtcaccactctcctggaagcaacgacttgaaatttgcatgggagctgctagagggcttcactatctccgcactaacactgcggaaggcataatccatagagatgtaaaaactgacaacattctcttggatgagaattttgtggccaaagtagcaagattttggcatctcaaagaaaggtttgcggaggtgtctaaaaggtgcctggctgagaataggatcaatagaccaccaatgggttttgtcttgtgttgtttggaagatgctttgcaccttgaactcagcaacatagctgatgaggaaaattcatttttaaattatgaaatgcaagataatgcccgaattgaaggtgagctagatgccgtgttaccaattagtctttga

SEQ ID NO: 79236 - DNA, 251 bp, Glycine max
  Peptide Sequence Number=SeqID_196014
gggaagcttgtgatcacacacaatcatagcaaatcaatatctggaaaattaatttctgttcagatttatagtgggacagaggtggatcccgacaaggagaaaaccgtcgtcgtagatgggagatcccgtgagcttggccttgttgacgtcgatcggaggaagagatgggtcgccggcggtagcggggcgaagacggtgattgaggctcaccgtcgttcacgatttcagagaggtcgacaagaggagggaag

SEQ ID NO: 79237 - DNA, 246 bp, Glycine max
  Peptide Sequence Number=SeqID_196015
atggagaggaacttgccatccaagaaggccacctctctacatggcaatgcaaggaaaatcaacattatggttaccctcccagaagttgtggagatatatgtcaatgttgtgcctgtcactaaggaggacagagttcttggcaggacttatcagccagattttcagaatccagcaaagtcaggtgtggcaatgccagtggttggaggggaagacaaatatagaataacatcgcttatttctgcatag

SEQ ID NO: 79238 - DNA, 249 bp, Glycine max
  Peptide Sequence Number=SeqID_196016
atggggtggcctcaacagaaaaattgtgggaatcaaagaggattcccaacaatgcttgaatccaagtacaaatttcttggtctccctgccaatggaacgaccattgatttggagatactaagctcaagtgagggtccagggccattgaagtttggttcacgatctgttattatcaaatatagaatgaagacatgttgtagttatatacagcatggtaaccaaaagaatgtgccgagtcaagaattttga

SEQ ID NO: 79239 - DNA, 471 bp, Glycine max
  Peptide Sequence Number=SeqID_196017
atggcactggaagggggcacaacaaccttgctatcctctttgtctcgtatactggcattcgacacagttggccacgaactgtgtgatgtcatccctaagtctaggccagtgcaaattctccaagagcctagctatcatcttcgtgacccccatatgccctcctgtgggtgttgcatgatattcaacaaggagagaaggaattattgggagggtgtgatgccggagaagtcaagatgtcttggtgctaactgcggtattgtgggtgactggccaattgccgatgtagttcatcgagaaaggtcaagcaaggaacaaagaggatcattgagagagaagatgtgtgttctgtcatactccatcaagcgtgccaggtacatatgttgttcgggagtttgtatgacctgggtcaataattccttgaggcttcggtggtccatgatgatcgtgaattggtggcccaacagatactag

SEQ ID NO: 79240 - DNA, 351 bp, Glycine max
  Peptide Sequence Number=SeqID_196018
atgacatctggaaatgacattacaggtcaaatacttgtgccatcttgtatctcagaagggggtcaaacctgtggcttcaaaggtggccgtcgtctctcaatagcccgtaccacagtcaacgaaagctgtgaggagttttttgggcttggcaagcttctaccgtcggcccagaaagcctttgagcaactcaagcaagtgctatcaacaacccctgttctggccttacctgattttctagtgtcgtttaccgtggagactgattccttcggcaacggaatgggagcagtgttgtcacaacggggccaccccatagcatattttagtaaaccattcagcaagaagcttctctag

SEQ ID NO: 79241 - DNA, 804 bp, Glycine max
  Peptide Sequence Number=SeqID_196019
atggcattcccaggagtttggtctcgaacagggaccctttattcatcagttcggcttaccatcctcaaagtgatggtcaaatcgaacacagggaccacaccatatgagatcacatttggtcgcaagcccttcagttttccagagtatctctctggaacttctaaccttgacgttgttgatgagatactaactaactgggaagaagtgtttaacagcattcgcaaaaagttaattaaagcccaagctagcatgaagcaccatgttgatgccaaacatagagagataaattgccaaactggggattgggttcgcctgaaactgcatccataccggcagaaatctgccaagggagcacaagtagtttccgacaagttggctaaacgcttctacagtcccttccagatcattgaccgtatcgacactgtggcttatcaattgcaactaccagaaagttctcaaatacaccctgtattgcattgctccatgcttaaatcgtttcatggtatcccagacagagccaacatcgctcaactgccagaccactttgtcaatgatcagcctttaattacccctctagctatttcggattatcgtcattcatcccgtatcaaggatgctccatgggatgtgttggatcatcaccttgaggacaaggtgattctccaagggccgaaggaagataatagcatatcagaagcaataccagaaatggaaacaggaaccacaatagcaaaagcagcgatgcaaatggcaaagactaagaggagcagtaccaggccttcgtacctcaaagattatgtctga

SEQ ID NO: 79242 - DNA, 177 bp, Glycine max
  Peptide Sequence Number=SeqID_196020
atgtgttttacttttgatgttttggattgttgtctgacatatcgcgattggaggccaaagtggagatcgaggctggaaggtcaactacaagtcaaagacagggagatattgactattactagaacggtggctaaaaattctcaaactctgaaggcccaaaatgagaagctacaataa

SEQ ID NO: 79243 - DNA, 999 bp, Glycine max
  Peptide Sequence Number=SeqID_196021
atgaaggaggaattgttcctacccaaagatgatagggacaaaatcagcgagttgcctgacaacatcttgctccacatgatggattttatggacacaagagaagctgttcagacttgtgtattgtctaaacgatggaataatctttggaaacgtctctcgactctgctattcaatacctcgaaatttgaaagtgttttcaaaattaacaaattcttgtgtaggtttctgtccgatcgagatgactccatttctctacttaatgtcgatttggatgtcggacctcccattgagctcgaattatatctttcaggtgtcttataccgtcctcccattgagctcgaactcctacatagaataatggaatatgctgtgtcgcacaattgtcagcgctttacaatcaacacaggcattggtttcaaatttgaagttgttactgtcatttttttctgtccctctttgacaaatcttcggctttcctgtggtacgccacttggtcgaacttgtaaacttccaaaatctctgcagctgccggtattggaaactttgcatcttcattctgtcttctttaccgcaagcgacaatggttgtgctgaacccttttcaaagtgttttttgttgaatactttggtccttaaaagtcattatgaggattcttcggtatgcccaagttggctgcaactggtcactaatgtaaaggaattgattctttcggcgaaaaccattaggtttattctgaagctggctctaaaagttcttgactcagtgagaattcaacctcctggctttgttaatttagagtcccttgtggtaaaacgtgattcattggattttgtatctgatgaagaagtacattgtatagtgcggtttttacttcagaactctatactaactctagatgtagaaaagacggagaaagttatatatactaattccctgtttaaatatttaggaaatgtgtttctggaggatgataatttaaaaacattgacaaatttgtga

SEQ ID NO: 79244 - DNA, 489 bp, Glycine max
  Peptide Sequence Number=SeqID_196022
atggaaataggaaccataatagtaaaagcaggggtgcaaatagcaaagactaagaggagcattacccggccttcgtacctcaaagattatccagcccttggcggtagctgtcgtatcaatttggttctctcattgtctctatgccggatttcgacaagaaccaggggtcctctgatcatcttcaggatgcccttattcgcctcaccaactagcaactgtacctcaacgagtctaccacctcctatgcctcagcctccacctgtccctgcatccacacatcgtatgaagttagacgtgcctcggtttgatggcaccaagccactaggttggatctttaagatcaaccaattttttgagtaccatggtactctagagcagaacaaactcaccattgcatcattttatatggaagcattgcacactcgctttgcgccgtctcagtacgatgaccccaccgccgcgttgtttaagctcactcagaagggcatg

SEQ ID NO: 79245 - DNA, 610 bp, Glycine max
  Peptide Sequence Number=SeqID_196023
atgcatggcgccagtggtgatggcgccttcgacagggacaagccacgtggctgtgtcgccactgcgactggcgacagcagcgatgtcgccacctgcaatggcgctttggccatgcagggtggagtcgctggtgcagctttgctttttgcaggtgcagcttttgctgaaaacgccagctcctttggcgatttagggatgaattcggttataacagtgttgtatttcaatggaagggtatatgaagataatgatggtgtaatatttgaaggaagtaaaaaagcgattcagattaaacgtggaattagtttcaatgctttgaagaaaaaaattggagataaggatgtcgctggtgattcaatgtttcattctgcaaattcgcttacatcatgtggaaattatttatctaatgatgagacacaaccggcaacaaatatgagcaatttacatattgacgaagacgatgatgatcatgatgatgatgattatcttatgtctaactcatacgttgaagagtctgtagacgaagatgacagtgttgacggtatatctaaaacagacgatgaagtcaccgacattcctcaaccagtaagaattgttcacccagcagaag

SEQ ID NO: 79246 - DNA, 1004 bp, Glycine max
  Peptide Sequence Number=SeqID_196024
atggctgaccacggaaccagaaagacgaccactgatcgcctcgaagatgccatcgtacgcctcactaatagccaggcttccattaacgaacgttacgcagacctttctagcaaggttgattcgattttggatcaccttcgccttcatgattctggccagaacactgccaccacagcaaatcaccagaaccatcaacgcaacgcggtcaagcttgacataccgagatttgatggacgcgatccgttaaggtggatcttcaagatcacacagctttttcaataccaaaacacactggaggaagacaggatcaccgttgcgtccctataccttgacggcgccgcattgagctgttatcaatggatgttcagcaacgactttatcacgtcatggaacggtttcctccaagctctcgaatcacagtttgctccgacgttctatgacgatccaaaagacgctctattcaagctgatgcaacgaggaacaatgaatgagtatctaaccgaattcgaacagctagcaaaccgtgtggaggagaaactacgtgacaagcgagctcctattccacgcaacttcgtcccaccttccccctctgctagccatatcactcacacaacgagcaaagctaaaccttcctacgttcaacgaacaccagaggaaatggttttccggcgagagaagggcctatgctataactgcgatgaaaagtggaacgctaatcatcgatgcaaaaggcaagtaatgttgttcatcgccgatgagcaattgccgctaccagagactgtcgagctaggacctgagggggagcaggctacccatccccttcacgtactagtgggaaatggttctatgttggaatgtgatcaggtttgccccgatattcaggtcgccatacaaggccactcctttgcagttacattccatcttctccagatcagcggtgctgatgcagtactagggatcgattggttgaagaagcctggaccagtaacaacatattacactac

SEQ ID NO: 79247 - DNA, 975 bp, Glycine max
  Peptide Sequence Number=SeqID_196025
atgggcaccctctggcttacttcagtaaaggccttggccctcagctcctctatgcctctacctatattcgagaactacatgctatcgttgcgactgtcattcaccattctaaccgaccacaagagcctctgggagttgatgatgcaggtcatccagaccccagagcaacattactacctctccaaattattggggtatgagtatcacatccagtacaaggccggtgtaaccaacgtggtcacggacacactttcgcgagccccaccacctgtaggacaattgttgattctttcggtgccgcgacttgatttcatgactgacgctaggcactcattagaagcttccttggaattccaaaagctaataacatcgatccagactgaaccagcaagctaccctgaccacaccttttgcaatggcttgatcctgtttaagggtagaatatggttaaacaacgacaacccatgcattcccaacttgttaactgaatatcatgcatctccgttaggtggtcatatgggtgtagctaagaccacccatcgcatcgaatctagtttcttttggacaagcctgaaacaggatgttaaacattttgttaaagtgtgctcgacatgccaacaaactatgagtattaccaggcgtccagcaggtctgctgcagccattgccaccgccgactggggtgtgggaagacctctcaatggacttcatcacacacctacccccttccaatggcttcacgattatactcgtcgtagtcgatcgatatttgaaaggggtgcacctgggtgccttgcccactagtttcactgcattcaaggttgtcaccttgttcttggacattatatgcaaactgcatggatttcccaagagcatagtgtctaatcgagacccgatattcctaagcaagtttttgagggaattattttggttgagtgggacacggttgcaactaagcactgcatatcatccttag

SEQ ID NO: 79248 - DNA, 207 bp, Glycine max
  Peptide Sequence Number=SeqID_196026
atgcccatgatgagttcgaaaggccgttttctcaacgtcgtcatcgttcatcagtatttggtggaacccccgtcggagcggtacggtgggacgttcaccggagcagtggatgggttcaaggctagaagatatgagcatatcatagaaggaggtttgcgatggaggagatggggtgttgggtcgtggtttgctcgggttgacgttcgg

SEQ ID NO: 79249 - DNA, 657 bp, Glycine max
  Peptide Sequence Number=SeqID_196027
ccaccaccaaccgtactggactatgtggctggaacgactaataatgaagctgcccagtccttacttgagtcccgccatgcactgcattctaagcttcaacaaaggttgaagaaggcccaagagacgatgaagcgctacgctgatgcaaaacgagacgatgtctccttcaaagtagggcaatggatttacgtgaagctaagaccaggccgccagagctccgtcaccggacagcccctcccaaaactatccaagcatttcttcggtcccttccagatcatggagcgcgtcggagcggtggcatatcggctccaactgtcgcctgagtcccgaatccaccccgtattccactgttctcttcttcaagctcatcatggaccgcaactagccgcacatgatgtttgccccttacagttcctggatcagcaacctctccgacaaccattatgtttcctcgaccctgaactacgcgacacctaccaccttgagggcaaggtggattttggagaggggggtattgttagcaccacccaccaggtagaagaagagaaggcacgttcaaccccgtcgacgctgatggtacaacccacgagaccagcacgaactagggctaggccacttcgcttgcaagattaccacgtagatgggttaccatattag

SEQ ID NO: 79250 - DNA, 231 bp, Glycine max
  Peptide Sequence Number=SeqID_196028
atgttggaaggaactgcccatcctcctcgagaaaaaaatagttttcaagaaggttattggaactttaatcagcttgccaccttgatctcaaaggagattaaacatctggggaatgggttggtccttgatgatgttcttgatggttgggtttgggatcatagtctaaatggtacatattctaccaaggaaggctataagtggatcaccaacttgggaaactccacttcttaa

SEQ ID NO: 79251 - DNA, 471 bp, Glycine max
  Peptide Sequence Number=SeqID_196029
atggctctgcaactatgggagacattgaaggaggccatagttgcctacacggggctctccccgcccaccttcttcacccttctggccctgatcctagccctatactacgtcgtttctgggctcttcccctcttccgaccaccgccacaacaccgcctcgcgcgacttggagccccagatggagcctctgcgaccccccgttcagatcggcgaggtcaccgaggacgacctcaaggcctacgacggcaccgatcccgagaagcctctcctcatggccatcaagggccagatctatgatgtttcccagagcaggaaaggatgcaattctactcaggtgttagctaagtgtttttgggcctccatttttcaactattggttgacacttctgctagcctagcctcagggtctgcattgattaggtggaaaagtgggttggaggaaaatgaattgctgactgaaagtgacatttaa

SEQ ID NO: 79252 - DNA, 486 bp, Glycine max
  Peptide Sequence Number=SeqID_196030
atgccttcgtctgctgccagctgccactcgaccaccatcggccgggccggaatgccaccgccgaacaccagcggctcggtcgccagccgtgtccacagcaccatgccatcggccgagggatcacccgaggccacgcccagggtgaagggcgtgctggcaaagcgcggcgaggccagcaggttgcgtgggttcagtgcagtggcgtcggactgcgcggccagtgcgcacgccgtgcccatccaggcgccggcagcagacaggccggccaaggccaggaatcgcctgcgattgatcgtatccacggcgctgccctcagttgtagatgatgtggaagtagaagaagcggccgtagtcgtcgatctcggttcggaaacgcccgttcggaccggtgctgtaggttggctgggtgttgaacaggttcttggcctcgtacttcagcgtcacgtgcttgccgaccttgtggctgaacgccatgttgaacgtcat

SEQ ID NO: 79253 - DNA, 174 bp, Glycine max
  Peptide Sequence Number=SeqID_196031
atggatacatcggagtcaggagttctaaacacggtttctggggctaccattatgaaggcaataatggatagctctgggatggttttgatgccatttttgaataatgggaatttagtcatccatagactatggaatctggaagacacaaatatcaaatctgatcgggttacttag

SEQ ID NO: 79254 - DNA, 198 bp, Glycine max
  Peptide Sequence Number=SeqID_196032
tggaagattggcattacaaacaagcgatggctacttgaggatctcttctccggtgacatcgtggagtctgaggcggcggagcgtgacgacctcacagaagaagaggaagaaggaaaggaccctgcttcatgttttccagatctcatgggactgaaatttgaggacaaaggagttagatatgagtgtttgcgagaatga

SEQ ID NO: 79255 - DNA, 573 bp, Glycine max
  Peptide Sequence Number=SeqID_196033
gttctgatcacccttctactgacctcaggaagagatcctggcatagtgccccgtaatgctaatcctccaattctggatgaatatgaagggggtgccaatgtcaacaatgaacaaaccctacggccacatttgccgcgagcaaaggaagtagttgtcaatgaacgatttgatcttcactgcccttgggttggtcattgcattggattgtctacttatgaaaattttagataccggtatgatcaacaatccaacccttataacaaaggagtagctgcaaacttcagagaaatattttgctcctgcattcctccatccaagaacaacgtcaggtccaagattccaattccaaaggaaccatcagattcatctagaagaagagttgaagaggaggaggaaagtgattatgcagatgagtttaccaatgatgaggaacatggaaagggcagtggaataggtgataatatgtctgtggatttgagcaggatgcttcacacagaaggggggcaaacagaagttgcttcatttctaaggctctcgttgtgggacagaagcagcaaagaaaatgggacataa

SEQ ID NO: 79256 - DNA, 318 bp, Glycine max
  Peptide Sequence Number=SeqID_196034
atgtgcagcctctggtgccggcgaactccaactgcggcggttgccggagatactcctctggtcagaacttactgtgcttggaaaggcaataatgaattttgtcttagggggaggcttatatttggacctgatgggaaatctatatttttgacaatatttcttatcgttgcccctgttgctgttttctctgcttttgtggcgaggaatttgttggatgattttcctcatcactggggatattcaatattgatcgttgttattcttcacagtgtttctatttcaaatattttatacaagagaatggctgaagaggcctaa

SEQ ID NO: 79257 - DNA, 309 bp, Glycine max
  Peptide Sequence Number=SeqID_196035
atgcttttgggttggcagaactatgcaaacgagataggggaatggattctgtgtcgcatattcatgaagaaaagaaatatagaaagtgataacaacactactgctcccaggaagaacaataatgcagtgatgaataatgttgaggtggctcagccaagattctttgattttttgagtgttcacaattcagctcctccggctcctatacaatattcttctacatcctcatcttgttcaagttccaataacgttgtagaggcttcttcacctaaccacgaagaaacaagcggctatgctgatttttgctga

SEQ ID NO: 79258 - DNA, 1020 bp, Glycine max
  Peptide Sequence Number=SeqID_196036
atgaatgaggaaattcatgcccttgaaatgcacaacagtttggttgttcaacctctaccaccgggtaagagaaccatcagttgcagatggatttataaagtcaagtatagagcaaatggctcccttgataggtacaaggcccatcttgttgcgaaagggtacacacaacaagtagggatcgattttctggacactttctcatctgtggccaagcttacgatagtgagagtgcttctttccattgcagctcacagaaattggaacatgttgcaacttgatataaataacgcatttctcaatggtgatttgattgaggaaatatacatggacatgcctcttggttatcctgtcaagaataatatcatggtttcttcaagacaatggcttcacgagttctccatcatcatccttgatcaaggatttcagcaatgccctacaaatcattttttgttcactagagggagtggagcaactctagtcacattgctggtgtacattgacgacattatcatcgttgggccagatcagaagttgattgcagaaacacaacaaatgcttgccaaacccttcaaaatcaaagtgattggtgatctcaagtattttctaggcttagaaattgccaagtctcctcgtgaaatccatctttgccaacgtaaatattctttgcaactcttgactgacactagctttgcagcatcaaagcctcaatctgtccatatggatcctaatttacagttaaatgagactgatagtgttccattggaacatgcctctcaatattgtaggctaattaggaggttaatgtacctcacaatctcgcacccagacaactcctttatcgttaatcacctgagccagttcatgtccaagccaagaactcctcatctacatgcaatttatcacttgttgcagtacctgaagtcctcacttggacaaggcattctatttccctcatcatcatccatgcgggtttctgcatatgtggacgccgactggggcagttgccaagtcacccgttga

SEQ ID NO: 79259 - DNA, 246 bp, Glycine max
  Peptide Sequence Number=SeqID_196037
atggaaaggataaattttattgaaaatggaattttctcgtgccagttgcctgcttcaatcattcctgagattaatgtcagcaaatatgatccttgggatttgccagctgtaacttcccaaacacaagaatatgaagaagattttaaaggaaattgtgatgtgcaagagaggtactttttcagctccaaggaagccaagtatcgaaacggcaatcgcatgaaccgaacaactaactctggctactga

SEQ ID NO: 79260 - DNA, 1716 bp, Glycine max
  Peptide Sequence Number=SeqID_196038
atgatttgtcaaattgcttgcaaggttctctccgttttgcagtattacacaaaaatgaaatcaatctgggaagaactcagtgagtacaagcctgtacatcattgtcactgtggtggtgttcaaccagtcttagatcactttcattttgagtatgtccaaacatttctactaggcctcaatgaaagttacaatcagattcgtggccagattctcaccatggatccatttccctccattcaacatgctttccctctagtgattcaagaagaaaagctgcgggaggtaggtaatgtgcaaacttccttggattcgcaattggcatgtgttgttcaaggctctcaaaatttgaaatctggcaacaaaaaggacaaaggtcgtccactttgcacacattgcggtctccttggacacaccaaggatacctgcttcaagattattggatattctcaaggtcacaagaagcataagagcccaattaatcttgtcagtgataatcaaggagagtcttcaaactctttcaacatcgcccaatgccaacaactgctgaatctcatagagagtcagatggctcgggcaatgatttcagagacatcacagtcggatcagtcaaatcttggtatgatcttttcaactcttggtcagtcttctagcattaactctagttcttggattatagattcaggagctacatctcatatatgtcatgatcttaaattgtttgatcaatatactctattttcaaatagaattgtcacacttccaaataattacaaaataaatgacaagaaacagaacggagtgattggcaagggtaacctccatcaaggtctataccacttccaaccacacaatgaatatgcgtgtagttccatgcacactgttgttttgagtcaatgtttgtcttttgattctcataataatttttctgagttgccttttgacttgattcactgtgacattcggggaccatttcctcatgacactcatgatggcaagaaatatttcttaaccaccatggatgataattcacagtacaattgggttcatttgatgagaaataagtttgaggcaccacatctattacaagctttcttcaagcttgttcagacacaattttccaaaaacattaaggctatgcggtctgataatgctaaagaattatctttgactaagtttttgcagaatgcaagagtagttcaccagttttcttgcccacacagaccccaacaaaattcgatagtagaaaggcgccatcagaacctattgaatgtagcacatgctttaatgtttcaagctcaattactaatttatttttggggagagtgtgtatccatgaaagcttacatcatcaacaaaacaccaagctcaaatctgcagaaccaatcaccatatgagttgctatatggtaaagtaccagcctatgatttgatgaaagtgtttgggtgcttgtgctatgcagccactgtccctgctcaaagacataaattcactcctcgggccactaaatgtgtgttccttgggtatccatttggttataaaggatgcaagctctatgatttatacaatcataaattccttatatctagagatgtgactttccaagaaaatagctttccttttgccacaagcacatatacaacatctgatccgtttccaaactttgttgtacccagacctttgcctgacatgctgcctgatcgaaaccccactccttaa

SEQ ID NO: 79261 - DNA, 864 bp, Glycine max
  Peptide Sequence Number=SeqID_196039
gtcctcaccttcacagggctacacgctcacccctctagaggactacacgtcctcgcctttatagggctacacgccctcgccttcagaggactacaggtccttaccatcagagggctacatgccatcgccttcagagtactacaggtcctcgccttcagaggactacacgacctcgcctttagaggactaaacgtcctcgccataagaggactacacgtcctcgccttcagagggttgcacgccctcgccttaaaaggactacacgtcttcgccttcaaaggactacacatccttaacttcagaggactacacgtcctcaccttcagaggactacacgtcctcgccttcagagagctacacgtcctcgtcttcagagggcaacacgccctcgcctttagaggactacacgtccttaccttgagaaggctacacgccctcaccttcaaaggactacacgtcctcaccttcagatggctacacgcccgcgccttcagaggactttacgtcctcaccttcagagggctacatatcctcgcctttagaggactacacaccctcgccttaagagggctacacgtcctcacctttagaaaggtacacaccctcaccggcagaggactacgcgtcctccccttcaggtggctacacgccctcaccttcagaggactacacgtcctcgcctttagagggctacacgtcctcaccattagagggctacacgccctcaccttcaaaagacaacacgtcctccccttcaggaggctacatgtcgtcgccttcatagggctacacgccttccccttcagaggactacacgtcctcaccttcagaaggctacacgctcacgcctttagaggactacac

SEQ ID NO: 79262 - DNA, 267 bp, Glycine max
  Peptide Sequence Number=SeqID_196040
atgactttccgatccttttccaaaattggtgctggttttggtattgatgacgatgatgaaaaagatcgactaggtgacaaaaatgtcggtgctgtacgtgctggtgttgataaaattaaagttgttcctggtggtggtgataaaaaagttgttactggtggtggtaatcatcatcgtcatagtgatgacagctggatgcaaaggcctatgaagttgatgatcccacctctcatcaataattttccaaatagactaatagctacatag

SEQ ID NO: 79263 - DNA, 134 bp, Glycine max
  Peptide Sequence Number=SeqID_196041
atggttatccttcacccgtcgttgttcgagtcattcgatgacggtgtttgtaaaaatcgtcttcgttttcaaagacaatattaccaaaatgccaccggttcgatatactatgacgacgccaatggaccgaggtc

SEQ ID NO: 79264 - DNA, 786 bp, Glycine max
  Peptide Sequence Number=SeqID_196042
atggatttcctcggagtctggtctccgacaaggatgcactttttctcagccacttctggaaagaactcttttggcttagcgggcaagtcatcacctactatctccgattatgttcgcgggacatcgaccattgacgccgttgactctcttttaacggaccgtactaaacttcacgccaccctccagtgccggcttcgcaaggctcaggaaacaatgaaactcaatgcaaataaacatcaccgtgatcttcagctgtccgtgggcgattgggcttatgtcagacttcgcccttatcgccagacatccatggcctccaactactccaagctttcaaagtggtattacggcccataccaggtgattgaacgtattggagttgtcgcctacaaactgctgctacctccctcctcccgtattcaccccatgtttcacatttctcttctaaagcttcatcagggtcccctcccgacagttgagactactcttcctccggaagcaatagatcaccatcccatcgtcacccctttgtccattctagactggaaatgggatacctctgttactcctgctgtttgcaaggaaatatggcctgctttgaaggacacgtacaacctcgaggacaaggttattttcagaggcgcgagtgttgatagcaatatgcagtatgataccatagttgcagatagtaaaaccaatcaggaggaaatggaagtggcaaatagcagtacaacaaacagaccaaaacatattacaagcaggctcatttacctgaaagagttcgtttga

SEQ ID NO: 79265 - DNA, 357 bp, Glycine max
  Peptide Sequence Number=SeqID_196043
atgacgttggatcaagtgagggcccttttcctcggatacggttcaaatcacatgatcgtcctcggcggaaaacataaaaataaatgtgagtgccgtgcttgtggttggtggtgtttggtgtgggcttggccgatagtggtggttggtgtaggcttggccgatggtggtggttctgatggggagggtggcgctgagtggtggctaggccgatggtggtggttcacggaggagaagaggggcactgagtggtggctagtggtggctcttggctgttccggcgctttggctgtccgtattccctcctctctccctctgacatgcacagtaattaatgcagcatttaaaggacataattag

SEQ ID NO: 79266 - DNA, 468 bp, Glycine max
  Peptide Sequence Number=SeqID_196044
atgcggatgaggcgccactcgatgtttccatttgcctgcatgcctttggtattgtggggggtggttcgtttagtggtgtctagtcttgcgaacgtgaggtgcatgagtggtaatcgggatgtttttgtgcacggctccatgcttgcgcatgtaacgtgtgacatgcatccttttcattgtcaccttagccttcgtggcttatgtgctgacgattggttctgtgttgcctacctaccaaacggtattcgtgtggctagtcagacccattccatctcggcctctttgttggtgacgctggaggatttcaaagtcccacacgtgaaccacgtgattgttctctcggatgcggtgcatgcagtgaacgtgaatggtctagtgcccccacattgttccttaaaatcggttgtctcggatgacgcttgccctggcgcttgctttgttcaacgcgatgctactactcttagttag

SEQ ID NO: 79267 - DNA, 345 bp, Glycine max
  Peptide Sequence Number=SeqID_196045
atggctaaaccaagcagccccgcaaacttggcatcagccatcatttgtttctttgcctcaaagaagttcccccatagactaaaagcatcaccgggaaggtttgcaaggcaaaacccttcaccacacccttccgtcatggtccatgttcatggatttttcaaagtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcaaacgtgagggtgcatga

SEQ ID NO: 79268 - DNA, 441 bp, Glycine max
  Peptide Sequence Number=SeqID_196046
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgaggagaaggccggcgcgacggtgacgttccagacggatgcgacgaagccctgcaccatggactacgtgccccggctgaccgtgctcggcgtgaacccgccgaaggacccgtcggactacaccctcaccctcaaaggcgggaacctcgacggcgaggtgaaggtcctcggctga

SEQ ID NO: 79269 - DNA, 656 bp, Glycine max
  Peptide Sequence Number=SeqID_196047
ggctacatgccctcacctttagaggactagacttcctcgccttcagaggactaaacgttctcgccttcagaggactagatgtcctcgccttcagagggctacacactctcacctttagagggctgcacgccctcaccttcagaggactagacgtcctcaccttaagagggctacacgccttcgctttcagagtacttcacgccttcgctttcaaagtactacacgtcctcgccttcagagggttgccaactgtgcgaatacaaccagagagggaggctatcacgcagctactatgcataccgaggcaagatttcacccgtgctactgcagagagacaagtgtggatcgtgcgcaccaacatgaccactcttacacagatatgtatgacatttctacttagcaacattctgcccagtgaccgtaatgccgatctccccctgcggaagtatcagttgggatcacgcccgcaacacatccagtggacccggagaagtccagtagggattgcagggatcgcgcctgcaatgccgcaagtgcctgtcatccccagcaaggcaggcacagggcgagacaccacagcagcctggggatggccagcaataggcaacaaatgcaccgccgccacctccagagcccctcagctcatccacaaaaag

SEQ ID NO: 79270 - DNA, 431 bp, Glycine max
  Peptide Sequence Number=SeqID_196048
atgacccagaccggccgctctcccctgcttgcatccgccgccgcgttcgtcctgtcgggcgtggttggcagtgcccatgccgccgacagcgtcgccggccagttcgccgaatggagcggcgacagcacggtcagcaggcagatgaccctgcgcgaactcggtttccgccaaccgctggtgctcagcgggcaggagagccagcgcgaggtctatctgccggtgccggctggcgttgccacccgcgatgcacagctgcagctcgatgggcgctatgtacgcgggcacgctgggcgtacctcgggcttgtggtcggtggatggcgatccaatcgccgcgcgctcgatcaccgatgcccagggcgatgccagccagctgctggccatcgatggcgaaccccgccagaacggcttcgtgcgggtcggcgtcggctg

SEQ ID NO: 79271 - DNA, 459 bp, Glycine max
  Peptide Sequence Number=SeqID_196049
atgcagaaaaactgtcaaattatgcagaaaagctgtcaaattatgcagaaaattcgattgtgcagtaccagtaccagttttcactgtcgcgattccaacggtcaagacgtaggtttctgtattaggaacctccagttaaaatttcaaggtgatccaacggttaacgaattggggatggggactttactgaagacactattaagtcttgtggatgtgtgtattgaattgattgacggtgaggatgagagtaatccgagagagaaaccggaagagactacaactataagagatgatgcattgcggtggttgacaatgttaaggcttagagggattgatgggaacccggtgctgagaggaacgaggagaagaactacgcttgtggaaatggaatatttgctttgcgccattgcccgaccgccacctagtaccacatatgatgggtgccccataatccaataa

SEQ ID NO: 79272 - DNA, 159 bp, Glycine max
  Peptide Sequence Number=SeqID_196050
atggtgagcaaagtttggagctttgatggaggcttcaatggagaggaagaagaagagaaaagcaacgtgagaaggttgaatcaacctcaccgggtccctactgcactttcaccaacgcgatctcctttcctctcagtgacttcattcttcgatcagtaa

SEQ ID NO: 79273 - DNA, 303 bp, Glycine max
  Peptide Sequence Number=SeqID_196051
atgacaagatatgcattctcgccatcgatggcggcggcatgcgagaaggtgtctaaagtagaggagactgcagcaacacgcaagcaagaagaaacaaacgcatggcgaattggaactcaccatatagagagaggggggcatttgggcatggcaaaatgtgaagacagaaaggagaatcaagtgatgcaatcctaccccgcaagggcattggctagaagactccaagtagattgggctagagatccaaggaaaggccctagggttctcatgagccttggggtagattttgagcccatgggctaa

SEQ ID NO: 79274 - DNA, 429 bp, Glycine max
  Peptide Sequence Number=SeqID_196052
atgaagctagacactgtggaatggaaaggaaagaatgggaagtattacttccccccctcaagtggactaaaattcaattccaaggaggtatttcgttatcttgacaatgttcagaacaaaattatagttgagaaagctattgtggaagggttaccaccaggatgggtgaaaaagaccagaatcacaacaaatggagattcagttagaagagatacgttctacattgaccctgtaaatgggtatacattctgctcaatagaagatgttgatcactatcttgaaactgggaagataggaaggaatgaattcacgtcaaaagataaagatggcagtgatatggagttaaaagctgacaaatctcctgtatggatgatcataattgtgcttcttgtagtttatgtctattcgttaattagtctcatatgctaa

SEQ ID NO: 79275 - DNA, 693 bp, Glycine max
  Peptide Sequence Number=SeqID_196053
atgttgaaggatgagcttaagccgaacttagttgcgtgcaatgcattaatcaactcacttggaagagcaggggaactcaagcaagcatttcaggtctacaacaccatgaaatcttttgaacttaaaccagatgcatatacattcaatgctctactaagttctcttaacaaggctgataggcatcacaaagctcttgagctttttgagatgattgaaagagatcaaacatctcaattcaatatacatttatacaatactgttttaatgtcttgctcaaagcttaggttgtgggataaggctatagaaattttgtggcagatggaagcttatggactgtctgatttgacaatgtcttataatcttgtcatcaggacctgtgagcttgcaaggaagctaacaattgcactgcaggtgtacaagcacatggttcaccagaagtgcagtccaaacatatttacttatctgtccgtgattagatgctgtgttcgtggaaatctctgggaagagttagaagaaatcctaaatcagaccatgccaaatgccactctttataacgcagctgttcaagggctgtgcttacgtaaaaatgatgacttggcaaataaggtctacgcaaaaatgctagaaagtggttttcaacctgacgtcaaaacacaagtacttatgcttcgtatgataaggaaaaggaagtag

SEQ ID NO: 79276 - DNA, 297 bp, Glycine max
  Peptide Sequence Number=SeqID_196054
atgaatgaacataagtctagatttgttcttaaccctcgagcaagaaatgctctagtgtgcgctttatctcaagaagagtattccaaagttcacagcttcagaagtgctaaacaaaagtggttgtttgagagaaagtggagaccccaggttatagcattaagagccatcaagaatcttgattcattgactcttgaagagctcatcgcaatccttaaagtccatgagcaagagcttgctctagatgaaggaacaaagaaaaggaaatctttatcccttacggttcaaagaccaaaatga

SEQ ID NO: 79277 - DNA, 408 bp, Glycine max
  Peptide Sequence Number=SeqID_196055
atgcagattcgagttcgatgcaactgtggagaaggaagctgcgaggaatggggggttatagaacttcaaggagtggtggagccacagcctggattccacgattccctccaaaatcttcacatcggcactttgtgtcgtccttcttctcaggaagtctacaccttcactgttggataccatgaactgacggggtcaaaggttcccttaaagaagccaatggtggtgctcaagaaagtaaagcatcctgatggagaaagtggttgtaaggtggagctgcaagttgttggagtcattagacataagattctgttcaagaacagaccaaaggctctcatttctacttgttctatagtactatggatgcttttttatatccggggtacttcaggaatttcttcctttgtttag

SEQ ID NO: 79278 - DNA, 114 bp, Glycine max
  Peptide Sequence Number=SeqID_196056
atggaaactgccgcagctttccacccttttaaaaaggaaatggcagctttgccaggtctttctatgtggcagaatgaggttcccatgtatgttcttattcaagctgccttgtaa

SEQ ID NO: 79279 - DNA, 324 bp, Glycine max
  Peptide Sequence Number=SeqID_196057
atggcaagaacaatgcttaatgaccacttaactcccaaacactcttgggctgaagcagtaaacattgcttgttattcacagaacacaatttatataaggccattcttaaagaaggctccctatgaattgtggaagggatgtaagcccaatatttcttacttccacccattgggatgtcagtgtttcatcttaagcaccaaggataaccttggaaagtttgactccaaatgtgattctggaatcttacctgaatactctgaatcatccaaggcatatagagcgtacaacttcataaccttgacattggaagaggcaattcattaa

SEQ ID NO: 79280 - DNA, 417 bp, Glycine max
  Peptide Sequence Number=SeqID_196058
atggacaatggcaccaataaactttgtgcaaggtggcatccttggagacataggtcgccaagtggagggttaatgctcgcatggtttcaagacaggagtgccccaagtgtcttggccaagttgctacgcaccaggttggacaatgatgaaatgtccacatactgcaagggcatgcaggaagaaaaaaatgatttgaccagcaaggtggaaggcattgtggcggagagagacgagcttgccaaggtggttgctgatttagaggcacgacttaaagagtcagagtccaagctagaggagtctgagttacggctggctaaggagagggaggtcagtaaggaccttgaagatgagctaacaatgtacaagaaggaggctatggagcgacatgagaagggctttaacaaggccattaggtag

SEQ ID NO: 79281 - DNA, 234 bp, Glycine max
  Peptide Sequence Number=SeqID_196059
atgcctcatgaaatgagatggccccgagaaagcttcccgcaaagagatccaggaaagacaccattggagaaggctacagtgctacccaaccgactgacacagattttgacatgcaccgatttcgaagcatcgagcatcagtggtgcttcaagaccatcaagggatgctcattccttagagagaggcgggtccaacttagggatgatgagttccctggcttccagaaggagatag

SEQ ID NO: 79282 - DNA, 864 bp, Glycine max
  Peptide Sequence Number=SeqID_196060
atgacgacacatccaaaaccgcttcttatcctaacaacatcatcatcatcatattcatacgctcaatcccctgcagcaccagcagtggctcatgtcccttccaccagagcaacgcttcccatgttactcgtgatcttcctcttcgccctcctcttcaccgcattctgctccatcttcattcgctactgctcccacgaagaacaaccccacgcgcttccacaagccacgcgcgccacgccgcgcggagtcgacccgcgcgtgctcgccacgtgtcccgtcacgtcctactacgcagtcaaaatgaagacgccgcaaaaggctgcgtttcagtgtgcggtgtgtttggcggagttcgacgacgccgacgcgctccgcttgctacccaagtgcggtcacgtgttccacgcgcactgcatcgacgcgtggctcgcggcgcacgtgacatgccccgtgtgccgcggcgaagtgagcgtggaaatcgagggggaggcacgtgcgcgccacgtgtttgaagaaagttccgtgagaggctttggggtgcttctgaggtcacattcgacgggtcactctttggagaggttcactctgaggatgcccgaggaagtaatgaagaagattctggaagatagtgaacgcgggaatgtgacgaggatgatgaagcgttccgcgagctacgacgtcgttttgcggagcatggaagaagggggtgaaggtagtagtaatagtggtagtaatagtaaagagaagagtagtactaataataataaccggtgggttttatcgatgacgcctccctttgtttctcgcgccgttcggggattccgagagtgtcaagagagaacggttttccattgtgaagtttga

SEQ ID NO: 79283 - DNA, 210 bp, Glycine max
  Peptide Sequence Number=SeqID_196061
atgggtagttatgatgtttttaatagggtgaatgttatgagcggagaggaagaagatggaataccttggttcgaggtcaaggtccctcctactaaactaagcttttctcaaaatatttttcaggagaatgatagagcttatccagcgcaagttgttgcagcccagatacgtacactgctatataaacatgaaggctgcacgagtttttaa

SEQ ID NO: 79284 - DNA, 139 bp, Glycine max
  Peptide Sequence Number=SeqID_196062
aaatgtgataactcactccttgtgtgttatttgtattgatcttgtgatgatctcgaaccttgtgttcatgggagtagatgacgaggtggatgactttaaagaacctcgtgctagaggacgctggagcacaatgctctga

SEQ ID NO: 79285 - DNA, 486 bp, Glycine max
  Peptide Sequence Number=SeqID_196063
atgaccggggtagcgccgggccatgcccggcgggcgcaacgacgtggatcaggccccgccctggatgttggccttcactgcgggctgcatcagcttcggttcttccagcgtcgcatcgcgggcctggcgcacgctgacgaactctgcctcggccacgccgtcgtgcacgtggatgttgtgcgcgcgctgttcgccgatggtggtttcgttggcgaacccgcggccacccgggccgtagtcgtggcagacaaacacgcgcgtcgcatcgggcagggccagcaggcgctggatcgagcggtacaactgcgcggcatcgccgcccgggaaatcgcagcgggcagtgccgccgtcgggcatgaacagcgagtcgccggtgaacagcgcattgtcgatcagataggcgatgctgtcgctggtgtggccgggcacggcgatcacctggcagcgcaggtcacccaaagcgaaggtctcgccatcgctgaacag

SEQ ID NO: 79286 - DNA, 864 bp, Glycine max
  Peptide Sequence Number=SeqID_196064
atgaatgatgccctccagccattcttgcgtaaatgtgttgccattttctttgacaatattcttgtatatagctccgacttggacactcatgtgtctcacttggatttcgtgctctctaccttggtggcgcgccaattctttctctgggaacccaagggcattgctcctgatcctgataaggttcaagccatgttggactggccgatacctacctccaccactatcctccgtggtttcctcggcttgacgggattctaccacaagtttattcaaggttacgcatcagcaacaactcctctcacctcccttcttcgaaaaaaccaatttctttggttccctaaggcgaccaccgcttttgagcatcttaagtctctaatgactcaggctccggtccttgccacacctgatttttctctcccatttaccctcgaaacggatgcctttgcgatagccataggagtagttctactccaacaagatcatcctatcgcatgtttcagcaaagttttatgccctcgtctgcagcgcgctttggcttatgttaaagagcttcatgctattactgtcgtcgtctgcaagtggcgccattatctgttgggcccttcgctcaccatccttacagaccataagagtctgaaagatctcatgacgcatgttatccaagcaccagagcagcagaactatctcacgaaacttctaggctatgattatgatatccgatataagccgggctcttctaatgtggtggcagatgcattgtcacgcctccctacaggtgaatacctttccttcacgataccacacttcggtttccttgataagctttgcactagtttaatggaggataatcaatatcgggacctg

SEQ ID NO: 79287 - DNA, 312 bp, Glycine max
  Peptide Sequence Number=SeqID_196065
atggctgggttggatcaggccggccgcaagcatggaggagatttgggattcaatctcggctttttggaagtggggataatggtagggtcggacattcacaggagtgaaattgggaagaagggtggttgggtcaaggaagatggcggagtaacggtcaaggagggtggtaatggatgctggaatgggttgggggtgggcggggcagcgaaaggaggggggcaaatttccctaatagggcttcttttacaaactaattccgcaaatggggctattttaaaacaaattccaacatggggttgttttactacgtaa

SEQ ID NO: 79288 - DNA, 1038 bp, Glycine max
  Peptide Sequence Number=SeqID_196066
catctccagcgcctgctgggccagttcctttccggaggcgcccggaagcttcacatccgtcacgagcacatccgccggcatctccctcaggaagacgatcgcttcctcggcgctgccggcttcgaccacctcatagccggcgtcgcgcaggatatcggcggtgttcatgcggatcagcgcgtcatcctcgaccaggagcaccttgccgcgcatctccgtgccaggctccgacgccgcgccggcggccagcgccggggcctcggccgcgcgctggcgctgcgtgcggttggacagcacatggcgcaccttccgcgccaacgcctcgcgcgtatagggcttcgacaacagctcgacgcctgcgtcgagccgaccgccatgcacgatcgagttctcggtgtagccggaggtgaagagcacgccgatctcgggcaggcgcatgcgcgccagccgcgccagctccgggctcttgagttcgcccggcatcaccacgtcggtgaacagcaggtcgatcgcgatgccgctctcgacgacatgcagcgcgctcgtcgcatcgctggccttgaggacgcggtagccgagatcagcgagcatctcgaccaccgtggcccggacctgctcgtcgtcctcgaccacgagcacggtctcggtgccgccggaaatcggcccgttatcggtatcggtctcgatgtcctccttctgcaacgctcgcggcagatagagcttcaccgtcgtgccgtggccgagctcggaatagatcttcacatgcccgcccgactgcttgacgaagccgtagaccatcgagagcccgagccccgatcccttgccctcggcctttgtcgagaagaacggctcgaacaccttcgccaaggtttcctggctcatgccgctgccggtgtcgctgacggcgagcatcacatactggcccggcgcaacctcgtcatgggcgcgggcatagtcatcgtcgagatgcgcgttggcgagttcgatggtgagcttgcccgagccgtccatcgcatcgcgcgcatgatcgcgagatga

SEQ ID NO: 79289 - DNA, 105 bp, Glycine max
  Peptide Sequence Number=SeqID_196067
atggcttcagaatcatccgctgacttaacgagtacaagtgccagttctgattcatcaacagctacaagcaagggattgttgtttcaacatggatttggtatttga

SEQ ID NO: 79290 - DNA, 1588 bp, Glycine max
  Peptide Sequence Number=SeqID_196068
atgtggtatcatgaaaacatatcaaaacattcaaatgcctcaagcccacgattcagcctatgctgtggagatggcaagattgaacttccattgttacagaatccacctaaatttcagcagcaacttctatttgagcaaaatacagcttatgcaaaaaattatcaacagaacataagaacttataacatgatgttcgcatttacttctgctggtattaaatttgacaaaacaattgatcattccagaggtcctcctacaatcagaattaagggtcaaccctgtcacagaattggaagtctattaccaatgcctagaaaagaacctaaatttgcacaattatatatctatgaaacagaaaatgaagttcaaaatagaattaaaatcataagccacaataatgaaatagaggcacatattgtctcaaatttgcaaaaaatgctggatgaaaacaatgctcatgcaaaaagtttcaggatggcaagggatagattaacagacactcaagtgcataatgtcagactcaaattgattgctggtcgagaaaaagatggtcgtacatataatataccaagtgtccctgaagttgctgcacttcttgcaggtgatattgatgcaaattcgaacagagatattattgttgaaactcaaaatgggcaattgcagaggatacatgaattacattgtagttatctagctctacaatatcctctattgtttcattatgaagaagatggatataggactgacattgtacatcgtgatacattaagcaggaaaagaagaaaaaggaatcgtcttacaatgagagagtggtttgcttatagactacaatgcagacccaatgaaggtcaaactctactgcattctagaaaactattccagcaatttgttactgaaggatacacaatgattgaatccgaaagactctcctatgttagaaacaaccaaaagaaactcagagttgataagttatgtagcttgcagcagtcatccgaagctggaaataaaaaaggtttaggccaaggcaagaggattatcttaccttcaacctttgctggcagcccacgttacatggatcaactttattttgatggtatagctatatgcagtcacataggtttcccaaatcttattattacttttacctgcaatccaaattggcctgaaattcataggctgctgacacctttgaatttgacatcaatagataggccagaaataatctcccgcattttcaagcttaaatatgagcagatgttatcagaccttacaaagaatcacctgctaggcaaagtcgttgcatacatgtacacagtgaaattccaaaaacgagggcttcctcatgtccatttattgttatttttacacgccaacaacaaatatccatctccaaacgatattgataatattatatcagcagaaataccttcacagaaagacgatccaaaactctataaattagtccaaaatcacatgattcatggtccatgcggaattttgaggcctgcatctccatgcatgaaggaaggcaaatgcagtcaattttatccaaaaaagtttcagcccacaactcttatagatggagatg

SEQ ID NO: 79291 - DNA, 309 bp, Glycine max
  Peptide Sequence Number=SeqID_196069
atgaagagctggcaagttgagaaggctaaggttttaccacttatggaggtgcatccagaattctcaagtcaaggcatttgcaatttttggaggaaagacatcgaaactttcagggaaacatggctggatggttttttctggaattttacccgcttgacaccccacacccttaaagtcatcagattgttaaccttaagcaaattcaagacctgcactgcacgtctgtattatggtcatgcagagaaaatgaaacatagaattcatgccttgttcaaagtcacaagcatgaaattcatggatgcaagataa

SEQ ID NO: 79292 - DNA, 420 bp, Glycine max
  Peptide Sequence Number=SeqID_196070
atgggaatgaaggttgcaatggtggtcacatggaaacattcacatttatcacaaagcgtggaggacttaccacagataaaaactatccttatcaaggatcagatggtgactaataaggccaaagttagaaaccatgctgtcgccatatgcggctatgaaaacctgcctgctcacaatgagaatatgctaaaagctgcagttgctcatcaacctgcctctgttgcaactgatgctggaggttatgcatttcaactttattcaaaaggtaccttctctggtagctgtggaaaggacctcaatcaccgcatgactatagttggatatggagaagaaaatggtgaaaagatgaagcgagatcctaaggataaagatggtacttgtggaactgccatggaggctagctacccagacaagcattaa

SEQ ID NO: 79293 - DNA, 147 bp, Glycine max
  Peptide Sequence Number=SeqID_196071
atgagaggagaacatgggtctgaggaactggaacgcaaccagaacgtaaagtccgttgtaggacagctagtgcaagggggaagggatgggagctttgaagggtgtaagaaagaagatacgaataagttagctgggccttcgaacgtg

SEQ ID NO: 79294 - DNA, 504 bp, Glycine max
  Peptide Sequence Number=SeqID_196072
atgggtgacaaaattcttgctcatgttaagagtcaagacattgaaaaatggaaaaaccagttgacggagaatcaaacttatattgtgcaaaactttgaggttgaaaatagcactaggcagtataggggatccaatcacaaatacaagcttatatttgccagaggaactatggttaaggaaaaggacctaccagacatcccttcctattgtttctgtttcacagaatttgaggcattcaccagccaaaatgctcagagtgatatcttaaaacgatatgctttacttctatattatgagaataacaatgttagtttcttcaatagctgtgcatatagaaataatatgtttctttttgtcccagatcttattggggagtttgttgatgtagtccagtggcaattggacagtaaacgcataaagctgaaaggttttttggacaaacatggagatggtccagtcaccttggtgctggagcaagcaaagattaaagagaacaaagcttaa

SEQ ID NO: 79295 - DNA, 393 bp, Glycine max
  Peptide Sequence Number=SeqID_196073
atgagtacagcaagattcatcaagtgtgttactgtcggagatggagccgtgggaaagacctgtatgctcatctcttacaccagcaacacattccccacggattatgttcctacagtttttgacaacttcagtgcaaatgtggtggttgatggaagcacagttaatctcggattatgggacactgctgatttgagggaagataggcagtatttgattgatcatcctggagccacacctataactactgctcaggcagggagaagagctgaagaaggcaattggtgctgctgtgtacatagaatgcagctcaaagactcagcagcttttggaatagttggttttaagtattacaagggaattgttatagcaggagatgtgccaattattgtttaa

SEQ ID NO: 79296 - DNA, 197 bp, Glycine max
  Peptide Sequence Number=SeqID_196074
atggtatcaagttgcactagtatgccgtacaacgacacagactctaaatattggaccaagtggaagtgggaggatgaatttgacactatagttcatggaaaaaatattgattttccaagtcaccatatcactgctcaaatgaggaatcaacgttctgttctcggccttggtggatctatccccatctttattgggtg

SEQ ID NO: 79297 - DNA, 300 bp, Glycine max
  Peptide Sequence Number=SeqID_196075
atggcagaggtgcattggcctgtaatgccttatgcattcgataccaaacaagatgggcctggtcgatctgacgaccagtttgaagggcccacagcaagattaaatcctcctcagaggcttgggcaagagttaatgacctgggagatgaaaaggaaggaggaattggtgctgctgggtcaccggatgttccatggcggtggtggcctgcagtggtggtggtggaggaggatcccttttgtttctttgacgattctaccattggagcttgtttcagctaattctgatcaatgggctttgtag

SEQ ID NO: 79298 - DNA, 294 bp, Glycine max
  Peptide Sequence Number=SeqID_196076
atgtcaagaagcggcaagaaaggatgtggagagagaacatttggtgcattcaaatctcatttcataattatatgtggtccattgggtaattggcaaatgggtaccatgaagaacataatcttggcatacattatattgcacaacatgattgttgaagacgaacgagatacgtacaatggtaacgttgatgttgattacgatcatattgacaatgagatttcaaacattgacctatcttgtggtgctcatcctgactttgctacatacttgcaaacaaagacattatatgcgtag

SEQ ID NO: 79299 - DNA, 1284 bp, Glycine max
  Peptide Sequence Number=SeqID_196077
ctgcgcctgcacgcgctgttcgcgctcgcgcagggcggccacgtcggcatcgatttcgcgcagcggctgggtgaaccaggggtgcaccagcagcagcggtcacggcgtgcgcttggcatcggcatcggccgcctcccgggtcggggccgcagccggcaacggctgcagttcggcggtcatggtgaagcggtcacggccactggcggcgccatcggcctgcagtacgccggtcagattgaccttgcgccactgcggcgcatcctgcagcagctgcaccagctgcgaggcctcgcggctcaggccgatcagctgcaggttgttgttctcgatggccagcttttccaggtaggtgccctccggcaggcgccgggtcagttcattccagatttccaccgttccggcgcgctggctgcgctgcttttccaggaatgcggcaccatcgatcagtgcctgcagctgcgcgcgttcgctggcgacaccacgcgcactgcgcgcactgcgttcaacctgcgcacgcagctcatcggcggcggcacggcggttgtcgagcagctgcagggccgccagcaccagcatcaccagcgcggccacggccagcagcacattccagcgccgcgtcggatccacccgcagctggcgctgccccggcggcaacagattcacctgcagggggtcaccgtgggcgtcgatggcatcgacaccggccagcgcatcggcccactcgcccacgctggcgcgccacgcttcaagctggcgcaatggccaggcaaccagttcgacctgcagctggccttcggccgcgctcccgagttcacgcacgtcatagctgacctggctggattcgaacggcgtctggcggtcgatctcgaaaccgaccacggcgcgcaggcggtcggccgcagccgcaggcaggcgcagatgacgacgcagtacttcgctggccggcagcagccacgcccgcggcaggctgcgcagtcgcggttccagcacgcggtccagttcggccggcgacagcggccacggcacgctggccaccgcttcgcggcgctcaccggcctctcgccagacctgcagctggtcaccctggcgctgcagcagcaggcgcgcctgtgcccagcccagtgcccactgccaacgcgccggcacccaggccagcagcgattgccgccaccagcgcaggaaacggccggcgccagggccgatccggccctgcacctgccgcacactgtcctgccatgccgtcatcttgctgtcattccctgctcccagcgaagcactgtgtag

SEQ ID NO: 79300 - DNA, 543 bp, Glycine max
  Peptide Sequence Number=SeqID_196078
atgcatgtcatttcagggaccgagtatcccacttccaatctatatcttggtgaagtttggaagatgaaacaagtacttgaagaatcatgtactgatgaagggaatactagtggcagcaacacctcttctaattttgtgcacaagtctacaattgttactggatttgatgaaataattaatattgtgagagagaaagttgtccatgcaatgaaatccgaaatagatgtttatcttgaagaggatgtttgtgttactaaaagtgatagctcttattttagtgctttggagtggtggaaaaacaatagtttgaaatataaggttttatcaaagatgtcaactgatatattggccattccaatctcaactgttgcatcagggactagtgttagtgctagagggagagttatagatgaatatcaatcaaaattgaatgaggaatccattgaagctctcatttgtggagaagattggtttcgtcacaaatataacttgaagaagaaagaggtggatgaaccacttaaagtgatcaatttgaagatttga

SEQ ID NO: 79301 - DNA, 210 bp, Glycine max
  Peptide Sequence Number=SeqID_196079
atggatcatcatcgccacagagttgccgacgagatagatgtcgatgccgatagtgtcgaggtgcaccgcggcgaggtagttgtatgcgatgaccaaggtgatgggctaggaggcgcggtgcttctaccacaactagttcagcgtcacacacttaagtcattcatcacacacacgaggtggaagatgaaggttaaggaggataaggagtga

SEQ ID NO: 79302 - DNA, 249 bp, Glycine max
  Peptide Sequence Number=SeqID_196080
atgcagatagcggtgttcatttcttctattgatgttgtaaagccaggttggcttttgaaatatttaaaaggcattagacctgctcatatcaaagcaatgcaacaaaatcttgccaagatggttggcaaggtggtgaacatcaagctacacaccagaagatcccaacgtgtagtggaaggatcaagaagtcagtgtacttgtgaatgcaggtctggcaaaatcactaatactgcttcaataatttcttga

SEQ ID NO: 79303 - DNA, 1011 bp, Glycine max
  Peptide Sequence Number=SeqID_196081
atgactaacagtgttgcagagtctgaacgacattaccttatattcatagtggctatgatgcattcgaaaaacggttttgtggatgtctgccttcgccatgagaatttggtgaaacccttgcctgagatcgagtttcgagaaccaagatgtgtcactcagtttatccaggaactcgtctatggtaggcataggaaattgatctttgattgtgatcgagttaagagctcggtaggagatggatatggtgggcaatggtgcgaggtggaggtaaggttgtgggctcatgaaacaagaggtcaaaatgacagaggagtgtggtttaatgatgtggtcgaggcgggtaaccaggatagatggagcttggcggagatgttctggtacggggcccaaatcttgcaaccattggatcccaagcacaatatctgcactattaaggcccaagatgaagaggtcgacctgaaaggaggtggagaggttcagaaagttggcgacacatggttgtacaaagttgtgtgtactaccatcatccacaagaattgtcacctggtggatgaatgtggtgggcttagagggtcatcaggtggagtctctacaggcaacaaagtctcaagacctttgtcgcagcataccgctaattcctccgatgataagcgtttcaccggaactcgtaatggtgagggtcatgtaggaggtggcatggaaaacaagggaggagtttggccactacgacagcttggggcaacggtagaggttgcaaggcttggacctctcaacggagttcaagacatcgccgaccaagacgtcaggaagccgttgcgcgacatccattggttccggcaaagggctggaccttccatgaaaaatgatgcgatggtggtggttgtggggttggtggtgagtgcggtgatggaggaaaggataagtaaggcagttgacggcctcctcaagacgttcggtggtagccaaatgggtattgtgttcgggcatgatggatatgacagagcaggttaa

SEQ ID NO: 79304 - DNA, 414 bp, Glycine max
  Peptide Sequence Number=SeqID_196082
atgacaacatgctcgaggagatgctcgtccactgtcgttgccgcaccgtggcgcatggagccaagacgctgcatctcattggggacttggattttaggacctaggagtccagctccaatcaggtcatgctcgtgtgcggtgcatattgcagttcgtatattgaaagaagggggaatgaatgccataaaaatggagggagggttgccttcaagaattgttgcagcaaaggctatcgttgaggttggaattgttgtcataggccatgtaggccttactccccatgccattagtgttttaggggggtttagacctcaaggaaagaatgttgctagtgttgtcaagagtgtgtgcctacatggttgcgactacaaccacgacagcccttcaaattcctacaattggaattggggctag

SEQ ID NO: 79305 - DNA, 474 bp, Glycine max
  Peptide Sequence Number=SeqID_196083
atgagtccactgcctctattgatgttgagccttgtaaatactaaggtagcgacaggggaggtttgctgtaggttgcttcgaaaggggatataccagtggtcgaatgaacaatggtattgcacaaaggtattgtttgagggtccggttcaagacctttgtttggccgtcggtctcaaaatgagcgaggtcttcccagataaaggttggaatgggaagaggttgaaggaggctagtcggatttcgggttttgtacttgacttgctggcaagtaaggtactcggatatgaaggcacgcacatcctttcacatgtttggccaacaaaaattatcttgtattcgtctaagtgttttcgcaatgcccctatgtccgcccaaaagggtggcgtggaattctgcaaaaagagtggggatgaaatcatggctgaagggaagccacaacttgcggtggttgaaaatgaggcccctttgaattga

SEQ ID NO: 79306 - DNA, 975 bp, Glycine max
  Peptide Sequence Number=SeqID_196084
atggaaggaaaagaaactgagggaatgttgaagatgacgacagataagagacaacagaagcgaagcagaagtgacagagaagaggaaagggacaggctgagtgagttgcctgactgtgttgtgctccacataatggaatttatggacacaaaatatgctgtacaaacttgtgtcttgtctaaaagatggaaggacctttggaagcgtctaacttatcttggattcaatacaaccctctttaaaaatgttgtcaaattcaacaaatttgtgtctcgcgttctgtctggccgagatggttcagtttccctgctcaatcttgaattcacgtgtcgcggtatggcagagcccaagctcttcaataggctgatgaaatatgctgtgctgcacaatgttcagcagtttacagtatctctaaatttaagcttcagacagagtttcgagtttcgcccctacatcttttcctgtgagtccttgacatttctgaagctttcatttaattcttttgacacctcgattgtagcacttccaggatctctgaacatgccagcattaaaaagcttgcaacttgaggctgtctcttttactgcaagggacaatgactatgctgagccgttttctacctgtaatgtgctgaatactttgatacttgatggttgttcgttgcataaagatgcaaaattcctctctatatcaaattctagcctctctagtttgaccataagtggtagctttgaaggaggagcttacaaaattgcgctttctactccaaaccttagttctctcacagtcacgggtcataataatcacacaatctcctccgcatgcaatctttctttccttgaagaagtaaccattgacacccttggttatacactttttccgaatacagacttactcatcataagctggctgcaagttctcaccaatgtaaagatactgaggctctattcgggtacccttctgacaatactacgg

SEQ ID NO: 79307 - DNA, 225 bp, Glycine max
  Peptide Sequence Number=SeqID_196085
atgtcggcttcccaatttggaggggagtgtgcttattgcaactctttggctgttgaagagagtgaatatgcttttatggatgttgttgaatctgattctcttgaaattggttatactaatgttgatttagattcctctgaaatggaacttgacatgggtgatgagatgactacactttcaagtttagtttctatcatgcatatcttttgtataattataatctaa

SEQ ID NO: 79308 - DNA, 186 bp, Glycine max
  Peptide Sequence Number=SeqID_196086
atgacaggtggcaaggggagagagggaggagagagaaggttccttgttcatacattgttgatccaggccctcaaaggatcctatgtggctcaatttggaaccctatcagagcaatcggaggaaaaatttgaggaatctcaggaaaccgttagagatgttgctattgttgtcacaatgcacacgtga

SEQ ID NO: 79309 - DNA, 3483 bp, Glycine max
  Peptide Sequence Number=SeqID_196087
atgacgagttcaagcgtgaagaatgaagatgaagagaaggggtctctagctggttcgagtaagactgagatttttagggatagtgccaaacactcagtctcaaacgcactattttgttctttttttgggttgataatgagacttcaaaatgacatcgtagaggaagattacagagatatgagttctcaaattcggagagaaagaagggaatggtccagggttccaccacaaggtgctactcgtcaagaatgggtccccagaggggctgctgctgctgctgcgtccaccaatgtcgctcagccatcaaatttgcattcaaacaacaatgctgatgctggttcttccaatctaggggtggctgttgctgctccgtccgtgagtcgcagtagaagcaacaatcatgggaatgatgttggttcttccaatcaaggggtggctgttgctgctctgccggtcagtcggggtagaagcaacaatcatgggaatgatgccgggttttccaatcaaggggtggctgttgctgctctgccggtgagtcacggtagaagcaacaatcatggaaatgatgccgggccttccaatcaaggggtggctgttgcttctccgccggtgagtcacggtagaagcaacaatcctgggaatggtgctggttcttccaatcaaggtttggcagttgctgctccgccggtgaatcgtggtagaagcaaaaatcatgggaaagattctgtctcttccaatcaaggggtggctgttgctgcactggggagtcgtggtagaagcaacaatcatgggagtcattggatggaaatggaaaaggataaggggagcaggagtgggagtcaggtggagaagggattgagagtgggagtcagagactctagtttgcctcaattggtgcaagagattcaggagaagctcatgaaaggtaccgtggagtgcatgatttgctatgagatggtccagaggtctgtgccggtttggtcttgctccagctgttactctatctttcacctgaactgcatcaagaagtgggctagggcaccaatctcaagtgatttgtccttgtccgtggagaagaatcacgagcttaattggcggtgtcctggttgtcagtctgtgaaatttacctcttcaaaggagattagatatgtttgcttttgtggaaagaggatagaccctccatctgatttgtatctgacaccacattcatgtggagaaccatgtgggaagcctcttcagagggaggtgttggttcctggagggaatagggatgatctttgccctcatgcttgtgtcttgcaatgccatccaggaccatgccctccctgtaaagcatttgctcctccgcggttgtgcccttgtgggaagaaaaatattaccacccgatgctctgatcggcagtctgttcttacctgtgggcagtgctgtggtaaacttcttgaatgtgggcgccatcgctgtgaacgcatttgtcatgtgggttcatgtgatccttgtaaggttccaagcagtgcaacttgcttttgcagtaaaaatatggaggttgttctttgtggggacatgactgtgaagggtgaaattgaagcaaaaggtggggttttttcttgtagttcctattgtctaaagatacttggttgtggtaatcatgtctgtagtgagatttgtcatccaggaagctgtgtggaatgtgaattgttacctagccgggttaagacatgctgttgtgggaaaacaaggttggagaatgaacgccagagttgtttggatccgatacctacctgctcgaaagtatgtggcaagctgcttcattgtggcatgcatagttgtaaagaggcatgccatgttggggagtgtccaccttgtttggttgaagtttcacagaagtgctgttgtggctcaacttcccgaactgtggagtgctataagactatgatggagaatgagaaatttatgtgtgaaaagtcttgtgggataaaaaagaattgtggaaggcatcgatgtagtgaaaggtgttgtccattttctaattcaaatcattataatacctttagtggggattgggttcctcacttttgttccatgccatgtggaaagaagctaaggtgtggccagcatgtgtgtgaatgtctgtgtcacagtggtcattgtccaccttgtttccaaacaatctttaatgaattggcttgtgcttgtggtaggacttcaatacctcctcctctaccatgtggtacaccgcctccctcatgtcagcttccatgctcagttcctcagccatgtggtcattcagtctcacacagttgccattttggagactgtcctccttgttcagtgcctgttgcaaaagaatgtattggcgggcatgtagttcttagaaacataccttgtggttcgaaggatattagatgcaatcatccctgtgggaagaccaggcagtgtggtttacatgcatgtggcagaacatgtcaccctccaccttgtgataatctatctggtgttgtgcaaggtttcaaagcaccatgtggccaaacatgtggtgctccaagaagaagctgcaggcacacatgtatggctccttgtcacccttcatctccatgcccagatataaggtgtgaattccctgttacaatcacttgctcttgtggccgtataacggcaaatgttccttgtgatgttggtggtagcagtagcaattataatgctgatgccatacatgaagcttccattattcaaacattgcctgtacctcttcaaccagttgatgcaaatggcaagaaagttcccctaggacaaagaaagctgatatgtgatgatgaatgttctaagctggaacgcaaaagggttctcgcggatgcttttgacattactgctccaaatctggactctctccattttggtgataactctctttcttctgaattgcttttagattttttcaggcgtgagccaaaatgggttttagctgttgaggagagatgcaaaattttagtacttggcaagactagaggaacaggaactacacatggtttaaaagtccacatcttttgtcccatgctgaaggaaaaaagagatgcagtgaggttgattgctgatagatggaagcttgcaatcactgctgccggctgggagccaaagcgatttattgtaatttctgttaccccaaaatcaaaggccccggctcgtgtgataggggttaagggtactacaactttaaatgtgcctcttcctcctgtatttgatccgttggttgacatggacctgcgacttgttgtctcatttccagacttaccaagggatactgaaattaattccttggttttgaggtttggtggcgagtgtgagcttgtttggttgaacgacaagaatgctttggctgtttttcatgatcctgctcgagctgcaactgcgatgaggaggttggattatgcaacagtttatcagggagctgttttgctaccaatgcctggggaggagctggggcaatga

SEQ ID NO: 79310 - DNA, 402 bp, Glycine max
  Peptide Sequence Number=SeqID_196088
atggatttgaggttagctcatggtgcttctagaagattcaagctttttattaagcaagctaaggcatcacatccatctattaatatcgaaagagaaaaagaaatcgagagaaaaattggggaagcgaaaaagagcgaaagtgaaagaaggaacggttcatggtggccaagtcaaatacttggccttgatcacctttctacttctcatcttacttctcctcattcaggaactcccgttaaacttctcagaaaggaagactccaacaaggcggagtccacccagggtatgctgttaaagaaaaaagagaaatatacaggtagagaagatgccattcttcatgctcttcaacttgagaggcaaatgttaaagaagcaagaaaaaataggtgatgcttctgactag

SEQ ID NO: 79311 - DNA, 153 bp, Glycine max
  Peptide Sequence Number=SeqID_196089
atggggtttttatattttcttctgcgcttgttctgcttgctgcttatgcttttccatccctccattgcagccaggtacaaatttccttcccctcctcctcctcctcaagcatgctgtcctaagcataggccagatgttgatgcaagtccttga

SEQ ID NO: 79312 - DNA, 309 bp, Glycine max
  Peptide Sequence Number=SeqID_196090
atgggtttagccttccatcacaaggaagcaccttttacaagcaagagaaggggtttgagagaatttcatagatacatagtggggaggatgcttaaaaagggctttctgaccttgaaggcgtgcttagtgcgagtaagtgaacatccactgagcaagctagtcgcgcttagcgcaagaagagacaaacgtctcactgagcaagctgatgatgcactgagcgcacagatgcttctcaaattctcctccagattctcccaactcgctaagcgggctgagtgcctcgctaagtgggctgagtgcctcgcttag

SEQ ID NO: 79313 - DNA, 291 bp, Glycine max
  Peptide Sequence Number=SeqID_196091
atgactaggtggatgacttcaaagaatctcgtgctagacgacgctgggacacaatgctctgctaggatgtgcttggcacccatcattaggcaatttgtgaaattccaggacatgccggaaaaccaaaaaatattgatgcacagtccaaaaatcaagtcgaagtacttccgtaacgcttccgtaagcgattctgtggaaattcttcatcgttcttcaccgttcttcatccgttcttcgttcgttcttcgttcttcaacggttttcttttcttccgtttttaacgtgctttaa

SEQ ID NO: 79314 - DNA, 390 bp, Glycine max
  Peptide Sequence Number=SeqID_196092
atggggcgaagcgggactcgagagcctgcagcatcgccggccaagaaggaaagtaatcattgcggtgcatccactggtaccatgagagggtcggaccatccatatagaaggatgcaatggaggagggtggggagggggaaggggcgaagatacagggacagtgattgccgcaagacgatcgaaaagagactcgatctgagaggaaagggttacatggatagagtcaattttggcgttgagggagtgatggccctgggagagggtagcttggccctcggtcagggaagcttggctctgggaaaggtgttggaaagcctctttaagcttgtccatggtgacctgacgagtatgatgttcaggcatgggaagggggcaggtcggaccagttga

SEQ ID NO: 79315 - DNA, 390 bp, Glycine max
  Peptide Sequence Number=SeqID_196093
atgaagtgtgaggagagtggggttgtgaggttgaaaagaaatggatccagtgggaaccatggaaggaccattgggaaaagccaagctaaaggggaagacccatgggtttgggtagtggtgatgagtggaggaataatcaatggctcagtagcatatgtagaaatggggggcgaacttggtggaggggaggggggggggggtggtgtcgatgcattgtttacggatataggtgaagttcggcggtttttcgtcgctggagaagaagaggtgtaccaacaaaaattcttggtgcctctagcggttcccaagcaaataacatataagactgaacttaaaaggtccttaaaggctacaccaaaagaaaagaacaataacaaaggcccaacatag

SEQ ID NO: 79316 - DNA, 4602 bp, Glycine max
  Peptide Sequence Number=SeqID_196094
tccgttagtagcaccttcatcagaaaaatgcgaactcgctttctcaacaatgactacttcgctctccctccacctcaaaccttccccttcctccacctccccgtccctcgcctccttccgccgccgccatacgccgtctaccaccacctccgctttggtcctccgatccccctctccctccacctcgaccccttccccgttgacgccgtgctctccaccttcctctccgccgtcctacctcaccgaatccacacagctccgtcgaatcccccgcaagaggcggaggttatcttcgaagaatgtgtctccgaagttgatatcaaattttcgaatgagagtaaaactattgctctcaatgataagaacgatgatgtttatgaggcgattcaattcgaaacaccagagcttgacgcgttcttggaaaatgtttatgtcactgagacggagaggatgcaaatgctgtctcaaacttcagaagttgaaaatagcctggacatgctcaagcctgaaccatcaaggcaatacccgtatgaggctctggaatcagtatctttggtagaagatgtaatttcagagtacttgatggggggaaatgcatattctctagaagataatatttctgttcatcaccagccacactctgataaaaacaaattccttattttggaagtggatgaggaaactttgggaattcccacgcgcttctctttgggcaaggagcttttgggttctatgaagcataacatgatggagtttttctcagatgagtgtgtatcaaagaagagtctggagttatctgatctgtttcctgaaagggattttatgaatttgctggaaactgaacttgttgataggaatattggcctgcaaaggacatggcatgctaacactttctatgacacaaaagcttcagatgatctagtaacatacgagtggatgtttaagaaagagtttaacttcaagagttttgatgaattgattgttagtaatgagatagcactaacagatgacacgttcaaatcactgcctgtacctgttatctatgatcacataaagatgataactctacatgacatcatcgtagaacaattttccagcttgaagacccgacctctctctgcctctgatgggatttacttaaactgggatctacttgaagaagataagtgcaattgcaaaatctctaactggtatcagaacatattggccaagatagatctgaacaaccaagattttggaggaacatcttttgatgatggaaaattggtatttgatctagttttctgtgatgataccatagatgaatgtgacattaaacaaaatgaagagttgaagaagttgctttctgattgcatgcctctacttgataatcatcctgtagaagttgcttcaggaaaaattttagaacatgtatcttctaaacaagaaagtcaagaacaattacctgaaagaaaggagagggcttcattgttatttaaatctatgtcagaaatcagcaatcttgattatttcttaaaccctcaaaaagcgactgataaggggaattgtaattatacagtagagtccagtaatgttaatgttagtattccaaaagtttcatccaatgaatcgaaggttggtacacagtcacaaggattccatactgttctgcatagagttaagttgtccaataatattgtgacccttgctggatattttgaaaaaagctatctagccattttgcacagtgatacagagatgacaaaaatgcataactcggatgcagattatttaaaattgttgggtcttcaaaagcacaagctgattgaataccatataaatggaaaccaaatggcatttgtcgtgttatgtgctattaaacaggctgcttggtacttgtgtttctatggtctccatccagcattcttttatttagacaaattatgtcaaaacttggagtatttgaaatcaaagttaggcttcctccaatctttgatcaaagatgaaaaggggaaggtggacaacaatgttactatggcacacccgtcattaacaattgtcaaggagattttacaatcatacatcaaacagaatagtttgaaaactttgattgtggcggaagaaccatgtgccaatactgtgtctgaggacacagatactaaaatgaaagaacttctgatttcagactgcttgttggtttcacacaagcatgtttctcccttgtttccattgaacaaatttgacattatcttggaatatggaggttcatatgactcatctaggatatctaagctttcacaaaacttggttggattgcctcatcttcactttttgagggttgaattggatggccatgctgctctcaaagcactctgcgaaggtgttgaaatgctcccaaacattgaaatgtcaatgggaagtgagactcatcttattttcaatcataaggtaagtatgatgaaccagaacttggagagactactgaacttttgtcctgtggagcaaagctatgataaaaaatcttccaaggttgcacctgaagcagataatcacatgccgctagttcctgctgtgaaaactgagcatggccataaaagcatggaagtttttcctggaacagttatgatcgtaaatactcaaaatgtagataaggaaatgataatgtctagaagaagctcttacctggtaattcttgctatggagaaagaaggaattcaagttgttgaacgtgatttagatttgcctgtggatattatattaagttctgctatttgcttggcatggtatgatagtagaaacctcgggaagaaatcaactccagcgactgaagcgtcctcaagcttgcctttatgtattgagaatattgccacagatgttctgacattgcttagtttttacttccgtggttgctttctggtgtttgaaggagagcttaactttctttcaactgtaatggaatcctcagatggactttatgctgcagcaacaagcctaggaattgatttgcagatattcttctcttactcacctgagttgacaaatgaagttattgtaagctgcattaagagtgctaacaatatgaataggggtctgtatcctaaaatgcctgactcagtgactcttgccgagtcatttcttacagaatttcctggaataaatcctttaactgcacactctatactatcttcaggggtcaagcttaatgagtttcttgtgtggtcacatgagcaaaggatgcatgttttagaaaagtatcatgtcccagacgaaagtatttctctattcagtgttttctgcagatatggggaacgggaggactcaaaatccataatgacagattgctcctcttcagtatcttctggtctggactcagattggtgttgtttatatcaagttgaaaatgaaagaaaaaggaaaaatcctataagtagtcatcagatagatgaactatgtttggatgaattgttgcaatttgagacattaaatcaagtagttgaggctgcgccggattcctctaccttgccaaaaccttttgattttgttatgtcaaaaaatgctggaagatccagtgacttagcaaacgcaagtttgtccatgagtgagtttttcggtcaaaagcaaagcaccggtgcagctacaatgagaaacctttctggagtctcttattcagcagggaactgcaaagctcccaacaaatcagagcaactgaaacaacccagtttatccttgaaaaataaagagttggctcaaaatgaaatactgggtactgctttgatgggcaaaggtgtgaattggcataactttagtaattcaaagaagctgcatgaagacattagaggtgaggtggtggacttgactgatagccccttatttgataaacgctttgccattcctgattccatgtatttcacaagtttgatggcagagaaagagaaagatctgatgagaacgaataaaattgcaaggaaattgtcatttgataatagtagtcacccagaaaccaactcatcaaaaatatggagatccttaaaagacaaacggggagaagttgacaactaccctgaaccagattttcgagaagatatatttcctcttgatttcaagccccgtgaaaacattggctttactcaggcatcgatgagaaacttagaagaatcaccattcaaggaggaactgtcacatttgggagaaactccattctcatatgcccgccagtctgctagtatattaaagaattcaccttggacgattgagtttattaataaagtaaaagaaaagagcagattgcgtcaaaaatcattatcaagtgagaactctggcccttattttgggtaccccgggagcatgtccaaaacttctaagcgaagaagtccttccgtaattgatttgtttaagaaccaacctaatagaacatctggaaatgttccgaaacagaagagacagaagcgatcgggaccatcttcaaactcggtcaagaaagcaagagattccacttcatcatgtactccttgtgataagaaatcaacgaagtttttaggagggatagtctccgtggatactcaccgtagtgcggtgaacaacgtgacaaaatacaaaccgttagatagatctatactcatctaa

SEQ ID NO: 79317 - DNA, 2853 bp, Glycine max
  Peptide Sequence Number=SeqID_196095
atgtttaagttacggagaaagagtaacaagattaaagctgtattcaaactgcaatttcaggcaactcaggtgccaaatatgaaaaagtctgtactgatggtagctttggtgccggacgatgttgggaagccaacggtgaaactagagaaagttgctgtccaggatggaacctgtttatgggagaatccaatttttgaatcagttaaactcgctaaggacacaaaatcaggaaaacttcaggagaaaatctaccattttattgtttcaactgtaagaagtagatttaattgcatactatcttttacctgtctaggatatgttgctggaaagtctaatctctataggttcttgcagggatcttcaaaatctggctttcttggagaatcctcgattgactttgctgattttgctgcagaaactgagccactgactgtgtccctacctctaaagtttgcgaattcaggcgcaatcctgcatgtgacaattcagaatgtggaaggggttcatgcagatcaaagtagtttcagaaatggggaagataatggaaatggaagctcaagacacctacttagcatttgcagtgcagatgaaggttcacataatgttgataaagattttccccagctattaccacccttgagacaaaattcaatgccatcaagaggaactattgaggccattgcaacaagagctcaaatgcataggaggtcaatgggttcagtatcagataggagtttaggtgactactggagaaaaagcctggaagatactcttcctcaagaaagattacaagagcctccagataatgtcactgagaacctcaaaagtgaaattgcttctctaaagacgaaagtggaagaatcagaactagagttacaatcgcttcagaagctgatggaaaaggaatgcagtcgaggacaaagtatgtccagacaaataatcagccttagagatgagagaaatacaatcaaaactaaatatgagcaactcatatcccagaaaaacctcaacaatgtgaccaaatcttcaaaagccttgcagactgagattgcagatgctaggcagcagttagaagcaacaaaggaagagcttgtttatgaaagagagtttagttctaatcttcaattgcaactccaaaagacacaaaactcaaactctgagctgcttttggcagtgagagaacttgaagcaatgctagaacaaaagaataaggaattgttggaaaatactaaagagcatgattatgccacagaattaggtctcttgaagcagaaaactgcagaccagaatggtgagatagacaattgttataagcaacgtgaagagctaaatgaacatataaaagagctccactttgaatgtgagcttctgaagaaagaaaacctgggtatctctttgagattaagacatggagaagcacaaaaaattgtttggcaaaataaacattcagcttctttggcaactatagaacaacttgaatcacaagtacagagattagaagaaaagataaagaatcaggcagatgatttttcagagactttgatttacatcaatgaacttgaaaatcaagtcagtgacttggagagagaactgacaactcaagcagaaaaattcgaaaaagatttacatgccatgcaatgtgcaaaaaatgagcaggaagaaagggccacccaagcagaggaaacattgataaaaacaagacacagcaatgatctcacatgtcagtgttttcagaaagtagaagaaaatgaaaagaagaccatggatgcttatgcagaagctgatgaattgcggaaacagaacaaactaatggaagaaatgctccagaaatgcaatcaagagctcaggcttattacaaatcacaatgaatcaaaactgcaacagctcttgaaccaaatagattcaaaacagaaggcaatagaaatgatgtcacaagaactagagattaagtccaaacaacttgaagatgtacaaaggcatagggatgaacagtatgatgcattattgaagcaaattcaattgctcagaattgaaattacaaagctggtggcagaggagcatgcattatctaaaactgagccaaaagagcacatatctacgatgttaatgcaagagaacaatgatgaggagataaggcttggcaccctaatgtcagaagtagaaatccttaagacccagcacaatgaattaaaacatagattgcacatggaacaagcagagaaagaaaatatgaagaaaaaaatatctcaattagaaggagagctgaataagaaggaagaagatctaagtgctgtagaaaggaggctcgagaatagcaatggacaagcaacagccacaaatattaatttggcttcatggcactacgacagtgctgcatattgttcttccactaatgaatacaataggatttcaaaatcagaaatgcacaaggaaatggatgatgcaaacacccctgttgacaagtctgaaataggaagaacgatatgcatttcagctgagaacaaagtttatctagcatcacacacaagtgaagtgaaaacttgcttggaaaatgaggttatcgtcttcaataatgataatgctggcgagtttcatacaaataaattgttgaatgaagtggaagtacttaaggaaatgaatagatatatgggaactcagctgaaagaaatggaagaaagatattcagagattagtcttaagttcgcagaggtagagggagaaagacaacagcttgttatggctctacgtaatttcaggaatgatacgagtaagatagcgggtaatacttcgcactacaaatatggtggaaaaaaacactataaatgctatcctaaacaggttcttagatcgtaa

SEQ ID NO: 79318 - DNA, 411 bp, Glycine max
  Peptide Sequence Number=SeqID_196096
atggttcgaggggcggtggtggttgcacgagggaggggtagcaatggtggctcgagggtcgacgatggttgtgtgagggaaaggctgcgatggtggtggtgcaatgaagaaaataagagaaatagaatgagggaagtgagaagtgggggaaatccgatggagaaaagaaaagaaagaggggtgtggctcgatgaagaaaagaagagaaagagaatgagggaagtgaacgtgtgtggagaagtgggaaagacactgaacgtgtggggaagtggggaaggctctagaagtgtccgaagaagttatgtattgggaaggttgaaaaaaaaacataattggaatgtcgagaagagagaagtgaataattggaacgttggatgtgaatgttgtggagaattggaacgttggatgtga

SEQ ID NO: 79319 - DNA, 2292 bp, Glycine max
  Peptide Sequence Number=SeqID_196097
atgcttggacaagagaattgtgtccttaaatcaccattcttgctatgtatcttcattggcttcttgatgcattctgttgtgggagctgagattccattgggttccaagctttctgtggttgataatgattattgggtttcctccaatggtgattttgcatttggattctacaacatttcagatcaacctaaccagtttagtgttggcattagattcaattccaagtctataccatatagccaacaaactgtggcttgggttgcaggtggtgatgtcaaagtaggtaacaagtcctactttgaactcactcaggaaggggaactggtcctgtttgattccataggtgagggttctgtttggaccgtcaaaacgggaaaccaatctgtagcttcagcttcacttcttgacaatggaaatcttgttctaatggacaaggagcaaaaaatcatttggcaaagttttgatactccatctgatacacttctcccaggacaaagtttgtttgctaatgaaacgcttcgggctgctaccgcaagcaagaatagcaaggccagttactatactcttcacatgaatgcttcaggtcatttggagctacattgggaaagtggtgttatctactggacaagtgaaaacccttctgcttcaaatctccgtgctttccttacagccagtggagcactagagcttcaagaccgaagcttgaaacctgtttggtctgcatttggagatgatcacaatgattctgtgaagtacagatatcttcggcttgatgtggatggcaatcttcggttgtattcgtgggttgaaagtttaggatcgtggagatcagtctggcaagctgttgagaatcagtgcaaggtctttgcaacttgccgtcaacttggtgtctgtgtgttcaacgcctcaggttctgctgaatgcaaatgcccgtttgaggtaactgggggtaacgaatgtttggttccatatgaggaggagtgtgaatctggctccaatatgatagcatataagaacacatatctatatgcattctaccctcctgataattcttttatcacaagtagtttgcagcaatgtgaacagttgtgcctgaatgacactcaatgtactgtagcaaccttttccaatgatggaactccacaatgctcaataaagaaaactgagtatatcaccggttattcagatccatctgtaagctcaatatcatttgttaagagatgttcaggtccatttgctgtaaatccaggtatcactaagtctcctcctccttccgaaccgcctcctcggttctgtgttccttgcctaataggagcttcaacaggcacatttttcatccttgtcattttccagatgggaattgtgctcttcatctacagaagaaaaaactctaccaggaaaaggtccactttaactttcacaggcacaaattcaaagggtttaattgttttgtccttctcagaaatcaagagcctcacaggggatttcaagaatcaaattgggccaaaggtgttcaagggtttgctaccaaacaaccatccaattgcggttacagacctcaatgcgtccctagaggaaaggaagttccgaagtgctgttatgaagatgggttgcatccaccacaagaaccttgtgaaactggagggttattgttgtgagtttgatcacaggtttttggtgtatgaatattgcaaaaagggttcagtggacaagtacatagatgatgatgctctttgcaaggtgctaacatggagaaagagagttgagatatgctcaagtgtggcaaaggccatatgttatttgcactccgggtgcagggagtttataagccatggaaacttgaaatgcgaaaatgttatgttggacgaaaacttaggagccaaggtgactgaatttgggtttgctattgcagatggcaaagcaacatattgtggcttttcagctgagaaggatatagaggattttggcaagttagttctaaccttgttaaccgggtgtcgcaatcacgatcacattgagctttgtgagtgggcatataaagaatggatggaagagagggtggccaatgtggttgataaaagaatggaagggggctacaaatcagaggaactagagcacgtgttaagaattgcgttttggtgccttcaaatggatgaacgtcggagaccttccatgggggaggtagtaagagtacttgatggtacattgagtgttgatccgccaccacctcctttcgcctttcagaggcccttgcaggtagatgattcagaagaaaatgtttcagagttagaa

SEQ ID NO: 79320 - DNA, 1542 bp, Glycine max
  Peptide Sequence Number=SeqID_196098
ctggatgtcgtgattctggaagtggggctgggtggccggctggatgcgacaaacattgtcgacgccgacgtggcggtgatcaccagcattgcgctggaccacaccgactggctggggccggatcgcgccagcatcggccgcgagaaggccggcgtattccgcggcggtaaaccggcggtggtcggcgaggccgatatgcccgacaccattgcccaggtggccgcggagaagggtgcgcagctgttacaaattaaccgcgactggcagtggcagcgcgagggcgacacttggacgctgcaggatgcccagggtgaactgcgcgatctgccgctgccccaggtgccgctccctaacgcggccaccgccattgcggcgctgcgcgcttccggcctgacggtgagcgaggcgctgattcgtcagcatctgccgctggcgattctgccgggacgtttccagacggtcagcaccgcgccgcgcgtgatccttgatgtggcacacaatccgcatgcggcttattatctggcttcacgtctcgctgagctgccggcacacggcacggtgcatgcggtggttggcatgctgcacgacaaggatatcgccgggacgctggccgcgctggcaccgcaggtcaaccgctggtactgcgcgccgctcgacggcccgcgcggcgcgtccgctgatgagctgatggcgcatctgcagggcggcagcgcctggcagagcgttgaagccgcgtggcaggcggcgcggcagcaggctcagcccgacgatgtgattctggtgtgcggctcgttccacaccgtggcgcagaatcgtttagtgggtacggtgattctggtggcgattggcgtcatcgtgttaccgggtctgctggatggtaagaaaaagcattataaagaggagttcgcggcgattccgctggtgccaaagcctgacgatcagcaggacagcgaaatggtgccgccggtgacgcagccgctgccgtcgcagccgccggaaggcgcgagcgcggcgcagcaggcgcccgccagcagcgcaacgcagagcagtgccgccagcggcagcacgcagccagcgcaaaacagccagcccagcgtcgtgacgccgccgccggtgcaccagcagcagaaaccggcagagcaggtgaagccgaagccggtcgagcagccgaagcctaaaccggtggagcagccgaaaccgaagccggcagaacaaccgaaagcgacagaacagccaaaaactacagagcagcctaaagcggcggaaacgccgaagcagagcgaaccggccgcgccagcaggacaggcgtatgtggtacagctcggcgcgctgaagaacgccgccaaagtgaatgagatcgtggcgcagctgcggctctccggctatcgcgcctttaccgtgccgtcgacgccggtgcaggggcagatcacccgcatttacgtcgggccggatgcgtccaaagcgaaactgcagggcgcactcggtgagctgaaaggcatctccggcctcggtggggttgtgaagccgtacagcacacgctga

SEQ ID NO: 79321 - DNA, 1230 bp, Glycine max
  Peptide Sequence Number=SeqID_196099
atgcaggaagaagaggagagacctctcataagaaaaagaaagttacctacgacttcgaccaaatctgctgaccaaacagaggcaggcaattcccaggctcaaatgcctaagaagaaaaagaaagtgaaacaggtcgagcctgaaccttctgtggctgtcgagggtggtgagccagccaagaagaaaaagaaaaaaaccaagtcttcaaaagaacaaggtaacaaacaacctgttgacgtccaaccaccttcgaccgatattgacggcactgaggtagaagctgctccttctattgctgagatgggcaaccctgtcgagcaaccgaacttaccacaagaacaaactgccgtcgaggtgcaacgaaatgtttctgcagaagaaatacccttatgtgcgcgaacatctcccgctcctgaggcggatgcagtgaatgttgaggaatgggatgaaggtcacggcattggatccagtagtcctcatggttgggcagaggttgatgatcaacatgagccgaaccagtcagataataccatttctcatgaatcgagtcagaaaagtttatctgaagaaaacttttttgatgaagatgccataaaagaggctgaagctggaggctcagacatttacccggtatcctcgacatctaaactttctgctagcatagggattgcagaagatacattcattcaaatgcaaaatgaagaccctgctgcagcccttcgactcctgctgaacacaagtcaagccaacacctcaagtgacaagattcctggtgcttcgacctcatctgatgctgaaataaactcttcagtacgccaagattctctacttttgaagttatcaacggaatacgcactgaaagatgtgcttaaatccattgaagagaacccctctgctgcctttgggcacctgaactttttgaagaaattgcacaacccccttacctctgatgagactctaggcaaagttatccaaatcgaggccatcattgaccagtttgcaagtgctgtgcagaaaaaacgcgaaaatggcacaagactagatgcccagaaacaggcacatacccttctgctcgagaaagcccgagctgctcaacatgaagtcgaacgtctcaccaaagaggcgaaagaagggtcttctgagatcaaagattgtgatgataacatctcttcctgggaagcaactattacggatctgctgtttcaagtcgatgatctaaggcagaaaatt

SEQ ID NO: 79322 - DNA, 234 bp, Glycine max
  Peptide Sequence Number=SeqID_196100
atgggaaaagaaatgaaaaaaggtatatgcaaatgggtgaacaaagaggaaggacctaaatttctcaaagaggttatgaaacttgatgcaaaaggaattaatcatgttgaagaatcatcaggtaagacaaatgagacaattgataaaaaatggaaggtgcagaccattggtagaaaacagctagaaaaggatatctcacaacctataattgcggcaacaagacctcaatattaa

SEQ ID NO: 79323 - DNA, 325 bp, Glycine max
  Peptide Sequence Number=SeqID_196101
atggaatgcactttctcttgtgttgttgtcaatgtggaacatctaagtgtaaatgaaatcaacagttttgctaccttgagcattgggcttatgtggccttgtgctagggttttctttgagccacagttccaagagcagtgtagggttttctttgagttttcttcgatagggggttctgtgggttcgagcgagcggtttccggcagatttcaagtgggaggagaaagagaagagagactgcatggttttcgagcgcgcgggcctgggtggttttgaggaggcagcgatggccgacgaggatcttgatgaatttagggtagagcttg

SEQ ID NO: 79324 - DNA, 369 bp, Glycine max
  Peptide Sequence Number=SeqID_196102
atgaaccctatttgtgcaaaggtccaaaacctccaaaccaaaacagtcaacaaaaccattaagaatggggccagagaatgggactcagtcatgtatagatcatttctgagatgtgatgatccaaaaggagtagtagaatgtgggataatcaggaaatacaagactcgttctcacaaagtaaaggacaagacaaaaatcctgaagacgggtgaaaacttggagacatccttgtccttgatgaacaaaagatacaaagaagagaataaggtcccaaaaggatgtgatggaaatctcatcgatccatcatcttatagagatattatgtttgatgaaaagtctgaagatattgcagaaggtattgcaaaatga

SEQ ID NO: 79325 - DNA, 318 bp, Glycine max
  Peptide Sequence Number=SeqID_196103
atgtgtgatagtatcattgacacacttcttaacattaaaggcaagacaaaggatggtttgaatactcgtcaagatctagctgagatgagtatacgtgaccagttacatcctagtaacatcattgatcctctaaagttagatggcttggaaaatgaggctattattatcttatgtcagttggagatggagattaaactgtgtagccgcatttatttatggtggatgtacccagttgaacgatacatgaagatcttagaagggtatacaaagaatctacaccatctagaagcatccattgttgaaaggtacattgtataa

SEQ ID NO: 79326 - DNA, 336 bp, Glycine max
  Peptide Sequence Number=SeqID_196104
atgacagattgcagaaatacaagtagtgggaatgcctcctccacctctagaacctcacaatctctcacaaactcatctcaagctctcaggatagcttcctcttccagctctggtggctctattcgttctcatgcgcttagtgcaattctgaaccgcttagcgcggcttttctcgctaagtggatggactaaagcagtgcgcttagcgagattgtccttcactcagcgaacatgcacatcttatccttcttccggattcatcctcatgcttagccgaggattattgcacttagctgatggcttgctaagccagcagattggattagcaagagggtga

SEQ ID NO: 79327 - DNA, 840 bp, Glycine max
  Peptide Sequence Number=SeqID_196105
atggtggcattgtcgttggtttggaggacgtttatgggggcagagttgtttgcgctgacggaggcgtcgaaaatggctttgtatgtggttttggggaaattcgggcgaaggaatgacccagggtttcatccaatggcatcgtctccgcaaacttcagccggtctcggttcaccaatatttgacaaacttgaagctgagctggctaaagctgttatgtcattgcttgcaaccaatatactaaaacttgcttatgcatcaccagaaggaaaagaatcagaggggaagttggtggtgaagatgaaggaggaattgaacctatccaaagatgattgggacaaaatcagcgagttgcctgacaacatcttgctccacatgatgaattttatggacacaagagaagctgttcagacttgtgtattgtctaaacgatggaataatctttggaaacgtctcacgtctctactattcaattcctcggaatttgaaagtgttttcaaatttaacaaattcttgtctaagtttctgtccgatcgagatgactccatttctctacttaatgtcgatttggatttcagacctccccatgagattgcttgtctaagtgattgcaccttatattatttaggtttcttaggccgtcctcgctttgagctcgaacccctaaataggctaatggaatatgctgtgtcgcgcaattgtcagcgcttttcaatcaacgtaggttttgattgcagattggatgttgatcctgtctgcttctgtccctcgttgacaattcttcggctttcctttacgccttatggtgcaaattgtaaacttccaaaatctctgcagctgccg

SEQ ID NO: 79328 - DNA, 921 bp, Glycine max
  Peptide Sequence Number=SeqID_196106
atggcatcaccagaaagaaaagagtcagaggagaagttggtggtgaagatgaatgaggggttgaacctatccaaagatgatagggacaaaatcagtgagatgcctgacaacatcttgctccacatgatgaattttatggacacaagagaagctgttcagacttgtgtattgtctaaacgatggaataatctttggaaacgtctcacgtctctactattcaattcctcgaaatttggaagtgttgtcaaaattatcaatttcttgtatatgtttctatctgatcgagatgactccatttctctatctactgtctatttggatctcagtcaacgtccacgtgattccacaagttgtttaggtttcttaatcactcatgcctatgattgggaatgcctaaatagatgttctttggaccagtatgctgaagtcatatgcatatcaaattctaacctttcctgtttgattctggataatgccatggaagatgctgatacaattgtcctttctactccaaaacttagtttgctaactatcaaagatgacttttgtaggaataaatactcctccacatgcaatctttcttttcttgaaaaagtatatgtagatgcttctggttataatgaggattcttcagaacacctaagttggctgcaactggtcactaatataaaggaaatgatactttcggcggataccattagttttattcgaaagggtcttgaagttcttgactcagtgagaattcaacctcctggctttgttaatttagagtcccttgtggtaaaacgtgattcattcgattttatatctgatgaagaagtaaattgtgtagtgcggtttttacttcagaactctatacaaactctagatgaagaaaagacggagtgtgctgttactctgtggaacgtcgcagagacatag

SEQ ID NO: 79329 - DNA, 156 bp, Glycine max
  Peptide Sequence Number=SeqID_196107
atgagaatgccaactactattgaaggaagttcccagaatggtagaaagcaagggacagatgaaacggccacagctaagaatagtgcatcttatatcgggaagagattgttagaaagtttggttgcagttgcagggcttctaatttggctttcatga

SEQ ID NO: 79330 - DNA, 279 bp, Glycine max
  Peptide Sequence Number=SeqID_196108
atgcagctgtcttctcaagaggaggctataaaacagaaggatgtcctggctacagaagtttcctctcttagaggagagttgcaacaagaaaaatgttctttgaaagataatcagataaaggcattggaagagcaactagcaactacagagaagaaactacaggagttaaaagggaacattcgtgtattctgtcgagtgaggcctttattagctgatgaaagttgtagcacagaaggcaagattttcagttatccaacctcaatggaaacttctggatga

SEQ ID NO: 79331 - DNA, 108 bp, Glycine max
  Peptide Sequence Number=SeqID_196109
atggaaaaagttcccggcaatggcgccaaaatacttgatggatttgctctgggatactacttgtctgtgtggatgcgaaatctaccggcaagtgcaccgggccgtcaa

SEQ ID NO: 79332 - DNA, 279 bp, Glycine max
  Peptide Sequence Number=SeqID_196110
atgactaaagcacgtcaaaagggggtacgaaaaggaaaagagggagaagcttgccacccagctcgcccaggcgagctaggttgcttcctccagaaggcaccgccttctggtggaacttcctggaaggcccaaattgtgcaacaatgcttccttttgacttccggcatgtcacagaacttcacggattgtgcaacaatgctttcatttgacttccggcatgaaccgattgggaaaataacaaaaactgtattttcccctcaccggaggctccgtacttga

SEQ ID NO: 79333 - DNA, 327 bp, Glycine max
  Peptide Sequence Number=SeqID_196111
atgacgtgcgaccattctttggtcctcgtgaggtgcttggcacccatcattaggcaatttgtgaaattccaggacatgccgaaaaaccaaaaaaatattgatgcacaatcccacccaggcccacttgggccctctggaatattcctccagaaggcggttgcttctggaggaagcaaccctgctcgcctgggcgagctgggcggcaaccacctcccctattttgctataaataggggaggaaggcaagaaggaaggggttcagcccctgaggcacttctctctctttcgaatttgcttggaaaaattgtttccgtgaagaaaatctaa

SEQ ID NO: 79334 - DNA, 393 bp, Glycine max
  Peptide Sequence Number=SeqID_196112
atggaaaagttctcagcatcacctattccaattcagaaaaaagataaatttagtctcgaacaatgtcctaaaactgatctggcacgaagacaaatggaaacaattcattatgcaccagttgttgggagtattatgtatgctaagatttgtactcaacaagacatatgctttgcaactgaaatgttaggaagatatcaaagtaacctaggaatggaacattggagagctgcaaagaagcgaaagggcgaaaaggccaaaatagatgggccaaagcgtttgtctctaagggagaaaacgagcggtcgccaccaacgtttattcgaggaaaacgacaaaaaaatgaaaaagactgtggattttgaaaatgagggttcgggagttgtttacgcatga

SEQ ID NO: 79335 - DNA, 261 bp, Glycine max
  Peptide Sequence Number=SeqID_196113
atggagtctcttcctcgccttcgttcacattattgtctcccaaaaactcgtacacactatcgctttcaggttcggaatgagaatattattcgaaaacaacaacatcttctggttggttgggtaattttcgattgcggaggaagcggatacaatgacgtgaaaaagcagttttcgagtagtgataataccccaaagctcagcttcaagcacactacagaaaccaaatctccaagagaagaccattatgaacttgccatttga

SEQ ID NO: 79336 - DNA, 414 bp, Glycine max
  Peptide Sequence Number=SeqID_196114
atggcggtgatgcggtgttttgatcgggcgaagatttatgtgaaggtgggggacgaggggaacgacgtggtagcgttccggcgggagaagtacgtgccgatgggggggcatcgggggcgacggagggaagggtgggacgtgtacgtggagcgtgcatttccgggcagagagaggggaccaccggtaggggagcatgcagagtggggtaaaaggcgaagatgtggtggtgaagcttcttcgattcagagagagagaggttttggtggtggtgggactcttacggtagccatggcgatgtccgtgatgcgtggttcagagaaaggaaccgtcgctagttcgcatcacaaacttcttactaatgcttttggccattgctgtgataatatttggagtgtggatgagcactcatcatga

SEQ ID NO: 79337 - DNA, 2100 bp, Glycine max
  Peptide Sequence Number=SeqID_196115
atggctacgaaggttgacagtacgatcattggatcatccaagaccaattgtataggtggatgccgcaactggccgaggatcgggcctacacaaagagaaattccacaattatcttggggtcaagatgaacaagatccttcggtcaaatatgacgtagacaaagaaacttgggagcaatttgccgcaagccgtaagacccctaactggcaggcctcattggaagaacaattgtcacagggtacgtttgtcctgaatggtcgtcaagacatacttaatacagccattgggggaccggatcatggagggcgtgttcgtgcagcgggttctagggtgacaataactcaatactttaggaagacagcacatggctctagtagctcacgtagatccttcagccaacaacagggatcgaccgtctcagctcctattcagccagatatacaactattaggtgcaagagtcagcacaaaggggagcaatgcggaggctgttgtgaacccatcttcgccagatcatgttagtcctgtcaagcctactataaggttgtatgtccataggcaactttgtacagagttggtggccttgggaaaaacatatgacgaaggctctaccatacatagtgtggcttatgcagatgatgtcgtcagggttagtgttgacttggttattaaaggtgaagctgaagtcccatttccgacatcagacattaagtatgtcagccaggcgctagacacattcattgcatggccaacatcacttgtaaaactagtctcaaataagcttacaagcagtactccaaataaagacaatgaaccttttcaaccggtcaatgatgttcctgtagagggcccgttgcgcgagttgattaagagcctagttgacatttatgagaagcctatagagttcgtatgggatcctgctagatttggaattccaaatggatgtcaacaaaatcatatcaggcgtacaatgtttgaacataactatagtacacttgtgaaccatctcgttttgtgtccagcagagaactgtgttgtgtggttttgttctttgcgtagaaagccagatgttcatataaaatctgcaattaacaatgcatttaagacattaaattcgacttctgaggggaaatctgatcaaactaccccaaggtggctagaaattaagagtcacattcaaagcggaggctatgagtgtggctattatgtcatgcaatggatgtggaacataatcggcgaggaggtgaagactgattggacgatgccaacctttgcagaatcaaagggagcttctcacatcccttcaaccaaccactctatcacagacctctatgatgatgtagctgatgagcttgcagcttccatcccagtcgatgacttgtctctcctcacttcacatgaccctcaaattcacaccaaagctctgtaccaacttggcaaggcctatgcaaaatggggtttcttcatgggagaaggggagactggagagctcacaaatgatgagactctggagaagctggtggaggatgtgaagaaaaagtctcgtgagtttcatgattttccggtggaagaaaaggagtttagtgacaaatgcccttttacacccatcaggtatggcaccaacttttatcctgaagcagagaatgttcattattggagagattatctcaaggtcatcacatttcctgaattcaacttcccccaaaaaccaccaggttacaggttgcctatgattatagataaaaaattcagagtctggcttgcagcttttgattgcaaacctgtacccaccatgtttgcagccacaccttgctcttgggatgcttccacactccttcctgacctcggggttgctgaaattgacattcaaactaagaagatgaaagaagagcaaaaaatgaaagaagcacaggcaacagcagtcgcagagcatggagaggtagcactaattactgtagaaggtatccagtctgccaatagaaagattaccattgaggccaccaatgttgcaggtttcctaacacctcttttcttttctccattcctaaacctgaccttgtttaggaattacgaggaaggaaccaagatcctcaccacttga

SEQ ID NO: 79338 - DNA, 369 bp, Glycine max
  Peptide Sequence Number=SeqID_196116
atgtataccatgatgcagggcattctgtcaaacagcaaaccaatagcaatcaaacaattatcacctaaatcagagcaaggaacccatgagtttataaatgacataggcatcagcgttgtattgagggaaaacaatagccatgcagcagcattatttgataaagaagtagtagtaaatgggttatctgaggaccaagcatggtcagcttgccaaaccgctgcgggaagggctctgtggaagcatgccatccatgatccactggctgacgtgctggcaggagagacttacttgagaaacctccatgaaaagatcaagaaagacattgtcaacaatgctcgcgaaacttccggagtcattgtcgcagtttga

SEQ ID NO: 79339 - DNA, 312 bp, Glycine max
  Peptide Sequence Number=SeqID_196117
atgacaatggcagtgagatctaaaacaatggcacggagacttgaagctttcctcgtacctcgatcagatcaccatgaaatgtacctagggttaaccgaaacaacacagacctacaaaaacctaatccttgcaagagcacgacttccacaaaccaactccttgcaacacacacaaacaaacatccttgcagtgagcaaaagttccccaaacaaagaaacaaagaagaagaagaagaagaagaagaagaagaagaagaagaaaacaaatactaaggtccttgcggttacaaagaagaagaagaagaagttgtaa

SEQ ID NO: 79340 - DNA, 216 bp, Glycine max
  Peptide Sequence Number=SeqID_196118
atgtcattgcctagcgctgttcatgtgccctccaccttcgagtctggagcccagcgaatgtcattgcctagtgctcgcggagcctctggtgactgggaaatatgtttttctgttattttccggatcggttccttcgccaaaccctttgttgcacaatatgtgaagtcccgacacgtgccgaaaaatcaaaaggaagcaggcttacgcgatccgtga

SEQ ID NO: 79341 - DNA, 287 bp, Glycine max
  Peptide Sequence Number=SeqID_196119
atgaagcttgcttctacagaagcctctaatggccctcctccatcccgagagtatatatgtttccttgagaaaacactactaagaaccagggaggcatttgttgaagctcttcatgatacaactcatgttgaaagagaaaccaaaagatggaaggtccttaggaagttcttctttaagatgtttgttgaagccccaatggatagttcatctgatcatgaatctgggggtgagttctttcacaagcttggaaaggaagaagaagctgccaaacaaaaggaagagaagaa

SEQ ID NO: 79342 - DNA, 177 bp, Glycine max
  Peptide Sequence Number=SeqID_196120
atgaacaaaaggccccaatggaaagctaaaaactcaacgattgaatacttacttgctggagtgagtaggaatcccaaaaatgaaagcaaaatgcaaccaaaagtggcttggggaagcaaaaactccaagcctcgggttgctcgcccaggcgagctaacctaccaaatttttttttag

SEQ ID NO: 79343 - DNA, 1030 bp, Glycine max
  Peptide Sequence Number=SeqID_196121
atgatgtcatctgcagtggctcccgccgttaatcaaaagcgcgtactgattgccggatccgtcggcaattttatcgagtggtatgaattcgccgtgtacggtttcatggccacgctgatcgctaaacatttcttccagctggaaggagaaagcgccctcaccagcctgatcctcacctatgcggcctttgcggtggcgttcttttttcgcccgttaggggcggtgctgtttggccgcctgggcgatcgctatggccgtaaaccggtgctgatcgcggtgctggtattgatgacgctggccaccgtcgccatcggtctggtcccggtttatgccagcattggcgtggctgcgccgctgctgattacactgctacgcattttgcagggactgtttgccggcggagaatacggcggcgcggtctcgctgatgaccgaatcggcgccgcccggcaagcgcggattttatggcgcatggcagtcgctgacggtggcgctcggactgctggcgggcgcgggcgtggtggcagtactgccgctgctgctgggagacgccgccatgaacgcctggggctggcgtattcccttcctgctggcgctgccgctcggcgcagtggcgttgtggctgcgcagcggcctcgatgaatcaccgcagttcagccagacaccggcggcaccacaacagcaggcatcgctgggtgtcacgctgcgcgctatcgtgctgggcattgggcggttaatgatatggtcagccgccggttatacctacctggtaatcatgcctacctatctgcaggccgcgctgcataccggctttaaccaggcgctgctgattgcggtaatctctaacctcggctttgccgccaccatcctgccggccggcatactcagcgatcgctatggccgccgcacattaatgctgctggcaacgtttttgctgctggtgctggctttcccgctgctgaaagtgttgcagcacccggagagcggtatggcgatcaaagcgctggtggtgtttatcgccgagtgcgttg

SEQ ID NO: 79344 - DNA, 500 bp, Glycine max
  Peptide Sequence Number=SeqID_196122
tagatttgactgattctgaaaattatggtcaaccagtcgatgttaacttgataacattagataaagttcacaaagaagacgagggacatgatccttttgatgactttgaaaccaatgcaattgggagcatgcttcccgatgatgaagaggaccttttggctgggattatggatgattttgacctcagtaaattgcccagtcaactggaggatttggatgaaaatgatctgtttgtcaatggagggggatttgagatggattttgaaccccaagagagcctcaatatcggtgtgtccaagataagcatatcagatggagttgcttcaaatggtattggtcagtatgcaatcccaaatggtgtgggaacagtggctggggagcatccctatggcgagcatccatcaaggacattatttgttcgaaacatcaatagtaatgtcgaggactctgaattacgaacactatttgaggtattggacatttgcctaatgcttcaatag

SEQ ID NO: 79345 - DNA, 654 bp, Glycine max
  Peptide Sequence Number=SeqID_196123
atggaacaccagcccgctggcggcggcccgctcaccgcgcgcgccgccgctgcgcagcgcagacgggatcaggcgatagcgcgccttgaacaactcgttgaaacgccgcaggctgccgaaaccggcggcgaacgccacctcgctgagcggcagatcggtgtccgccagcaggcgtttggcctgcagcaaccggtgcgactgcgcgtaatcgatcggcgaagcgccaaactgttcggcgaagatgcgccgcaggtggcgatcggaaataccgagccgcgccgccagcgcttcgcagctgtgttcggacagatagccttgctcgatgagctgcaccgccacctgcgcatagcgattgcccagatcgatcagcgccaggccgggtgccagctccggccggcatttaagacaggggcgaaagcccgccagctcggccgccgccgcgctcggataaaaggtgcagttttccagcttcggcgtgcgggcgctgcacaccgggcggcaatagatgccggtggaagagacgccgacgaaaaagcggccgtcgaatttgcggtcacgcgcgcgcagcgcgtcgtacaacgcttgctgttgagtattcatggcaacgctcgggttcggttttttctgcattatggggctcgcctggcgcgctga

SEQ ID NO: 79346 - DNA, 186 bp, Glycine max
  Peptide Sequence Number=SeqID_196124
ttgcgctcagcgccacacctcgcgcttagcgcgttcagatcgcgcgctgggcgcgccatgcacgctgggccggtgcttctgttggatcgggcgctgggcgcctgtgcgtctgttggatcgggcgctgggcgcctagctggcttagcgcgcgtaacggtttccgccacgcccagcgcctccagttag

SEQ ID NO: 79347 - DNA, 678 bp, Glycine max
  Peptide Sequence Number=SeqID_196125
atgatgtcaacaacatcccaaactaatgttaaccatagcttgtttgaagagcaagatcagatccctacgcagatggggttgttcaatattcctttcccaccaaaccaaacataccctcctttgggttgccaaacaggcactttgaaatccatcagtgcaatagctccttcactttcatctgctacaagtttttctgaaaccctactttcaaccgcagttcaaagaccacgagaagatctcacttcaaatttgctagctggaggaggaggccaactcctttccttgaacagatccagagtgaattcatgggcatgggaagaagtaagcgattgtttgatgggtaaaagaattggaggagatgataatcatcatctaggggtttctgccatgaagatgaagaaaatgaaagcaaggagaaaggtgagggagccaaggttttgcttcaagactatgagcgatgtagatgtgttggatgatggctacaagtggaggaagtacggacagaaagtggtaaagaacacacaacacccgagtacaaaaatacagctttttttacactttgatggaattgctactctagaaattataaacttctttttcgctggaaggactgaccagatagacccaaaaggcttggttggagacaggttaacggtaattgtggggccagaactataa

SEQ ID NO: 79348 - DNA, 174 bp, Glycine max
  Peptide Sequence Number=SeqID_196126
atgggtgccaagtatctcgaagcggtcaagcaaaggttgcatgccatcaaacaatggtccccagacgaaattaggggattaagagaccgagagtctcttgttgtaaagaaatctgaacacaaaggaaggttgtccttgtgtggttcagaacttgtaaagggatttgcaagatag

SEQ ID NO: 79349 - DNA, 243 bp, Glycine max
  Peptide Sequence Number=SeqID_196127
atggaagtatcagttggtctgtgtcgttccgacatagggatcgtgcccacaagacacccagtggacccggagaagtccaatagggtcctggggtttccaactctagttacgggcctctggatcacacccagtggacccaaagaagtccaacagggtcctggggtttccagctctgattaccagcctctgtcagttctacgaagtgcccgtcatccccggcaaggtcatcaggcctcctactaa

SEQ ID NO: 79350 - DNA, 627 bp, Glycine max
  Peptide Sequence Number=SeqID_196128
atggagaacaacaaaaagaaagtgggaggaggttcttcctcatcatcattcaccaactttgatcatctttttggtcccaaggacccctccaccacttcatcttcatccaccagcatctttggctccattttcccacctccttccactatggtatttgagcgggtagttagaaaatataaggctgatccagctgaatggatgcaaaagggtgaagggagagagttggagggagagattcaacaaaacaggacacgggatgcaaaaattatggagcaccaggaaattacagttacaaaggtgaaagcagcgctagcggtgtctccaacaacaataatactactagtaccaattatcatcagaatgagacagtggagcccagctactacagttcatcaatccattatggtggtcaagaaaattattccccaagaaccaggaccactgaatcccaccatatttttaagaaagataaggatgatgatgatccaaatggtaatgattcaaacagtgcttcaagggggaactggtggcaaggttctctttattattaacatctgccaaagtatgcaagctcgccatcctgtataccagctttcaaacatggactttcttcatgttgcaggatga

SEQ ID NO: 79351 - DNA, 513 bp, Glycine max
  Peptide Sequence Number=SeqID_196129
atgaagttaacaaggaagatagtttgggtgtcccttaacaatgtgtccaagaagctgttcaagtttgactcaaacgttattcgtcaatttaaggattgcttcttcaagttgaaccctactaggttcaagtcctttgatgaggatctactaaccctggtggagagggttgacaaggccattctggagcaattgtcggcttcattggacgctcgagccatttttacccttccttcaacgggcaaccttctttcttccttagatgatataatgggtgatttcgcatggaggcccttggtgaagcaggtcggacctactaatgatgacgtgccttcttctgctttcggacctcctataagagaaaagggtgaacctacaactagggttgaccctagtgatgatgaagttgctaaggtcacttctagcatgcctcactttgtcctggccaagaggaagtgtgatgacagggttggggtgtctggccgtaagaagtcgagggtccccttcagtctttga

SEQ ID NO: 79352 - DNA, 705 bp, Glycine max
  Peptide Sequence Number=SeqID_196130
ggttgctggccagatcattgaaacgtgtttccagcatcgggttcatgttgctagttcaagtattcagctatacaaggacaatgccgaaattgatatgaagtctggaatggccggatatacacatgaagaggtacgcacacttgtcgagatgcgggccgactcactcggtcagaatatatcaccatcaacatttaatcttgcattggaacaactcgggttttttgtcaaacagcttgtttgtaatggcagtgatggatttggcacaattgtcccaggacctgttgaactgacgtatatactggacaatggcatacctgacaatgtatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 79353 - DNA, 475 bp, Glycine max
  Peptide Sequence Number=SeqID_196131
atggaatgtaaaaaccctactccaagcactgccatcagccccaacctccccacaaggtcacagggactaaagaggtgtaccaccatgtcggacgatgaaagggaggagaaggagttggatctctcttctgcagaagttgtaaccaaatacaaaaccgcggctgagatcgttaacaaggccttgaagctagttatttcagaatgtaaaccaaaggcgaagattgtggatatttgtgagaaaggggattcatacattcgagagcaaactggaaatgtgtacaagaatgtgaagaggaagattgagagaggtgttgctttccctacatgtttgtctgtaaacaacgttgtctgccatttctctccactagccagtgacgaggcagtgttggaagaaggtgatatattgaaaattgatatggcatgtcatatagatggattcattgctgccgtagctcacacccatgttcttcaggaag

SEQ ID NO: 79354 - DNA, 414 bp, Glycine max
  Peptide Sequence Number=SeqID_196132
atggggaaaatttttgagctgtgtagaatggtcatacaatacgtcatgccattcaagctctggaagcccttcaatattcctcaatatattgtgagaacatctgatgtagcggccattgatgacatgttgactagcagggaagtcgtattcacagaagttagaaagaagctcttgaaagctcaagctatcatgaaacacaatgctgacaagaaaagaagggatgtcaactttaatgaggcctacataccattgcctttatcagaaaccattattgataatcaacccgttgtcattcccttggtcatttttgggacacgacaagactcggattctagattatcgattaatgaagaatctattgttggatttatgaaagcaattaactcttctttttcatgcttagtcaagttttaa

SEQ ID NO: 79355 - DNA, 255 bp, Glycine max
  Peptide Sequence Number=SeqID_196133
atggctagaaacatcaaggaaggtactgataagaataacagagagctcgaaacaaagtctggaattcttgataaggcatctacgaccacattggattttccagatcgggcgatagggtgtctgttttgtgagaggatcacgcccataccaaccccagaggtgtctgtctccaaagtgaaggggagaatgaagtttggtagaagcaaaactggtgacgaggtcaaggtagcctttaatgcatcaaaagcggtatga

SEQ ID NO: 79356 - DNA, 315 bp, Glycine max
  Peptide Sequence Number=SeqID_196134
atggttacttccatgcttcaacttgactcgatgaaccttttcgtaaaagaacgagcttggttcaaccccataacccagggaatggcaattttgatcgccaatacttcaacaacatttcataggggtgaaatactcgagaacgaaaaagatgcgcggagtccccagtggagtcgccaactggggactccgcgcatacaacgcatgtgtgacggtatgatgcagatgcacatgcatgaaatggaaagaaaacacaacaaaggggtaatttacatatacgagaccaaaaagatccatctttttaatactacgttttag

SEQ ID NO: 79357 - DNA, 303 bp, Glycine max
  Peptide Sequence Number=SeqID_196135
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctcaaaaggagctctgaaatctgaagtaagggtggatatgagaagaatatttaggctaaaactaagggaaaagaggggcaatgtaagccaacaagtaaaaagagggttacaaactaagaaacaaagtggagaacaacaaaattaa

SEQ ID NO: 79358 - DNA, 468 bp, Glycine max
  Peptide Sequence Number=SeqID_196136
atgttttcgcgtttcacactggccacgttaacggccacactcctgctcaccggctgcgcgcgtcatgctgccagcgacagcagcgctgatgctgccgccgcagaagccccggctaccgcttccgctccggtcgaaaacaacgacagcgcttcgccgtttgccagcggaccgaccgtcatcaatgtctcccatctggtgacgcgcaccgacgatggctcatccgtgtacgtgacggtggatggccaggaagccggactgctgcaaaagggcgagagtaaagagctccgcgttccggccggtaaacaccagattggcggctacgtgcaaacactgtttggttttggcaaagtgaccattcctgcggtcgatgtcaccacagacaccaatggcccgaaaaacgtggtctattccgttacgcggcaaaaaccgcagttcagcgaaagcgctgccacgccaaacaactcctga

SEQ ID NO: 79359 - DNA, 382 bp, Glycine max
  Peptide Sequence Number=SeqID_196137
atgtataaacagaatcataaggactttctcaggcttgtagtgaggcttggctacaaaaattcattggtttttctaggattcaaagcttataaaaggagcaaaggatacaattatcttgcaagagattcatgcaaagattattactcccagctagccattcactcacagagtaacgtcacactcttaccggttttggttcaagcttttctttcacaatcaatttgtctactgactaacaattctactcgagaattcgctaagcgcgacactcagtggctaagcgcaaggaagaaaccagaagatgatgagttgtcaggttcgctgagcgcaccgctccaggtcatcaagcacaccgcttcagctcattcgctaagcgaaagaa

SEQ ID NO: 79360 - DNA, 126 bp, Glycine max
  Peptide Sequence Number=SeqID_196138
gtgaaaatgcgatagaacaaccactgatagatcatactgaaaacgagaaaaatgttataaaacaaccacctatagataatactgacaacgatgtagaacacctacctagagatgatactgacaatg

SEQ ID NO: 79361 - DNA, 258 bp, Glycine max
  Peptide Sequence Number=SeqID_196139
atggaaaatgtcattcaaggggtcaaatcaagtttttcattcactgagaggttcgcacatgttaaggtttcgacgcccgacttatttggtttgaaagcactggaacagttgatgacaccgcaacagtgccgagattttgtcgatacctatgggaagattctgaacttggacatgatagaagttcttacagctgccattaccgctttggtccagtattatgatcagcagatgggatgcttcactttcagagatttctag

SEQ ID NO: 79362 - DNA, 255 bp, Glycine max
  Peptide Sequence Number=SeqID_196140
atgacattgaaccaaggtggagattttttatttttagatgatagacgagagaggcagggtggaggacaaccttggtcgtgtggtccagatggagaagagattctagatacatccatctatgatggggaaggtagtaggacaccatttcatggatataagctcatagatcctttgaagaatctgagatccacaccagttttgagaactaaagagttgagtctagtgattttgagaatcactaagttgcgtatgtga

SEQ ID NO: 79363 - DNA, 498 bp, Glycine max
  Peptide Sequence Number=SeqID_196141
atgtggagccctctaaaagtgaggacgtgcaaccctctgaaggcaaggacatgtagtcctctgaaggcgagggcatgcagctctttaaagacgaggacatgtagtcctctgaaggcgaggatgtgcagtcctctaaaggcaaggacgtgtagtcctcagaaggcgaggacgtgtagccctttaaagagaagggtgtgtagccctttgaaggcgaggacgtgcagtcctcagaaggcgaggacgtgtagccctttgaaggcgaggacgtgtagccctatgaaggcgagcacatgtagtcctctaaaggcgagggtgtgtagccctctgaaggcgaggacgtgtagtcctctgaaggtgagggcgtgtagtcctctgaaggcgaagacgtgtagtcctctgaaggtgatgacgtgtagtcctctgaaggcgagggcttgtagtcctctaaaggcgaggacgtgtagtcctctgaaggcgaggatgtgtagccctctgaag

SEQ ID NO: 79364 - DNA, 345 bp, Glycine max
  Peptide Sequence Number=SeqID_196142
atggaattggcggcgacgcggcggcattccggcgactgcacggcggcgcgtggacttcacgcgccgaaaaacgtgcgtgagaaaggcggcgcgtggcagcgcgtggaggctcctttggaggcacaacttccaggggtaggtcgcgcttttcgaggcgatcctaaccctggtctcgccagtgaaaactggccggagatggcggcggccggcagcgggcgcgacggcggacagcggacggtggacaaacctgctctgagaatacaagagagagagagaagggcagtgacagtgacagctcactgttgcccttctgaacaagcttaccaactaagctaccaaaagtag

SEQ ID NO: 79365 - DNA, 327 bp, Glycine max
  Peptide Sequence Number=SeqID_196143
atgaatccattattagtttttcttgtgattgctgaaaacaggtacattgctaaaacattatacggtacagaggaggaagaggatgcatctcagccaaacagtagagtagaggaaccaaaactcctaggtgttactagtggttcatatgaaaaggttcttttgaaaagtgggccttatggagtttatgttcagctcggagaagacaggaagggatatatacctaaaagagcttctgtctctcatgttgtcgtgcttgtagtcgcggtggagcggggcggcatgattgcggttcttggagcagatccttccctgcgatctgaaatttga

SEQ ID NO: 79366 - DNA, 413 bp, Glycine max
  Peptide Sequence Number=SeqID_196144
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgattccagcggcttttgccacttatgatcagtgttcacaggaacgagacggttcaatgtcttacaatgttcaagcagcattcttgccggaaggattttttaggaagcccggacacctaccgaacatccctgaaggatggaacaacatgatgaagaaggcggcgaaagtttag

SEQ ID NO: 79367 - DNA, 588 bp, Glycine max
  Peptide Sequence Number=SeqID_196145
atggatgacatgtttgggagactgcatgttcttctaaacaatctacaagctttgggccaaacctacaccaaggctcaaataaacctaaaagttctagacaactttcctaaggaagttgtacaagggttgcttattgctggaaaaatttgtggacttagagaacttgaagagcgatggagaatctcaaagttttacgacaaactagatacctcatctaaagctcttaaagtgaagatgattgagtttgatggttcaaacaacaattatggaagatccccggatgatgaagtggttgtcatgtccagaaaattcaagaaaatgttgaaaaagaaaggaaagtttaagcattcatccagaagaaaggacacaagattcaagaagaaatacaaggagaaaagcaatgagatcatcagctttgaatgcaggaaacctaaacatatgaaagctagtaagatagacaaatcttctatagttgataagctaagagaagaggaaaaggccagggttttagctggtatcttgatggtggctgctcaggacaaatgttggggagaaaaggtctatgttcctcgacctaaagccaattaa

SEQ ID NO: 79368 - DNA, 474 bp, Glycine max
  Peptide Sequence Number=SeqID_196146
atggagtctatgactagacttgttgtgggccatgttgatcaaaatatgagtgttgccttgtctgaaactttcaccaaaatggaagtgaaggaggcttttttccaaattcaccttattaaggtgccaagcttggatggaacattgggcctgttctaccaaaaattttggcacattgtggatgatgttgtatctcgcttggtcctacaagtgttgaatagaggagctaatccaactgaatttaacaaaactctctttgttcttatcccaaagcaacaactgatgaggcttattcttaagagatatgaagaagcatctaggcaacatattaacttcaacaagtctgaactctcttgtagccaaaatgtcccgaataccataattaatgagcttgttgagttgttgaatgttaaggtagttgagagtcctcaaaagtacatgggccttcccactattgttgcttgctcaaagacctaa

SEQ ID NO: 79369 - DNA, 486 bp, Glycine max
  Peptide Sequence Number=SeqID_196147
atggatttgaaaggttattcttgttgggttaacggtggagtcatgcatatcaaagggaaaataatgtttttcgtaatgcagggaaccaatcatgcgtccaatggctcatctgatgattctctatggtatctacgtctagggcccatgagtgaaaaaggtttgaatattctgagcaagcgaggcttagttggaaatcacaaggtggaacttcttcagttttttgaacattgtgcctatgggaagcaacattggaggaagttcctaaaggttgtgcacataacaaaggctatgttggagtacgtccattctgactacttggggcctttgagagttccatcactgggagggccaaggtgtttggatgttcgacatactatcatgcaagtgaaggtcattctaagtagagatgtcatctttgaggaactcttcatgatgcattctaaatctgacgaagatttgggcaaagttgaggatgtcactaagtag

SEQ ID NO: 79370 - DNA, 252 bp, Glycine max
  Peptide Sequence Number=SeqID_196148
gaagtgatttcctattttgaagtcgaggagtgggcagtaactatcaatgaagatatggactcccttcagaagaaccaaacttgggattttgttgagctacctgaaggcaaaaaagaagtagggtgcaagtggatcttcaagaagaaatctttattgtccactaaagaagtcgttttttataaagctcgtctgatagcaaaatgctacaatcagaaggaaggaatggactacaacgagatattctctctgtag

SEQ ID NO: 79371 - DNA, 237 bp, Glycine max
  Peptide Sequence Number=SeqID_196149
atggcggcgcagctaatccgtgatcgagtagagatggagtgcttagagggagcttgggagaccctcaaaggcaacacgaggtgccgatttcggggcaccattcgattcacggctacttctttggtgcatccagatgaacctgcacggacgcttcagcgcacggtggagtggacaactccttggattagttttgtgtattttttaggccaccactatggacacctttgctctggatga

SEQ ID NO: 79372 - DNA, 317 bp, Glycine max
  Peptide Sequence Number=SeqID_196150
gccacaaggttcaacacaatgttgataaaggtgcaaacatgattgctaatcttaagggagatgggactcatccatcaatagaagttttgaacccatattggaactacattgtggatgaaactcatcaaccttcaaaaacgttttgtgctctacctgaatacatatacctgaaagagctgaaaagcaactcactacagacaccctcattgccaaacaatttgccgaagaagaagaataaagtctttactgagaaagactaccaagaaaggcaaagggaaaaaatcaatgaagaagcagaagaagacatcaaatggtaa

SEQ ID NO: 79373 - DNA, 630 bp, Glycine max
  Peptide Sequence Number=SeqID_196151
atggtagccaaacgaaggggagaagaatggcgggagggtcgacggaggagggtgagtcggaaaaacacgtcatggacggagatggtggaggcgcgtgaacttcacgcactggagtgtggcggcaaacatggttgcgatagtcgacgttgggttcaccggagaggggtgctcctggtcagagggtctcactggcgtgatgacaatgcggtgccagggcaagggcgctcgcagccttttatggatacattcatagttactgcaaatggcctaggttgctggattgccattctagctttctggcatggtttgacaatacaacttaatattggaaatcctgataagtctattatattacggtcttccagctcaagggttgagtttcctggatatcgggcagtttttacggtatggattgttttgagtgacattgttactgaagctgttcaagataaagacagtgatgaattcagccgtgatcaaacatttggagtactaaattccttgaagcaatacaccccctcatgtgtggataacatggtggatgaccttttgaatggatctatgatagactttaataccatcttagaatgtgggcttggggctgattcaaccccaaaagctagttcatag

SEQ ID NO: 79374 - DNA, 1287 bp, Glycine max
  Peptide Sequence Number=SeqID_196152
atgactaccaaatctaccacgacttccgttgtgacctttaccactattccactgatcccgtgcgaaaaactcattgggactaactatagcacttgggccgctgctgttcagttatggttccaaggccaaggccgcaccgatcacttgacaacaaaatcgacagatgttccaactgacaaccgagctcgttggaagcaaattggtgcttcttcatgcaatgttctttggttttctcttgttcctaatctccaagcacaataccaagcttttacaacctcttatgatgtggggaccaaggccaagaaagtttattccaacgatgttcatcgcttctacagtgtactcaccagcctaattaacattaagatggcgaacatggacatgcaatcataccttggtaagttggaccgtttaattgtggaatattccactcttatgccctttactagtgatgcagagaccttttacaaacaacacggacagttcttcatggtgattgctcttgctggactcacaccggaccttcaggcagtccataatccgattttattgactcccacgattcataactatgacttagatcaggaccagttgttgcgtctcaccattccacaaacctttcgaccttcttccacgtctgtcgaagattcctctgcccttgtctctcattcctcctatcgtggaggacgtggtggtggtggatgtggtattcgctgtcactactgcaagaattggggtcatattgaaactgattgccacatcaaagctagagaactgtcccggtcaattaatgtagcccaagtcatcacctttgcttcaaatattactatcactgttgttgaatataataagcttcgagcagccaacgaacctgcatcacctgttacctctgtggctcaatctaacattggccacttcactagttggacatcaaaaatgtcttcctacatggtgacttgcaagaagactatacatggatcagcccctggttttacagtttccggcgacgccactctgcttgagtttggaatgactcgtgaaactgatcacttggtattttccccccattcaccgtctagcctatgcatctatctagttgtttatgttgatgacatcgtcatcactggcgatgactctaatggtattcttcgcctcaagtctcacctccacaatcagtttcagaccaaggacttgggtccgctcaggtacttccagggcattgaagttacccaatcctcatctggcagtcatttcccaacggaagtatgctatagacattctgactga

SEQ ID NO: 79375 - DNA, 417 bp, Glycine max
  Peptide Sequence Number=SeqID_196153
atggctacatatcgcaatgttatagaagcactgatgcaatcctatcccgcaaaggtattggatagaagactccaagtagattgggccagagatgtaagagaaggtcctaagatgtatgcaattgcagactttgttgattattacagatggaagaaggtaattgccatttacgtagatgatgacaatggaaggaatggagtttctgttttgggggatgcaatgtcaaggaaacgtgccaagatctcttacaaggctgttttccctcttggtgccacagaaagtgatatcagtgacttgttaaatgaggtgaacttagtggaatcgcgtgtctatgttctacatgtaaatcctgatcatggtttaacacttttctctattgccaagagactaagaatgatggacagtggatatgtttga

SEQ ID NO: 79376 - DNA, 336 bp, Glycine max
  Peptide Sequence Number=SeqID_196154
atggttaacccaaggacctttgtttgttactgctgtaaggattggggaactcgtggtcacctcaggtacatttcatctcgtggtcactcgtggtcacagggtctcattttgattgagagagtaagtcctatcctgattctgttgtttttcatggtgcctcaccagagattgtggggtaaagaccttttggttgctacatctgattctggtaagttgttgttgctcacattttgcaatgaaatgcacaggtttgttcctgtaacacatattcagctatctaatcctggaaaccaaattgatcttcctggaagaaagttagcagttgattccaggtga

SEQ ID NO: 79377 - DNA, 642 bp, Glycine max
  Peptide Sequence Number=SeqID_196155
atgtctctaaccacactctttggcaaattacaggaacatgagatggaactccaacggctaaatcaaaatgaagaaaccgacaagaggaaacaaagcatagcactaaaagcctccttatcaatgcaagaggaaaataaagatgaagaatcagaagataaagaagacttctcactttttgtgaagaagtttcacaaatttgtcaagaataaaagaagtgagaggcgtcaaaatttcaacgatggaaaaagattccaagaaggctctccaactcttagatgctacaagtgcaaccaacttggtcacatcaaagaaaattgcccctcaaacaagcaatggcctgagaagaatgataagaaaagccatgaagaaagaaggaccaagaaggcttacatctcttgggatgacaatgattcatccgaaggatctgaaaaagaggaaatcaaccttctaacaaaagactatgagagtgaagaggacatcactcaaagggggtttgtcatcatcaaaaaggggagattgtggaagcaaagctaccatgatgattcaccaagatgttttgatgataccaaagctcaaagagttgtttcaagattaaagaatcaagcattcaagattccactcaaagattcaagaatcaaatga

SEQ ID NO: 79378 - DNA, 360 bp, Glycine max
  Peptide Sequence Number=SeqID_196156
atgttgatgtttgctctgaaaaataacatcaaggttgattggcatgttgtggttatggaaaatatcttgaaagcaagaaaattatcagatgttatcaaggaagttagtgacttcactaggcttgtacatgagattaccatggaagccctcgagcaaattgggcttaagaaaacttatgatggatgggttgtggacatcattactcaagtgggtgaagaagctatagttggtgttgttgctggagaaaaagatagacaagttgttgaagacaacatgaagagctcaagactttgtttacctttgagacaaatgttctactcaagatgggtgagatcattaggatctaaagggaacacctaa

SEQ ID NO: 79379 - DNA, 705 bp, Glycine max
  Peptide Sequence Number=SeqID_196157
atgtctcgcgtgtatgttggtaacttggattcacgagtcaccgagagagatctcgaagacgaattccgtgttttcggagttattcggagtgtttgggttgcacgtagaccacctggttatgcttttattgactttgatgaccgcagagatgcacaggatgctatccgtgaattggatggggatttgcactgctatcgcgagctacacttctgttgcataatgggtttgttttatgagatgtgtgcttctacacttaacctatggggaccatgcaagaatggttggagggttgagctttctcacaactctagaggtggaggtggtggtcgtggtggtcgctctggtggttctgatttgaaatgttacgagtgtggtgaacctggtcattttgctcgtgaatgtcgcatgcgtggtggttcaggaagacgccgtagccgtagtccacccagattccgtaggagcccaagttatgggcgaaggagttacagtcctcgtgggcggtcccctaggcgccgtagtttgtcacctcgtggacgtagctacagcaggtcacctccttatcgtgggcgtgaggaggtcccatatgctaatgggttattttttaactctgggatggacctgatttttcaatatgcattttattctgaaatggccttagggaacgacgcagaagcagaagttgattttgagacttggtatctgtga

SEQ ID NO: 79380 - DNA, 177 bp, Glycine max
  Peptide Sequence Number=SeqID_196158
atggcagttttggatctggacggagatggcggcccgcagagttggtgcggtggtgatgggttgggtggagagccaatagcaaatgtggttggggctaataacaactccctccacacaatgaagagaagcctaggaaaattccaagctcccgatagcatttgcttttataaattgtga

SEQ ID NO: 79381 - DNA, 318 bp, Glycine max
  Peptide Sequence Number=SeqID_196159
atgatagtagatacacgagaatcttggatggctttggacatgcaggataacattgttcaaacagaattggggtcaaatagggttgggacacgtggacaagggggagttaaagctgaagagtgtatttggacgtggttggtgaggctgctgacgttggtcgtggttcaaggtcgttgttggagggtggttgttctggcggaggcaagggacgagggaactgtggaggagaaggaccatgatagcggtgtagttgagacacgtgaatcacagggtgtatacgcgagctctctggaaggagaggatccctgttggaggtaa

SEQ ID NO: 79382 - DNA, 405 bp, Glycine max
  Peptide Sequence Number=SeqID_196160
atgactgaggatgtacctgcacccagtgtaaaagctagtgatgttgctaagggattagctggtgatgatgctgaaggatcagctggtgatgatgctgagggattcccaggtgggccacgtgacccatcagtgctgacttcgtttgttgaccatgttgcacatagcatatggaatggagagaggtggcacaaggagactagcagcttccatcttccagtaggagagctgaccatcacactggattatgtggtgtcactgcttcatcttctgatcataggcgccttccatagctttgagcctctgcatgtggacaagcctgtcgtggctacgggatatctatcagaggagatgcaaggcttgacattggattgttgcagctcgtgcgtatctcctacacttggttga

SEQ ID NO: 79383 - DNA, 579 bp, Glycine max
  Peptide Sequence Number=SeqID_196161
atgagtgaaatagaggaggtgcaagagcagatgaaggctgacatggaggccatgaaagagcaaatggccacaatgatggaagccatgatgagtatgaataaaatgatagaggccaacagggctacaatcattgctacaagaatcgccactgatgaggatccgacttacccatctagcttcactcaagtaaagcgtccagcctcaaatatggtaggtcaagagggcaaagagttgggaagtgcgggtgacccccattttgtgcatgctcagaacaaacattccttcccaccatatggcttgcctcccaactatacaccacccaatgttgcacacgctcccaatgagaatgtcaataactccaatcccatactcattgagagccaacaaccccactttggtcaggtacatgaggcaccccaagaccacaatctagctgacttcgaaccttaccttgaatatgccacgaaggggcaagcagttggtggtgtacccctgccaaacactttgggggccctcagtaccacccacaactacaaccctttccttttgcagtgggaagagtccctcttgccatggtag

SEQ ID NO: 79384 - DNA, 357 bp, Glycine max
  Peptide Sequence Number=SeqID_196162
atggtggctttgtgctcgacttttcactcttctacttcagggatccaagatgcttctgccaaaataatatggtacctgaagaaatggattcgatggaatcaagattggacacttcgattggagattgtagcgaaacaaaggtggctcgggaaggcacaaagaggaagaagaagacgcaaacgtggactgaaccatttccacacaaaggagaagaagaagaagcgaagcggccatgaaggaagagtgagagggagtcgaagagtgggagcaccaacagttgtatttgtggcttcgaaccctggaggggagtcgaagagtgagagggagagtcataatacagggagtgcgagagagtaa

SEQ ID NO: 79385 - DNA, 870 bp, Glycine max
  Peptide Sequence Number=SeqID_196163
atggatttttcaaacaccttttccgtgttaggagatgagaacttggtaaaccatgggattaacacaaccaatcaagccctcctcccctcccaaccaacatcggcgacggtggacgatactgatgagcatgtcattaagttggagaagaaagtggatgtcttattgctaatgaaaaaagggtttcaaaaattggccgagacaagaaatcgtggggaggaggtggacaaaaaaagtgatattatgttatggaagatagctaagcttgaaacaacctctaatgtctcaagaagcaccatgcacactaaacataacaacaactttgtgttcaatgcgaagccccacccgattgtacacaaacctcccataggtgcttcaccaactactctgaaacaacctcataacgtgaggtcaacaaacaatgggtcattttttggtgcatcaaaggatgttgcacagggcaaggcaatagttgcacctacatcaatatatgagttggttacaacaactaatgataccctaattgacagtggatggaatgtgaataacattgcattttgcatcaaaatcccagttccacatatggcccattcaacatcaaaaggaaatgttggatgtagaatttcaattccaattcccaggaagtcaaaccatgtccaacaacaaagtgtcaaccaaagatcgacacatggcgtagatcacaaaaatcaagaatattacaaaacaataggccacataatgccaaagcttaatttccatgcgaccttgcgcttagcacgggctttcgcgctaagcgcgcctttgtgcttctttgtgggccttcttcgtgctaagcttgagctggccactaagcgaggaatgcactgggcctag

SEQ ID NO: 79386 - DNA, 753 bp, Glycine max
  Peptide Sequence Number=SeqID_196164
atgactagggttcaattacgtgaggttcaacataaatgtgatttgattgtatgcaagcgggcaaggctaaacactacaagcaatgtattagtaatcacaaatgccttaaattcgtttgcaatgcaacctaaacttcacaaagagcaacaactaaatgagtgtttcatttcatcctctgtaaaagattttggtaaccagatggtgtcttatttttggatgccagtgacgtctgccgaaaaggcatgttgttttcttattggtctctttatcatcaaatgcatagcaatggctgaccaaatccacaaggaaaagacttatgtggtgtttaaaggtctcaaaccagggatatatcatagttgggctgaatgtgctaagcatgttgtggttgcgtgggagagacattgcaagttccctgcattggacaaaccttgcaagtttgaaacgaaaaatagtcccaccaaacaatatacatctttttcagagaagaatacaagttcgcagaataaggcggaggagtgcaatagcacaaggttttatgattcaatgtttattgatcaaattggaagcaatgttgtttgccttgggaagtttgcaaacaatgatgaagatgcaaaagaggacgttgttgcttcattgattgacagactccttagcacaagtggaaagaaaatacaagatttgaatttctacactattaggaaattggaagtccaactccatcaagccttgcatgaaaagagcaattgcaaatag

SEQ ID NO: 79387 - DNA, 795 bp, Glycine max
  Peptide Sequence Number=SeqID_196165
atggttgaagaagttgattgtcacggttttgtacaagaattttgtgattcagactatggcaagggtttcattgaaggtttggatggtcttcaatataaaggtgcaaagggtttttttgaatacaattgtgcggagagtttggttgaaggaatggatcattttgattgtgatgatgaacatggtttcaccgaaggcattgatgattcaatggttttgctgcaaggaaaggttaggttgttaaggacaccaatggtgaagttgtacaatagacttatttgtgttacagagaaggctttaaacaagataagagaatatggtgaaaggagaatgttggcaagtcataagtcgatgactgaatttgatatgttgcaaatgaataacatgagagcagttggcataggcacccctcaaatttatggatcattggcaagattcaacctatttggtgacatcttggtattcaatacaacttatagaaagaataagtatgactgtccattaatagtattttttggctttaatcaccacaatcaaactatagtgtttgctacaacaatcattgctaatgaaattgaagaaacatgtgtgtggttgcttgaaaatttcttagaagctatgaaagggaagctgcctttgtctgtcattactaatggtgatcttgctatgaagacttcaatacgaagggtcttcccaaatagccaccatagattgtgtatatggcatatattgtgcaatgcaacaactaaccttggtaatgtagaatttaatagagttcacaaaatgcttgctaagtga

SEQ ID NO: 79388 - DNA, 375 bp, Glycine max
  Peptide Sequence Number=SeqID_196166
atggttttcttgaccagacatgaagagtctataaaaattcaaaggactaaccgcctgagaatcatttgtcctgacacattggagggtacatcctttgtggtacaagtagagggtacatctacttgggttgttatactgagaacaagagaggatacatctcttgtggatcagttcaagtggagggtacatccacttggttgttcaaagagaacaagggagggtacatcccatgtggatctttggcttgtaaaggattttacaaggttgaaagaaatctcaagaaccgtcggttgcttggggactggatgtaggcacggattgtggccgaaccagtataaatcttgtgcttgtcttcttcttccttacactctttaa

SEQ ID NO: 79389 - DNA, 684 bp, Glycine max
  Peptide Sequence Number=SeqID_196167
atggaaaccacaccgcctctagccactgatagcttctcatatagctggttaccaaattgcaaaccccttgcaaatgacctcaaggagcctctaagagaatccacttacaattcctgtgaaggcaccaccaattatccattaatggaagaatggcaaaacttcaattttgatatttccatcacacagtcccctgctgttctttctcatgctgatgaactcttctctaatggccttatcaaaccactatttgctggcccttccacattagagtcttgcgataccaccacaaattccacacaatccaagcctatttcttccttttcttcaagaattgtttctccaagaactgtgcaaattcatcatggtttcctcacaaagtggaaaacttctacttgtagaaccttgagaaacctttctaggtatgtcaaccaactatgccagaaagttggaagctcaaggaaaagtactaaagttgatgatattgataaagaagagtggctagttaatagcagctggagcagttcacagcaaccgtctccaaaatcaagcactgtcaatcctgttggtgctttgcttgatcatgagaactcaatctatgaagcagtcctccactgcaaaagatcaatagtgaatactgtctttaataaggaaataaacctctattcttctgaagttcaagactaa

SEQ ID NO: 79390 - DNA, 636 bp, Glycine max
  Peptide Sequence Number=SeqID_196168
atgggcaaggagtactactggcccaaagaacaaacccaaaacagccttactacgacactggatcaaggacggtccttccaaaatgtcgttatcttcaataggatggaattggtccagatcagacttcaccttgttcttcagctccgcgtccatcgccactgtgtcaaagctcgctggatgcgtgaacggcgccaagcgccactcaccggcgttggagttcacatacaacttgacgtccttttttcttcattgctcgatctcgtcagcaacagagagaatgtgctggaatcaaaggatgagctcgtcgccggaggcgttggttcaagagagcctggcgctgaggaaggtgtcatgaacggtgtggttagggtcgaggtggaggaaggtggaggaagggattggggccggagaagaggtttgcataatcggaatcttcaacgaagggaagagaatcgagttgtagttgcagggtacaagcaagcaggggaaggaactttgtatgagaaagagattgtctctttgttgaaggatgacagtacatttatccaggagttgtttgctaggctaaaattgccaaccacctctcaagaatcaaagaagaacctggtatccaggctgctttcctctgttttataa

SEQ ID NO: 79391 - DNA, 363 bp, Glycine max
  Peptide Sequence Number=SeqID_196169
atgtcttcaagtttttttcaaactcaacaacttgttcctcgtgctctgaaacacttatgcaacacctcatcgcattcaaataaatataaccaacacaatttgcgtcctactaacttccccatcacaaacggaggtatccaggatttctttccaatctcaaatgaagcgttagaattctccacctcaaatcatcactctcagctctcggctctaactgtcactgtcactctccgcggaagcacttctcaagtctcactcccactcttaacctcaaatcctcattcccactctccgcggcggcatttctcgagtctcactctccacggcctctacaccgttagtcacgaaaggttagcctcctga

SEQ ID NO: 79392 - DNA, 648 bp, Glycine max
  Peptide Sequence Number=SeqID_196170
atggcaatgaaatcagcaatcacagtcacattcttatccttagtctctttagcactagcaagtgattctgatggtggcataattgcaatctattggggccagaaagataacgagggcacgctggccgaggtttgtgccacagggaactatgattatgtgatcatagcctttctgccaacctttggaaatggccaaactcccatgatttatcttgctgatcactgtgacccttatagtaatgggtgcactggcttaagctcagacatcaaatcttgtcaagacaaaggcatcaaggtattgctttctttggtaggaggtgttggaagctactcagatactaattccactcaggatgcatgtcaagtagccgcttacctttggaacaacttcttggggggacagtcatcgtctcgccctcttggccctgctgtccttgatggctttgattttggtattgtttatgacattgaaggtggaccaaagcagtactggcgtgatcttgccaagttccttaaatggtataaccctaaagaaattcccttacaactggcctttttgactttgtttggttcccaattctacaatagccctccttgccaatacagttctggtgaaattagcaaccttgaagattcatggaaacaataa

SEQ ID NO: 79393 - DNA, 936 bp, Glycine max
  Peptide Sequence Number=SeqID_196171
atggcatcgaaatcatcactctcaatcagattcttgtgcttactcttgttagcactagcaaatggttctaatgctggcaaaattgcaatctactggggccagaatggcaacgagggcacgctggccgaggcttgtgccacggggaactatgattatgtgatcatagcctttttgccaacctttggcaatggccaaactcctatgattaaccttgctggtcattgtgatccatacagtaatggttgcactggattaagctctgacatcaaatcttgtcaagccaaaggcatcaaagtattgctctctctaggaggaggtgctggaagctactcaattgcatcaactcaagatgcaagccaagtagccacttacctttggaacaacttcttggggggacagtcatcgtctcgccctcttggccccgccgttcttgatggcattgattttgacattgaaggtggatcaaaccaacactggggtgatcttgccaagttccttaaagggtatggaaagcaagtgtacattactgcagcacctcagtgcccatttcctgatgcttggatcggaaatgctctcacaacaggcctttttgactttgtttgggtccaattctacaacaaccctccttgccaatacaattctggggcaattagtaaccttgaagatgcatggaagcaatggatcacaagtatccctgccaacaagatattcttggggttaccagcttctccactggcagcaggaagtggtttcattcctcctgctgatgttacatccaaggtgcttccagccattaagggttcttctaaatatggaggtgttatgctgtggtcaagattttctaatatttgtttgtcatggacttctaaccttgctctatcatcttcagataatcagatgcaaacaagcgttcctgtttgttaccgagaatgttaa

SEQ ID NO: 79394 - DNA, 2022 bp, Glycine max
  Peptide Sequence Number=SeqID_196172
atgagtccgtgcaatgagattggccgcaacgagtcaagatcagaggttccaaaccctaattcacctcaaagaaagggaaacaaacatagaatccttataactgtcattatagtggtggcagtggttgttgttgcttcaatagtagcacttctatttatccgtaaccaaaggagaaaaaggttagaacccttaatattaagcaagaaggagaattccaagaacagtggaggcttcaaggagtcacaatcatccattgatctgacaagtgatttcaagaagggtgctgatggggaattgaactttgttagggaagagaaagggggctttgatttgcaagacctgcttagagcttcagctgtggttcttggtagtggcagtttcgggtccacatacaaggccatgattttgaatggaccaacagtcgttgtgaagaggtttaggcacatgaacaacaatgtcgggaaacaggagttcattgagcacatgaaaaggcttggaagtttgacacaccctaatcttctccctcttgctgcattctactaccgaaaagaagacaagtttttgatttatgactatgctgaaaatggtagcttggccagtcatctacatggtagaaataactcaatgctaacctggtcaacccgtttgaaaatcataaaaggagtagctagaggcttagcctacctctatgaaagcctccctagccaaaaccttccacatggtcatctcaagtcctccaatgtgattttggaccattcatttgagccacacttgacagagtatggccttgtgccagtgatgagcaagagccacgctcagcagttcatggcagcctacaaggccccagaggtgatccaatttgggaggcctaatgtgaaaagtgatgtgtggtgtcttggtatcatgattctagagctactaacaggaaaattcccagcaaattatctgaggcatgggaagggtaggaacaataatgccgacttggcaacatgggtggattcagtagtgagagaagagtggactggtgaggtgtttgataaagacattatggggaccaggaatggggagggtgagatgttgaagttactgaggattggaatgttttgctgcaaatggagtgtggagagtaggtgggattggagggaggcattgggaaagattgaggagttaaaggagaaggatagtgatgaggagtactactcttcttatctcaatgtggggacatacattggatcaaggggtggcttcaacattgcagttgtaggtttggttattgggattttgattgagaaaaagcattttttaggacagcgaaacgacgacggttatccaataactatattaggcggtggcaatttgaaaatttcctataattttgacgctattcttgttgatccaaatttcgagacaagtgttgttaagattacatctgcccatgatccaaatgattttgaagtgggaaaacgtcacaaccttgaattcattaatggcctttatagaggatctgaaaacaatgagatgcgccctggggtctgtttaagaagaaatgatgtattggagcctatgataaagccccggtggtatgtcaattgcaatgatttggaaaaacaagctcttcctactgttgtggatgaggaaaacaaaaggatagagattattccaaaacaatatttggctgattggaagagatacttatatctttgtttgctttttgcaaattcttgtaatgagcatggtaaaatttatccaacagagcatttctctataatgatttatttgcatcccatggtttgtgatgcacatggacacaagatgtccaagcccttaggaaatgttattgatcccattgaagtgataaatgggatatcacttgaaggtctacataagaggttggaggttggtaacctggaccccaaagaactagccactactatagagagtcagaagaaggactttccaaatggtattgatgaatgtggtgttgatgctctccgttttgcactggtttcatacatagctcag

SEQ ID NO: 79395 - DNA, 225 bp, Glycine max
  Peptide Sequence Number=SeqID_196173
atgggtgaccttctagatcaattgcttggagcgttaatggtctctaagatagacttaaggtcaggatatcaccaaattagagtcaagagcaaaggcattcctagtactgcctttaggacaaggaaattcataaagggtttctctagactagctttacccctcactaagctgactaggaaagagaaaccttttgagtgggataaggagtgtgaagcgagtttttag

SEQ ID NO: 79396 - DNA, 435 bp, Glycine max
  Peptide Sequence Number=SeqID_196174
atgtggctgctgagtgagtatgctgcgcatgcatttgtgcaacttctggttgatgtcttgtctttttttatcaaggatgtggattctatcaccctgaaagatgcacttgaggtgctacaatacccattgacattgcctcatcatctggtgcaaataggcaatcgtcctgctgacatcctcatctgttactcttttcctgcaacttcttccggtaatcatcctaaggatgggcagcctgtcatattaaagcttgcaagagctgggctttgtgttagacatcggcgcacggttgcttctgttcctaagaatgtgaagccaagtgatgttaccctggaaaaagcacttgaatatttatctggtgatgatgttagacgatctggtcgtccaaaaggcaaatctaaagttcaagaagttgaagttattgaagcgttttaa

SEQ ID NO: 79397 - DNA, 234 bp, Glycine max
  Peptide Sequence Number=SeqID_196175
atggatttaaagaagaaaaagaaagtagcaagttccaaacataacaaaataggtgctttctctaaccttctcaacccaagcctctttaaattgcacaatgtagggatgctaaattcgagcaataagagcagtctacaattcccaaaacagtccacaatggtcaaatcacagaactcgaagcaaatcaacaagcaagaaattgaagaaaccaaaaacctacctcttgatcagtag

SEQ ID NO: 79398 - DNA, 389 bp, Glycine max
  Peptide Sequence Number=SeqID_196176
atgaatttcatagcattgctgcttatacaggatctgctaagacttaacggtacgaaagacatcgagaaagcaactgataatttccatgcttcaagaatacctggagagggggtttttggccttgtttacagtggtatccttgaagatgggatgaaagtggcattcaaggttctaaaaagggaggaccctcatggtgatcatgaattcttagctgaagttgagatgcttagtcgtcttcaccatagaaatttggtcaagttaattggggttgacagggaaatcagcccccttgattggggtgcccggatgaaaatagctcttggagcagctcctggtcttgcttatctgcatgaagattcaagtcctcgtgttatacatagggacttcaa

SEQ ID NO: 79399 - DNA, 1534 bp, Glycine max
  Peptide Sequence Number=SeqID_196177
atggcccccagaatccttctatgcggcgacgttttagggcgcctcaaccagctcttcaagcgcgtctcatcggtgaacaaatctgcaggtccattcgacgcgctcttgtgcgtgggtcagttcttccctgactcaccggagcagctcgaggacttcacgaaatacatcgaaggtggatctcactttcctcttccgacgtacttcatcggcgactacggcgtcgccgcccccaaacttctcttgcaagcttccaaggactccgccaaccaaggcttcaagatggacggcttcaaggtttgccacaacttgtattggctgaaaggcagtggcaaattccctctctttgggttatccgtggcctatttatctggtaggaagtcatccagtggtcagcagtttggaaattacactgaagatgatgttgatgcattacgcgcaattgccgaggaacctggagttgttgatttgttcttgacatatccttcaattcctgtgcattactcacgtagagaaaacactgattcggacattcctgctggactctctgatggcagtgattcaactgtatcggaattagtacaagagatcaaaccacgttatcacattgcaggcaccaaaggcatttactatgcccgcgaaccatattccaatgttgatgctgtgcatgtcactcgtttcatagggcttgcgtctgttggaaatagagataagcagagctgtaacattttgtttgcttctgcattccagaaatttattcatgcaatctcccccacacccgcatccaccatgtcttcaactgagattgccatgaaaaccacaaataccaccttatcgccatacacattcaaggagaaaagaacttctccaatggattcagcaaagagatccagtgattctatctctgatcctcaatattggagatatgatgttgctcaaaagcgacaaaaacatgaagctggacatggtgataaattgtgtttcaaatttgtttcttctggctcttgtccacgaggagagaagtgcaattttcaacatgatacagatgcaagggagcagtgtatgagaggtgtttgttttgattttttgaataagggaaaatgtgaaaggggtccagattgcaactttaagcacagcttgcaggatgagggcaacaggcttccttctaggaggcctggatctggcagcccgaatgtagagtcacatttaatcataagcattggggaaaattactacttggcactggctaaaggtccacttgttgaagaccacgtactgataataccagtcgagcatatgcctagtaccttatctatgcctcctgaatctgaaatagagctctctcggtttcagaacagtctcaggagttactgcaagagccaagagaaggaattcatcttttttgagtgggtctctatacgtggcactcatgccaatcttcaggccattcccattccatcttccaaagcaattatggttgagaaagttttcaatttagctgcacagaagttgggatttgaatttgtggctaagaaat

SEQ ID NO: 79400 - DNA, 312 bp, Glycine max
  Peptide Sequence Number=SeqID_196178
atggttaactccctcttctctcttcatcttcggaacttgaatcttactcgttccaacaccctcactgttagacacagtcacgtccttcgatctctccctccatatacaccaacaccgcatgtcctacccgctcttgcatgcatgcagcggattcagtctataaacttcttgcgtctctacaagtcggactccacacaccgagagattaggaaatcggcgagtgggaggaggaagaggaggtcgagaagcggaggccgcagacggcgagacctgttgaaacgacgtcgtcgtggagagaggacgaagaagtag

SEQ ID NO: 79401 - DNA, 1065 bp, Glycine max
  Peptide Sequence Number=SeqID_196179
atgtcaggtgaactggatctcagtgttgcgattggtaggtttatatttgatgccatgcatgcagttactggtgcttatgctaaacccatcttcgttgataaactcggtgctagtctggattcaatttcaaatggaatccctttggaagattttggacatggccatcctgatcctaatctaacatatgcgaaggatcttgtcaacattctgtatgctgaaaatggacctgattttggagctgccagtgatggggatggtgatagaaatatgattttaggaagaagtttctttgtaactccttcagactctgtagcagttattgcagccaatgcaagagaagcgattccatacttcaagaacggtgttaaggcttcacatatttttagacatagttctcaaataacaagagatgggccctggattcaggtccccactggttggaaattttttgggaatcttatggatgctgggaatttgtccgtttgcggggaagagagttttggaacaggttctgatcacattcgtgagaaagatggcatctgggctgtcttagcttggctttctattattgcacatcgcaacaaagacaagaatcccggggagaaattgatctccgtatctgacgttgtgatggagcactgggcaacttatggaaggaatttcttctctagatatgactacgaggaatgtgaatctgaaggtgccaataagatgatagaatacctacgagatattttgtctaagagcaagcctggtgatcagtatggaagttatgttctccagtttgcagatgattttacatacaccgatcctgtagatggaagtgtggtatcaaaacaaggtgttcggtttgtttttacagacggttcaaggattatatatcgtttatcaggaactggttctgcaggggctacggttagagtgtacattgaacagtttgaaccagatgtctctaaacatgatgttgatgctcaaattgccttaaaaccattaatagatttggcaatatccgtgtcaaagctcaaagacttcacagggagggagaagcctacagtcatcacataa

SEQ ID NO: 79402 - DNA, 642 bp, Glycine max
  Peptide Sequence Number=SeqID_196180
atggcaagttattattatagattttcaaaagctttgattatgctatgtttaacttgcatagtgttgatcacacaggcacaatcacaaacatggtcattactccaagcaccaaaagaaataacccttaagctcattcgtgaccccgtgaccctttcactagcctcaattgattatggccacatagttcatgacaacccttttgcaatatttgccccatcttccattagtgacatctcactcttgataaatttctcaaattctctggccatccctatcaccatagctcctagagggcaagcccactcggttcatggacaagccatgacaaatcatggggttgtggtgaacatgactgagttgaatggctttagaaatggtgatgggattgtagtagtggttgatgacacaactattggtccatatgcagatgtgggtggtgaacaaatttggattgatgtgttgcatgcaacacttgagcgtggactcacacccctctcttggacagattacttgtacttatcggttggtggaactctctccaatgctgggataagtggccaaaccttcaggtttggtcctcagatttccaatgttcatcaattggatgttgttacgggtatgtatggttattctcttccctag

SEQ ID NO: 79403 - DNA, 513 bp, Glycine max
  Peptide Sequence Number=SeqID_196181
atgtttgaaaaagatgtgtcgtacgaagagttcctaaacagggttcatgctgacgagcttttcctaaggtcacaagggctttgggatgttcctcatccttggttaaacctctttgttccagcatctcgaatctcggatttcgatgaaggtgtgttcaagggcattattctccagcaaaatatcactgcaggacttgtgataatctatcccatgaaccgaaccaagtgggatgataacatgtcagcagttacacctcatgatgatgttttctacgtggtgtcatttcttcgttcaactgggtttgataagttggaggaatttaaggctcaaaaccgacaaatattacagttctgtgcgaatgctggtatggggataaagcaatatcttccccaaaacaaaactcgggaaaaatgggaggagcagtttgggcccaaatggaaaactttcaaacaaagaaaagctcaatttgatcccaacagaatattgtcacctggacaggggattttcaattaa

SEQ ID NO: 79404 - DNA, 675 bp, Glycine max
  Peptide Sequence Number=SeqID_196182
atggctttctcttgtaaacttgacagcttcattctctctgcctataaaccccaaaactccattctcccactttcaatccaaccttcctccttccttccatctccttcttctttgaagcctcagaagcttcccttcagaattcgctatggttctaccatcagagccacgtcatcatcctcaaccccttccgcaaccattgccgaacctgaaggcattaagattaaatcgattccaaccaagcccattgatggacaaaagactggaaccagtgggcttcgaaagaaggtgaaagtgtttatgcaagacaattaccttgcaaattggatccaggctctgtttaattcattgccaccggaggactacaagaatggtttgttggtgttgggaggtgatggtcgatactttaatcaggaagctgcacagataataatcaaaattgctgctggaaatggtgttggaaaaattctgggaaggtattttgtcaacaccagccgtttctgctgttataagaaagagaaaggcatgccagcaaatggtggatttattatgagtgcaagccataatcctggcggacctgaatatgattggggtattaagtttaattacagcagtggacaacctgcaccagaatccatcactgacaagatttatggaaataccctgtcggatgaataa

SEQ ID NO: 79405 - DNA, 1608 bp, Glycine max
  Peptide Sequence Number=SeqID_196183
atggctctaaactacccttttttaacctacttcatactactgctagtaaccataacccgtttgatattcactgtgggaaaaactgagcaatggaaagctccgattctaccagagcttgacattgataacatatcccacaaactccatgatgaccctgaaaccattcaaatggcttcaagggactatggccatttaacgcatgaattcccattagctgtgtttcgtccatcttctatagatgacatagtcaccttgataaaatcttcgtacaatagctttgccccttttgacatagctgcgaggggccaaggccactccactcatggacaagccatggctcgtgatgggattgtggtggacatggccagcctaagaaaacaaagaaatggggttgcgattagtgtctctaaggaccctttgatgggtcactatgctgatgttggaggggaacaactctggattgatgtgctacatgccacacttgaatatggacttgcaccagtttcttggactgattatttgtacttgaccgtgggagggacactttctaatgctggaatcagtggccagagcttccgttatggacctcaaatcagcaacgttcatgaaatggatgtcatcactggaaaaggagagttcgtaacatgctcttcacagaagaacttggagttattccacgcggttcttggaggcttgggacaatttggagttatagcaagggcgagaattgctcttgagccagcacccaaaagggttaagtgggtcagactactttatagtgacttttctgcttttaccaaagaccaggaacgattaatctcaatcaatggaaggaaacaaaagaacgcattggattttctggaagggatgctgctaatgaaccaaggccccataaataattggagatcctctttcttccctctatctgaccatcccagaatagcttctttaataactgaacatagcatcctctactgtcttgaagtggctaaatattatgacgaacaaaccgagttaaatgtggacaaggaaattgaagttttgctccaaggactagcctatatccctggatttaattatgagaaaaatgtctcgtacgttgagttcttgaatagggtccgaagtggagagttgaaacttcagtcacaaggactgtgggaagttcctcacccgtggcttaatttgtttataccaaaatctcaaatcttggattttaattcaggagtattcaaagatatagttcttaaaagaaacatctcctctggaccagtcttggtttatcccatgaatagaaacaagtgggacgataggatgtcagcatctataccagacgaggatgttttctacacagttgggtttttgcactcaagtgggtttgatacttggaaggcatatgatgctcaaaacagagaaattttggagttctgtagagatgctggcatcatggtcaagcaatatcttcccaaccacagcacacaagaagattggacaaaccattttggtgctaaatggatgaaattcttagaaagaaaacatcagtttgatccaagaatgattctatcacctgggcaaaaaatcttccacaaaaaattacagccagtgttttaa

SEQ ID NO: 79406 - DNA, 2415 bp, Glycine max
  Peptide Sequence Number=SeqID_196184
atggcgcttcaaccaattccattaaattgttcttcttccacaccgtgtagctattcttctctgcattttctcaaattcagagtttcttgttcgaaccagacatcgcaacttgacactccacaacgagtgaaggtagcgaacaagacaaaaaacagcagccacaggccaagcttccttcatcaaattcaagataaatggtcactcaaattagggtcccaaagggaaaaattcccatggcaagaacaaaaacacgaggtggaacaacaacagcagatagaagaagaaaaagaagaaaaaaagcgtgagcagttccagaatcagaagaagccttcagcatcgaattttcagtttccaaagcgagtttcgccttgggcgcaggcaataaacccgagcagtgcactgttagactctgaatccgatgattccgaggacgaggaggacaatgaagatgtcaaaggtaaagcgttgcaacacaactctattggttctgttcgtgaagaaagaaagggaatggcgagtgaggtttcttcgaatgaagcagaaagagtaaatggggagaggaaaaagagaagaagcaatacagagttggcagagaggacgattcctgaacatgagttgcggaggctgagaaagattgccttgaggatgatggagagatttgatgttggagtaaaaggcatcacgcaggaactggtagcttcagttcaccaaaagtggagagatgctgaagttgttaagttcaagtttggcattcctctttctgctcacatgaaaaaggctcatcaaattctagagagtaaaattggaggcatagtgatatggcgatcgggcagttccatagtgttgtatcggggaatggcctacaagcttccctgcatagaaaattataagaaagtgaatcttgctaaggagaatgctgtggatcactcactacatgttggaaatggaagtgatggtcaagcgagtgttaacgaaacagttggaactgcagagtcggtcatccaagaatctgctgagtatttgaaggacatgagtgaagaagaattgatggaaatgtgtgacctcaaccatttgttagatgaattgggtccacgtttcaaagattggacaggccgtcaaccattgcctgttgatgcagacttgttgccagctgtggttccaggatataaaaccccattcagacttcttccttatcggataaggccttgtttaaccaacaaggaaatgactaacttccgtaggcttgcaagaacaacagctccacattttgcccttggcagaaacagagaattgcaaggtctggctcgtgctatggtgaaactgtgggaaacaagtgctattgcaaaaattgccatcaaacgaggtgttcctaatacatgtaatgacaggatggctgaagaactcaggcctaatggtggttgcatttcatacatgcagaaattgactgggggaactctactttccagaaataaagaatatattgtattttacagaggcaatgacttcttgcctcctgttgttaccaacactctgaatgagagacagaaactaaccctccttcaacaagatgaggaagacaaagcacgacaaattgcctcatctattactgtatcaaatagcaaagcagctcaagtgccattaattgctggcacccttactgagactagggcagcaaccaccaactggggacaccaaccaagtaaacaagaaattgagaacatgatcagagattctgccatgaataaactttctgctttagtaaaacaccatgagaagaaactagctctagcaaaatcaaaattcaggaaggctgagaaggctttagcaaaagttcagcgtgatctggacccagctgatattcctagtgatttggaaacattaactaatgaagagagattcttatttaggaagattggtctgagtatgaagccatacttacttctagggaggcgagatgtttatgctggcacaatagaaaacatgcatctacactggaaatatcgtgaattggtaaagttaattgtaaaagggagaaattcagcccaagtcaagcatatctcaatatctttggaagctgagagtggtggagtgctagtgtctgtagataaggacaccagaggccatcatacaattattgtttatcgtgggaagaactatttcagcccgcgtgtcgtgagacccaaaaacttgttgacacgaagacaggcattggctcgatctgttgagcttcaaaggcgagaggcactaaaacatcatatctcagacttagaggagagaattggattgctgaaatctgagctggaggatatgaagaatggaaaggagattgaagatagcaaaactctgtacccagcactggagaatcctgtttcttctgatgatgacttggaagagctaaatattttctttccgtaa

SEQ ID NO: 79407 - DNA, 585 bp, Glycine max
  Peptide Sequence Number=SeqID_196185
atgaaactaacagctgggccgaaaaaagcagctcttgaacatttgaggaagaaaatagaggaatcaacagaaagaatccgggtggccaagctaaaggaagaacaggcacagaaggtgtgggaatcagcatccaaagtagtaagagatgaggaagcattaaagcaaaagttatgtgaagacttgagtaatctggttcaagaaagcagtaactctcagtttgctaggctggaggaattaaaaagaagattggaagctttgaatccaactcgcccatcaactaatctttatcatgatgggagatcaggagcttcttctcagaatagtacaccccaacctggttcctctgttcccaatgccaaggaatcaaatgagggatcaaccgagagtattcccaaccaaagtaatggtcagaaagttgcagtaacaaatgggcctaatcagcagcctcataatgaaggcgaaggcagaagtaaaaagaaagtcaacttccaaccaaaaggaaagggaattggtgctgtggccaagggtagatcttcaactcctgactggactggggctggcttcgatgtagatggcagaacctga

SEQ ID NO: 79408 - DNA, 1620 bp, Glycine max
  Peptide Sequence Number=SeqID_196186
atggatggtgttttcgccctccctgaagcagccagagctgattgtctccgctctctggtgcaatcttgtggctgcacttacgtttctctgtggcaatatgactccaatttatccaatttgttcttcttagatggtttctacgatgcaacgaacaaccaacaaagctcttctttagggagtgtagctgaaaggcttttacaccaatatcgggctttaacgtttgatgtcaatgatcatgaatatgttcctggggtcgttttcaggaatcagcttccctacatagagctgcaactattggatcttctaagactgacttcgacagaaatacaaacaaaattctttcaagaagcagggattgagattgctgttttcatggggtgcaaaaacggagaaattgagcttgggttctccaacatttctcaagttgacattcagacaacacttaaaaatttatttccgcaagatttctatatacattcacaatcaacaactgatcaaaatccacctttatcatcatcatcatcatcttcttctttcatgtcattatccacgggtaggcctgatcaatgttcatcttcattattactcagtagtattccgggaacttctcagtaccactttcctcaaacccttcccacacaaacacaaacacaaactcaaactagcccacagtaccaagcattagatttagttccagtcattccaagttattttcccacaccagagggtgaacatgaagcaatagtaaaagcatttatcagtgttatgtcttcttcttcaacttcaacttctcagcagcatcaaccccaccaaattgtgcctaagtatacttcagtggtacatccaggagctaccgctttcaataaatgtagaccagatacattgaacccaaatataacaccccaattgggatccaattttcgcagccaaagcctacagaaaagatcatttgaattctttagaaacttaaataatttaacgagaatgagagaacgcgttactcaacctgcaccacgtcccattagtacccagcaccagtaccagcagcataccatatcagagcgaagaaggcgtgaaaaactcaatgagaattttcaggcacttagaacacttcttcctccaggaactaagaaaaacaaagcaacgatccttacaacagcaacggagacaatgagatcattgatggatgaaattgaaaagcttaacatgagaaatcagcagttgatgacagttttatcagtcaaagaagctacagctactagtactgaagaaaacaaagctaaacctagctcctcatatgaaagattgaatgttggggtctcgcatgtatcggaatcaagttcatcagaagagcaaatggtgaacttgcaagtaacagtgagaggagaaagttgtctagttgatctattgattcagttattggaattcttagaaagggttcagaacgtaaactttgtttccatggacgcaaacaaccatattacaggagagacagccattaaccaattaaccttcagactgaggataattgagggcattgaatgggacgagcatgccttcgaggaagcagtaagaagagtggctgctgacacaatacaatggcaaccactggagcaataa

SEQ ID NO: 79409 - DNA, 483 bp, Glycine max
  Peptide Sequence Number=SeqID_196187
atggcacagattcattacttcagagaatactttctttcatttggccataaaagaacaggaaaagacaaaatctgggcaatccttcaccttcttcgtgagggaagaggggagaagtttgatatggaagctgtaacatctacacatgccaaggtacagacaggctacaagttacttgagattttggtaactagctgcctaaggctaaggtttctgaggccatatgaggttgtagatagttcaaagacaagtaactccaaacagcccaaggaaaagaaggaaagaatattccaaaaatatattgattgcaagatgcttcctgacattgatcagtgtagaatgcagacaaatactcaagcagaaaaccataatgacataataccaaaaaaggaagagagaaggctgtacagagagatgaacaacacacctcatggaataaagcagaaaccaggaaggcaattaaaagagcagcagcctgtacaatga

SEQ ID NO: 79410 - DNA, 273 bp, Glycine max
  Peptide Sequence Number=SeqID_196188
atgaatcccccccgcgtactgaagaagtcttcacaaactctaaaagcagcatgcagcatcgaaatgtttgttcctgagccgtattatcactcagaaaaggtccttgtgggccccgaatctcaacgactcaatcaattcaaacataaagttacttctaagaaggctcctcctcctcctcctactagcattcaaattttcatcaatttttcggatgtgggaaaaaaaatagaagaatatcaactgggacaaccagtgaaccacatttactattag

SEQ ID NO: 79411 - DNA, 1419 bp, Glycine max
  Peptide Sequence Number=SeqID_196189
atggaacctcgtgttgggaataagtttcgcctgggtaggaagatcggaagcggctcctttggggagatctatttaggcactaatattcagacaaacgaagaggttgcaataaagctcgaaaatgtcaagacaaagcatccccaattgctgtatgagtccaagttgtacagaattctccagggaggaactggaattcctaatgtcagatggtttggagtggagggagattacaatgttttagtgatggatctgcttggacccagtcttgaagatctatttaacttctgcagtagaaaactatcactaaagacagttctcatgcttgctgatcaaatgatcaaccgtgttgagttcattcattcaaaatcatttctgcatcgggatatcaaaccggataactttctaatgggattaggaaggcgtgcaaaccaggtttatgctattgattttggtttggctaagaaataccgagatagttcaacacatcaacacataccttacagggaaaataaaaatttgactggaactgcaagatatgctagcatgaatactcaccttggcattgagcaaagcagaagagatgatctcgagtctcttggttatgttttgatgtacttcttgagaggaagtcttccttggcagggtcttaaagcgggaacaaagaaacagaagtacgagaaaatcagtgaaaaaaaggtttctacctcgattgaagccttgtgtcgaggttatccaacagaatttgcatcttacttccattactgccgatcattgaggtttgatgataagccagattatgcttatctcaaaaggatattccgtgacttgttcattcgtgaaggattccagtttgattatgtctttgactggaccattttgaagtatcagcaatcacagctagccactcctccaacacgggccattggtcctagtgctggaaccagttctggaatgcccccggctgttactaatgctgataggcatacaggaggggaagaagggcgacctcctgctttggtttcagtggattcctcgaggcggagaatgtcagggcccattttaaatactttatcaagtgccaatgtcttgggtcagtcaagtggatcatctaggcgggctgctgtttctagtagccgtgatgcatttgttggtgctgagtcagatattcggactcgcactgctgaggctagccctggagcagcacatcgaggtttgagtgggcaaagaagttcaccaattggatcttctgatcctaagagagttgtatcatccgggagaaatgcttctcatgtgaaaaattatgacactgcgcttaggggcatggaagatgtttacagtttcacgcacgtggactgcaaatgtcaaaactatcaaataccagcaaaaaatgtaattagccattgtactcttgttggataa

SEQ ID NO: 79412 - DNA, 1593 bp, Glycine max
  Peptide Sequence Number=SeqID_196190
atgggattatcactttccttactccaatctgcgtgggaagaaattgttagacattttcccttttctgatttgcctctcagcatcagctttgcttccaaagatggaactttgattttaagggcatcaagcttcaagagaagagaatcagaaagtgctattactgttttgtcaaacgggtccagaagttcgaaccggttgagggataacagaccccaacatgtgatccttgaaagaaacttttcgtttgttcaagatgaggagaacaacaaaatgggttgggatactcttgcaagcaaaggtggtgaattgaaacataaaccagtgcctgtgctttctctgcctcaagcagcgattttctctcactctagacctgcctctgagcttgatgctgcagcaacaaagcttcaaaaagtttacaagagttaccgtactcgaagaaaccttgcagattgtgcagtggttgtggaagagctatggtggaaggcattagactttgcagctctcaaacggagttctgtgtcattctttgatgttgaaaaaccagaaaccgccgcgtcacggtgggcaagggcaaggacaagagtagctaaggtcggcaaaggtttatccaaagatgacaaagcacaaaaactagccctgcaacattggcttgaagctattgacccacgtcatcgttatggacacaatttgcacatgtattatgatatttggtttgaaagtcaaagcactcaaccatttttctactggttggatgttggagatggcaaagaaataaatcttaagaaatgtccaaggagcactctacaaagccaatgcattaaatatcttggaccaaaagaaagagaagaatacgaagtaatagttgaaaatggaaagctagtttacaaaaaggatggtaggcttgtggacactgatgagaaatccaaatggatatttgttcttagcaccacaagggccttgtatgtggggagaaaacaaaagggtacgtttcaacactcaagctttctttctggcggtgcaaccacagcagctggcagattagtggcccatcaaggtgcccttgaggctatttggccatatagtggtcactaccaccccacagaagagaacttcaaagaatttataagctttcttgaggagcacaatgtagacctcaccaatgtaaagagatgtgctatagatgatgataatccatcacttattgggactaattcatttactgccactaatgaatcacaacaagctatgggccctactctaaattctcacacaggcccagcaagtgcaatcaatgtcaatgatagcaagacgcacaaaaaggatgatgcagcaacatttaacttgtctaagaggttgtcttgtaagtggaccactggggctggacctcgtattgggtgtgtccgtgactatcctgaacatttgcaatcgagggcgttggaacaggtcaatttgtctccaaggcccacttctgcacgcctgagcaattacggcccaattccttcacccaggcccagcccgaaagtgaggatgtctcccaggattgcttacatgggcttgcccagtccaagaaacccaattccagctgcgagttaa

SEQ ID NO: 79413 - DNA, 333 bp, Glycine max
  Peptide Sequence Number=SeqID_196191
atgagaaacatcaaagtgattgatgtgatgcagcaaaattatggttctgctaaattttttggaaatgatatcaagcctgtacttgatgtggtgaatccccaacacaaaggtccttggggtgcgctttcacctatccctgagaataatgctattgctgtcaatactcaggggggatctgtttttgctgcatctggcgattcttgtgcatattgttgggatgtggaaactggtaaagtgaaaatggtattcaaggggcacatggactatttgcattgtatagttgctcgcaactcattagatcaggtcttgattcttgaccttattgtcatttga

SEQ ID NO: 79414 - DNA, 333 bp, Glycine max
  Peptide Sequence Number=SeqID_196192
atggatgcactaatgctcagaggcggcgatggaggaagagatggagtaggatgcgacggaaccgtcgctagaggcaaggatgagagtgtcgaggttagaggtgtagggtggggcccaagcggttcggaaaacggttcgggtttggatttccctctccttgagaatggtttctctgtatgcgtcttcgtcccagttcgtggcgtcaccgcacatcgttactcgccgctcgctgcgttcgttcttcagctcctccgccaacaacaaagcagtgcactcaacgacgacgttttaaagaggatgatgacccggggattcgggcagcgaccgggatga

SEQ ID NO: 79415 - DNA, 909 bp, Glycine max
  Peptide Sequence Number=SeqID_196193
atggcgatttccgatgagcctgaaagtgtagccactgctctcaaccactcttccctgcgccgccgtccctccgccacctccaccgccggcctcttcaattcgcctgagacaaccaccgacagttccggtgatgacttggccaaggattctggttccgacgactccatcaacagcgacgacgccgccgtcaattcccaacagcaaaacgaaaaacaagacactgatttctccgtcctcaaattcgcctaccgtccttccgtccccgctcaccgcaaagtgaaggaaagtccgctcagctccgacactattttccgtcagagtcacgcgggcctcttcaacctttgtatagtagtccttgttgctgtgaatagccgactcatcattgagaatttaatgaagtatggttggttgatcaaatctggcttttggtttagttcaaagtcattgagagactggccccttttcatgtgttgtctttctcttgtggtatttcctttcgctgcctttatagtggagaagttggcacaacggaagtgtatacccgaaccagttgttgttgtacttcatataatcattacctcaacttcgcttttctatccagttttagttattctcaggtgtgattctgcttttgtatcaggtgtcacgttaatgctgttttcttgtgttgtatggttaaaattggtgtcttatgcacatacaaactatgatatgagagcacttaccaaattagttgaaaagtttttgaaccagaacatcctgcttgacttagcagtagcttatggatcatggagaagcactgctcgatactctgaacatggactatccttacaacgtaagcttcaagagcttggcatatttcctggttgcccctacattatgttaccaggtagcagtactttcaagtga

SEQ ID NO: 79416 - DNA, 1614 bp, Glycine max
  Peptide Sequence Number=SeqID_196194
atggtgcagtttgccaacgtggtggtgtatagctatcagtatttgcttgatccaaaggtggctggcataatatctaaggaaatgcagaaagagtcagttgttgtgtttgatgaagctcataatattgataatgtctgtattgaagcgcttagtgtgagtgtgaggaggcagactattgaaggtgctagaagaaatcttaataggatgcgtcaggaaattgacaagttcaaggccactgatgcaggtagactccgtgctgaatacaacaggcttgtcgaaggtttggcactaagaggagacctgcctgctactgatgcctggcttgcaaatccggccttgcctgatgatatactaaaggaggctgtacctggaaatattcgccgggctgagcattttattcatgttttgcgtagattagttcaataccttgaagggcgcttggatactgagaatgtggagaaggagagccctgttagctttgttgtttctattcttaaccatgccggaattgaccaaaaagcactaaagttctgttatgatcgccttcattctttgatgatgacattggaaattacagacaccgatgagttccttcatatccaaactatatgtgattttgccacccttgtaggaacatatgctcgtggtttttctattataattgaaccttttgatgagcgaatgccacatattcctgatcctgtattacagctttgttgccatgatgcttctcttgctatcaagccagtttttgagcgatttcagtctgttgtgattacatctggcacactaagcccaatagatttgtaccctcgtcttttgaatttcaatcctgttgtcagtagaagttttactatgtccttaacaagagattgcatatgtcctatggtgcttacccgtggcagtgatcagcttccagtcagtacgaaatttgatatgagaagtgatctgggtgtggtaaggaattatggaagactcttgttggaaatggcttcagttgttccggatgggattgaaataatgcaacataaacttgtctttattgagactcaggatgtggtagagactacattggctcttgataactatcgcaaggcttgtgattgtggaagaggtgctatctttttttctgttgctaggggaaaggttgctgaaggtatagattttgatcgacattatggccgactagtaatcatgtttggtgttccttttcaatacacattaagcaagattttgcttgcacgtctggaatatctacgggatacttttcaaattaaggaaggagattttctgacttttgatgcattgagacaagctgctcaatgtgtgggtcgtgtaatccgttcaaaggctgattatggaatgatgatttttgcagacaaaaggtatagtcgccatgacaaacgttcaaaattgcctagttggatactatctcacttacatgatgcccacctgaacttgagcacagacatggctttgcatatagcacgtgagttcctcaggaaaatggcccagccttatgataaaaccggtggcactggcaggaaaaccttgttgtcccaggaagacttggagaagatggctgtcagtggcttggatgatatgatgtattga

SEQ ID NO: 79417 - DNA, 531 bp, Glycine max
  Peptide Sequence Number=SeqID_196195
atgaagcggtcattaaagtctgaactgacaacagacttctataagtcatcatgtcctaacgtttccaaaatagtaaggagagaggttaaaaaagctctcacgaatgagatgcgaatggctgcttctttgcttcgtcttcactttcatgattgctttgtgaatggttgtgatggatcaatactactagatggtggtgatgatggagagaagtctgctgttcctaacctgaactctgccagaggatatgatgttgtagatacaatcaaaagttcagtggagagtgaatgtgacggggttgtctcatgtgctgatatattagccatcgctgccagagattctgttttcctgagtggtggtccttcttggaaggttctgctaggacgaagagatggaacagtctcaaacggaactctagcaaatgaggcgcttcctgcaccatttgatccattggataccatcatttcaaagtttgctaatatgggccttaatctcacagatgttgtttctttatcaggatataaagagagataa

SEQ ID NO: 79418 - DNA, 597 bp, Glycine max
  Peptide Sequence Number=SeqID_196196
atgaagttcgagatagaggacataaccgtgtacttcccctacgacaacatctacccggagcaatactcctacatggtagaactcaagcgcgccctcgacgccaagggccactgcctcctagaaatgcccaccggcacggggaaaaccatcgcactcctctccttgatcacaagctacgttctttccaaaccccattcccccctcaagctcctctactgcacccgcaccgtccacgagatggagaagacgctcgccgagctccgcctcctccacgactaccagctccgccaccttggccccgccgccaagatcctcgcccttggcctgtcgtccaggaagaatctctgcgttaatccgcgggttctcgccgcggagaatcgcgactccgtggacgctggatgccggaagctgaccgcgtcgtgggtccgggcggtggccgcggagaaccctggcgtgccgacgtcaaggtttcaaatcatggttatggttgcggtttcattgcgatctttgatattgtgggaaattgtgaacaaatgtcgtattgtggttgccattgataccttgaaacccttgacgttgtggttgaaagttgtgtaa

SEQ ID NO: 79419 - DNA, 1017 bp, Glycine max
  Peptide Sequence Number=SeqID_196197
atgtctcgaggaattaatgaatctaatcgtcacccacagtgtcagtccatcaagaagaactctgattggactgtgatattaagttgtcaaataaggtcccaactgacaacagacttctataagtcatcatgtcctaacctttccaaaatagtaagaagagaggttcaaaaagctctaatgaatgagattcgaatggctgcttctttgcttcgccttcactttcatgattgctttgtgaatggttgtgatggatcgatactactagatggtggtgatgatggagagaaatctgctgctcctaacctgaactctgctagaggatatgaggttgtagatacaatcaaaagttcagtggagagtgcatgtagtggggttgtctcctgtgctgatatattagccattgctgccagagattctgttttcctaagtggtggtcctttttggaaggttccgctaggacgaagagatggaacagtctcaaacggaacactggcaactgaggtgcttccagcgccatttgatccattgaataccatcatttcaaagtttactaatatgggccttaatctcactgacgttgtttctttatcaggtgcccatacaattggccgagcaaggtgtacactgtttagcaatagattattcaacttctcaggaacaggtgcaccagacagcacactagaaactggcatgctctctgacctgcaaagtttgtgtcctcaaaatggagatggaaatgttactacagtccttgatcggaattcatcggatctatttgacattcactacttcaagaacctgctcagtggaaaggggcttctcagttctgaccagattctattttctagtgatgaagctaattcaacaacaaaacctttagtccaaagctatagcaacgatagtggacaattctttggggactttgccaactctatgatcaagatggggaatataaatattaagactgggactgatggagagattaggaaaaactgcagagtgataaattctcagtaa

SEQ ID NO: 79420 - DNA, 276 bp, Glycine max
  Peptide Sequence Number=SeqID_196198
atggcctctaagatgactctggcatgctgtctacctagaggaacaatgacaataatagagattgttgcaaatggagaggcattcaatgcaatgatgaaactggtcacgtacaacaataatgattttttacgatgttacataccggaagccatgggctccttcaccaacttaagatatctcaatctctcatattctgtatttggtgggaggattccttctaaacttggaaatctttcgcaactacgatatctagaactcgggggaaatcatctttga

SEQ ID NO: 79421 - DNA, 3450 bp, Glycine max
  Peptide Sequence Number=SeqID_196199
atggccgctatagcatccactatggccgctattcagcccactatgttgtccgctactcagcccactctgtggtccgctacggccactagactaaacctctccgctacagcagacagcccttgtaataggcaagggatgctccggactgctatattggttgtttggattgaaaatactaaacctgatacccaaaccgaacaaggcagggttgactttgtggaaatcgccgtctctaatgtctttgatgggaggatggatttaggtggaggaatgtttctaaaaggtaaatcccagtatgtggaagttggatttcctcacattgctagaatccctgagtttcttgttcaaaatgagaatgagctggaacaaagggaatcgcagattcgcaaagcttttgatgctcaatatcagagcggcgggggtggcttcgttagtgtagaagggctccatcaagttcatagagaaacaaatatcaaacttccacaagagaagcttgagcacctttgcagtgatggcttcattgtatggagtgagttttggcaggtcattttggatctagacaagagctcaggaggtttaaaggattcatcaggattgatgggattcaacgggtcaagtaaaagtgctgaagcaaaatgtgtagagagggaaagacaaacacttctcaacttcaaacaaggcctcatagatgcctctggcatgctgtcttcatggagggatgatgacaataataaagattgttgcaaatggaaaggcattgaatgcaacaataaaactggtcacatagacatgcttgatcttcgtggttcagaaaaacattatttgacaggtgcaatcaatctcacttcattgattgacttgcaaaatatggaacatttggatctcagttctaattatgattccagtgaaatgcaaatcccagagcacattggctccttcaaaaacttaagatatctcaacctatcatatataggtttgagtgggaggattccttatgaactgggaaatctctcaaagttggagtatcttgatcttaaagcaaattttcttgatggagcaatcccttcgcaactcgggaatcttacaacttcacgatatcttgatctaagttataattccgaaattgaagggcaaatcccctatcagtttcgaaatctctcacaactgcaatatcttgatcttgaaggaacttatctttctggagcaatccctttcaaaattgggaatcttcctatcttgcatactcttatgcttggtcaggatttggatgtcaaatctatggatacagcgtggttgtctagtctctattccttgacacatcttggtttggattctataaataatcttggctcctctcagcacttgctactaacgataagcaaattttttccaaacctaagagagttgagtcttacagatagaagttttattgtttcatctacttccacagtgaattcttcatcttctcttgacacccttcatctctcctttaatctattgaaatcatcagttatatttcactggcttttcaacttcaccaatcttcgaagacttcaccttgttgctaacttgttagaaggttccattcccgatggatttgggaaaataatgaactatcttgaagatcttgtcattagctctaacagactgcaaggcgaaattccagcttcccttgggaatatatgcacattgcagcgattataccttaagaaaaacaacttgagtggggaaatttctagcttaattaaaaaaatttcatggtgcaacaagactggcatgctacctaatctttcaaatttagatctttccttcaatcggttaaccggagaaatacctaaaagcattggattgttatatgagttggagtctcttcacttggaggagaattacttggaaggtgacatcattgaatcacatctcacaaatttgaccaaattggaggagttagacttaaccggcaacttattgtctctcaagtttggtaatacttgggttccatctttccagttatatgttttgggattagcttcttgcaagttgggtcctagtttcccaagttggatccagactcaaagtcacttacagtttctggatatttctgatgctgggattgatgactttgtaccagattggttttggaacaagttacaatctatatatgccatgaatatgtcttacaacaatctcaaagtttcaatattggacctttccgagaacaagatttcagatttaaatgctttcttctgcggaaaaggtgcaactgcaaacatgctcattttggatttatcaagcaatcaaataatgggaaagctgcccgactgttgggaacatcacaattcattaaaagttcttgatttaagcaataatagattgtcagggaagattccagagtccatggatactcttgttaatttgaaatctctggtcttacgaaacaacagtttaattggagaactaccactcacattgaagaactgcaccagtttagttacatttgatgtgagtgaaaatttgttgtctggtccaataccctcatggattggagaaagtctacaacaacttaaaatcttgagtttgcgagtaaatcgcttctttggaagtgttcctgtacatctctgctatttgaggcaaattcgtctcttggatctttcaaggaataacttgtcagaaggaattccaacatgtctgagcaattttactgcaatgagggaaaggacagtaatcagaagaaaaattgttacgggacaaaggtggacatatggagttatatcctcagatgtttatgactctaatgtgttattgatgtggaagggtcaggaatatttgtatttgaatcctgagtttcttttgaagagcattgatctctcaagtaatgatttaacaggtgaaataccaaaggaggtaagatatttacttgaattagtttctttgaatttatcaagaaacagattaagtggagaaattcttcctgagattgggaatttaacttcactagagtttcttgacttatcaagaaatcatttgtctggtgaagttccttctactctttccaaaattgatcgtcttgctgtgttagacttatctaacaactatcttgttggaagaatcccctggggaagacagcttcagacctttagtgcctctacttttgaaggaaataccgatctttgtggtgaaccacttaacaaaagctgccctggaaatggcacagcaacaaagcctcaaggaccagcaattcaaggtcatgatgacaattcagttttctgtgaagcattatacatgagcttggggttaggattcttcacaggcttttggggcttaataggtacaatactactttggcaatcgtggagaaatgcttacctgatgttcttaaacaaactgacagaatatatattagtaatggttgaagtgaacatagcaaagtgccataggtggctcaagggctag

SEQ ID NO: 79422 - DNA, 171 bp, Glycine max
  Peptide Sequence Number=SeqID_196200
atggataactgtgatggagttgtgtctagtgaagttgtggtggctttttgtggtgttgttttgatatattcaaatggcaagttcataaaggtcttctttaggagatttggtttctgtagtatgcttgaagctgagctttggggacataatttgaaatggaaggagcaataa

SEQ ID NO: 79423 - DNA, 2072 bp, Glycine max
  Peptide Sequence Number=SeqID_196201
atgcgaactagcggtccagaatttctagaacgagttagcattacagcaggaatacctgataaagatggcgatgtgggttgctggagaggatttcataaattgggattagcactagcttttgaacatggatgcccagatgctacagtccccctcttttatcactcttcaaaaacgtggaagccacttattaaaagaggtttatataaagctgaatggcttaatgaagctatatttgatcttttcaatgaacctgtttactttgacgaattaaaaactcacagaccttgccttctaatcggaggccgtgggacaggtaaaacaacggtgttaagaggcttatcatatgaggggcaatatgcgtctttttctgcacacaaaaaaaatgtagaagaatggcctttttatgggatgtaccatcgagtcaatactaatagagtaactgcttttaggggaccagaaattgatgagtcaagctggactcgctatttttcacactatatcaacttgacattttgcaaacaaatattagactttgtaaagtggttcaacttaatcacaaaacttgacattgagttgaataaaagttctattaagaaaatttgcttgagccttggaattaatgaagttgatactttagaagaactttccgaagagttggaatatgctgtaattgattttgaaatttccgttaactcgataatagataacccgcctaaaaatctatctattcttgcggctccaatcgatatattgactgagtcgttgtgctcattatccatattcaagggtaaacagttctattttttaatagacgaatttgagaactttgaagattatcaacaaataattcttaataccattatcaagcattctaataactattatacatttaaaattggagttagagaattagggtggagacagagaggaacattaaactctaacgagtccttgatttctccagccgattatgcgttgataagtatttcagaaaggctgcaaaaaaataattttgagctttttgctaaaaaagtaataattgatagattaaaaaaagaattcactgaggttaaagacgagtgtattgaccccacaaatctcttaacatcaattacggaaagagaagaggctgaaatattaattggatctgaagattacaataaaacaatagaaagcctttcgactatagttagcaaaaaagatttagataaaattagaagcatagagagagaactagttcatgcggcctttataaatcatatcgaaaatgatggggttctttttgaacctattagtcccaagacccaaacagatgcggcaacacaaataggtaaaaagaatttgtctgaacttgaagggttaagtgtcgatggtgcaaaattaacaaaacttgttcttagtttaggacgaatttttcaagtgatggcatctgacggtaaagggcattcaccagaagttaaccagtttcatataaaaactgatagcataccatcagaagctaatgaggcagattttattcctgaagataattccatatacatcttcgggagatctggtgaagaacgttctaagcatattaattctgtatacactaatactcctaatgttgaatttagagaaatatttgctgaagacctttatggttttacatcagaaaatgaacataagttctatttacgttcggaaagaagcatattagatttcattgggttagtagaaataaaccaatgtgtttatatagacataacgggcttgactcattctgtatgggctagattaattcaggtttcattgaaccaaaaatataaagtgagagtagtttatgttgagccagatcaatactcaagaagcacagctcccgtggaaggacagatctatgatttaagtgaaaaaattcaagggatcgcacctttaactggattcgcaaaaatatctgatgattctgaaaaagactttcaatttattccattattaggatttgaagggacaaggctatcttttatcactgagcaagtgcaacccaacactgaaaatatcattccaattattggaacccctgggtttaaaccttg

SEQ ID NO: 79424 - DNA, 354 bp, Glycine max
  Peptide Sequence Number=SeqID_196202
catttcgtttctaaacgaccatttagaggaaacactgggtccaacaaagataggagaaaatcactcaaagtgtatcaatctcacacagtgcgtggcgagaaagtcgctagcgcacaggattttgtcggcaatcaaagggagaggaccactttaggttgtggtttcctttttcttgttcacttggtgacaattttgtaccgtttagatattgtctggacaaggatttatgataagttgggattttggctcaaggcttgtagaacggttggtcatgatatatgtcagggtttggccagcggttcggggataaaggggatgtcctacattatttccatgatacacatgcaacaatga

SEQ ID NO: 79425 - DNA, 540 bp, Glycine max
  Peptide Sequence Number=SeqID_196203
ccagagcaactatttcacagaaaatgtctccacattactagtgaggctttggctggaacccgtgctagaggagcatcacaagcactagatcttcaaatcgaacttgacttacttaccagtccaaaggatgacattgagtttactatagtgagagaaaccataagaagaaaattagaggcagtatgtgaaaaggttgtaatcaagccagagaaaatgattagaaaactctccaggattcaacatttatattctcaattatctggcaggttaagaagtgaagaagatgagtttgaaattttgtcatctcttcacccgagtccagcagtttgtgggtttccaacagaagaggcacaacttttaattgcagatgcaggggaatcggaaaacggcggtgtacactaccacactcaatcacaacattcagtcaatagcgcaaggcatggcccaagcccttcacaccagcgagcacctccgtcttttacgtgttatcctatgcccgcactcgatcgacgcttcacaagctcagatggtgtttcttga

SEQ ID NO: 79426 - DNA, 213 bp, Glycine max
  Peptide Sequence Number=SeqID_196204
atggcccaggcaggaggaggggcccttttgtttattggaagggttcttgtgtctgacatcgatattggatatgaggagatagttaacactctggttcttgctttcaatggtaaacctgtgaagaatctgaagagcttggacaacatggttgagagctgcgatgatgattatctaaattttgatctggaataccaacaggttttctctcattga

SEQ ID NO: 79427 - DNA, 555 bp, Glycine max
  Peptide Sequence Number=SeqID_196205
atggagataaatggtgatccagtgtctgaagatatgattgttgagacaatccaagaacagtcagaacaaaagccaaaaagattagaagtggagaagcttaagagttcaatctacattggaacatggtgttcatgtcttcacgatcttgaagatgatattattgaaacagactcaggtgttgaactagtcagaccaaggccagtatctgaaacagacaaacaagcactcgttgttgtactgtttgaagaaatggatgaagacatgatcatacattttgaaagtatatatgggtcttttgcatctgtcaacatgaaggagatgcaagtacatttggaaaggagaaaagtgcttcaaatgactgaaaaactcatcatattgatggatctttttcaaagacttgatcatcgcctgatgaggaaagatttgtaccaagccaccacatggcttcctccttcaagaaccatgcctctaccacctctacagattgtacctgttgagcctaacgttaatgttcaatattatcatggctttagaggccatagagtcccggagtga

SEQ ID NO: 79428 - DNA, 264 bp, Glycine max
  Peptide Sequence Number=SeqID_196206
atgcataatgcagtgcatgaagagcaccacgatcgtggtgaaatgggtgattacggttgtggtggctcagatgattcaggttcagacttagaatctggagccttcctctttggggttgttctagggtctaaaggtttgggcttagatgaaggttgtttcttgggtttcttggttgggtttgagggatcagggttagatgttagtggaggtgggtcttttcttttgatggggaggttggatctaggttggctaggtttggtctaa

SEQ ID NO: 79429 - DNA, 873 bp, Glycine max
  Peptide Sequence Number=SeqID_196207
atggtttttcctcttcaagctcttgttcgtatgttgattagcttggagggcagccctgggcaaccacaggatttagggagaaacatttctatgtggatgctgcttgagagagtgagatttaccttagatggtattgaatgtaacaaaattggtgtcagctatgaagcttttaatcaacaaccaaacttttgctcttctcccttttggacctgcttgcataatcaattgtggaattttcgggagagtgctgggagttattctttctccataggaattacagaggttcttaatacaaaccttgtgctagaattaagtgtgaatgatgtagagtatgtttatcaaaggatcccaggaaagataataagtgttagtgtccctacatttgaagccttaactcaatttggtgttgctacaatcacaactaagaatactggtgagtttaattgctccaaggatatcaccctgatggagcccgtattaaaggattctgattataatgaagttgatagagctgaatgtcaatttgctactacgacaactgttcttgacaacgacacaaagtgcttgtgctattatggcttttgcgccagaaaggggcatcaccatattcatgataacaaacatcataagcaagaacataggcactctaactatagtgctcaaaataggcgaaggaccacttatgagcatatgcacaagcattctgaaaggaacttcggttattttgatgatttacaccatgttcataaagaaatgcacaagtatggacataaaaaacagaatatggataatgtgcagcatattgttgaccatcctgcacatcacaaacacagaaagaaacgggatagctcaaagggggagttaaagagatga

SEQ ID NO: 79430 - DNA, 450 bp, Glycine max
  Peptide Sequence Number=SeqID_196208
atggcatcttcctcgttgcaagctaagcatgtttcagaacatatttggaatggggaagaagatagaaaattacacatcatacaagttgtcctcatgtatcaaggtttccgtgtggatgggtcaccattaattggtccaacaaatcttgattgggctgatttatgtgaaaaattgttaggagtcagaccacaagaaggtgaacttcaagagtgcagcacgtatgcatggggacctgctgtgcttgcttatttatatagagagatgtgcagcgccaccgattacaaaactaaatcaatcggagtttttgtggaagtcttacacaacaaatgttatgtcagcgtcacctccaatttgtttggttggaagtgtagcgtagcgtggtgcacggtggtgtcactcatttgtttccatgttgttgattggcaccaacccgataaagttttgagataa

SEQ ID NO: 79431 - DNA, 232 bp, Glycine max
  Peptide Sequence Number=SeqID_196209
tgctatcaagggtcttgatgatgctccacagcgtaaatcaaaggctcctgctaggtggattgtcgtcaagtctaatagacaaaaaggaactactaagtgcggctactatgtcatgcactggatgtccactatcattttaggaagttttagaaataattgggaagcgaccattggagcccgagagattaaaagcattgcggattcagtgggcacaattttatctccaagttag

SEQ ID NO: 79432 - DNA, 567 bp, Glycine max
  Peptide Sequence Number=SeqID_196210
atgggacaagaactgcagagtctgttgatcttttttagagccatatttttgttatttaaagtagtgaatgtcactctagaagcatttgagaaacatgctttaagggaaaggagtggaaggtggaagagaaacatctgggttcatttcgaagacgaagacaaagttccactctggaagacacctctgataaaatattacacacaccagtcaaatgtggttaaccgaaaagactctgcaatgaggaaacaaaacattcacagggatgagttcctacgttgcacgaaatgcgggaaggagtgcaggttccatctcaagagtagaccagacattaagaactaccatgatgctttaaacaacaaatgctggacttgttctctttggccttatcaaaaaataacatgcgatgattatgaagagagatcaagtctgaaagcaagcaggggctgttcttgttcttcaacttgccaagactgctcaacttgttactgtgaagggtgcatcaagtgccgctttcaggattgcaattgccaagaatgcagagactttatgctatatgctgaaccttaa

SEQ ID NO: 79433 - DNA, 267 bp, Glycine max
  Peptide Sequence Number=SeqID_196211
atgcctaatcctgaaaagttcataactgagacgttcatcacccgacttgcaggggtgacatcaactaacagatgttggggagttatgatgacaagtgtttcaagaacgatgccattttttgctgctgcaaagagcaatgaagcacatgtagatggaggcgttggctttgtatgcgagttgctggagtatcgaagggagcttgatcatgaaatgtggagagactcatacctaattagggttcatgacattgaggggagaatgaggtag

SEQ ID NO: 79434 - DNA, 210 bp, Glycine max
  Peptide Sequence Number=SeqID_196212
atgtacaatttgagcgtccaaatattgggattcttaattacatgcgatgatgatgaagagagatcaagtctgaaagcaagcaggggctgttctagttcttcaacttaccaaggctgctcaacttgttactgtgaagggtgcatcaaatgccgctttgaggattgcaattgccaagaatgcagagactttatgctatatgctgaaccttaa

SEQ ID NO: 79435 - DNA, 255 bp, Glycine max
  Peptide Sequence Number=SeqID_196213
atggcgaaagaagaatctggactacctatagtgatccacccccaacagaagacaagtcaaggaaatgagaaaaagaaagaagatgagtatattactcaaggcgatccacctcaacaggagagaagtcgaaaaattggcataaagaaaaaattcaagaatatagcgcaagatgatgcacctcaatgggagagaagtcaaaaaattcagaaaaacaaagaactcaagaatattacgcaagtttattgggcacattag

SEQ ID NO: 79436 - DNA, 294 bp, Glycine max
  Peptide Sequence Number=SeqID_196214
atggcaagaatagaaaaagtggtcaagatctcagaacaagagctagaccgattaaagcaaaataggaatgaagtggcagagataccaaggaagtgcttggaggagaaggcgaaagcttttggccaaccaaggagaatgggcaacattcatcaacgtattagctctgctagtgtttgggacagtactattcccgaatgtagacgggttggtggatctagtggcgatcgacgcctttcttgcttatcaccacagcaaggaaagctcgatcattgctgttttggcagatacatgtga

SEQ ID NO: 79437 - DNA, 224 bp, Glycine max
  Peptide Sequence Number=SeqID_196215
atggcttgcacccacattccagtggaagcaaagatcgattctcctcaaatttcagccagcccgcatcaattagactttgcaccttacgctttgaggtcatacagtgctcaatggaatgtcccggaactcctccatgatatgcacatgttgcattcgagtcgtatcctcagaaaatggaggttgaggaaacctagcgggggttatggctaccattgcattatcaa

SEQ ID NO: 79438 - DNA, 225 bp, Glycine max
  Peptide Sequence Number=SeqID_196216
atgactactcaagcgctcgaatcccctactacaatgcacagacttcacactagatttcggattgcacgaacgttggcccttggagcggtccgcggtgggactcagggacagatttctagggcgagggagttcagtgaactcatccagtatgagcacccactcaagtatgccgatgtcacaacaccgaggactgatgagacgcagtacacatacactaagtgctag

SEQ ID NO: 79439 - DNA, 528 bp, Glycine max
  Peptide Sequence Number=SeqID_196217
atggctgtgaaggacattctcaagtacttgcgaagaggggggagatttgtttttggtctatggggataccgagttgaaattagaaggcttcacgggattctagtttttcaatcggacgtggatgactcgaagtcaaactcggggagttccaaacaaggcacgacggctgattccaccaccgaggctgaatatattgcagcatcagatgcttcaaaggaagggtcatggattaggaaattcatccaagagttgggtgtatttccgaacgctagcgatccagtacggctgtactgcgataacaacggagccgtagcgcaagctaaggaaccaagagctcatcagaagtcgaagcacgtgttgagaaaataccatgtgatccgagagatcatagagagaggtgaagtcaagctagacagagtcacctcggaggacaatattgcagatcccttcaccaagccattgtcaggatcagtccacgagaaacatcgagagtcgatgggacttagatttatgagtagttggctttag

SEQ ID NO: 79440 - DNA, 951 bp, Glycine max
  Peptide Sequence Number=SeqID_196218
cctgtacatagacaccgttatgaaacggtttagcatggaagaatccaagaaaggattcttgccaatgtcccatggggttcgtctctcgaaatctatgtgtccgcaaacacgtagtgaaatcgaggagatgaaaaggacgccttatgcttctgccataggaagcattatgtatggcatgctatgtacgagacccgatattgcgtatgttgtgagtgtcataagcagatatcagtctaaccccggcccggctcactggaaagccgtgaaagatatcctcaagtacttgcgaaggactaaggatatatttttggtctatgggggtgccgaattgaaattacagggttttactgactctagttttcaatcggatgtggacgactcaaagtcgaattctggatttatattcacgcttaatggtggtgccgtgtgttggaagagttccaagcaaagcacgacggccgattccactaccgaagcagaatacattgcagcgtccgaagctgcaaaagaagggacttggataagtaagttcatccaagagttgggtgtcattcctaatgctagtgatccagtaacgttgtactgtgataacaccggagccgtggcgcaagctaaggagccgcgatctcatcagaagtcgaagcatattctgaggaagtatcacgtgatccgagagatcattgatagaggtgaagttaaggttgaacgagtcacctcggaagagaacgttgcagaccccttcacgaagcctttaccaagatcggtcaagtgggagattgttggagtagtaaacggtattgtgatatcggcatgcacaagtgggtgctctccttatgacctagacatcaccgtgacttcactagaggaccagctgtatcgtgacctgtccctgagttccaccgaggaccatcccaagggccagtgttcgtgcagtccgaaatctagtgggag

SEQ ID NO: 79441 - DNA, 1062 bp, Glycine max
  Peptide Sequence Number=SeqID_196219
atgatcactctccttgaaaagctactgaatctcgatgtcaccctcctggccgagctctcgttggatttgatcctgttttctcttcctagttcctatgaatcgttcatagtgaacttcaacatgaacaaactagatcctcccttggatgagttaatgaacatgttggtcagtttcgagtccaccattaagaaagagaagtctgttctcattgctgctacttctggaaagaagagttcttcccaaaagaagagaaaggaaagagttcccttcccaaacagcaagttcgaagtgggtgaaggtagtgggggccccaaagaaaaggtcatcaagcaagttgatgatgcttgccatcactgtggaaagaaaggacattggcgccgcaactgcaaggcttacctaaagcagaaaagttctgaaaaggcaaaacgtaaggagctagatcaaaaccccgcacaactttggcacgctagattaggtcatgactctttaagaaggatgaacgattttgtcagtgaaggattgttctctttggaggacgtgaaatcactacaaacttgtgaatcctgccttaaagggaaaatgaccaaatcaccctacaaagggaaaatggaacgagccgagggtcttttggatttgatccatacagacgtatgtggtccactaagtgttagtgcgaagggtggatataactacttcgctacctttaccgacgattattctaggtatgggtatgtgtacttgatgaattacaagtctgaaacatttgaaaggttcaaagattttagacacgaagtggaaaagcaactcggacgaagtattaagaagctgcgatccgatcgtggtggagaatacttgagcatcgagttcattgactatctaaaagagaatgggatacaatcccaatggactccaccgggaactcctcaacttaatggagtctccgaacgtcggaatcgaactttattagatatggttcgatcaatgatggggttcacaaacttaccggcatacttgtggggtcatgcacttcgtactgccgcgtatttgctgaatagaggttaa

SEQ ID NO: 79442 - DNA, 132 bp, Glycine max
  Peptide Sequence Number=SeqID_196220
atggggagtaggagtcgacgtccccctgagcatgctatcgaggattctcgtggaccccataaggatgtcgaggaggctccccttcgaggacgaggggaggaacgtgacccacgtcgtcatgtatggctggtg

SEQ ID NO: 79443 - DNA, 297 bp, Glycine max
  Peptide Sequence Number=SeqID_196221
atgaatttattgcctagtgttgttcatgcgtcctccaccattgagtctggagccccgcgaattgattgcctagcgctgttcgcctatcctccaccctcaaatcttattcgtagacctatgaatagattgcaaagcgctgttcgccaatcctccactctcaaatcttatccggagccctatgaattgattttcattcatgcatcctccaccaacgagtctgaagcctcgcgaattgattgcctagcgttgttcgcctatcctccacactcaaatcttattcggagcccgatgaattga

SEQ ID NO: 79444 - DNA, 423 bp, Glycine max
  Peptide Sequence Number=SeqID_196222
atggtacatctcttgtggatcagttcaagtggagggtacatccacttggtttttttcaaagagaacaagggagggtacatcccttgtggatctttggcttgtaaaggattttacaaggttgaaagaaatctcaagaaccgttggttgcttggggactggattaaattgcttgcttatgaacataaactgactcaacaattttatgcagaagaaatagaatgggagaggaaaggaattgcattaaaagttaactcctcaaaggaagaatacaaagatagttccagcagtaaggaagatgcagagaatttcaatttgatgttaatggatgacccattgtcataccctaatttcgtctggggaccattgtttggtggcatgcaactttcatttgaccacttcgaggtacttggcacccatcgttag

SEQ ID NO: 79445 - DNA, 351 bp, Glycine max
  Peptide Sequence Number=SeqID_196223
atgggtggaaaccttggattgttacctgagaggttgttgcaacaacgtaacaacctcattattcaggatggagggctaatgaggactactcaatgcaatgtcactcgccatgtcactcgtgaaccccaaacagctatggttgaaaggttatccagtgtgagcatgatttatatcccttcgggtagagtcaagttgatgcaagctccattggagcttataggcctaggatcttcttcatcaatggattcctttgctccttggaagatgaatggcagcggaatggagaatgaagagagagaggagacgccacttcaaggagaagatgagtctagaagaagctcaccaccatag

SEQ ID NO: 79446 - DNA, 1836 bp, Glycine max
  Peptide Sequence Number=SeqID_196224
atggcgtgggcgtgtgcggcttcacgtcgtaccagtgggggcatttctcgccctcgtaggaggacgcgacctttcactgcttttagggagcctatcctggttattgtgatcttcccctattttgcttctgggggtgtgaggagaggtagtggcggtggagatgttagggcatctcctcgcactgggttgtcatcatccacacctgtcgtcgctagctatgagtgggttaagctagcgagccctgaagacacttgcaagttagtcgttcaggcttgcgggagtgatgacttccctttctggaaggcggcgtcaggcagtccaccctcatcttttatgtatatgtgtctctttgaggtcttgggtcttattctccccttgatcgctttcccatatgctttgcttgaacacttgaatgtggcttcttctcaactccacccaaacatttgggatatgatgaaattaactaacaatattggttgggtctacttgaacaacgtgcccaagaagctatttgagcttgactcaaacgtttttcatcgcttcaaggatcatttctttaaggtcctagctactggtgtcgtggctgatggtctgccacaaatgttcaataaggacggggaaccccgcttctcgttctactggtattataggtcagacctgcaagcgggactgtgccaccgtctattgctgcttctattgatggaaaatgaggttaacctgctggtcacctctagtgccccttcctctattttggaaaagaggaaacaaaattatggtgttgggtcatctggtcgtaacaagtcaaaggtgtttatgagccttcgtgccctaagacaagctgtagggttggcgcacagtacgggtcacccttcgatcatggaggatgtttctttggctccatcgaccgtcgaggctcctactactgttgtttctgctgtacctgttcaggaggccactcctgctactggtgttaacgtgccagccacttcagctggttctgttgtcgttccatcgtccaccatcactgcatccttgttcagctcatgtagtgttggtgtggcgactgcaagtgctcatatagtgtcgcctcctccttcttcggctccaccctttgttgtattggcgatggcgtcaccttcctcatcttcttgtcctcatgtctcattagatcacctgtacacctcaagcgatactaattcattgtgggggtgcaagttacaggttggagcaaaagaccccaattggctttgtgttagacttcgacaaaaatttgattcagttagccgaggtgcagaatgctacaaattctgccaatgtctttctccagagaagtttggcgattctggaggagaacggacaacgtcactaaaagactttgcaccaggtggcgtccttagaggcggaggttgccaaatgaaggagataaaggacctggctggcaaggtggagggcattgtggcaaagagggacaagctcacgaaggtggttgctgatttagagacccaacttaaggagttgccaaggaaagggaggccaaaaaagagcttatggagtagctgctcatttacaagaaggagaccatggagcggtgggtttcaaaaggttgtcaggcaggctaggttcttcaccaaggaccttgacttgggtctctttgatgctttcaaggacgtgaaggatggttttctacttgacgaggaagaaattactgcaaaggaggaggttgttgatgaggagcagggttctgaggagcaagacgatgatgccactgttaggttaccttttgtttatcttcttttcttttgcatggttggatttttggccatacaggccttgtaa

SEQ ID NO: 79447 - DNA, 285 bp, Glycine max
  Peptide Sequence Number=SeqID_196225
atggttacctcaaagaaaatcgtgaaggtcagattgagcttcgttctctaccgaaacctcaagacaagcttggaagattccactccgattaaaggtttcctcttgcggccaccggtggttgtgggtggtggagaagaagcttgggatgttggaaatggttttggggaagaggatgagaaaggaaagactattttttccaaggctacacgaaaaataaggcttgcaacattcaagtgttttctgctctcgggaaaggaagcatctcgaacacaccagaagtcataa

SEQ ID NO: 79448 - DNA, 336 bp, Glycine max
  Peptide Sequence Number=SeqID_196226
atgaccaaacttggtctctgcttgtcatcgggcccgccacctctggatgacaaaagggtgcgaataaccataagaatgaccaaacttggtctctgcttgtcatcgggcccgccgcctctggatgacaaaagggtgcgaataaccataagaatgaccaaacttggtctctgcttgtcatcgggcccgccgcctcgggatgacaaaagggtgcgaataaccataaagggtcagtatgacaaagattatggggcggccgacaaaagcaaggctcttgctcctacgtatcctccaatgaggaactcagacctacgtagttctggaacttgtgagacttga

SEQ ID NO: 79449 - DNA, 519 bp, Glycine max
  Peptide Sequence Number=SeqID_196227
atgccttcaccagtgcagccaagtcactctccatcatctgctgaaggtgagaaacatgcacgcaagcaattggatagagagattagggacatggtctctgccatcactgacagggtcacagattttcacaaaccaggctcaaccaaccatatggagaatgatggtgaacatggtttgagcatggtcacccttgtaggaaacaacaacggcgccactatgaaaagtgaattcgacgaaaaatcaggcaacccttctcatggtgatgagcctgaggcactgagcacctatgttaacagcaacttccaagccatcaacaactcagtcatgcttggtggaagttaccagaccaatgatccaggtgtgcacatggatatctcagatttctccactgagcatgagcagcaccatcgaagtcactaccagaaggaagaaaagcatgggaagaagggaaagaaaatagagaaaaaagcttccaaatccagacatctttcatcatcatcatcagaagattctgattga

SEQ ID NO: 79450 - DNA, 357 bp, Glycine max
  Peptide Sequence Number=SeqID_196228
atggcagaacaagctaaacaagtattttatgttcaagacccttgtgatgaaaggtggcaaatgactacaccacctaggtctcctcctttttctcctcctcctcctattgatgcaacatcacattcccctcctaccttaaagcggacaagaaaagccacaggcttgagatcattagctgctactagaccagttggggcagagagacccctggtccatgtggatcctacaactgggaaagccgacggtccccatagaaagaagttaagaacatatttggggattatcgctcgtgataaggtggatgtgacatatgagaattggaaacaagtccctattgcacaaaagaatttgatatag

SEQ ID NO: 79451 - DNA, 558 bp, Glycine max
  Peptide Sequence Number=SeqID_196229
atgtcgaaatgggaacttgtagctgacaaggacagtgtcgatgacattgtatgcgaaaagtatgacattaacaaggagaagtggacccaattttgtcagagtcgcagagaccctttgtgggaggatgtgcaaaagaaggcacagaagttggcagatgagaggaaaaagaaacaactggaggaagctgctcaatccagaagcactaacaccacgattgatccttcatctcccatcagacgacacgtgaagtggaagatgacccgcaccaagaaaactgagcaaatgacatctgaggcagcaaaggaaattgctaacaagattgcaagtcactttcagtttttaattgcaattatttatgattcgttggaggatcatgcctcacaaggttcctttgtcgcccatggacatcaggatgtattgactgttgccattgggcgacaagaacaccctggtcgtgtgcatgctgttggagttggtgtcacaatcaaacaatactttggaccggctccaaggacctcccgcacttcttcgtccatggctcccgaagacctggagtag

SEQ ID NO: 79452 - DNA, 390 bp, Glycine max
  Peptide Sequence Number=SeqID_196230
atgacaaccctaagggttatcaacatcgtgaatggcgagaaggccacgaagggagctcaccaaattgaagagatgatgctgttgttgcatggtcagaagaagaagaagcaacaagagggagtgaaagttgtgaacgatgaactccctggtggtggtggaagcagtggctttggtggaggctgtggcttcaatggaaccgtggtggtggtggatatggtggtgggggtgatggtggcagatatagtggtcgtggaagtgaggcaagggtttgggaaagggaggagccaaggggcagaggacggtgttgcgagacaacatgcagggcatcacgaaacccgacgtcaagagaatcaatggcatattctaagaaaaaacccgcaaagtccttaa

SEQ ID NO: 79453 - DNA, 996 bp, Glycine max
  Peptide Sequence Number=SeqID_196231
atggttaggtctctaagaaggaagcaacaacgaaagttaagaggacttacaacaaaaagtaattctatcccccacaggtttcttcccttctatttcaccacctaccttcttcttatgaacacccagttcaatccctattttgcaagtactaagaactgcttgctaggtttgtgcggtgccatggaaactcttcatccaccatctcccccctcacacccgaaactggaaacaaatatccatgtagaaatcacagattttagcggaggagcgtgcgttgatgaaggtgatgactccctgcgagattctccatggcccaagccacaatcctccatcacgattatacccaccacgacgatcaccgaaaccatagagagccttgacctgccttttgcgagcatcaacaacatccatagtggtaaccatctttatcctagcatgtgctcggtgaagaaagttattatggactctgcgtgttttttcttagaagatgccactgattctcttgatgccgggtttcgtgatgccctgcatgttgtcgcgcaacactatcatgtgtcccttgactcctccctttcccaaacccttgcctcacttccacaaccaccatatccaccactgtcacccttagcaccatatccaccgccaccgtggttgtatccattgaagccacaacctccaccaccaccacgactgacgcaagtctgcgcttcattgacaatggtgttcggttgtcaaggtcttagccgtgtagttcgtcgttcacaactctcactccctcttgttgctttttcttctttttaccatgcagcaacaacatcatctcttcaatttggtgagttccattcgtggcctgcacccattggaacagaagttagagttgctagtgcttccaagagccacagccaagcaaagaaaaggcacagggacaggatcaatgctttgcgacgcaggtcaccacccaatcctctcgcctttcacgacgttgataacccttga

SEQ ID NO: 79454 - DNA, 192 bp, Glycine max
  Peptide Sequence Number=SeqID_196232
atgccaacttatttttcagcttgtagatggctgagaacgttggttatggttacgcaacctgaggtttttacaattcgtcaaagcttcaggatacaggatttccttgaccttttgaccacgctcttgatcactgcgttagcgacaatagcagagcacgtgttaaaggttgctacaaatttctatatgacataa

SEQ ID NO: 79455 - DNA, 426 bp, Glycine max
  Peptide Sequence Number=SeqID_196233
atgagcaagttcgttggtgtgttcctgctgcttttgatcactgtgaccgttgctgaatacgaccacagttatcctgaacatgaaaacgagaaaaatggtccatgcggcaagtttagcacacttagaattttgacgcataaactgcgtcactgcgaaaaggctgcacgaaatgcatgggctcctgtttcttcacagtgctgcaatgaccttgtagaaagtcgcaatcaccattccccatcgttgccatttctccaacaagccatagaccacaacttacctacctatcataaatgccaacatatttttcagcttgtagatggctgggaacgttggttatggttacgcaacctgaggtttttacaattcgtcaaagcttcaggatacagtagtatgttcgcgatatgggttcttggcctagctgcataa

SEQ ID NO: 79456 - DNA, 150 bp, Glycine max
  Peptide Sequence Number=SeqID_196234
atgccaacttatttttcagcttgtagatggctgagaacgttggttatggttacgcaacctgaggtttttacaattcgtcaaagcttcaggatacaggagtgtgtgttgtgtattatgttagcgatatgggttcttggcctagctgcataa

SEQ ID NO: 79457 - DNA, 186 bp, Glycine max
  Peptide Sequence Number=SeqID_196235
atggctgaatttcctgatatagcaaaggacacaacgaaacataagaggatttcttcaaagtctttagaagaagctcgcaaagcctttggaactgatgaggatcttcttttgatatctttggagaaaagcagtaaccatcatcaaccttttatgcaactatccaatgatgtcaataccgattcttga

SEQ ID NO: 79458 - DNA, 109 bp, Glycine max
  Peptide Sequence Number=SeqID_196236
tacaaacaaagtccctggggattcgacactcggacttccgagagctttactacttgtgacgatttggtacacttgccaacgagttaacaagtttttcgcgtcgttgtag

SEQ ID NO: 79459 - DNA, 507 bp, Glycine max
  Peptide Sequence Number=SeqID_196237
atgatacgcggagataccttacggttatctgcacccttttgtcatccagaggcggcgggcccgatgacaagcagagaccaaatttggtcattctgcacccttgtatcatccagaggcggcgggcccgatgatacgcggagataccttgcggttatccgcacccttttgtcatccagaggcggcgggtccgatgacaagcagagaccaaaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggaaatacccgagtgacagaatgcttgatagcatgcagaggctgacacagtcttctgcaccttttgttcctccggggacaacaagtcaattacatgcggaaatttcgtggtcacccgcgactctcgtcaaccgagaggagcgaaattag

SEQ ID NO: 79460 - DNA, 372 bp, Glycine max
  Peptide Sequence Number=SeqID_196238
atgaggaagcttgtgtttcaagatagcatgacatcacaattgcaattctcaccaacaaaatcatcagcacaacaaagcatacaaatatatcaacaaaatgtatcttcatcagctcgtacctcgatcaagtcgtacctcagtatctgcaagattacgtctaccaagtccaacaaagagactgatgacaattacaatgcaaaactttctgcttttggcttggcaaaggatggaccagttggtgataagagccatgtctctacaagggtaatgggcacatatggctatcctgctcctgatcatatggccacagaatttgggcctagaggttctatgcttcaaggctcttttttggtaacatctgtcactggttga

SEQ ID NO: 79461 - DNA, 213 bp, Glycine max
  Peptide Sequence Number=SeqID_196239
atggaatgcacgattatactactcgaaaatatgtttggagatataagcaattctgttgctagtcctacttctgttgatcccacagcagattcaaattccaactctagttctcctatcaatgttgattctagtcctactattgagcctgcagctcctatctttgaagttggatctacttctgtgcaagctaattctcctcaaccattagattag

SEQ ID NO: 79462 - DNA, 231 bp, Glycine max
  Peptide Sequence Number=SeqID_196240
atggaggccttaacagtgaaactgtcagaaaaggacccgagagaaatttctgaggcggttcccattggtgatgtagcaggtggtagatactacaatggactggatcacttttcatggaaaaacatgactttaaattatggactcaagtcacatggttccaacatcagactaaggtcagtcccaaagggaaccaatagctgggttcaaattctgttaacattccagtcgtga

SEQ ID NO: 79463 - DNA, 567 bp, Glycine max
  Peptide Sequence Number=SeqID_196241
atggctaaacgatgggaagacttcaagaaaataatgaaggacgaccaggagaacttgctcaagcagtttgatctgtttgagaacagtgccatccatgttgcaactcgctctaacagcccacgactcctcagagaattgatagagatgttaccaaaagaagaaaggtggcaagctttgtgcaaggaaaatcgcgaagggaacacggttttacacgaggttgtgttttgtaagaagaagaaaatggctgatgttgtgtttgagattgaagatgagttgttattgcaacaacaatcatcatcactagaggaaaagagaacattgctagatatgagaaaccaccgaggtgaaacccctttgttcatggctgcaatgcatggaaagctgaagatgctcaagcatatggccaaccgtacaggcacacgaaatatggaagattttcgaaaacatttgcatcgatctgacaaatattctgctcttcatgccagtgtcatggggcaacattttgcttatcaaaggaaagagatccagattattttaagatttggtcgtaaaataaataaaatttga

SEQ ID NO: 79464 - DNA, 180 bp, Glycine max
  Peptide Sequence Number=SeqID_196242
atgaaggatcatattaggatcagtagatgttgtctttgtacggataatcacttgggtatatctgcttgccacctaacacatgggtcaggatcaacagatgctgtgagaccaaaaaagtctcggccggaagatgctgacatctccggaaagggtgcagacgatcatattggtctccgctag

SEQ ID NO: 79465 - DNA, 240 bp, Glycine max
  Peptide Sequence Number=SeqID_196243
atggcgatttcttttcccattgacgatcatttcaatggtgacttaatgttgttttggactcacataattcttggatttaatttccaagtatattggcttcaatttggacgttattttgctcgaggaccagtgaatgagatggcttgtattattgtctttgattacgtgactttaaacccgaaaattgctttacaggaaagagatgactatgccttggagttggccatggctgacgagtaa

SEQ ID NO: 79466 - DNA, 153 bp, Glycine max
  Peptide Sequence Number=SeqID_196244
atgggatggtcatctcggtttgatgtttgcgtttgtggtagctgtgaaggtggcgtaaaggggggtgaaggatggttttgttgttcaaaggaggcggtagttgtagttgtggacatgagggttgtggagacgatggttgtggttgaggaataa

SEQ ID NO: 79467 - DNA, 171 bp, Glycine max
  Peptide Sequence Number=SeqID_196245
atgcccacgagcagtgtccgcggcggaggctttgagattcagaaactcgggtttggagacgacggttcaggggactcttttaggtgggtctcatggcctttaaggacgaaagaatggggagaggagattggaggagggttggtgactcagggtggctttttgtgccggtaa

SEQ ID NO: 79468 - DNA, 468 bp, Glycine max
  Peptide Sequence Number=SeqID_196246
atggggatggaagaagaagaatggggatggagaaggagggaagaaatggctttagagagagggtttcccctatatgagatgctcaagctttggccacgcgacctcgcgctaagcgcgacatatgtgcttagcgagtatgacggtgatcacgcgcttagcatgagcttcgcgctaaatgtgccttcaattatcaaacacaagcccccacgacgtgacatccttattgtttggcactgccacgttcatgattgtggtcatcatggtcacattgtggagcctcattgcaacgacaaaggagccgatgccactgtcgacgtcgaggtcgagtacatgtggaagagaaactttgaagcaagctcctggaacatgttttggtccaagcccgaacccggtggtggtgatgactttgttggtgatggtgaagaagaagacgagtggtggaataaaggaattggaggaaccacatga

SEQ ID NO: 79469 - DNA, 513 bp, Glycine max
  Peptide Sequence Number=SeqID_196247
atggctaccgcgtctggcatgcctgagcaggagacacaggtgttttctggcaacaatgaccaatatcctaggttggatgtctacgtgtgggacatggatgagactcttgtattgctaaactccttgctgaaatcatcctatgctgaggcttttaacggtctgaaggatgtgcagaagggggtggaaatcgggaggacgtgggaaaatctcattctacaaatatgtgatgattatttcttctatgaacaaattgaaaattacaataagccatttcttgatgctctggcccaatatgatgatgggagggacctatctgattatgacttcaaccaagatgaattaggttccccacatgaggatgatgccaacaatagaaaacttgcatataggcatcgagtcattgcccaaaaatacttacagtacattcctttgtattttcaatttttcatggtggaatggttcagttatgaagccatggcattgttttggtttatggaccttgtctacaaataa

SEQ ID NO: 79470 - DNA, 342 bp, Glycine max
  Peptide Sequence Number=SeqID_196248
atggggtacaggcccctaacgaaggacaaagaatgtgacagccctgtgaccgtggtggtcggaaaagagaatagggtgttcctggtggaccctttcatattacaagagaacccttttcgggttttgatggacacgtccatgaggaagcagctggaggaggatcaagaggacaacaacaaggatcatcatcataataatctccatcaacctagtaaggtggtctttgtcgatgtggatgccattttgttcgagcacatgttgtggctcatgcacaatgattgttcttctttgttcgagcttaatttgaaggagattattgacttctacgctcaggatatatga

SEQ ID NO: 79471 - DNA, 177 bp, Glycine max
  Peptide Sequence Number=SeqID_196249
atggccttttctcagcaagggcctcggacagtttgtattctttctgctattggtgcaatcggtaatgttacccttcgacagcctgcaatgtctggtggtattgctacctacgagctttgtttatgctgtattggaaatgatctgggactaatctcagtgatgattatatatgagtaa

SEQ ID NO: 79472 - DNA, 546 bp, Glycine max
  Peptide Sequence Number=SeqID_196250
atgccggttgccgcttccgccatttactttctcaacctccgcggcgacgttctcatcaaccgcctctatcgcgacgatgtcgggggaaatatggtggatgcttttaggacgcatgttatgcaaacgaaggagcttggtacttgccctgtgaggcagattggtggatgctctttcttttacatgaggatcagcaatgtctacattgtcattgttgttagcaacaatgccaatgtcgcttgcgctttcaagtttgttgttgaggctgttgcattgttccgatcatactttggtggagtttttgacgaggatgcaattcgcaataattttgtactcatttatgagctcctagatggtgtgttgcattgtgaagaaattatggactttggttacccacaaaatctttcaccagagatcttaaagctttatatcactcaggaaggagtgcgttccccattttcatccaagccaacattattgttgctacttgctagtggctaccatgaagaaagggtacagataggagaaaacatggagatgatgacatga

SEQ ID NO: 79473 - DNA, 444 bp, Glycine max
  Peptide Sequence Number=SeqID_196251
atgcagaattattatgtaccattattagaacaccggatgctatactcaaactgcttcaatcaaccatcactcctactcatgatgcaattatgtattacaacgggaagtggaacataccacgtcaagggatgtggcatggaaaaactcaaggatttaatcaagcaagttgcacctataggggttccccctaatggaattcacggatcacaattgattagacgattgttctttcgacaaccaggtcattctaagtattccaaaaatttgattgaatatgagataacagaattgaaaaaggatgaaaacgtgctaaaggtattagcacaatccaactattggaaacgattctgcacaatagaaattttggttatttttagcaaaccagtcatccaaatagaagaagaagacatgtattctgcaccacatattttagatcctcattag

SEQ ID NO: 79474 - DNA, 414 bp, Glycine max
  Peptide Sequence Number=SeqID_196252
atggcggcgcagctaatccgtgatcgagtagagatggaatgcctagagggagcttgggagaccctcgaaggcaacacgaggtgccgatttcggggcaccattcgattcacggctacttctttgctgcatccagatgaacctgcacggacgcttcagcgcactgtggagtggatactacccacgcctacaccatatcgtctagtggagcccgttcaagtgatcgagagggtgatgaggatccacttcttgaggtggattctcccgaggaagtcatgtcggcatctgaggcagactctacggaggatagcggcccgagggagatggcgatcagcggaggctcttcatcctagtggacagctttttggatttgttttgtatattttgagggtgggtgtatctaggactaactgttag

SEQ ID NO: 79475 - DNA, 255 bp, Glycine max
  Peptide Sequence Number=SeqID_196253
atggagggtagttgttgggcactttcagcaccggctgcaatacagggtatccaccaaattacgacaagtaaattaatgtttctctctaagcaaaaactggtggatagtgttaaaggtgagagcgaaggatgcattggtggttatgtggaagatgcctttgaatttattgtgaagaaagggggaatcctaagtgaaacacactatccttacaaaggagttaacattgtaaggttgagaaggaaactcatagtgtag

SEQ ID NO: 79476 - DNA, 317 bp, Glycine max
  Peptide Sequence Number=SeqID_196254
gtggcctggccaggagaccagccctcttcttctggaggggtggggcctccgcagcccaggagcctgtgtctgaggagccaccagcaccagcactagcaccagcagaggatgaggatgagctcactcctcctgaaccctcttattttgatgcaggtacacacatggttcaagaggaggagactactccagatcagactccacaaccatctccagtccctgcaccagtagcgaagcctaagcagcttatacaagattcattagtagctccagcagtggatttgaatgaagaccagccacaggaggagcaggacgtttaa

SEQ ID NO: 79477 - DNA, 229 bp, Glycine max
  Peptide Sequence Number=SeqID_196255
acctcttcagctactacaccttgatctatttggtcccacaagaactacatccactactggaaagaggggacccatcactagactcatggctaggagactccaagaagattggtccagagatgcaggaaaaggccctagggttttgatgagccttaaggaacatttagaaggacttggaggacctatggcaagggctacaacaaagaaggccaaggaagctcttcaacaa

SEQ ID NO: 79478 - DNA, 414 bp, Glycine max
  Peptide Sequence Number=SeqID_196256
atgggggtggttggaatactgagaaaatgcttagaggcaaaggcaagaatcttggcaggtagaggcgaatgggccccgttcatagacattctcgcactgttgagcttcggagggagttcctctttccaaatgtgggatgggttggtggacctagcagcgatcgacgcttttcttgcttatcatgaccacaaggaaaactcggttgtcactatgctagccgacctatatgacaccttcgaccgaagatgtgagaagagcagtacgaggattgtttgttgtactcccgctctttatagaaaggaggcacaaattgggaccaactcttatcaaacaaagaagaagcgtctgtcaactggttccctcaatggaaagaaggaagaaccggagttcttgtctcgtgcagaggatttctga

SEQ ID NO: 79479 - DNA, 771 bp, Glycine max
  Peptide Sequence Number=SeqID_196257
atgagtcaatctctagctttctcaaaagggtggacctttggagggctccacgccctcgccttcagagggctacacacccttaccttcagagggccactcgccctcacctttagaggactacacgtcctcgtcatcagaggactacaggtcctcgcctttagagggctacacgtcctcaccttcagaaggttgcacgccctcgccgtcatagggctacacgcccacaccttcagaggactacacgtcctccccttcagagagctacacgtcctcgccttcaaaggactacacgtcctcacctttagagaattacacgtcctcgccttcagaggactacacgtcctcgccttcagagggctacacgtcctccgctttagaggactacatgtcctcgccttcagaggactacatgccctcaccttcagaggactacacgttctcgcctttagaggactgcacatcctcgccttcagaggactgcacgtccccgccttcagaggactacacgtcctcaccttcagaggactacacgtcctccccttcagaggactgcacgtccccgccttcaaaggactgcacgtcttcccctttagaggactgcacgtcctcgccttcagaggactacacgtcctcgcctttagaggactacacgtccttgccttcagaggactacacgtcctcgccttcagagggctacacgccctcgcctttagaggactacacgtcctcgccttcgtagggctacacgccctcaccttcagaggactacgc

SEQ ID NO: 79480 - DNA, 132 bp, Glycine max
  Peptide Sequence Number=SeqID_196258
atgaggtggcagttagcagcaggaacaggaccagcaactagggttgttcacagagcagccgtctttccgtctcaagcggagaagacatcaaaagaatctttatctatggctctaccagggaatcctagttag

SEQ ID NO: 79481 - DNA, 234 bp, Glycine max
  Peptide Sequence Number=SeqID_196259
atggcggcacctactccgcccccgaggaaatccacggacttctcggctattgcaactcatggagacccaactctcctagctaccgcgcaccatcctcccccaaacgcagtaggacgagagaagagtacacaggggcacaacagcaacccccatttaggatacaatcgggtggcttacccttatggattactgcctaattacatgccgccagtcatgcacgatgacgcgggccat

SEQ ID NO: 79482 - DNA, 567 bp, Glycine max
  Peptide Sequence Number=SeqID_196260
atggcaacctcaaaggtcttaggggctgctttcattgttttgctcattgtggaccttgcgtttgctgctagggttacagataggttacttggtgggaggggtggcggtggtggtggcggcggtggtggcggaggaggtggcggtggtggtagtcttggacgtggttccgggtatggatcagggtatggctcaggtgggggtgaagggtatggtggaggatcactaggaggaagcggcggtggtggtggtggcggaagaggaggaggtggcggtggcggtggtgggaccggcggttctgggtacgggtccggatatggatcggggtatggatccggatacgggtctggtggcggtgcgaacggtggaggtggaggcggtggtggtggcaaaggtggaggaggtggaggaggtggaggttctaatggttcagtggtggccggtggaggaggaggaggtggtggtggtggcggtggcggtggtagtggaggctctggctatggtaagtggctcaggatatggggtccgggttggggtggtggagaaaataacgagtcccccttaaactaa

SEQ ID NO: 79483 - DNA, 447 bp, Glycine max
  Peptide Sequence Number=SeqID_196261
atgatatttattgaaataaagcagcaatatgcaaccttggatgtctctatcaaaacaacagtagagagtgtttacttctcaggttatcagggtgttccatacacatatgtgcttccgtctgttgcaccaccggcatacaatgcagtgaattacagaccaaatggtgctgctggaggaaagctccagaacagcaagctgtatattttatttttggaaattgaaatccctaaaattgctctcctccccccaaaacagagcaatagaaaagtggagagccaaggactgatcctccgtttgcaatcatgtgcagtagttcagtttgcagtaaagccttgggatcttatcagtataactacaaaggctccaatgctctgtttcatggccaaaaatgcctcagaaaacagagcaacagagaagaatggagatattcacaaatttgtgttttga

SEQ ID NO: 79484 - DNA, 276 bp, Glycine max
  Peptide Sequence Number=SeqID_196262
atgaaatatgaagttgggaaggagttgttgaggcgcggtggtgtttggacagttggtggtacggtgagggggttgtgcgaggcagaggtggttgacgtgattgttgtgatgtgtggcagtttggatctggacagaggtggtgtggctcacgacattgatgaggaggagccaataacaaatggaattagggacaataacaactccccatgtccttacttcttagcatttgaggctgattgtccaacatattgcaatttgcatagcagccttaaatag

SEQ ID NO: 79485 - DNA, 147 bp, Glycine max
  Peptide Sequence Number=SeqID_196263
atggccggtcacgattggtcgtgtattgtttgtctcctgcttacaggcattaggcctatgttgtattctgaagcaatggggcatgccacattgccctcattctcttgcaatttatgtccaaacgtgcgcccaccaagtgctcggtga

SEQ ID NO: 79486 - DNA, 342 bp, Glycine max
  Peptide Sequence Number=SeqID_196264
ggtgagaagatcaaagagaaagtaaataatgtagatgagaatgaagttgttaggttgataaaagagcaggaggacaaaaatttggaaatttcagctttgaaggtagaactggaaacaaccaaaagaacatatgaagtacaattctcacagatggaagaagaagctaacagttttaaagcagcattgacacgaaaggtccgagaatatgagcaccaattggaagaattaagaaatgagttggaagaagacgctaaagatgctaaagtagaattgacacagaaggcccaagaatatgagaatcaattggaagcattagggaataagtttgctgcacaaggttaa

SEQ ID NO: 79487 - DNA, 253 bp, Glycine max
  Peptide Sequence Number=SeqID_196265
gctagaggactttgtcaaggctatctacatatttgatattgggcaaaatgatattgttgctgttattaacagagtgggccaggaagattctcatgcagtcatctcagacattgtggattattttgaaaaccaactccaagtaaaaactccacaccagtttttgggtctgccacagggagcatggtttcaagatggtgggttcgagattgctgtgttagatttgggtctacaaactagcaaaaactccacacct

SEQ ID NO: 79488 - DNA, 336 bp, Glycine max
  Peptide Sequence Number=SeqID_196266
atggggttgaaccaagcacatgtttttaaggaaaggttcatcaagtcaaggtcaagtatggaagtaaccagcttgcaaaagttagggaaagaatgcgctttacggtgcccttaccaaacgtgtgccagagctaaagtaatgagtgaaatagaagaggtgcaagaacaaatgaaggccgacatggaggccatgaaagaccaaatggctgccatgttgagcatgaagaaaataatggaaagcaatgcggctgcagttgccactactagtgccccgattgaggaagacccaactcacccatcgggccttaataaagtaaatcctccagtctcggatatg

SEQ ID NO: 79489 - DNA, 228 bp, Glycine max
  Peptide Sequence Number=SeqID_196267
atgacactgcaaatacttgcaggaaaaataaactccctcatcagaaaaacgtgcagaactatagaaaggagttgtcatgcttgtagaagtgggaaatgcccatacgcgccttttcatctcctaatccctccttcattcgctaatcactgtcgtgttgacggaagctccgccgatgccatctccactcctgtgttgaccccaactccagccgtcgtgccatctctgtag

SEQ ID NO: 79490 - DNA, 372 bp, Glycine max
  Peptide Sequence Number=SeqID_196268
atgggatgggatcgatttttgattgtggcatctgaggaagggttagtggaggcaaaaatatttaaggtgcaacgagagggatctgatacattacttgatgaggagtttgaacacatagagccctcttgtgatctcatgttgggtgggggagtaggagaaatatgctgtcatggaactttgtatgccttgagggatctcatgtcaagtgcaggagtaggaagtctatttatgagaaagaaaaatgtctcacaatgttctctgacaaatgccccagagtgtgatgccaaggaaggtgttggagggttatggaaaggagtgcattgggagtgggctgaggcatggtgtagagttcattcttatggtgacctttga

SEQ ID NO: 79491 - DNA, 708 bp, Glycine max
  Peptide Sequence Number=SeqID_196269
atgtcgagtgcagaggtggagtttcaagctatggttcatagaatttgcgaggacactcaatctttcaacaaagctccttttgatgtgaacaagcttcctatagaaactcaaaatcttctagctgtgtgcaagagggaaagcatggctgagtatccatcacccgaaaaggatgataataattgtaagcacatggatgactacccttcacctcaaacagataatccaaagcctttctctcaaatatacaaacgaaggcggcataacttgaactccaacaactctcatgtttctggagattcaatccgaaccagccaggatccgtgctcctctacaataactactgctgcaactgcactcccaaccactaatgctgctgctggcacagccaccaacactgcaccgaaaaaacattttctttccgcactggtggagttttcgctgctagagtcccttgaatcaaaggacagccttgcttcaattaagacaccggattttgacgtggaaaatcttgagtcatccatgcctccaagctgcgcaaagttcatcaaggaaatgaagagtgagatgcagaagctttcagttgaaaaggagacgatgaggtttgagatgatgagcacacaagcaatgattaacattctccagtctcgcgtcgacgttctcagcaaagaaaatgaggatttgaagaggatggtggcccaaaatccttag

SEQ ID NO: 79492 - DNA, 219 bp, Glycine max
  Peptide Sequence Number=SeqID_196270
atgccactaatccttggaaactctggttctggaagcacaagtcaggtcaggaaatggaacatgaatagcacaaggtgggaagatacgaaaaatgaggttacattaagcaaaaagggcaatagaaatgaagagaaagaaggaattctgaagcaggcccagcccaacagtggcgctaagtgtgcgtcaggcgctaagcgagcaaccaaatgcaggcgctaa

SEQ ID NO: 79493 - DNA, 123 bp, Glycine max
  Peptide Sequence Number=SeqID_196271
atggcagaagctcaatctatctcttctcttatggcttcaagttgcaagttgcaaaaagaaggatccgaaagttgtgcaggatgggtggtattttgggaagatttctgggaagcgtgtgagtag

SEQ ID NO: 79494 - DNA, 273 bp, Glycine max
  Peptide Sequence Number=SeqID_196272
atgaaggagtttgaagaggaaggtggtgtaaacccaatcatcattgggtacggtggtcatcatgcacttatcgtcaatctccaagcaaagtttgacaatgtcttctccttctcgattgtcatttcctctatcgtcggaagagagtatcagagtcaattttctacaacgataatagaatcctctttgacaacaaccttaatctttgctcttttcacttcttcaggtggagaaggcggacgcgattacttgtggccgttggatttgatcttgtga

SEQ ID NO: 79495 - DNA, 378 bp, Glycine max
  Peptide Sequence Number=SeqID_196273
atgagtgttaaaagcttcccacaacaaattctgggaagaagggttactgagattcctggcctggagagcagcagtcctaagggtcttaagagtccaaagattggcctcaacaaatgtcaaactcctataaggcaaattgtgcttcttgcaaaggtcaatcaccaaaggtgttggatggagcaaacagcaaaactggccaaaacaaacatgaccctttctccccaatttggcagggatgagatcaatagagggaaccaaatccaaaacactaggatccccattatgttgaaggctctatctggcacttttctcctagagaacaacagcaacaaagtctggaggtacaaattgacccttgcaaagcacaaaactgggtag

SEQ ID NO: 79496 - DNA, 1074 bp, Glycine max
  Peptide Sequence Number=SeqID_196274
atggcgagtgtccttgctttgcaatgctatgtgaaactggagaaccctaaggactcttgcaagatggttgttcaagcttgcacgaaaattggtcgcgtctccttaaatagcatgtccaagaagctattcgagtttgactctaatgtctttccccgcttcaaggaccgtttcttcaaggtactggctattgatgccatggttgatggtttgccacttatgttcaacagggacagggagccctacttcccattctactggcaatctgaccttaccaaattcaagtcattagatgaggatctattgacccttgtggaaaagattgacaaagttattttggaactgcttccatcctttctagaagtgcgggccatttttatctctttcctcggaattatgggtaacttgtcttggaggccccttgtgaaacaggttggacctgtaagtggaatcttgccaccatctgttgtcgcccctactgctagagaagaaaggcaaactactagtaaggttgaccctgtttctgttgttgctaaggtcaccccaaatgcccttacctctatcttggaaaagaggaaacaagatgatagtgctaggccatttggccacaaaaagtcaaggtcccctatgagccttagtgtgctgaggcaagttgcagggttgacgcctggtttgggttgccttttaagtttgcaagatctgcctctggctccatcgggcgtcgaggcttctggtcctactattgttgttgctgctactcttgctcctccacctcttcttgtcgtacttgttcaagaggttactcctattgctggagttgatgcactggttacttcgaccgattctattgcagcttctacatccaccattgccacacccttgttgagtgcctatgtggtgaccactagtgcttccatgatgttgcctctttcttcttcgactcccccgattccttcctttgttgtgttggcgacgatgttgccttcctcgtcttctcgtccccatgtctctttggaccacttgtacacttccaatgatgctaattcactgtggggttcgaattacaagccggaataa

SEQ ID NO: 79497 - DNA, 426 bp, Glycine max
  Peptide Sequence Number=SeqID_196275
atgatggttaatggtagaccttgcataccttgcattcttgtggagatggaacttagcaaaggaagggctcaccaaggtgatacgtacaagagacatggtgctcttgaatacatggcacttatgaagtggcacatactgaacactcggtgtcgtgctattgcatacatggcacgtatgaagtggcccgtactggagacatggtgctcttgcatacatggcacttatgaagtggcattacagaagacgtggtgttgtgctcttgcatacatgacacttatgaagtggcacatactggaggcttggtgtcctgctcttgcatacatggcacttataaagtggcacatactggaggcttggtgtcatactcttgcatacatttcactcgctgtgggtggcacatactggagacatgatgacgtgctctag

SEQ ID NO: 79498 - DNA, 400 bp, Glycine max
  Peptide Sequence Number=SeqID_196276
atggtgatcacgtgggagttgctatgtgcacccagcattattgctggggcacccagtgaagtggcgaaactgcccttcagtaattcttctttcggaagaatacccacaaactacttccggaagaacgtcatccagaatgtttccggaagaaccttcttccggaagtttccggaaaaagcttcttccggaatttccattggtggtcccgtgaagtatttgaagatttggtggtcccgtgttccgtatttgaagttttgcatagcaggaggaaggtccgaaatgaccacttccggaagaccttcttccggaagtaacttaggcctattccggaagaagtgcttccggaaaacagatcttccggaagttactaagactcattccggaagaagtgcttccggaa

SEQ ID NO: 79499 - DNA, 1467 bp, Glycine max
  Peptide Sequence Number=SeqID_196277
atggaaaggcttagtcttactcagggaaattctctgatagatgtgacattgaggcatggggcttttaattcacatggtgtcacagtagagactagaggctacatggacctaatgatcacctccggtcatggccaactctctaggagcttcttaataacatatttacttgttgatgcaaatacatcatattttgctttgattagcaggaagacacttaacgagcttggagccatagtctccacgttgcatctaaaaatgaaattccccactctgactggggagattgtgaccatcaaggtggcaccctatcctcccactagggatcctgccaagcctcaccccacagcggctgaaggtactcaagttatgagcgtggatgaacccatcaaagagcttgtcaagttacagcttagacccaaacccaagcggtgtatgcagctcagtaaggacctcaccagccatgagcataggcacatcgctgatgtcctacacaggaaaaagccgggaatccaccctatcattatttgccacaagctccccatttgtccacaagccaaaccagtatcacagaagaaaatgaagataagagaagaacgacgcaaagctgtcagagaagaagtggacaaactcctcaatgtcaacttcatcagagaagtcaaatatttcacctggctcgctaatgtcattgtaaaaaaggagaaaaaaaatggcgaattgctatgcttcctggacgcttactctgaatacaaccagatcaggacgcacactccaaagaaagagaaaatgaaattaatcactgaagatgtcaacttttgctacaaggtctatgttgatgatatggtcgtcaagtctcagagtatagcccaacacatagcatacctagaagaggtctttggagagttctacaaatacaacatgtgtctcaacccagaaaaatgtactttcagggtcggtggaggcaagttcttcggctttatgatcacgcatcggggaatagaagccaaccccaacaaatgcattgctattttggagatgcatagtccgattaacgtccaggaagttcaaaaattgaatgaaagactagcatccttgtccaagtttctccctaagctcgctgaaaaagtgaagtcattctacaaattgctcaagaaaactgggcctttcttgtgggatgaaacctacaagcaagccttcttagcctttaagaagactatcgctacaccgtcggaagagaagcaccaacttcctatctacttcaccaatcgcatactccacgacactgagaagccctaccaaatgatagaaaaggttttgctaaagcctgaactggtaggtaggatggtggcggggtttgtaaaactttcagagtttgatatccagtatgaacctcgtggtcttatgaagacacagttcatggccgagttcttggcaaaattcgttgggaacaaccaaaccaccctagactag

SEQ ID NO: 79500 - DNA, 327 bp, Glycine max
  Peptide Sequence Number=SeqID_196278
atggacaagtgttgtctaatgttgagagcgataatcttgacaagtgtggacatgctttcggttttgcaggcgaggtataacatgtcaggtattctcatcctaatcatgtattcatttttgtctgactttgccatcggcattggtggcattgattctgggggttcgattcaacaactcctaatggactgggaggtcatttccattggtggttcctcctcagaggatactcgttgtggtgcctccgataatgaatcctcttcctcggagaggttgagagcttcacgtcgtactagtggaggcacttcttgtctctacgggagggcatga

SEQ ID NO: 79501 - DNA, 558 bp, Glycine max
  Peptide Sequence Number=SeqID_196279
atgggtcctccttcatgcggctcacgccatcagtttaaattgatgatatgtgctatcggtgttcaggaacaagaacaagtggacaagaaagccattgatgggcttaacgtgtacaacatactagagccatgctaccatttcctcgatgctgccatagccaaagaaaatggaaccttaccaaagagtttcaagcaattaggggttactgagaggcctctcctagtgagaaagagaatgtttggtagagcttggccttttagagcaccagtcaaacctggttttgttacattatggccccaattggctcaaatgaggcatgtcacatgtgttgatacattctttgtggtacaagtagagggtacatctacttgggttgttataaataagaacaagagagggtacatctcttgtggatcagttcaagtggagggtacatccacttggttgttcaaagagaacaagggagggtacatcccttgtggatttgtgcttgtaaaggattttacaaggttgaaaagaaatctcaaggaccgcaggtcgcttggggactggatgtag

SEQ ID NO: 79502 - DNA, 1245 bp, Glycine max
  Peptide Sequence Number=SeqID_196280
atggtaacacttagaaaacttacaatattcattgaacttcttgcagttcgatacattgacattgaaacatgccagtttggggttattaagacttctggtgatgttccagtagctcgtgtgggacagtctgccacaatggttggttccagagtgatattgtttggtggagaagatatgagcaggaagctgttgaatgatgtccatgttctcgatcttgaaagtatgacttgggaaatgataaagactacgcagacacctccatctcctagatatgatcattcagctgctattcaaggagagcggtaccttctaatatttggtggttgctctcattctatcttcttcaatgatcttcacttgttagacatgcaaacaatggagtggtcccaaccacaaactcaaggtgatttagtatctcccagggctggacacgctggtatcactattgatgaaagctggtttatagttggtggtggagataatagaagtggttgccctgaaaccctggtgttagacatgcctaagcttgtttggtcagtattgactgttgtgaaacaaaaagattcgctttctagtgagggtcttagtgtctgttcagcaaaaattgatggagaaaagtatttgttagcatttggaggttataatgggaggtatagcaatgaggtttttgttatgagacccaaggcaaaggataccatgcgtcccaagatttttcaatcaccagctgccgccgctgctgcagcttctgttacttcagcttatgcattatctaagtccgagaagttggatttcattcaactagatgatataaattccaagttatctgcaaatggtcatcctaaagatgatgtcacggataaagttgaagccattaaagaagaaaaacggttattggaattgtcaattgctgaagtcagggctgaaaattctaagcttggaggcgagatagaagaaataaataatactcatgctgagttgaccaaggaactccagtcagtccaggcacaacttgtggctgagagatcaagatgctttaacttggaggctgagtatattaatagtaatgttcctttccaggccaaaattgcagaactccagaagttgctggaatcaatgcagtctgtggaagatgaagtacaggctcttcgtgaaaagaaatctgctctggaccaggagatggagctcgctgcaacagctgagaggaaaagttctggttggcgatggtttggtgggagtgaaacatga

SEQ ID NO: 79503 - DNA, 135 bp, Glycine max
  Peptide Sequence Number=SeqID_196281
atgggaaaaggagtggaacctgtggctagagagagatgtaagatatcgaaacaccgtcgtcagttacggaggaggagatcggacggtggcggatcgaaagccaccgtcgagatctcaatggatacgtcgtcgtcc

SEQ ID NO: 79504 - DNA, 993 bp, Glycine max
  Peptide Sequence Number=SeqID_196282
atggctttccctttcccaatccttttccttctcttcctttccctcaccccctccttctcctccgcaacgctcaacgtcgattactacaaaaaatcatgtccactcttcgaaaaaatcgttatggaaaacgtcttccacaaacaaagcacaagcgtggccacagcaccgggtctcctacgtctcttcttccatgattgcatcaccgatggctgcgacgcttcgatcctcatcacttccaactcatacaaccctcatgcagaacgtgatgcagacctcaatctttctctggcaggtgatgcctttgacatcatatttagaataaaaaacgcattggaacttgcatgccccggtgtggtgtcgtgttccgacatcgtggcacaggcaacaagagaccttgttaagatggttggtggtccttattaccctgtgagattggggagaaaggatagcactgaatcagttgctgcaagagtgagtgcaagccttccaacaccagacatgaccatggaccagttgcttgagaagttcacctcaaagggtttcactgttaaggaaatggtggctttgagtggggcacacaccattggtttcgcacactgcaaggagttcataaacaggatctacaacttcagcaaaacctctgatgctgaccctttgatgcaccctaagctggttaaagggttgagggttgtgtgccaaaacttcaccaaggacatctcaatggctgcattcaatgatgttaggtcaccagggaagtttgacaatgtttattaccaaaatgtcatgaagggcttggggttattgacctctgactccattcttgctgttgacccaaggacaaaacctattgtggagctctatgctaatgatcagcaagctttcttcaaggactttgctgctgccatggagaagctctctgtgtttagagtgaaaactggcaacaaaggagaggtcaggaacaggtgtgaccagttcaaccatattcccgtctaa

SEQ ID NO: 79505 - DNA, 354 bp, Glycine max
  Peptide Sequence Number=SeqID_196283
atgtgcttgctgggctcgcagaggatgagaagtgcgccgtttgactttgacaaaggcatccttgaggttatcgaagatggagaagagcgagcggaggccattggtggtggtctcccagctaaggccacggatgaagagcttgcgctgggagacgtcgtggtccgcgacggtacgcacaacagcaaggacgttgaggtggcacaccaccgcatcctaaaggatgtcgaggagctggttgggagtgaagcccttgatgagcttgtaggcttcgaagggggagagcttgagaacgagaaagcttcaataaaaggaaaattaaaacacaacattaaaattcaacatcgatttttgtaa

SEQ ID NO: 79506 - DNA, 336 bp, Glycine max
  Peptide Sequence Number=SeqID_196284
atgacggtgacacagctcgccgccgttgagaactccacgtcaaatgcgaaccatgctcgtgttttcactgcaccaaaatgctctcccattgcttactatgcagtgatggcagcagctaatgctatcttctatctttttgagattggtgaaagtagagggggtgcttatgttacaatggaatctattaactcagctagaaaagcaattgtggcattggatgcgtccgatgttggtggccgccaagtgcaggttagattttttgttgagatgaatcccaagagaaggaatcttgaaacaatgaactcgtcacccaggagtgttggccccaagacttga

SEQ ID NO: 79507 - DNA, 888 bp, Glycine max
  Peptide Sequence Number=SeqID_196285
atggcattgaaatcagcaatctcagtctcattcttctgcttagtattgtcagcactagcaaatggtttcaatgctggcaaaattgcaatctattggggccagaatggcaacgagggcacactgtccgaggcttgtgccacggggaactatgattatgtgatcatagcctttttgccaacctttggcaatggccaaactcccatgattaatcttgctggtcactgtgatccatacagtaaaggatgcaccggcttaagctcagacatcgagtcctgccaagccaaaggcatcaaggtgttgctctctttaggaggaggtgctggaagctactcaattgcatccactcaagatgcaagccaagtagccatttacctttggaacaacttcttggggggaaagtcatcatctcgccctcttggccccgccattcttgatggcattgactttgacattgaaggtggatcaaaccaacattggggtgatcttgccaagttccttaaaggctatgggaagcaagtgtacataactgcggcacctcaatgtccatttcctgatgcttggataggaaatgccctcacaacaggtctttttgactttgtttgggtccaattctacaacaaccctccttgccaatacacttctggggcaattagcaaccttgaagatgcatggaagcagtggatatcaggtatccctgccaacaagatattcttggggttaccagcttcaccacaggcagcaggaagtggtttcattccttctgctgatcttatctccaatgtgcttccagccattaagggttcttctaaatatggaggtgttatgctgtggtcaaggtattatgatgttcagagtggatatagctcctccatcaggagccatgtctaa

SEQ ID NO: 79508 - DNA, 174 bp, Glycine max
  Peptide Sequence Number=SeqID_196286
cgtggtgccgatggcctaatatattgtggtggtgagcatggtgttgttgatgatctggtggagcttcttcatgctgaaatagtcgaggagaatacgatgctctatgaggaggtagtccatgatggcattgtcaatgttgcacacagtgatggtggttttgttgttgatctttga

SEQ ID NO: 79509 - DNA, 2199 bp, Glycine max
  Peptide Sequence Number=SeqID_196287
atgagtaaccagaagaagaggaacttccagatagaggcgttcaagcaccgcgtgttgatggatcccaaatatgccgacaagacatgggagattctcaaacatgcgattcacgagatttacaaccacaacgctagcggtctcagtttcgaagagctttacagaaatgcatacaacatggtgcttcacaaatttggtgagaagctctactcagggctggttgcaaccatgactggacatctcaaagatatagctcaatctgttgaagctgctcaaggaggttcttttctggaagagctgaacaggaaatggaatgatcataataaggcgttacaaatgatcagagacatactgatgtacatggataggacctacattccaagcacccagaagactcctgttcatgaacttgggctgaacctgtggaaagaaaatgtcatctattccagccagatcaggactcgactattgaatacacttctggaattagtacatagtgaacgcactggggaagttattgatagaggcattatgagaaatataacaaaaatgcttatggatttaggcccttctgtttatggacaagaatttgagactcattttcttcaagtttcagctgagttttaccgggtagaatcccagaaattcatcgagtgttgtgattgtggtgattatctgaaaaaagctgagaggcgtctgaatgaggaaatggaaagagtgagccattacttggattccaggacagaaaagaagattactaatgtggtggagaaggagatgattgaaaatcatatgctaagattaattcatatggagaattctggcttagtgcacatgctttgtgatgataaatatgaagatttgagtagaatgtataacttgttccgtcgtgttactgatggtctttcaaaaatacgagaagtgatgacttcacatatgcgagagtctggtaaacaacttgttactgatcctgaaagattgaaagatcctgtcgaatatgtgcagaggctcttagatgagaaagataaatatgacaagatcataaacttggcattcgtcaatgacaagtctttccagaatgcattgaattcctcatttgaatatttcatcaacttgaaccctcgttctccagagttcatttcactatttgtagatgataaactccggaaaggtctaaaaggggttagtgaggatgatgtagaagttacccttgacaaggtgatgatgctattccgatacctgcaagaaaaagatgtttttgagaagtactacaaacagcatttggcaaaacggcttttgtctggaaaaactgtttctgatgatgctgagagaagtctcatagtcaagctcaagacagaatgtggttaccaatttacatctaaattagagggaatgtttacagacatgaaaacctctcaggacacaatgcagggcttttatggctgccaccctgaactaagtgacggtcccacgcttactgtccaagttcttacaacagggtcttggccaactcagtctagtgttacgtgcaacctgccagcagaaatgtctgcactgtgcgagaagtttcggtcattttaccttggcacccatactggcaggagattgtcctggcaaactaatatgggcacagcggacttaaaagcaacctttgggaaggggcagaagcatgagttgaatgtctctacttaccaaatgtgtgttctcatgctgtttaataatgctgatagacttggctacaaggagattgagcaagcaactgagattcctgcttctgatcttaaaagatgcctgcaatcattggctttagttaagggaagaaatgtccttagaaaggaacctatgggtaaagatattggtgatgatgatgcattctatgttaatgacaagttcagcagcaagctgtacaaggttaaaataggaactgtcgttgcacaaaaggaatctgaacctgagaagcaggaaacccgacagagagtcgaggaagacaggaagccccagattgaagcagcaatagtgaggatcttgaaatccaggaagcaacttgatcataacaatcttatagccgaggtcacgaagcagttgcaatcgcgtttcctggcaaatcccacggaggtaaagaaacggatagagtctctcattgagcgggactttttggagagggatgatagtgatagaagattgtaccgatatcttgcttag

SEQ ID NO: 79510 - DNA, 5181 bp, Glycine max
  Peptide Sequence Number=SeqID_196288
ctggagctccgcggaagccctaggttgcttgcggcgctgctatttggctgccgcgtgttcgatctgcgggcggtgggaccttgcgaaacggcgtcgtgtgtggctgcccatgctattgggttggttttgatgccgcctgaaccattgccttgggatcgaaaggacttcttcaaggagaggaagcacgagaggtccgagtcgcttggttctgtcgccagatggagggattcctcgcaccaccgcgacttcaaccgctggggatccgccgagtttcgcagaccgccagaaaagagttttccagtggttaatgatttggtggattctcctttgcgtgttcgatatgtttttgagggtcatggtaagcagggtggctggcacctgttttccgaggaacctggtcatgggtatgcgatttctcggtccagcagtgacaagatgcttgaagatgatagtcggccgtcgatctcgcgcggtgatggaaagtatggcaggagcagtagggaaaatagaggaggaccctttggtcagagagattggcgagggcattcgtgggaacccaacaatggttctatgaattttcccaggaggctgcaggatgtgaacaatgaccagaggtcagtagatgatgccctagcatattcctctcatccacattctgattttgggaacgcttgggatcagcaccacttgaaagaccagcacgataagatgggtggtgtcaatatgttcggaacaggaccaagaagtgatagagataactctctgggtgactggaagcctcttaaatggacccgctctggaagcttgtcatctcgaggctcaggttttagccactcaagtagctcaaggagcatgggaggagcagattcccatgaagtgaaggctgagttgctacccaaaagtgtggctgctaatgagtcgcattcaggggaagctgctgcttgtgcaacatcttctgtgccatccgaggatacaacttccagaaaaaagcctaggctgggttggggcgagggacttgcaaagtatgagaagaagaaagtcgaggtgcctgatgcaagtgcaaacaaggaaggtcctgtcttgtctactagcaacacggaaccttgtaatctcctcagtcccagcttagttgataaaagcccaaaacttttaggattctcagaatgtgcatctcctgcaactccatcttctgttgcctgcagttcctcacctggtatggatgataaattatttgggaagactgcaaatgtggacaattatgctagtaatttgactggttcgcctgctcctgtgtctgaaagtcattttgctaggttttcttttaacttagagaaatttgatattgactccttgaataatttgggttcttcaattattgagttggtacaatctgatgatccaacttctctggattctggtccaatgaggtccaattcaattaataagttactgatatggaaagctgacatttcaaaggtgttggagatgactgaatctgaaatagatttacttgaaaatgaactgaagtcactaaaatctgaatctggggaaacatgtccttgtccatgtccagtaaccttgggctcccagatggtaggtagtgatgaaaaatcctgtgaagaacatgttggggtctctgatcaggtcatccggccagtaccgttgaaaattgttgatgatcccaatacggagaagatgcctctttcaactaatttacatagtattcatgaaaatggcaaggaagaggacattgatagtcctggaacagctacttctaaatttgttgagcctttgcctttaattaaagcagtttcttgtgataccaggggacatgataacttctcccgggacttggatactgttctgtctacagctgtgaaatgcctagttccctgtactactaggaaagaagctagtgtgcctgcttgtgttgatggcaatatctctatggagctaaaggatagcatggatattttatataaaacaattatttcttccaataaagaatctgccaacagagctagtgaggtatttgataagttatggcctaaagattgttgcaagattgaaaagatggaagcaagcagtgacgcatgcactcataccttcatcatggaaaaatttgctgagagaaagcaatttgcaagatttaaggagagagttattgcacttaaattcagagccttgcatcacctgtggaaagaagatatgcgcttactggttctgaagtctgaacttgatggtaatgatttaaatatgttgagaggtttggtggtgaagctagcaggaaatcaactaagcttggtttcaacatcagagataatcaattttacaagcaaactgctttcagaatcccaagttaaagtgcagagaaacaccctgaaaatgccagcattaattttggatgaaaaagagaagatgatttccaagtttgtatccagtaatgggttggttgaagatccattggctatcgagaaagaaaggactatgatcaatccttggaccccagaagagagagaagttttcttggagaaatttgctgcctttggaaaagattttcggaaaattgcttctttttttgaccacaagacaactgctgactgtgttgaattctactacaaaaatcataagtctgattgttttgagaaaattaagaagcaagatggtgataagcttgggaagtcatattctgccaaaactgacttgattgcatcaggtaaaaaatggaaccgtgaattgaatgcttcttcgcttgatattttgagtgcagcctcattgatggcagatggcattgcaggtaataaaaaattgcgggcaggaagctcacttttgggtggatatggtaaagtgaagacgtataggggtgaggacttcatagagaaatcaagcagttttgacattcttggggatgaaagagagactgctgctgcagctgatgtattggctggtatatgtggttctctttcatctgaggctatgagttcctgcataacaagttcagtggatcctgtagaaggtaacagggataggaagttcctgaaagtaaaccctttatgcaaactgcccatgacacctgatgttactcaagatgttgatgatgagacttgttcagatgagagctgtggtgaaatggatccaacagattggaccgatgatgagaaaactgcttttcttcgggctgtatcatcttttgggaaggattttgccaagatagcacggtgtgttgggacaaggtcccaggaacagtgcaaagttttctttagcaagggccggaaatgccttggattagatctcatgcgcccaatacctgagaatgttggatccccagttaatgatgatgcaaatgggggtgagagtgacacagatgatgcatgtgttgttgagacaggctcggtggttgaaactgataagtctggcactaaaacagatgaggaccttcatttgtatggcacaaacacataccatgatgaatcccatcctgtggaagctaggaacctgtcagctgaattaaatgaatcaaaggaaattaattggacagaagtagatcttgaagatgcaaatgtcacttctggtgcttgtcaaatcaatattgattctaaacagggctgtgatggtagtgaagttttcttgtgtggttctaacaagtctggatctgttggtgaacgagcagatataattatgtcagatagcacagaagttgaaaatgataaagcaaataaattgggaggtgcagctacagaattgatttctgctccaaatacaagggaaccatgccagagtaattccattgctgaggatagaatggtggtttctgaggtatcttctggcggtcttggaaatgaattggagaggcatagagtgtcttctaccctatgtgttgatgatagagataataagcatgaagctgattcaggtgttatagttgatatgaaaagctctgtgcatgatttaagcactatgataaattcttcaatctcatctttgggcaattcttgttcaggattgagttttagttctgaaaataagcatgtgccccttggaaatcctcgtgtctctgcattgtctatggacaaccttcatgcacttttgcaaaatacagttgctgttgatgttcaatgtgagaaaactgctagccaagatcaaatgtcctctacttgtgatattcggggaggtagagatatgcactgtcagaattccattagcaatggtgaccatcagcatattactgggaatttatcagaccacgttgatgctgttagcattctccagggatatcccttgcaagttcctgtgaagaaagaaatggacagtgatatgaattgcaccagttcagcaactgaattgcctcttctgccccaaaagattgaacatgatgatgatcatatcaaagcattccagtcgtcagattcagataaaacattcagaaatggtgatgtgaaactgtttgggaagatactaaccaatccttcaaccacccagaaacctaatgtgggtgctaaagggagtgaagaaaatggtacccatcatcctaagttaagcagcaagtcttctaatccgaaaattactggccatcatagtgctgatggaaatttgaaaattttgaagtttgaccataatgattatgttggccttgaaaatgttcccatgaggagttatggttattgggatgggaacagaatacagactggtctctcgacattgcctgattctgccatcttgctagcaaagtatcccgcagccttcagtaattatctcacgtcttctgccaaattggagcaaccgtcattgcagacatattccaagaataatgaacggctcctgaatggtgcatccacttttacgactagagacatcaatggcagcaatgctttgatcgattatcagatgtttagaagggatggtccaaaagtgcaaccatttatggtagatgtcaagcactgccaagatgtattctctgagatgcagagaagaaatggtttcgaagcaatctcaagtttacagcagcagagcaggggaatgaatggtgttggaagaccggggattcttgtgggaggatcttgcagtggggtctcagatcctgtggctgcaatcaaaatgcattattccaattctgacaagtatggtggtcagactgggagtattgcaagagaggatgaatcatggggagggaaaggggattga

SEQ ID NO: 79511 - DNA, 216 bp, Glycine max
  Peptide Sequence Number=SeqID_196289
atgaatcttgatcgaaagaagaatcaaggtccaatgacgagccgtaagaaatttggaattccttggcctgaatgcaacgacgcagactgcttaaggctgattgaaattattttttataggttcttgcagttgattgaaattattgcaccacttccctccaccctccgcacagcagaagaggctaaggaaattactacaatgcagcagactgcttaa

SEQ ID NO: 79512 - DNA, 1015 bp, Glycine max
  Peptide Sequence Number=SeqID_196290
atggaatccaagttctcaacaataccacacagtatacaagaagaacgtaacctacaagaaaatattgtggtatctgatgatggaaagacgtctaaagaaaatattgtggtgtctgatgatggaaagacatctaaagaaaatattgtggtgtctgatgatggaaagatgtctaaagggaagcgccgaaagcattttccgtgtgaagttggacttctggaatcagtagatggccttgttgaacccaaaaattatacgaactttacatggttttctctagagtatgttgaccgtgaagatagaacatccaaaattgatttatttgaacctcgatttggaggacatcagactctagaggaaagagaaacttcattttatgcaaaaaaccagactcttcattgtggttttgtaaaagggccaccaggacatccaagcactggatttgatataaatgaaaaggataaggcatatatgtacagatgtaaggttgcagtttcttcttgcatttttggaagctctgatttcctacggaggcctacaagtagactgatgagtcaatattcaaaggacaatgtttgttttgttatgttcctggatgatcaaacgctatccaaactttcatcagaaggaagcagtcctgatgagaaagggtacattggcttgtggaaaatagttgttgtaaaaaacttgccatatgaagacatgcggagaactggcaaggtgccaaaatttttatcacaccgcctcttcccaaattctaggtattcaatttggcttgacagcaagatgcgactcaactctgaccctatgctgattattgaatattttttgtggcgaaggaaggcagagtatgccatttcaaatcactatgaccgccacaatgtttgggaggaggtactccaaaataagcgcttaaataaatacaaccatacagcaattgatgaacagtttaacttttaccagtctgatggcctccccaaggttgacccatcaaagccaaatgatcctcttccgagtt

SEQ ID NO: 79513 - DNA, 360 bp, Glycine max
  Peptide Sequence Number=SeqID_196291
atggccaacatgggccagggccaaaaagctcatagggccaaaaggcctacttataaaaaatcccacaaagccctgtgggctagggccatcccatgggccaaaaattttaatgatggagagttaaaaacacagctccagcacagatccagaatacataatctaaaagatagagctactaaaagacaagccataaaggatccacctgaaaaggggatcaatgctgatgctgcattcccggtagctaatgatggggctcctcctggagatagtctattggcagtagcagtaggcagcagatgcaggagagagacctgcaagaaaaattttgatgattcaaatcagaaacaccaatcatgttag

SEQ ID NO: 79514 - DNA, 1071 bp, Glycine max
  Peptide Sequence Number=SeqID_196292
atggaagctttcaccttgctcaaatactggagaggcggcggcggtgctctcggacacccaccttcctccgacactccctcttcagacaccgcaaccaccaccatcctcaccggcgtcgaaaacgaaaatgcaaccgaaagcgacgatgacaacgacaacaacgacgacgacggccccttcttcgacttagagttcaccgtgcccgacgaagacgcaaatgaaaatccaaacgccaaccacacccaagaagaagaagatattagcttagaagaatccgacggcgagagagagtttaagttcactctgtccccttcgagcaacgatcgtagtgatcccaacctttccctgcagtctccttcagaggatatcttcttcaagggaaagctggtgcacgtcgaccctaattccgaacctaactccaagcctcagttcaccgcctccctcttaaaatccgccaccaagttccgcgtcttcatgttgggcctcaagaagcccaagcccaacgatggttccgattccacacccgccgcgattccagaggcccacaaaggcaagaagcacttcaccgtcaaattcaaagtcgaagaggtccccatcgtctctctcttcagctccaaaggtaacaaaaaacaatcctccgaggaccaaccttccgaagaaaaacgtttctccaaggaagtaatgcaaaagtatttgaaaatggtcaagcctctctacattagagtctcccgccgctacggcgacaaactcagcttaaactccgccgcaccagaaggtgttagtgttggtggcggcgaaaccaacgtgatgaagactagtactcaaagtcagaaactacctgcagggcttagcgttgtgtgcaagcatttggggaaaagccgttcagcatcttcggcggcggtggcggcggctcctccggcggcgtttgtgtcttcgaaacgacgcgatgattcgctgttgcagcaacaggatgggattcaaggagccatcttacactgcaagagatccttcaatgcatccagacctgagtgcgagtcttctcagctgccgcgttctgtgagccatcaatga

SEQ ID NO: 79515 - DNA, 615 bp, Glycine max
  Peptide Sequence Number=SeqID_196293
atgacaacagaggaagtgatcaccatgttcccatcacgcaaagaagaaaaacaaagcagcagcaagtgtttggtgtatgctttggttgtccttgtagccatattgttcatttggcttgtttttgcatctatcgtgttgcgcgtggttgatccccagattcagttgaaatcagctagattgatgcacaacactaaaaatcatagtttttcatcaacttcttccttgaacgtgactatgattgctcgtgtgtccctcacgaatccaaacttgttcggtcgcttctattacgggaacagtagagtgagtgtgctatatggggcttctatagttggtgcttgggaattggaaggtgcgagattggagggtagagaaaccaaagaaatcgatttcatggttcacatgaggttcagcactaagctattggtaataatgagaaatctaaccaatgacactgcccactctgactctgcaggcatgcttaaactcagaagctacgcaaaattaagtggtacagtgcacgtgctgaacatggtaaataagaaaaagaccttaggaatggcttgtattatgaatctcaacctgacctcatattccacacaacatttccaatgctaa

SEQ ID NO: 79516 - DNA, 423 bp, Glycine max
  Peptide Sequence Number=SeqID_196294
atggcgacggagatggaagaactcgtctcctttctttcttccccatcgccacagatcagaaaagccgccgttgacatagttcgcggcttaaccggctccgtcgagggcttgcagtccctcgccaattactcaaacgccctcttacccgccttgtctcgcctcttaacgttacccaaggaggtttcggaggctgctgcggaggcgctggtgaacctgtcgcagaactcgagcctcgcggaggtgatggttcgaatgggactggtcaaaacggcgatggatgttctgtacaagcccgactgcggcattgctcgcttgcttgtcatgcttttggtcaacctcactcaactcgaagctggtgctgcttccttgcttcagaaacttgaagctctgagttttagtgagttgaaaagtagactcacttag

SEQ ID NO: 79517 - DNA, 534 bp, Glycine max
  Peptide Sequence Number=SeqID_196295
atggccaagtccatagagcaagaaggaagaagcggcaagtgtttcgtatattttctgggcgcctttgtcatcttatgcgcacttgtattggtttttgcctccatattgcgcctcaagaatccatatctcaaattaagatcagctactttcaaccaaatccgttacagcgcttcaccatcaccttccttcaacgccaccctcatcatctttcttgccctcaacaacccaactttcggtgccttcacttacgagaataacagcctcagtgtgctctatgcgggtctaaagatcgctcatagccaaatcaacggtggcagggtgagtttcagacaaaccaaagaaattcatgttactgtgaaattcatgtccgctattgacattacttcggggtcgttgaatctcaccactaatgtcttttttagtggcaaagttcatctgtttaagattattaacatcagaaagaccattgaaatgccttgctctatgaacctcaactttacctctcacgcaactcaggctattcaatgccaatag

SEQ ID NO: 79518 - DNA, 633 bp, Glycine max
  Peptide Sequence Number=SeqID_196296
atgttttctctttgggctgaagcacctgtattggagagttcagattcaaagataagtgaaagtgtttttttaacagatgatgcttttgaacatgttggttcaatacttgttaacatctcaaaacagcggaaagggagggagcttctacttgacccaaaacggggtctcttaaagcagataatcagacagtttgattccaacagttcattgagaaagaaaggggtctctggaactattcgcaactgttgttttgaagctgagaatcagctacaaaatttgcttttggtatcagagtttctctggcccgcattacttcttcctgtagctggcaacaagatctacagtgagcaagacagatcgaaaatgccacttgaacttgggactgcactctcgattgaacgtgaactagttaatgatccagaaattcgtattcaggcattggaagccatatacttgatcatattgcaggaggcaggtcgaagagccttttggtctgtaaatggacctagaatagtacaaatcggctacgaagatgaggaagatccaaaggtgatggaagcatatgaacaattgggatctttgttggttcacagcagcagtgcggaggaaccatccagtcagaccacaaagtag

SEQ ID NO: 79519 - DNA, 419 bp, Glycine max
  Peptide Sequence Number=SeqID_196297
atgacttctgctggacctgcattctctttttccggaactccgactatcacgactgtgaaactaaactggaagaactatttgtcctggtctgcttcggttgagctgtggtttcttggccaaggacaccatgatcacttggaaaaaggtattgatactgttccaagtgacagaaaatctgagtgggagaagctggattatcagctatgtgctgtcttgtggcaatcggtcgagacagatgttttggagatccttagatcattcaaaacatgttctttttggaagaaggcccgagaaatctttgccaatgatattcagagtttgtttgatgctactatgaaggtcacagccctcaaacaaaccagtcacgacatgattgcacacataggtaaagctcgggttgcagtggaagagttaaagag

SEQ ID NO: 79520 - DNA, 291 bp, Glycine max
  Peptide Sequence Number=SeqID_196298
atgactatcaccacggtgatgaatgtttttatcaccaatatcatgattgtcatcacaacaaccatcaccattgtaatcgccagcatgatcgttatcgctaccattaacataatttctatcgatggtaatggtcatggtggcgacagtgatagtaacgacaaccacgacagagatcatgttgttggtaacaacgatggtcatgatgataatcacgataataatagtagtgaaagtatcgtgataataatcatgatgatagtgacaattgattacagtggtgatcgtccataa

SEQ ID NO: 79521 - DNA, 1983 bp, Glycine max
  Peptide Sequence Number=SeqID_196299
atggtcgttgtgttgccgcagctatggcaattggagacgcttctgttacaaaaggacacgtatctcaactacagccaagcactaagctacaccagtcaagctttgagccagaacctacaaggactaagggcgagaagtccgatacgtaggatgagccgcagaatgctgtactacttgcaagaaaattggcggagactttgggttttagcattgtggatttccgctatgattggactgtttacctggaagttcatcgagtacaagagaaaaaatgcttatcatatcatgggtaactgtctactagcggccaaaggtgctgctgagactctgaagttcaacatggcacttatactcttgcccgtctgcagaaataccataacttggctcaggtccaccaagttggcttacgttgcacctttcgatgataatatcaactttcataagacaattgcggcggcagtaatgatcggtgttatacttcatgccgggaatcaccttgcttgtgattttcctagacttgtaagttcgtctgaaaaagattataagacgtatttggatggcgtatttggtgatcatagacccagttacggagacctcgttaaaggggttgaaggtgtgacaggaattctgatggtgattttgatggcaatagcatttactcttgcaacaaaatggttcaggagaaatctcattaagctgcctaaaccgtttaataggctcactggtttcaatgcgttctggtattctcaccatttgtttgtgattgtctatgtcctgctcattattcatggtgtaagtctttacctcgagcgcagatggcaccggcaaacgacatggatgtatcttgcagttccaattttactttatgcgggagaaagaacgctaagattcttccgttctggtttctatacagtccgtcttataaaggttgccatttatcctggaaatgttctgacattgcaaatatcgaagccctctcaatttcgttacaagagcggacaatacatgtttgtgcaatgtcctgctgtttctccatttgagtggcatccgttttcgattacctctgcccctgatgatgactacctgagtgttcacatacggcaactgggagattggacacaggagctcaaaagggtattctctgcggcctgtgaacctcccgtagctgggaagagcgggcttctcagggctgatgaaaccaccaagaagtgtttaccaaagctaaggatagatggaccttacggtgcgccagcacaagactacagaaactatgatgtcctgttacttgtcggtctcgggataggagcaacaccttttatcagcattctgaaagatcttctcaacaatattatcaaaatggaggagctggcggattcagtctctgattcaagtagaggttcagaccttagcactgggagtgcagattcaatatcttctaataagatttctcctaaacggaagaagacactgaagactacaaacgcttatttttactgggtaacaagagaacaaggttctttcgattggtttaaaggggtcatgaatgaagttgctgaacttgatcaaaggggtgttattgagatgcacaactacttaactagcgtatatgaggaaggcgatgccagatccgcccttattacaatggtacaagccctcaaccatgcaaaaaatggagttgatattgtttctgggactagggtgagaactcattttgccaggcctaactggaagaaggttttctcaagaatatgctctaagcactgcaatggacgaataggggttttctattgtggcgcaccggttttggccaaagaattaagcaagctctgcttcgagttcaacgaaaaagaatatgaggcattgtacatcccggccggccggcaagatggctgggcattgatcatacatgtggctgcagctcaaaggagatattgcccttacaaggctccagcaacttcagatacattctgccgaaccgcatag

SEQ ID NO: 79522 - DNA, 228 bp, Glycine max
  Peptide Sequence Number=SeqID_196300
atggctagtaaggatagaaaagattttcactgccataggaagccaagagaagggcataagggaaatagcttagcacttgcgaagttgagatttcatacctatctatcattttttgtaaattgggagcatcttcccatcattaatgatcaggaggatgggtttcttgtgataaacccaccatctgacaacgaggccaccaagaaagacccaaagaaggatccaagatag

SEQ ID NO: 79523 - DNA, 462 bp, Glycine max
  Peptide Sequence Number=SeqID_196301
atgtcgtcgaaaattctccatgaagttcaggcccatcaacccatgtcgttgatgcaagccatggctttttccaaacttcaagaagataaagtcaatgatcaacactgctcctcgtgtgctccatctcatgttgtttcagctccatctccatccaccctactttctttgtcgactcctcctaaagctccctttaaggatatttcaccaaaggaaatcgcttattgttgcgatcatggcttttgttactacaacgatgagaagtttcacatcgaccaccattgcaagggccgacttctcttactcttgtctgatgatgttgagggcatccccgatcttactcagatcccattgattgacattccttcatttgatcccattgcagcttgtaggccttggatcttcttcatcaatggagttctttgcttcttgaagatcaatggcagcggaatggataggatgtaa

SEQ ID NO: 79524 - DNA, 3148 bp, Glycine max
  Peptide Sequence Number=SeqID_196302
atgagagtgtttccaaggctcaaatcgctgtcaagagcggtgcacgaggaacaagagcgtgagcatgatgatgaggagaaaaagaaggcagcagaaaagttgtacacatccctaacagtttggagaaaatccttgctaatgagttgcaatggattcacggtgattgattcttatggaaatttggtgtatcgtgtcgacaattatattggtcgacccaacgaagtcactctcatggatgcctcaggaaaatctatcctcaccatgtgccgccgcaggaggcttggattgttagatagctggtttgtgtatgaaggggaagtggggaacaatattaataacatgcgtacgaggactaggaggaggagtagtaacttgtctaagtcatcaaagactccaatttgttgtgtaaggaagcatgtgaatattttacatggcaacaccaacgttcaggcctacgtgtaccgtggagcttcttcacattcagataaacggtgtgcggcgtttaccatagagggttcctacgcacatcgaacgtgtaaggtgttggatgagtgcggaagggtcgtggctgaaatcaagaggaaggaagctaacgccaaaagtgtctcttttgggatagagatttttcagttgattgtgcaccctggctttgatcctgcctttgccatggcactcgtttataacgaggcaaaattgaaaccctcacttgtgttggcgaagaaaacgacgacggacggaagtcttgttcgagtgagagtgcaaatgaacaacagttcgccggcgttgacacttccgtcggatacgtcgccgtcagtggtgaacatgttcagaatcaacaaagttgctgaccgtttggcttggattgctcaacctggcaaccgaggcgagcctcacgaattttacaacctctgcctctcgctctctcgaggcattgattatgcacttgccaatggcgaaactccacccaaggctcatgatctgccactactcgtgaaacagaatgcttgtgaaattggatggttccaaaccaaagaatctgaagaacttgttagtattgctgatgagatcggaaaggtctacagcagtttggggactataaatgtcagacctagatcttgcagtactgtaatatcaacaataatgcagaaattctatcctaaatttaaattgggtcctatacttgcatcgattgaagcccagcctggatatggagcttctgcggttgattttcatattaccaagagtgaagttcttaaagacaaaattgccccagagcatcagccaccattggcacctttgtctgtacctatgagccttcatatggtaggccaagaccatcccgcttcaatagcacctttgaaccctaatgatcttcctattcttcaccaaacttttctcctcaatggaaaaggagtactcaataggactaatgttcaaatggatcctggagcacaggtgccaactaatgtgactggtatgcttaaatttgggacaaatcttcttcaagctgtgggtcagttcaatggtcgttatgttgtacttgttgcctatatgagtgttacacctttgcttgaggatccagttcttcaagattatcttcagcctgctgttacatctgttgatttagattcagatattattgagggggcttcacggatttcacttaattgtccaataagctttacacgtatcaagactcctgttaaagggcattcatgcaaacatttccaggtgactattcctgcattagcatcacttaatgtgcagcaaattgtcgctgcaacttatgcctttctctctctgatcctgaaaaatgttggtgagaacattacggaagtgattgtctttgctaatggatcatggaaggcagtcttggaaaaggatcatgatgtggataagatgcagaagaaggcacccaattgtgaaaaagaacaaactcaaccacaagaatctacttgccctcctagtactgttgacctcactaaagatgatgatggtttggatacagtgggctcttgtgatattgtagaaagaaaacctcccccggcatctattcatagtcattttgtctccccaaatttaacttccttgggtatgaactctactggtgttaatcaaaatgttgccgctcaaacggatgacttttggactggagtttatattggccgtagtagttctgataccccaacagttggtaactccgagctacctgttctgcccgatactgtttctcctgcatttagtcaggaatctgcaggtcgtgacaataaccctgttgttaattctgccatgcataatcaattttcgggaccaagcaacttgcagatgcagatgaatcatatgaattcagttaacgagtatggtaggtcatcctcagcgccaagacatattcataggactccggtagctgttcaggccctcccagttcaatctcaggcattgggaccacaggaaaattcaataactaatttgaatagttccttgctacctagcaattcctctgctgctcctcatatttctttgtccaaccctgcctctgtagatactttgaatgccatactaagtgatacggaaagacaacaacatttttctcgaactccagtgaatccgcctcaggtctcaggtgtaaattcacctgcatttcagcatcacactgcaacccagcaagctttgaatcgctggccacccccatcaacatcatctaatacccagtggtcccacatccagcaaagtgttccacaatctgggaattttcaggtagcagccaggggtggtgcactggctgccagacaaggtagttcccatgctaggaatgttccgacagctggagctactactcataggggtatggttcctaaccaacctgccagatggacgcaatctgtttcggttcaaaatctaagtactgtagcaggcacacctttccaggggttaacaggagagcaaagaggaaatacagcacagtcagtttctaggcctgaagaattattcagtccgcaatcagaacagaattggactcccactggacgaatgcgtggaagtctagatttaagtcagctttacgatgagtctattgcacagcgaataattacgccaacacaaggtcaaaattcaaagccaccaggtccacaacccgtccgacggactg

SEQ ID NO: 79525 - DNA, 1185 bp, Glycine max
  Peptide Sequence Number=SeqID_196303
atggctacggtgccggagaagaaagcgaaggaagcattcttcgacgacgaattcgctctggccgttgatctctactctgaagccatacgattggatcccaacgacgcaaatctcttcgcggacagagcccaagcccatatcaaactcaacgctttcactgaagccgtttccgatgccaacaaagccatccaattaaacccttccttgtccaaggcctatcttcgtaaaggcaccgcttgtatcaaactcgaagaatatcacaccgccaaggtagcgcttcaaaacggtgctgcttttgcccaagatgattcacgattcgccaacttgattcaacaatgtgatcgcttcattgaagcagaggaatcaagtggccttactagcaccttatcatcaaatgggtccataacatctgtaccgtctggtaatggttcccatttcagcaatagaaatgatgggatgactaaagaagctgaaggagacagtttggtatcccaaaagaatgaagccacactaaaaagaccaaaatacaggcatgaatactaccagaagccagaagaagtggttgtgacactatttgcaaaaggaatatcagcaagcgatgtagttgttgacttcggtgaacagatgcttagtgttactattgacgttcctggccaagatgcctatcattaccaacctcgattgtttgggaaggttcttatcagttggtaccttttcccatgtctcttagctgcaaaagagtggcacaggtggtggcaacggcattattgtgttcccccaggactagtaacaaaggctagtgcacagccaacccgcatgggctcagtggctgtggagtgcggtgggatgttaagatccaattgcaaggtatgggacttgagtcccacaattcaatctgaaaggtctgcatatccatcatcaaaaccgaggacaagagattgggataagttggaagctcaagtgaaaaaagaggagaaagaagaaaagcttgatggtgatgctgctttgagtaaattgttccgtgatatttaccaaaatgcagatgaggacatgaggagagcaatgagcaagtctttcttggagtcaaatggaacagtgctatcaactgattggaaagaagtgggatcaaagaaggtggaaggcagtgctccagaaggtatggagttgaaaaaatgggagtattga

SEQ ID NO: 79526 - DNA, 540 bp, Glycine max
  Peptide Sequence Number=SeqID_196304
atggaggtccgttccaatcccgccgccgacaactcctccgaccaccttcgaccgcccgccgtttcgtccaagcagccgctgccttctcctaccgccgtcgacacctccgccgtttctcagagactccagaaggaattaatggctctcatgatgagtggaggagatctcggggtgtcggcttttcctgatggagagagtatttttacatggattggcacaattgaaggtggaaaagggactcagtatgagggtttatcttataaactctccttacgttttcccctagactatccttttaagcccccccaagtgaagtttgagacaatgtgctttcatccaaatgttgaccagtttggcaacatttgtctggacattcttcaggacaagtggtcttcagcttatgattgcagaactattcttctgtctattcaaagtttattggaagagcctaacctggagagtcctctaaacagctatgctgcagcactttggaatgataaggaaggtttggaaaattattttttaaactgccaacattga

SEQ ID NO: 79527 - DNA, 420 bp, Glycine max
  Peptide Sequence Number=SeqID_196305
atgaaagccatagccaatgtgatgtactatgaccattccaaaacctatgaagctgttgcagtcgtaaacagaagggcatgtgagaaaaatgaaaagatcagcttaatggacttcaaaagccacaagtcatgccatggtgaggttgaaggttttgatatatgcagtgcatgcagcaaagagaatgaaacatgccctgaaaagggtttgtactctgatcattcgggagcttttaggtgccttgtggaggaattgggagacattgcttttgtcaagggtgatactgtgttgctctattctatggaggggcctcatagccaactatggtcaaccaagtctgttagggacttcatgtatctttgtcctcaagggggttgcagagaaaatcaatggctatcctggagattgttcgtaagtttttaa

SEQ ID NO: 79528 - DNA, 2538 bp, Glycine max
  Peptide Sequence Number=SeqID_196306
atggcgacggtgctagcaccgccaccgtcgctcaccgtgcgcgcctcctcgtgccgccggcatagcaagaagaagcagcagcagaagcgagcattgggagacttcagcctcttcgcacaagtggttcgcaaggacgtggaattcctcaagagaggaatcgataacggtgttgcctgggccaaggagaccttccgcattcccgaggttgccaagaaaatcgacgacgttgtttggctccgcaatctcgaagaccctacctctcctcctcttccttctccttcctggccccaaccttgttacccagggctaactggagtggatttgctcatgtatgatctcaaggcttttgaagcttatgcttcttacttctactatttctctaagctttggaccaggccgctccctcaagattatgatcctcagcaagttgctcagtattttagtgttcggccccatctggtcacccttcgtgttcttgaggtacttttctcctttgccactgctatgatcagtattcgaacttcaggatttagcaagtttctacggctaattcctgaagaggatgtggatgatacatcatctcagtataattttggaatggtgttaaaggaaacattgcttaatcttggccctacctttataaaagttggtcagtccctttccacaaggccagatatcattggtgttgagatgtccaagatgaaacttctgacaaaatataccgtaactgcattgtcagaattgcatgatcaaatccctccttttcccaggactgttgctatgaagattatggaggaagaatttggttgtcctctggaatcattctttagttacatttctgaggaacctatagctgctgcatcctttggtcaggtttactttgcccgtactactgatggtaataatgttgctgttaaagttcagcgtcctaatttgcatcatgtggtggttcgggatatctacatccttcgccttgggttggggctgctgcaaaagattgccaagagaaagagtgaccctcgcctatatgctgatgaactagggaaaggttttgttggtgaattggattacactttagaggctgcaaatgcttcaaagtttctggaagttcactcttcctttacttttatgaatgtgccaaaagtatttccacatttaactcgaaagagagttctgaccatggagtggatggttggtgaaagtccaacagatttgctctctgtgactgctggaaactctgttggaaatgtctctgaatattcagaaaggcagaaattagatgcaaaaaggcgtcttcttgatctggtcagcaaaggcattgaatcaacattggtgcaacttcttgaaacaggcttattacatgctgatccacatcctggtaacttgcgttacacttcctcaggacaaatagggtttctggattttggtttgctctgtcaaatggaaaaaaggcatcagcttgctatgctggcttcaattattcatatagtaaatggtgactgggcatcccttgtccgtgctctggttgatatggatgttgtgaggccagggacaaatatcagacttgttaccctggaactggaacaagccttgggagaagtagaatttaaagaaggaattcctgatgtgaagtttagcagggttctgggaaagatttggactgtagcactcaagcatcatttccgcatgccaccatattatacacttgtcttgcgatccctagcttcattggaaggtttggctattgctgcagatacaaatttcaagacttttgaagctgcatatccttatgttgttcggaaacttctcacagagaactcagctgcaacaaggaatatattgcattcggtgcttctaaaccaaaggaaggagttccagtggcaaagactttccctgttcttgagggtaggggcaaccaggaaagccttgcgactagtggcatcaaatagtgagacttcccttgatcattcaacaagtaaggccactgatacaattgatattgcatatttggttttgaggcttttaccatccaaagatggtgttgctatcagaagacttctcatgactgcttgctcctccatgcctagcaatagatatctggatggagcttcattaatcaaagcaatggtctcgaaggagggggagtttttccgtgaacaactctgcaagatcatagttggcatactgtaccaatggatgattaaattatttggacaaggaattacaattactcagtattcccggatggtattggctaacggacctagcagcaaagaatcaggtctatcccctagatcatctttgcctacatatgattacaattccatctttagagatcggcgacttcgggtgatattctctaaggttctaaaatctgcaagtagggataaaatattgatgctgcggttctcctgggcttcccttaaaataattattacagcttcaactttggcttgccaccagcttgtcgtgtctctgtctgaagcttacttgagcaaaatatttgatgctccaaagagatacgcagtcagtgcatga

SEQ ID NO: 79529 - DNA, 144 bp, Glycine max
  Peptide Sequence Number=SeqID_196307
atggatttgactaactatactagtcaaatggatgtggcgtgtgtgagcgtggataagacaatggaatcaatcttgccgttagccgatacatcgcacaacaattggctggagaatcctatgtgggccgacaagaaagaaaaatag

SEQ ID NO: 79530 - DNA, 690 bp, Glycine max
  Peptide Sequence Number=SeqID_196308
atggaagatcttcggaatttgacgctaaaattcttctccgatcaagagctttgctatgctgatatcgtccctcttgctcaggtccgagccagaattgaagtctctgtcctcaattttctcaaaatattaaatgcctccagccctgccatctcagatttgcctttgattcagagaaaatatagcaatagtcgagtgaatcatggcctgttgactgaactatcacgtgtttttctctccaattccgtatcgacgaggtctctgatgagacctaacgcagcaaaggcttttgttagggtgtggaaggtgatggagatgtgctatcagatattgcttcaggaaaagcgtgtcactcagagggagctcttctacaagctgctgtgtgattcgccacacctgtttccttctcaaacacatgtcaacaggacaatccaaggttattaccaatgggaatatatcaatctgtgccaaacagatcttgtagcattgcttcggtgcagccgattcagtcttggaattatggcatctagtcgaggacttgtagctggccgtctgattttgcaggaaccgggcaaagaggctgttgattgctctttatgcggttcttctggatttgcaatatctggtgacttgaatttgttggatagtttggttctaaatgcagatgctcggtacgttataattgtggaaaag

SEQ ID NO: 79531 - DNA, 177 bp, Glycine max
  Peptide Sequence Number=SeqID_196309
atgacttcacatatccctctcactaaaaggggggaaaggggagcagatgaaattgattgtacggggtggtgttgggttcatggtaagacactaagacgcaacaatggtggagagtgcggagggataacagaggtggagagggcagaggtgcaatggagaagaaaaggggaggaataa

SEQ ID NO: 79532 - DNA, 303 bp, Glycine max
  Peptide Sequence Number=SeqID_196310
atgttggaaacaaacttgagaaatgctatgcattatctagcttgcaatgtcaagtggttaggactgcgggggcatgatctacccttgctgccgaaccaatctttcgttccattgaagccaaaggatctgcaaattgctcaaagcttgatgtcctcgggaatcttacaggataattacaaggaagaagtggccttgatggttcagagcggaaggagagctgaaatcgaggccctatactttaatggatatgattatttggggaagtacatagctaaaaaaattgtacagtccgattatgtataa

SEQ ID NO: 79533 - DNA, 1923 bp, Glycine max
  Peptide Sequence Number=SeqID_196311
atgtcttcatttttgtctgattctaccatcggaatgagtggcaggtactctgggggctcgattgagcagcccataatgaattgggaggtcatcttgataggagattcctcatatgaggatatccgtcaaggtgcctccaacaacgagtcctccttttcagagagggtgagggtctcgcgttgtgctagtggggacacttctcgcccttgcagaagggtgtggccttccacttctaccaggggtgtgaggagaggtagcgactatagagatattagggcatctccctgcgtgcgatgtagccagagtgttgggtcgctgtcatccatcccaattgttgttggctatgagtgggtgagaaaagacattctaaaatacaagtcatgtctcaccttggcggcttgtgggagtgatgatttcctacttttgagggtggcgtctggtcatccgcccttcttctttatgtacaggtgtctatttgaggtcctcggtctcattttacccttgaccgttattcagtgtgctgtgttggagcacttgaatgtggccctttcccaactccacccaaacagttgggcgatggtgctggcctttgaaattttgtgctctttcttcaacatcctgcctagtgtgctagtcttcttgtttttcttccgattgaaactcaatggcaaaattggatgggtctccttgaatagcatgtccaggaagctgtttgcgtttgattcaaacatctttcaccgttttaaggatcatttctttaaggtcctagctcttgatgggggtcaacctgctggtgaggttgacccttttgctgttgttgctaaggtcacccctagtgctcgttcctctgttctggcaaagaggaataggggtgatggtgttgggccgtttggccgcaagaagtcgaaggcctctatgagccttcgtgccctaaggcaagctatagggttgatgcctagtgctggtcgcctttcgactgtgcaagatgtgcctctgaatccaccgcccatcaaggcttctattgttgctgtgactacttctgctccttcacctcctcctactattgttgttcaggaggttacccctactattgctgaagttactatgtcagccactcagtctgactctgctagggcaccgtcatccactagtgctcctacggtgctgcctatttcctcatcggctcagttgtacacctctagtgatgctgactcactgtggggtgcaacttataagccggagcagaagaccttgattggctttgtgtcaactttcgacaagagccttattaggtcagcaagggtgatgaatgctactgactctgccaaagtctttctccaaaggagtttggccattttggaggagaatggactatggtaccatgaggctatgcaaaatgtggtgtccttggaggcagaggtcgccaaatggagggctattactgatactctttggcgagtggagcaccctaaagtgggcaatgccagcattgcttttgttgaggttgtaaggtcgaatcaccaattgtctttcaaagttggtggtgtattggccaagtttttgcgcacctggttggatggtgatgaattgtttaaacactacaaggacttacagagtgtggcggctgagagggacgagcttgccaaggtagttgttgatttagaggctcggcttaaggagtcgaagtccaggcttgaggagtccgagctacgagctgccaaggagagggaggccaacaaggagcttgaggatgagtcgtcaagcaagccgttttttgcgaaggaccttgacttgggtctcttcgatcccttcaaggatgtgaaggatggtgtcctgcttgatgaggaagacattgttgcgaaggaggaggctggtaatgaaagacagggttctgcgaagcaaggcaatgatgcctatgtctag

SEQ ID NO: 79534 - DNA, 1356 bp, Glycine max
  Peptide Sequence Number=SeqID_196312
atggttaaaggtctcgtcacccatctagtggggattccttctattctatggagcttcttccatgatggttgtaaggagttatgtttgacttgcccctggttaaaggtcttgccaaccagtcagggggtcatcttgacatgcgaaagtactcctctgatggttataaggattaagtgtgggctacacctgattgaagttctcgtggagataggtcttagtaacagaaagggctcaccaagggcgaaccttgggtttgtcgagccttggatcgaggacgtgattaccaagtacaaagcttgtgtgcagtgcaagcattgtgctcttgcttacatggatgctggttgggctgagcatctccagtatggcagtgcatttgtcgaggcacatgtcgtatttgcagagttccccgaagacttcttccaggtctgccacatgttggggtattctttgagattggacgaccatgtcgtccatatatacctcgacatttcatctgatctgttgtttgaagactcggtccatcagtcgttgttatatccggagtatgcatccaggaagcttagcactggaacccggacgttccatcaactagcctatcgatgctgggcaaaggggacatatagcaagtttgtggcagattatgccggggtggattctcggcatcacgtcgatgatgtgccggtgctcgggactagtgaggtccctactaaatcgtgtgcactgctcaggtttagatccgagttgcagctggacaagctgttcaatgggtttcgggtctatgtcaaagatggtcaaggctcagatctgggaccttcatccatgatcacaactttagtggtttcagccactgttacaatctcctttgctagtgtagagaatgtcattgtcaaatggggcgtggagactgtggctccaactcctggagagattgccctaagcgaaggtggtcatcaagtccatgtagtctctggtctcgactttcttgcctgtaaagccgaggaatggaccggtgtgagggatatcaacgaaactgccctagtcattgaggaccctggacaccatgaaatttgcaatgatgatggagacaaccatagggtcatcttgaatgacggggttgatgcccttgaagtccatgttgtcgctcacgccgttgttgttggtgtctttgtttgcctccatcttccgctcttctctcggctgcttcctggttcctattttgcttctcttgatgacctccgggtcatgctcctgcttggtgattgtctgtattttgttgcatctgaccccgacttgggaggtttcatctggggtagccggatgggtacctctagtttgaaagcttcctccaaaattgtg

SEQ ID NO: 79535 - DNA, 561 bp, Glycine max
  Peptide Sequence Number=SeqID_196313
atgaagaggactacttacgaagaagtaagcagccagtgtcctcccagcaggaaacttcatattatattcggtccagcgggattctcacctttgaaaatcaacgctaatttgcgggaacacgctataaatacctcccatggagtcgtagttcattcacagatacacgttctaatgagtgtgaacgaaccccaattactgtctaagattgccactggcgatggacatggtgagaactccccatactttgatgggtggaaggcttatgaagatgatccctttcatcccataaaaaatcctaatggggtaatccagatgggtcttgcagaaaatcagcttgcttctgacttggttcaaaattggttaacgaacaagcctagggcatccatttgcactcctgaaggagtgcgtgatttcaaggccatagctaattttcaggactaccatggtctgccgaaattcagaaaagctgtggctaaattcatggcaagaacgagaggaaatagagtcacattcgaccctgaccgtattgttatgagcggtggagcaactggagcacatgag

SEQ ID NO: 79536 - DNA, 993 bp, Glycine max
  Peptide Sequence Number=SeqID_196314
atgaccaagtcccgattcgacagggatttgaggtggagaacgggcgttgaacttgttcctgttaaatgtgaaagctcaaatgatttcaagttaacaaggaaagcgttgcaagaggcgtacgagaaaggcaaagagaacaacataagaataaagggcttgctaattaccaacccatcaaacccgttgggaaccatcatggaccgagaaactctaagaacagtggtgagtttcatcaatgaaaaacatatccacctagtaagcgacgaaatatacgctggtacagttttttgccacccaggtttcacgagcatcgcggaggtaatagaggaagacacagacatcgaatgtgaccgcgaccttatccacattgtttatagtctttcaaaggacatggggttccctgggttcagagttggcatcatatactcttacaacgacgcagtggtgaattgcgctcgcaaaatgtctagctttggattagtgtccacacagacccaataccttttagcatcaatgctttctgatgatgagtttgtggaacggttccttgaagagagtgcaaaaaggcttgcgaaaaggtatggggttttctgtaggggacttgcacaagttggcataaagtgcttggcgagcaacgctggtctgtttctgtggatggacttgcgtcgtcttttgaagaagccaacttttgaggccgaaatggaactgtggaaagtgatcattgagcaagtgaagatcaacatctcccctggctcttcctttcattgttctgagccagggtggttcagggtgtgctatgctaacatggatgatagaaccgtggaagtttctctggcgagaatgcgcaccttcgtgaatcagaacaccgaagccaagaaatcttgcagccagagaaacttgaggctgagcttctcgttcagaaagatggatgagtacttggtgtcacctcactccccttttcctcaatcacctcttgttaaagcctccacttga

SEQ ID NO: 79537 - DNA, 209 bp, Glycine max
  Peptide Sequence Number=SeqID_196315
ggtacatcctttgtggtacaagtagagagtacatctacttgggtttgactgagacaagagaggtaagcgatggtggctcgtggtggccactggttgtcgtggatggtggaggaagagggatctcacttaacaaattcgtctcgctaagtgaaaattcacttttggcgttgagcgcgacttctcatgctaagcacgacttctcacactaa

SEQ ID NO: 79538 - DNA, 273 bp, Glycine max
  Peptide Sequence Number=SeqID_196316
atggctaagagactccaggaagattgggccagggatgcaggagaaagccctaggcctctccaatcacctttcctcctttttcattccactgccattgatctcttcaagaagcaaaatactccattgatgaaaaagatccaaggcctacaagctctacttggagctacatcatatgtttacttgcctccaagttttcataattcttatggacttgggaacatgctttcaatagattacatctttcctcatttaggcaatcatgaagtttattga

SEQ ID NO: 79539 - DNA, 588 bp, Glycine max
  Peptide Sequence Number=SeqID_196317
atggtggaatcagcttatgcaaatcctaatttgatttgttttgtgcagatcattcccgagaagaaccgtaaagagatctgcaaatacctcttccaagagggagtttgctttgcgaagaaggacttcaatctggcaaagcacccagagattgatgtgccgaatctgcaggtgataaagctgatgcagagcttcaaatccagagagtatgtgagggagacatttgcgtggatgcactattactggttcctcaccaacgatggaattgagttcctcaggacatacctcaaccttccttccgaaattgtccctgccactctcaagaagcaggccaagcccgcgggaagaccattcggtggcccacccggtgatcgccccaggggcccacctcgctttgacggagagaggagattcggtggtgaccgtgatggataccgtggaggtccacgcggacctggtggtgatttcggtgacaagggtggagctcctgctgactacaggccttcttttgggggtggtcctggtggaaggcctggttttggtcgtggttccggtggttatggtgcaccaactagttcaaacattccttaa

SEQ ID NO: 79540 - DNA, 567 bp, Glycine max
  Peptide Sequence Number=SeqID_196318
atggaggatatagataggactctattcgagaagatcgtcaatgtaatcaagattgagaaattcatagggaagaatagcttcaacctttggcgcattaagatgcaagccttgtttaaagaaaagggcatatgggatcctgtctctggaaaggacttcattacacttgaagaagtcaagtccaatttctattctatagagtttcggctaaaggcatctgagaatggtgatgaagccttcacgtataggttatcagtgactgattttgctatagagcagaaaaagaagaaaggaaaaggtcgcaagaagaccaaagcagatcctaagggtatatgcaattatggcaaagaatcgggtcaaaggaagcgagactctccaaagaaagcaaagaaagattttcttgctcttattcaaaatgactcagcactggaaaacgatttggttttggttgttggtgaacaactacaacaacattccaaacaatgcaaaaagatagtgggtttgaaggtgaaagaaatgatgaagggtgtcattgctgatcctgagtggagggtggcagtgggtgtgtaa

SEQ ID NO: 79541 - DNA, 216 bp, Glycine max
  Peptide Sequence Number=SeqID_196319
atgtgttggttgaatttggtgcaaatgcaggcaatagacaagatcgcgaggccactaggaagcgagtcaagattatacatgtattattacgactttaataagtgtttgcgcgacgagcccagtgcatctccttgcttagcgacctcacacttggtgcaaaggagatccaaaggcgccctcagcgcaaaagtccgcgctaagcgcaagttcgcgtga

SEQ ID NO: 79542 - DNA, 1137 bp, Glycine max
  Peptide Sequence Number=SeqID_196320
tacgtgcaatacaacgtgtacggaaacttgttcgaggtctcctccaactatgtccctcccattcgccctatcggtagaggcgcatacggcatcgtttgtgctgctgttaattgcgatacgcacgaggaagttgccataaagaagattggtaacgcctttaacaacatcattgacgctaaacggaccttgagggaaatcaagctccttcgccacatggaccttgaaaatataattgctattagggatatcatacgacctcccagaaaggatgcctttgatgatgtttacattgtttatgagttgatggacactgatcttcatcagattattcgttctgaccaacctcttaatgataccactgtcagggctctgttacgggggctgaaatatgtgcattctgctaatatcttgcaccgtgatcttaagcccagcaatttgcttctcaatgcaaactgtgaccttaaaattgcggactttggtctggcaaggacaacatctgaaacggatttcatgacggtgtatgttgtcgcacgatggtaccgagccccagaattgcttcttaattgttcagagtacacctctgcgattgatgtttggtctgttggttgcatatttggtgaaattatgaccagagaacccttgtttcctgggaaagattatgttcatcaactaaggcttataacagagttattaggttcacctgttgatgccagccttggatttctccaaagtgaaaatgcaaaaagatatgttcgccagcttccacaatataggaagcaaaatttctcagctagattcccaaatatgtcttctgaggcattggatctactagaaaagatgcttatctttgatcccatcaaacgcattacagttgatgaagcactatgtcatccatatctttcatcacttcatgacataaatgatgaaccagttggtcctgggcaattcaaatttgattttgagcagccgacatgcactgcagagcacatcaaggagctcatctggagggaagcgtctaggataatgccaatggacaaactatcatttgggaaagaaaatgcgtcatcttctctagtccctggaatggcaacatattgcgccacgcaggaatcgcataatttgaagtgccagcaatag

SEQ ID NO: 79543 - DNA, 426 bp, Glycine max
  Peptide Sequence Number=SeqID_196321
atgggtggctgtaaacttgttgttgcacttgaatatggacccgttgatgaaaaaggtgacaagataaaagacgctacaaagctccatagacagagttcggttggcggggatcttctaggcccctggaatccttcgcaagttaagccacccaaaactcaacttcaaggacgccatggtagctatagaatacatgcgtggaccttttgcacttgcattgctgcctgcaaaatgcagagtggggagacttgtaaatgtttattggcgactttaacacctaagaaacaagagaagaatgaagctgacgaaacagggctagctactaaagagatgattgacccaatagtcgtatatagcaggcttccacctcttataggaccgttgctttgctctctcgttgttagaaacatggtggaaccgtggctctga

SEQ ID NO: 79544 - DNA, 525 bp, Glycine max
  Peptide Sequence Number=SeqID_196322
attctacccgccgctcgatgggaattgcgcttcaaggcgtctcgtagggctaatccgcctcacgagggtcaccaacggcacgtgcctttggggggccgaggcccccctactgctgtcataatccaacgcacggtagcttcgcgccactggcttttcaaccaagcgcgatgcccaattgtgcgaatcaacggttcctctcgtactaggttgaattactattgcgacactgtcatcagaagagccgacatcgaaggatcaaaaagcaacgtcgctatgaacgcttggctgccacaagccagttatccctgtggtaacttttctgacacctctagcttcaatcgctctagcactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaat

SEQ ID NO: 79545 - DNA, 357 bp, Glycine max
  Peptide Sequence Number=SeqID_196323
atggcctcctatgtgacgcctcctctctctcttccttctccattcggctgtcattcatcttccaagaagcaaaggaatccattgatgaagaatatcctaggcctacaagctccaatggagcttacatcaacctttatgccaacgataagcataaccgcaagaaagacacttaacaaaggttttaaccgtaggaccacatcgtctatggtgtataaactgacttgggtgacatacacattgaagtgctcatctggaacaatgttagtgaagcgatttttcgaagaatggtatacctgcatgaagcactccaacatccaagtaagatttcgactcagagcaataaatgcagatgaatag

SEQ ID NO: 79546 - DNA, 1514 bp, Glycine max
  Peptide Sequence Number=SeqID_196324
gagaggaggaatgaaagattcggataaattaacgtgggatcagggtcgatgtctgagtcccgcacaggcacgttcctcggcctcacagaagcttatggtgtcgctcatgttcttggtttccctcacctacatggcttacactctaaagctggtttccacgtccacatcatcaagcacgtgcagccacgctcctttcatcatcaaccacctcttcccttcctcaaacgtaacggagtggccgtcttcatcccaaacttcccgcaccggaaaggggaaacggccggggcgccagaaaacggagctccgccacctggtgttcggaatcgcggcgtcatcgaagctatgggagcacagaaagaactacataaagacttggtacaagaaggacaagatgaggggagtggtgtggctggacgatcgcgtgaagacgaacccaaaggaagggttgccaccaacgaaggtgtccaccgacacctcgaatttcgtatacaccaacaagctggggcaccgctccgcgattcgaatctcccgcatcgtgacggagacgctgcgtatggggcacaaggacgtgcggtggttcgtcatgggcgacgacgacaccgttttcgtgacggacaatctgctgaggattttaaacaagtacgaccacaactacatgtactacattgggagcttgtcggagagtcacttgcagaacatattcttctcctacggcatggcctatggtggaggcggcttcgccataagctacccgttggccaaagctctgagcaaaatgcaggaccgctgtattcagaggtatcctgctctctatggctccgatgatcgaatgcaagcttgtatggctgaactcggtgttccactcactaaggaaatcggttttcaccagtatgatgggtatgggaacttgtttgggcttcttgcagctcatccagggactccattggtgtcactgcaccaccttgatgtggttgagcctatcttcccgaatgccaccagagtagaagccattaaacggctaaccattccgatgaagcttgactcagcatctctcattcaacaatccatttgccatgacagaaataggagatggaccatttcagtgtcatggggttttgctgttcagatatttcgcggcatatttacacagcgggagatggaaatgccttcaagaacattcctcaattggtatagaagagcagattacactgcatatgccttcaacacacgcccgtttagcagaaacccgtgtcagaaacctttcgtcttttacttttccaaggcaaaactcaattccactttgcaacaaacagtgactgaatatgaaagagatcctattcctcctccagaatgtcgatggaatatggctgatccttctgctcttgacaaaatagaggtgcacaagaagcaggacccgcatctatgggatagagccccaaggagaaactgttgcagagtgatgaagtcgaacaagacaggaatcttgaagatagaagtggctgtatgtagagatg

SEQ ID NO: 79547 - DNA, 861 bp, Glycine max
  Peptide Sequence Number=SeqID_196325
atggccgaaattctgccatataaacactccattgcgccatggtgggcctcccttcacaaattgcctatggtggttggcaaaaaaatctggcacgccattctgccatggcggggcaatagtggctatttaacaacactggttttgtatatgggtaatttcgttgatgtgattgggcttgtgcacatagcaaggtcattgaggggatttgctaccattggcaggctattagcttatgaaactgttaacaagaacctctcaccaaagccaggggagcattccaaactccctattccagcatcattgatagcaggtgcttgtgctggagtttgttcaactatatgcacatatcctctagagttgctaaagactcgactaactatccagaggggtgtttatgatggtctactagatgcattcctgaaaatagttagagaagagggtgcaggagaactttacagaggtcttactccgagtctgattggagtaattccatattctgccaccaattactttgcctatgacaccttgaggaaagcatacagaaaaattttcaaaaaagagaagattggcaacattgaaacccttttgataggatcagcagctggtgcattttcaagtagtgctacctttccacttgaagtggctcgcaaacacatgcaagtgggagccctcagtggaaggcaagtttacaaaaatgtgattcatgcccttgcaagcattcttgagcaagaagggatccaaggattatataaagggttgggacctagctgcatgaagttggtgccagctgcaggaatttctttcatgtgctatgaagcatgcaagaggatattggtagaggatgatgatgatgaggagtag

SEQ ID NO: 79548 - DNA, 1922 bp, Glycine max
  Peptide Sequence Number=SeqID_196326
atggctcgacaagtgtgtgatgacaaattatcaactggattctgctactctgatgtatcatcgggaaatccaacgatgttggtgaaccagatccaaggctttgtgtcagacccggagatgtacaacctcaccacgggcatggaaatgatagggtttccaaagagtgacaccaacgctgtcatgtggagaagtttcatccccgaaccgggtccttcttcttccaaaaccatcaacgattcttccaccactttctaccaccacgactacaacaacaagaatgcagatttcacaccagcagggaatatttctgaaacaagtgccgagaatctaatcgtgggaaatcacgattcagccccgtggcaagacaacgactacaacagatttgacgattcttctctaaggtgtgtgtttccttgtgaaaccaacgaaaggcctagccaaggtctttcactctctcttagttcaaccaacccttccactatcgggttgcaatcttttgagctaagacaaacaggccatcatcctgattttgtttcgtcgagttccagagaagggttctttggaaaaccagtttctcttcaacagcaacagatgttgtcacaagatgggtatgtgagttctaattctaaagttgcaagtgtttatcaacaaggacatttcctggtgaagaactccaagttcttggttcctgcacaggaccttctcaacgagttttgtagcctttgtgcaaagcaaagcgacttgggaaagccaacaaaatcgttgaagaagcagtgggaagatcaggaaaataacggtgtcggttcttcgaagaagcattctctgacctctctagagttcgtggagttgcagaagagaaagacaaagctgctttcgatgctggaagaggttgacagaaggtacaagcactaccggaatcagatgaagagtgtggtgtcatcgtttgaagcggtggcggggaatggtgctgcgacagtgtactcagctttggcgttgaaggccatgtcgagacatttcaggtgtttgaaagatgggattttgtcgcagattcaggcaacaagaaaagccatgggagagaaagacccagttgcaccaggcacaacaaggggcgaaacgccaagacttaaagtcattgaccaaacactgagacaacaaagggcgtttcagcaaatgagcatgatggaaacacatccttggagaccccaacgtggccttccagagcgtgccgtttcagttcttcgggcttggctctttgaacattttctccatccgtacccaagcgatgttgataagcatattttagcacgccaaaccggtctctcgagaggccaggtttcgaattggtttattaatgcaagggtgagactatggaagccaatggtggaggaaatgtacttggaggaagtgaaggaccctgaaaacaacatagcttcctcagaaggggctactgatcaagacaatgatataaacccaaataatgttgaataccctccacctccttcttcatcacgatcagaggatcagaagccatctctggttcgaattgactccgagtgtgcatcctccatcatcaacaaccacagtaccccagataacaaaaacgacccaaagggccacgaacagtgctttgggtcagtggagcttgatttttcatcatacacacaccactcctcgggtatagtttcttacggaagtaatgatcagaatgggaacaacaaccagagtggggtgtctttgacgctagggttacagcaacatggggtgagcctagcgttcccgccagcaacacagagttcactgtactatccaagggaccaaattgaagattgtcaaccagttcagtactctcttttcgatggtgaaggacaaaacctgccttacaggaatttgatgggagcacagcttctacatgacttggcagg

SEQ ID NO: 79549 - DNA, 3534 bp, Glycine max
  Peptide Sequence Number=SeqID_196327
atggcggagcacacgaccagaaaaacgaccactgaccgtttggaagatgcgatctcgcgtctctcgatccaccatgattccctttccgataagcacgataccctagcttccaaggtcgactcgattctggaccgcctgaatcaattgacctctcttcctccgccaccatcgccggtttctcctcaacatcgaccaccagtcaaactggatgtgccacgtttcgacggcactgatcccctagggtggatctttaagatcacacagtttttcgacttccagagcactcctgacgaagaccgtatcaccatggcctcgttttacatggatggtccagctttaagctggtaccaatggatgtaccgcaatggttttattacttcgtggaatggcctcctgcaagctctcgaaacgcgcttcgctccgtcatactacgacgatcctcgcggcgcgctgttcaaactcaaccagcgcggctcagtcaacgactacctcacggacttcgagcgccttgctaaccgcatagtcggtctccaaccgcaatttttgcttagctgctttatctccggactctctccggagatccgccgtgaggtcattgctttgcagccgatttcattacctcaggccgccgccctcgcgaagctccaggaggacaaattgaatgaccgtcgccgcagctttcgccctggtccccctaccccttcccatccaccgccaccgccagccttaggcccaccttctagtacccaccctaaaaccccaaccgccaaacccatattcactcactgtaccccagaggagatggcttttcgtcgcgagaagggcctttgttacaactgtgatgagaaatggaactcatcacatcgttgtaagggtcgtatcctactcttcatcgccgacgagcccattcctagcccaccaccctctcctccttccgtctccccaccacaggaccttgaaaccccatcctctcccactttaccccatattagcttgcacgccctctctggtctctcagctcccgagacttttcgtttgtatggcttcattaatggcgcacgactcacggtactcgtcgatagtgggagtacccacaatttcgtccaaccatgcgtcgccaagttcctgcacttgcaggtcaccgagaccaaaccattgcgcgtcatggtcggcaacggttcagtcctcgaatgccaccaggtctgcaccactaccctcctcctccagagccactcgttcacggtacccctccacctactccccattagtggcgcgaatgtggtattagggattgcctggttaaaagggttgggccccgtaattactgattacaccaccctaaccatgcaattcactcatttgggcttaccaataacattgagggcagacgtggcttttgggcccacacccatttcggctacacagatgagacgccttatacagacccattccacctcggcctttttccacttggccttactacccgaacccccacccaccctcacccaccctatacctgaaattcaatcccttctcgaccgttttacccccatcttccaaactcctacccagttacccccaccccgacaaattgttcatcatattaaccttcaaccttcagccccccctgtcaatgtccgtccttaccgttatccatattgccagaaaaccgaaattgaaaagcaagttgctgctctcctcaacgccggtctaattcgcctgagccaaagccccttttcttcaccggtcctcctggtcaagaagaaggatggctcgtggcgcatgtgcatcgactaccgcgctctgaactccatcacgatcaaggatcgttttcccatgccgacaattgacgaattgttggacgacctcggcactgcatcctggttttcgaagcttgacctccgtcaaggcttccatcagattctaatggctgaggatgatataccgaagactgcatttcgcacccatcaaggccattacgagtatcgcgtaatgccttttggtttgtgcaatgcaccctctacctttcaggccacgatgaatgctctgttgcagccatttctgcgtaaattcacggtggttttcttcgatgatatacttgtgtatagttccactcttgctgatcatctttttcatcttactctggttttcgaggcactccttcagggacaattttatctaaaacagtctaagtgtttgctggcccaacgacaattggaatatttgggccatattatctcagccagaggaatcgaaccagagcagacgaagatcacggcaatgctttcttggcccgtgccttcgtcacaaaaggccttacgtgggttcttgggtctcaccgggttctaccgccgctttattaaaggatatgcttccattgcctcagccttgacgcctcttttatgcaaagataagttcctctggtcgtccacagctcaggaagcttttgatcaactaaagaaggctatgacccgtgcccctgtgctcgctccaccggatttcaccattccttttgtgctagaaacggatgcgtccggcagtgccatgggtgtcgtccttatgcaaaaaggtcaccctattgctttctttagtaagcaattcagtccacgcatgcagcgagcctcaacttatgtgcgcgaactccatgcaatgaccactgccattcgaaaatggcgtcattatttactgggtcaccagtttaccatactcaccgaccaccggagtttgaaggacctcatgtctcagattgcctacaagccaggaacatctaatgtagtggctaacgcgttatcgcgcattgacactgatcacgacagtaccctcctcatcctctcataccctcatttcgactttatgacccaacttcgtcagagccttcaatcgagccctgattttcagcaaatgcgcgattccattcttcgtgacccctctgcttacccagactaccggattcaagatgaattgattatttgtaaaggtagcatatggttggattcacgaaatcctttcattcaaactcttctttcggagtttcattctacccctttgggagggcatcttggtgttgctaagactctgcatcgtctccaagccaatttcgtatggtcctccatgcgcgacgatgttaaacttttcgtccgtcaatgctccacctgtcagcaacttaagcatcttactcgtcgtccggcgggcctcctccaaccactcccggtgccgaccggaatttgggaagacctctcccttgacttcatcacgcacctaccaaaatcccacggctacactgtcattctagtagttgtcgaccgtttcacgaaaggcgtccacctcggtgctttgccggcccaattcacggcgtctaaagttgccacactgttttttgatattgtatgcaaaattcatggttttccccatagtctcgtctcggatcgcgatcccgtgtttgtcagtgcattttggcgagaactgtttaaactcagtggcaccctccttcgcctgagtaccgcgtatcatcctcagacggatggtcaaacagag

SEQ ID NO: 79550 - DNA, 1846 bp, Glycine max
  Peptide Sequence Number=SeqID_196328
atggcaagagttcttctcgcacgtaataacctgtgtctgtggatccatgtgtattttttgttacttgttcatctccatgttggaactagtttttaccttcctggtgttgcaccggaggatttccacaagggggatctgttgagggtgaaagtgaacaaactatcttccacaaaaacacagcttccttactcctactattcactgccttactgtcatccaggtcacattgttgacagtgctgagaatcttggggaagtcctgaggggtgaccgcatagaaaactctccttacgtgatgtgcaatgttgtttgtcggctaactctcaatgcaaaaacagccaaagagttcaaggaaaagatagatgatgaatatcgtgtgaacatgattttagacaatcttcctttggttgttccactacggcgaccagatcgtgagtcatccttggtgtatctgcatggcttcctagttggtcttaaaggacagtatgcaggaaacaaggatgaaaagcattttgtccacaaccacttaacatttatagttaagtatcacagagatcccgtgacagaaatgtcaagaattgtaggatttgaggttaagcctttcagtgtcaagcatgaatatgatggtggatgggataataccacacgcttaactacatgtgatcctcatgcaaaaaagttagtctcaggctctgagcctcctcaagaggttgaagacaagaaggagataatttttacctatgatgttgagttccaggagagtaatgtgaagtgggcatctcgctgggattcctatctcctaatggctgatgaccaaattcactggttttcaattattaattctttattgattgtactttttctatcgggcatggtggctatgataatgttgaggacactttaccgtgatatttccaagtacaatcaattagagactcaggaggaagctcaggaagagtcagggtggaaacttgtccatggagatgttttcaggcctccttcaaactcggatttactctgtgtatatgttggaactggtgttcagttttttgggatgattcttgtcaccatgatttttgctgcacttggattcctctccccctcaaatagaggggggttgatgactgccatgctcttgctctgggtccttatgggactgtatggtggctactcttcggcacgtctttataagatgttaaagggaacagaatggaaaagaattgctctcaagacagcctttatgtttcctgccactgcctttgcaattttctttgtgttaaatgcactaatctggggccagaggtcttctggggctgtgccatttggtacaatgtttgctcttgttttcttatggttttgcatctcagttccacttgtgtttcttggtggtcattttggttataaaaagccagtgactgaggatcctgtaaagaccaacaagatagccaggcagatcccagagcagccttggtacatgaactcactcttctctattctaataggaggcatactcccatttggtgctgtcttcattgagcttttcttcattctcacatctatctggttgcatcaattttattatatatttggtttcctcttcattgtgttcctcatcctcattgttacttgtgctgagatcacaatagttctctgctacttccagttgtgtagcgaggactaccgttggtggtggaggtcttatctcacttcaggttcctctgcactctaccttttcctctatgctgcattttacttcttcacaaagcttgagatcacaaaaccagtttctggagtcttgtattttgggtacatgctgcttctttcatatggtttctttgtggtcactg

SEQ ID NO: 79551 - DNA, 1535 bp, Glycine max
  Peptide Sequence Number=SeqID_196329
atgattgcggtatcgactgtatcctatagattcaacgtcaatgggtacaagactgagatcatgggagcgagaaggggcctccgacaaggcgacccaatatcacctatgctctttgttattgtcatggaatgcctcaatagatacttgggtgacaagatctcagttggtatgatgatgagggcctatgaaagtttctcgaaggcaacaggtctgttggtgaatccacagaaatgcagcctgttatgtgctggtattgatgctgtgaccaaaagggagattctagaggtatcgggtttccaagaagggcaattaccgtttaaatatttaggcgttccggtgactagtaaaaagttatctaccatccattattcacctttgattgataaaattgtaggcaaaatcaagcactggacagcacgactcttatcttatgcaggaaggttacagcttgtcaatagcgttatgtttgcacttactaactattggttaaactgttttccttttcccaaaagtgtgctacagaaaattgaagcaatctgccggattttcctatggaccgggggatttgaaggaagccgtaaatctccggtagcttggaagcaaatctgcagtccgcgaagctgtggtggtctgaatatcattgacatagacatttggaataaagctaacttgatgaaattactttggaatttgagcagcaaagaagactccttatgggtgaagtggatacaagcatattatgtaaagagaagcgagctgatgcatattgagatgaaaaacaccgattcttggatcatgaaagccatactaaagcagcgagaagatctggaaaaaatagacaatatggaagaactcatgatacgaggcagcatcaatatgggtaaattatatcgtaaactgcaagattgtggacaaagaaaggaatggaagaatttgttatacggaaacaccgcgaggccccgtgcaaactttatattgtggcttgcgtgccatggtagattatcaaccaaggatagattgtgcaagtatggaatgattgatgataaaagttgttgtttctgttcagaagaggaatcgatgaatcatctattctttgtgtgtgataacagtaagcgtgtttggatggaagttttacaatgggtgcaaattcgccatgatccaagtgattggcctaatgaattacattggctcacacatcacaccaaagggaaagggactcgagcggctgttctcaaaatggcgattgctgaaaccatttatgagatttggaatattcggaacaacaaaatttttggccaagctattgatatcaatacagtaggaaagaaaataataaatacattggtgaatagagggaaagtcacttctttcatcatagtaggtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 79552 - DNA, 1143 bp, Glycine max
  Peptide Sequence Number=SeqID_196330
atggccgtgctacctttctcatactcaagatctcccactttatctctaccatcatctcaacaaataaggcctaaaacaaaaccaaattccaagacaaacacatgctctctaatccactgctgccacagccaaacagaaccaatcgaactaaatggccaagccagatttcgagagaagaaccctgccactgcagttgcatcccccgtggttgttccaccaaggcctcgaaggataatccttgttaggcatggagagagtgaaggaaacgtggatgagagcgtgtacacaagaatacctgatccaaagatatccctcactgagaaaggaaaggtccaagcagaggaatgtggcaacaggataaagcaaatgatagaaaatgaccatgaccaacattggcaggtttacttctacgtctctccatatagaaggacacttcaaaccttgcagcacctcgctcgtccttttcaacgctctagaatcgctggcttcagagaagagcctcgcattcgagaacaagattttgggaattttcaaaacagagaaaagatgcgaatggaaaaggaattacgccagcgttatggtcgtttcttttaccggtttccagatggagaatccgcggctgatgtatatgatagaataacaggattcagagaaacgctgagaacagatattaatattggacggtatcagccacctggggagaagaaaacagacatgaacttggtcattgtgtctcacggtctaacacttcgagtttttctcatgaggtggtacaaatggacggttcaacagttcgagggtctcaacaacatgggcaacggaaatatgcttgttatggaaaagggttttggtggaaggtatagcttactgatgcatcatggagaagaggaactaagacggtttggattcacggatgaaatgctgattgatcaggagtggcataaatttgcaaagcctgctgatctgaattacgattgtccaatggtgaattccttctttccccacctcagtgacagtgaagaaacatgcagaaaaaggaaatcaaacttatttgaatataacacaaatctgacgctgtacaataaaatacctcgtgttgtcgaggaagtgcaacatttcacttgtgctgagatgatgatctag

SEQ ID NO: 79553 - DNA, 109 bp, Glycine max
  Peptide Sequence Number=SeqID_196331
atggaacttgatttggatggaagaattgtgaagacgtctttgattggttggagtggatggcacatgccagattgggtagcctatgagaactttaccgacactggtagtg

SEQ ID NO: 79554 - DNA, 174 bp, Glycine max
  Peptide Sequence Number=SeqID_196332
atgaaggtaattagtgtggttccaccaatctttctcttcggaagaccacttctctacttgagagtggtggccgatgaagcaggtcatgaatacgccaaagaatgggaaaggaagacacgagtgacagtaattgacatggtggtggggtgtgagaccgatggtgatcaaaagtaa

SEQ ID NO: 79555 - DNA, 879 bp, Glycine max
  Peptide Sequence Number=SeqID_196333
atgtcttctgatctctatacttttgacatttcttaccaaagacattcaagcccagacaacatggtctcctatgatggaaatggaaactttgtatttttctctgaccctcactctttccctttcctcactggctcaccaattgatgatgttgttcaagggaattttaacacttctcttgaccctttttcctcttctttctgctccttttctcctcaggaaaaccctgtgcaacctctgtctaatataaagggtgagtttagaagtttctcttatttgcatggctccgaagtgacaagtaaggaatgccaaatgggtgtggattatacctacaatcagcactttatttctcaaacttgtcatggttctgaaagtgcatcaaagttaattcaaaggagcttcagctgtacctcttttgatgagaagcctcgtttcccctttgaacctcaccctgacactctcatggattttcaatggcatgctttgaactcccctgaaaacactttcttcgcagcatcaatgaggagagtgtgcagtacaggagatttgcagaacatgaaagcagcagatatgtctcaaacggagagccccttgttggaggaaggaaacttcaaagtaaggcgttatagtgccgaagaaagaaaagaaaaaatctctaaatacagagctaagagaagccagaggaagttcaataagactattaagtatgcatgccgaaagacactagccgacaatagaacccgcatacgtggcagattcgcacgcaacgacgaaatcagagagattccgaaagcaccttgttcaagttcaaccacagaagaatatgaagacgagttctgggttgaattcattgaaggattaaatgaggaggtcaacggttag

SEQ ID NO: 79556 - DNA, 360 bp, Glycine max
  Peptide Sequence Number=SeqID_196334
atggcctcacagcagcacatcgagaagatgcaactccgccagaacttccgcaatctctggcactctgatctctttagtaccattcaagctgacaccccttattgttgcttttctctgtggtgtgcaccgtgtgtatcatatctgctccgcaaacgagccctttacgatgatctgtcaagatacacttgttgtgctggttacatgccctgcagtggtcggtgtggagaaagtaaatgtcctgaactctgccttggtgtggagaacgaatatctgaatatgccacggaggtatatatttggatttcatagacaagaagtcaagctcatatttaaacgccaagttcactcagtattttgctga

SEQ ID NO: 79557 - DNA, 564 bp, Glycine max
  Peptide Sequence Number=SeqID_196335
atggaaagtaatatccacatagatgttgcggagtccgctattgaccgcatcgaagcagccatcgcgaaactcacccccaatcaactcatacttgtcgctgctacagacaccatggccaccacaatcgatgaccttattcagcgattgagccttcaccatcccactcctcactttccattttcctcccttctgcagtcaccgccaccagtcgaccccatatcgaccatgcctcccatgccaactccatttccacgtcccgaaatcatgcatgtatactctattcattctcaaagtggagctcttactattcattcgctggacaggtttcacaaggttgtcatcggcgttagctttggtcaacttgaggcacgatttgggtggagtgacaagagcttcaccgaattgcttgagttactgacaagcacatgtcctaatgattgccttttgtacaaaaatgaatttgcagaaatgagtaagtaccccacaaatggggtatcacggtacaaagttaaggatgacgaatgtagtgatgaaccaagtagaagcattagtcatccagtataa

SEQ ID NO: 79558 - DNA, 1389 bp, Glycine max
  Peptide Sequence Number=SeqID_196336
atgagaggtgctaatggaggcgctgtgaacaacactttggagactatcaacgctgctgcaactgtcatcgcttccgtcgagaatcgccttgatcaaccccatcctcacgtccagaagaaaagctggggaaactggttaagcatatattggtgttttggacatcgcaaaaaccgacagcgcattgggcatgcagtccttgttcccgaaagaataccttctggcacagataatgcaacagtaaattcaacacaagcacctattatcccattccacttcgttgcacctccctcatctcctgcatctttccttcactcagaacctccttcagttgcacaatccccaagtgctatactatctctcactcccggtggtcctttctctatctttgccattggaccttatgcccacgaaacacaattagtttcaccacctgttttctcaacattcaccacagaaccatcaaccgctcctttcactccccctcctgaatctaaccacttgactacaccttcttcacctgaagtgccatttgctcaactgcttgaccccaacaacaaaaatagtgaaacctatcagaggttccaaatacctcagtatgatttccactcttatcagcttcatcccggaagcccggttggtcaactcatttcaccaagatctgctttctcagcttctagcacatcatctcctttccctgacactgacactgagtttaattctcgcgcctccctcctccttaactttcaaacagatgataaactgtctactaatgaaaaccataagtcacatcaaggttctggctctctaaccccagattctataagatccacaactcaagctagttttcttccaagtcactgggtctctattgaagtgtctgcccaagaagtattcaattgtgtggaaaacaaggcagtggcatggactaaaccactttcaaaactcaaaactgatgcaccgggagaagataattcaagagaagtccttgtcatcgaaactcccagtgatgcaccacaacagaccgctgacgatggagatgtggaaagagttcatcataaggatgaatgtataacattttctgctgctaaagaattcaactttgataatgcagaaggaggggattctcctactcctaatttagttgctgactggtgggctaaggagaaagttgcaagcaaggaaggaggatcctctaataattggtctttcttcccaatgattcgacccggtgttggaatgcaattgcagaacttggagaaggggaggaaaccttgtgtgaaacattttagcaatgttcttaaattccactctagtaatttccagaaaaatacaattgtgataaagttcgatatggagctgatggatcctactgaatacatggacaagtaa

SEQ ID NO: 79559 - DNA, 3000 bp, Glycine max
  Peptide Sequence Number=SeqID_196337
atggatattcaggaagagagccccatgtttgggtccttgaaagccatgactacaaggaatatgtcatcatcatcttctgctttcttttccgcgaaccagtcacccttcttctctccaagatcaccatcatcatgtcaattatcagagtcagccaggcttgatgttccaagtaacagaattcatttaggtttggctccctcaagcaccacttcagagattccagaaccaaattcacttgtaaatgttagatgtactttgtcagatgtatctgcatctccagctggatgtaattcagttgatttgcagaaacttgatcgtatatcttcctcagttggcatctcaagtagcagcatatctagttactccaatcgccatgaggatggttattctggacagaaagaaaagcgaattaaaaaagacagaaaccatagaacatcctccactccaggttccacatcattttcttcttataggctgaggagttgtgatgttttcataggattgcacggctgcaaacctcctttactacgatttgctaagtggctgtgtgctgagttagagactcaaggcatcagttgctttgtttcagacagggctcgaagtaggagctctcgcaaacttggcattgcagagagagcaatggatgctgcttcttttgggatagtaattataacaaggaagtctttcaagaaccaatacaccattgaggagctccagtttttctgtagcaagaagaatttgatcccaatctactttgatttgagtccagctgattgtcttgtaagggatataattgaaaagaggggtgagctgtgggaaaaacatggaggggaactttggctgtcgtatgatgggttggaacaagagtggaaagatgctgtgcatggcctctctcggcttgatgagtgcaaattggaagctcaggatggcaactggagagattgcatactgagggctgtcacattattagcaatgagattaggaaggagaagtgttgcagaacgtttgacaaaatggagagaaaaggtagaaaaagaggagtttcctttagctagaaatgagaatttcattggcaggaagaaagagctttcacagttggaatttatactttttggtgatgtcacaggagatgcagaacaagattatattgaacttaaggccagacccaggagaaagagtgtgagaattggttggggaaagagtaatgtgatagatgagagatggagggaaagacatatgggaaatggcagcaggaaggacaaagaaccaattgtatggaaggaatcagagaaggagattgaactgcaaggtattgagttttctaataggcacaaccatctaaggctcaagcggggaatgtatagtaagaggaaaaggggaatgaagattttgtatgggaaaggaattgcttgtgtttctggggattcaggaattggaaaaacagaacttattcttgaatttgcttacagatttcatcagagatacaagatggttttatggataggaggagggagcagatacataaggcaaaactatctcaatatcagatctcttttagaagttgatgtgggagttgagaatggtttggagaaaacacagataagaggcttcgaagagcaggaagtagcagcaatttctagagttcgcaaggaactgatgagaaacataccgtatcttgtggtcattgataacttggaaagtgaaaaagattggtgggatcacaaacttgttatggatcttctccctcgttttgggggagagacacatgtaattatatcaacatgccttcctcgcatcatgaacttggagcctttgaaactttcatacttatctggagttgaagcaatgtctttaatgctaggtagtggcaaggactatccagttgccgaggttgatgccctgagaattattgaggagaaagttggaaggttaactcttggccttgccattatcagtgcaattttgtctgaactacccataacaccaagcaggctcctagataccataaatagaatgcctttgaaggagatgtcatggagtggtaaagaagctcactcgttcaggaagaatactttccttctgcaactttttgatgtttgtttctccatatttgatcatgcagatggtccaagaagcttggccaccagaatggtgctggtaagtggatggtttgcacctggtgctattcctgtttccctattgtcacttgctgctcaaaaggtaccggaaagatgtcagggaaaatgtttttggaaaaaagtaaagcaattattaacatgtggattcacatcctcgtatgccaaaaaatcagaattagaagcatcttctttgctgctgagatttaatattgcaagaagtagtactaagcaaggctatatccatatcaatgatctcatcaaactgtatgctcagagaagagacgatactggagctgcacaagcaatgattcaagctatcatcaatcacgggccaatatcacaaaatctggagcatttatgggctgcttgttttctgttatttggatttggtcatgatcctgtggttgttgaggtcaaggtgtctgagcttttatatcttgtcaaaagagtagttctgcctcttgcaattcatacattcattacttattctcgatgcaccgccgctcttgagcttctgcgtctgtgcaccaatgcattggaagctgcagaccaagcatttgttaccccggttgacaagtggttggacaaatcactttgctggagatccatccagactaatgctcagttgaatccttgtctttggcaagagttagcattgtgtagagccactgttctcgagactagggccaagctaatgctaagaggtgctcaatttgacataggggatgacctgatcaggaaggctgtttttattagggcttcaatttgtggtgaagatcatccagataccatatctgctcgtgaaacactgagcaaacttaccaggcttaatgcaaatgtccaaattcacacttcaacttag

SEQ ID NO: 79560 - DNA, 420 bp, Glycine max
  Peptide Sequence Number=SeqID_196338
atggctgtgacatcatcctcatccttagagagctctagcataggtgtacctgctggtgatgcctacagagaagacaactctagcactggtgtggtcactggtgatggctgtggagttgtctctagagtagccgggtcagtttctgggatgtctagcgctggaatctctagcctcctgagcagcctcttgctctggctaaggctcctgggctgtggaggcctcacctcccccaaaagaagaaggccggactcctggcctggccacctgagtactagtgctgacaggggtaaggaagctggtgcaatagaagcagggggagctaatgaagatggtccctcagatcctcaggccctggccttgcgggtccttgggaaagtgaccgaagggtcatccagattccaaaaattcttctttatataa

SEQ ID NO: 79561 - DNA, 222 bp, Glycine max
  Peptide Sequence Number=SeqID_196339
atgtctcattctcaaggaggttcgacggcaagcaacagtggctcgtggtggccaccgataatcgtgggtggtggagaaggaggtgttagggtatgggtggcatttggaaaggaggaaaggggggaaatcgtgcttttcatgcataatgatctgaaaggtgatatcttgccatggaaggctaagcccccacagttggggaatcctgctgagaacttgatgtaa

SEQ ID NO: 79562 - DNA, 1296 bp, Glycine max
  Peptide Sequence Number=SeqID_196340
atgtcatcatggtgggaaaagtcttcatccaaagatgtaaagaggaaagaaaaaaggaaaagtattattgatacaatacaaaggaaattaaataaatcaagagggtctaggagaaatcatagtcacactaactcagagaagggaaccacatcccttgtacctacaacatcaccatcaccctcaacacatgtttcccgcctacaaagttttgcggaaagacctcttgctcagccactcccactcccagggacgcactgctcctccaccaatcgagcaaattctggaactagtgtaacatcaaaaccacaaagcacctggggcttgaaatcatctctatatttccccttaccaaaacctggttgtgtttttaacaggggagaacctacagatgccgaggaagatattgccactgcatcaatttctagtggcagctctattgatagtgatgaccaatgtgactcacatttccttagtcctctggcatctgattctgaaaatggaaaccaagctaccgttcacaataccgtcagtgtggttcacaaggatcaaccacccattactatccaaaaaaactcaagagtatcctcaaaaccagctcctcaactgtgtaatcatcaacttttatataacacacccaaaggggcttctttgcatctgccgaatccgcaaatagcttcttcaggtggtttgtggagtgctccagacagttcaatgtcaagtccttctagaagtccactgagaatgtttggttccgagcaagttttgaattctggattctgtacaggaaagctatatccagatttagctactaggcactgttctagtcctggttcaggccataattcagttggtggggatctgacagggcataattctccgatacccagtcctggaatgaaaagtcctggtttcagttccaggatacacagtggtgctgtcacccctcttcatccacgtgctggaagtgctgcattagaatcgcccacaagacgccctgatgacgtgaaacagactcaccgattacctcttcctccaataacaatacctaatcattgtccattttctccaacatattctgcaactactactccttcagcgcctcgtagtcccagcatagcagaaaatctaacatatcctggctcgcgctggaaaaaggggcaactgcttggaagggggacatttgggcatgtatatcttggttttaacagtgaaagtggtgagatgtgtgcaatgaaggaggtaactcttttttcagatgatgctaaatcaagggaaagtgctcaacaacttggccaa

SEQ ID NO: 79563 - DNA, 348 bp, Glycine max
  Peptide Sequence Number=SeqID_196341
atggcggcacaagatgttgttcgacagcctaattttggaagaaagaagggaggaaaatggaaagtgaggagtgggatggtgaaggctcaatcgctgaataaggtcatcgattgtggtggccatggtgtctgtagcagcgacaagtatgagttgattgggggtgagtttcgcgatggctgcttcgatgcggtcaatagcggactccgcaacatctatgtggatattactttccattttcgggggggatgggtcctgcaaaaatggttgttggtgggtgactgtgtggaaaggatgtcatgggaaaagatggtttgggctggcatggaagccatggaaggcagccattag

SEQ ID NO: 79564 - DNA, 1344 bp, Glycine max
  Peptide Sequence Number=SeqID_196342
atgcaccaattatgcatagtcactcaaaccagttgcatcttgcaggaaattgcattgctaagtcacctgcggcatccaaatatagtccaatattatggatctgagacggtagatgataaactttatatatacttggagtatgtctctggtgggtcaatctataagttgcttcaacagtatggccagcttagtgaaattgttattcgtaattatactcggcaaattctgttaggtcttgcttatttacatgctaaaaacactgttcatagagacattaaagccgcaaacatattggtggatcctaatgggagggtaaaattggcagattttggcatggcaaagcatataagtgggcaatcctgtccattatctttcaaaggaagtccttactggatggcacctgaggtgataaagaattcaaatggttgtaatcttgctgttgatatatggagccttggctccaccgttttcgagatggctactacaaaacctccttggagccaatacgaaggggttgcggctatgtttaagattggaaacagcaaggaccttcctgcaatgccagatcatctatcagaagatggaaaagattttatcaggcaatgcttgcaaaggaatccagtgcatcgtccctctgctgctcaacttctgctgcatccatttgttaaaaaagccacactgggaagacctgttctgtctgctgatcctttagaagcaaaacctgattttgtaaatactatgagatctctggctattggacctgcaaaacataatttaggcttagtttcagaagcagctggtacatatctgtctagaagcttgagaactggctcaggatcaagtgaagcccatacaccaaggaacatttcatatcctgtgtctcctactgggaacccacttttgcctcctaggttactgcatgtgagtggaaggctgtctccatctagtcctcacactgcatctggctcatctacaccgctcactggtggcattggtgcagtcccttttcatcaaacaaagcagccaatgttctcacatgaaggtatcagtgtaatacaaaggcctcaaagttatcaggagccaatgcatgacccactttgggggattctgaaaagcactcttgcttgcccggatatagtttcgtccaataatgatgctcttggaaaccataataggagggttggccagggactcccaagagatttttatgatgggaagtcatatttagcggatcgtgtatcgcaacagctgttaaacgatcatcctatatattccttgggtccacaaagatggtgccaaatcctcaattttagagtggatgcccttggggatatgcaactttag

SEQ ID NO: 79565 - DNA, 792 bp, Glycine max
  Peptide Sequence Number=SeqID_196343
atggaaggagacaacatcataggactaaaaaatggcaagcaaagtatatcattagaacctggtggtcaatttgagcttagtggtatgcctttgaaaacattgcatcaaacttgtgatgagattaattcacatctctatcaggctaaaactgttgctgaggaaatgggaattggatttttgggattaggttttcagcctaaatggagactggaagacatacctggagtgcctaaggtacggtataacattatgcaaaatcacttacataaatttggcccacctgcaattgaatcattgttcatgacatgctcagttcagaatttaaaccagttggcagcagccttattcgctaattcacctttcaaggaaggggttccaaatggttatctcaccataagaaggtttgagcagtatgttgattacgctctcgatgtgccaatgttgtttgtttatcgaaaaaaacaagacttcatggcaagtaaactccctgccattcctggtcaggtgccaacacttggtgactgggaaaatcatctaataactatatttcctgaggtcaggctaaagagatacatggaaatgaggggtgctgatgatggccctttggaaatgttatgtgctctgccggctttttgggacgaatggtgtgggggcaaacaggggcgaacagccctccctcccttgacaccttatgtataccatgtgtatgtgtggggagtagatagtcaaatagtccctgtgggaattccttttgtcttctacaggtctattatgggactacattcacattag

SEQ ID NO: 79566 - DNA, 288 bp, Glycine max
  Peptide Sequence Number=SeqID_196344
atgactggtggtgtggtgacaatgatagtcaacggtagagatgttagtggtgatagcagtagtgatggtggcaacaacaatcatgatcgtaacaatgtggcatcaacaatggtgttagtaggtggtcatggaagtaatgacaatgatgatgtgtggacgggggcaatggaagtggagatgacagttgcagcgatgaccagtggtagtggtcatagtgacagtaatgatgatagtggtgacaaccaatggtggtggtcggtggtgaaggcagcagcagctgatcggtag

SEQ ID NO: 79567 - DNA, 2205 bp, Glycine max
  Peptide Sequence Number=SeqID_196345
atgggacaagaattggagtttgatctgaatgacaagtcttgcgtgggtctcagtcctgatactgttcttccacctcatcaatattgtttgaatgtgaagaaaagatgtaaaaatgggaaacccactgggaaagatgagtttttgcaactcaaagagaactttgccgatatcaattttggtcgcttccgcagtacttcaccaaagagccttccctgtagatctcatggactggaaggtaacatagaaatgacgcaaggttccaagtatccgagttcagagcaagttataaatataaagaaaatgggcaccatgaggggaaggaaaaaaatagaaatctcatctaggagtagtgatgcctctttttcaggtagtgttgttgattctctgtgtggttcagatgatgaaaatctgagtgactcaccatctccatctgtttctggttcctggactagtatagagaacaacacttcaaatggctatattgaattttgcataaattcagatgtttgggatgaaaaatatggtgcagtagaagggattggttctacagaaatcagaagtgagaaggtttctggttcaccaattgatggtaattttcatcctaaaaaagagacagttcatggattacaaaagccactctcttctatggttgaaatctctcacatgcaatctccatcagagagtgactgctcaccaagatcaagtccaaaagtctcactcacctccatcaggaaaaggttaaattcatttacaaagtcaaaatctttgacaagcccagtgagttgtgttctggaaactactgtggtaaaattaactgacactagaaatggtacaagaaacaggacttatcagagatctttgctgaatgacttctttaacacagcaaagcattctgacattatttctgattttatcaatagagatatccagttttcaggtctatcatgttctcctgttcatcttcatggcaatctcaagttgaaaaacaaacaaggacttccattttttgagtttaaggtaaagtgccctgaagatgtctttgtggccaagacatggaaatcaggcaatgctttcaattgggtatatacctttcattcaatggataatagaaagaaaagtactgcctctgacttgggatcccattattgtgacgaagactcatcaatggtagcacagatgctggtttcctctaattcatgctcgaaattagaaggtggagtgtttgacaactctattgtaacacaatttgtgttgtatgatcttacacactcaagcaaacacgtttctcctgaaaaaaagtgttacagcgagcagcattgttctaaaactctaaaagcttctcatggaggaatgaagggagaaactttcaggccagatgaagagactttgtccactaaaaacaagcttctatcaggcaatgcagattttgataattcaaattcctatcctttgtcatccacagaattgcattcaaaccctgaaatggctgccattgttttgcaaattccatttcgcaagagagaaagcttgaaatacaaaagaagggatagaataaatgctgaagcgcattcaaaattaggtgatctctcttcaggtgtagatcagagtagaaagagccttcatgataggaaagtcctagaacaggtgaaggtggtgctaccaaccgggagccatggtttgccaagtgctgaaagccagggtccctcatccttacttgatagatggaaacatggtggaggttgtgattgtggcggctgggacatggcttgtccccttattcttttaggcaatcctagcattcaatttgctgaagatcgcactcttatggagggatatcagacactggaacttttcactcagggagccaaagagagaactcctacctttggcatgacgatggttgaagaggggcaatatgcagttgatttccatgcaaacctatccccgttacaagctttctccatttgtgttgctattttgcatggcaactccaccttcagtggggcggggcaggagaaaaaccaacagatatctcgatgcaattcattgaaaatgcttcttgaggaggaggtagaattatttatcaactcagtcacaaaagaagggaataagaactcgttaaaaggaggagccattgctgttgctggtttgaccttaaagttggtagcaagtgctacattctctgcttgtgcttatttgaactga

SEQ ID NO: 79568 - DNA, 1401 bp, Glycine max
  Peptide Sequence Number=SeqID_196346
atggtgaatcgtcgacgcctcactcgggtggcgacgagcgacgatgaagacgaagcaccgccgcgtccacaacgcacgcggaagaggatgaggcttatcgaggaagataacgatgatgacgagaatgaagaagaaaaagaagaggaggtgccggagccgcctcagcttgcggaggacgctaaacctcttggccaacccgttagggtttcgggaaaaggaagaggcaggaagaggcaccatgattccttcgagttcgatggcatccaatatactctcgaggatcccgttcttcttgtacccgaggagaaaggccaaaagccttatgttgcaattattaaggacattacacagtctatcaatggcaacgtgaaagtgacggggcagtggttttaccgaccagaagaagctgagaaaaaaggtggtggaaactggcaatcgtgtgataccagagagctgttttatagtttccaccgtgacgatgttcctgcagaggctgttatgcacaagtgtgtggtgcattttgttcccagacacaaacagcttccaaagcgtaaggatcaccccgggtttattgtacagaaggtgtatgacactgtggaaagaaaactctggaggctgactgataaggattatgaggaatttaagcagcaagagattgatgtgcttgttgagaagactcagcaacgtattggtgaactacttgaccttgagcccgaggaagcccctgatgacgatggggatcaattgaaaaataaaaaaagcttcaggagaaagagtgtttcacctcttgatgtttcaaaagaggaggaagaaactcttaagagtgaacaacatccaaaatctgaaacaccaacgggttgcataactaatggttcagagtattatcggatattggtagatttcaatgcactaactggagatagccatcgagacaaatggttggagaggttgcttcaacgcattcagtacatgtgtgattctaatgatagcaaagaaagggacaaaggattagggaatgccaattctgatgaaatcaacaatgaaagcaagcatagaagttcagaatcagcaactgactgtcaagataaggttcagaagagttccaagtcttttaactggccagatgttgctgtttcagccatggttgctctcgaaaaagcttctcatgatgctctctcatcagattctatgaagtacaaccaaaagttgcggcaattagcttttaatttccagaaaaatgcagtgttagcacgccgtctattgagtggagagttggagccttcaaaaatattaaatatgacacccaatgaattaaagatgaacattcagccttttgagaccactcacataggaactttagtcctcattttagtgcttgttttgtttggaattgctttgtag

SEQ ID NO: 79569 - DNA, 1095 bp, Glycine max
  Peptide Sequence Number=SeqID_196347
atggcttcggagaagatttcctcgattctcttgttttctgctgtaattttgcttgtccgtgatgctccttctgccatagctggggacatagttcacgacgacgattcaactcccaaaaagcccggttgcgagaaccagttcgttctggtaaaagtgcaaacttgggtcaatggtgtcgaggatgttgaatttgttggtgtgggtgccagatttggcagagctattgtgtccaaagagaaaaatgcaaagcacacgcgccttattctttcagatcctcgggattgttgtattccgccaaagaataagattgtgggagatgtcatcatggtggatcgaggcaactgcacattcacaaaaaaagcaaatattgcacagaatgctaatgcttcggccatcctcatcataaataaccaaaaagaactgtacaagatggtttgcgaacctgatgaaactgatttgaacatacacatacctgctgtcatgcttccattagatgcagtgtctgtgcagctgtactcaccatttcgaccagctgttgacatagcagaagtatttctttggatgatggcagttcttacaatattgtgtgcatcatattggtcagcttggacaacccgagaagcagctattgaacaggataagctactaaaggatgcttcagatgaaatcccaaacactaaatatgctagtgttagcggagttgtaaacatgaatgtgaaagctgcagtgctttttgttgtatttgcttcatgtttcctgtttatgctttacaaattgatgtcgtcgtggttcattgatgtcttggttgttctcttctgtattggtggtattgaggatcaggatgctttaataccttgtactggtgaaaatcatgtcataaggtggttcaagcatgctggagagtcatacatcaaagtacctttcttaggagccatttcatacctgactttggctgtttctccattctgtataacatttgccgttctctgggcagtttatcgcaacgtatcctttgcctggattggtcaagatatacttggaattgcactgataatcacagttctacagattgtacatgtaccaaatctcaagtag

SEQ ID NO: 79570 - DNA, 1134 bp, Glycine max
  Peptide Sequence Number=SeqID_196348
atgtacagctttcaaattgttgctcgttcccctctttgttttaggctaaaaatcaaatcaatatcaaacaggtttttccagcagagattttcagaacctatgcagtgcaggccacaactgaatgggatatccttcagtaacattggccagcagcaaaatcagatgttggcactacttggaaaatggaggtgggagatgcttcagcaaagtaacaagttatggtccaagatactggattccaagtatggtggatggagatcattggtggaaggcagtagaaggaataatgagtcaggttggtggaaagacttaatggaggttacacatgaccaacagatgaattctatcctccaagatggcactacttggagggtgggatgcggggataaaatcaaattctgggaggactcatgggctggacacagacaggctctaaagatgaaatacccaaggttgtataggatatctcttcagcagcataaactcattcagcaggtgggaagtttcaatgactcctcatgggaatggaacctctcatggagaaggtctttgttcgataatgaaatcgcatctgctgcaggttttttggaagaaatttgtcagattacaatccggcgacatatagcagattgttggaagtgggaagcagagcctaatggttgctactctacaaggagtgcatataacatgttacaagaaagttcagtgggagcaaatccggatgaagcactaattcagcaggaggatgcagcccatctctttttcaattataccaaatctctagccttatggtgggaatccttagcgtggactggaatagttggggcattccccataatccctaggtaccattttctgcagcaccaaaatgggatgaatggagggaaaagaaacaataggtggaagtgctggtgggtagccttaacgtggagggctcacaagccatggggctttgatgatgtggaggatgttgacgaagagaaggacaaggaagaacaaaataaaaagaagattaaggaagtgtcacatgaatgctccttggtgaacaagcacaaggccatttggatgacaaagcctgaggagatcacaaaggaggagtattctgctttctacaagagtctcaccaatgactag

SEQ ID NO: 79571 - DNA, 576 bp, Glycine max
  Peptide Sequence Number=SeqID_196349
atgaggtacatgaagcccttgcaattgtttcatgatttgaagaatcagcagcgcggaaggttgcttggtttggatgtcggggataaatatgttgggcttgctctttctgacttcgataacaatattgcttcacctttcagcgttctcgtcaggaagaagacaaatatcactttagtggcttctgattttgagagtctgtgtagtgatttgagcaataaaacttccaagcatgttattggcatctcgtttgacaaacatcaagtgtcttctgatgctatgcaagtgaaggtcttcactgatcacctctgtaaaacaaaaatgcttgaagaatgtggagttgctgttaaagcctttaaacttgaatcattcagttctctccaagactatgctagacaagtttgctgcagtaggaatacttcagctggaggcatgcatcagaaatcacaactagatacctctgaatttaaggttggttggaggacagtaggggaagggaaaagttgctcaatgggagatcaaacatctatcatcaacatcacattcatattttgtagacctgagctgatgtcaatttag

SEQ ID NO: 79572 - DNA, 474 bp, Glycine max
  Peptide Sequence Number=SeqID_196350
tctgagttctgtctgcagcctccaggggatagtccaacaagaaaatcggttttcgattcactcatatcgggttgcattccggttcttttcgatcctttcacggcttattaccaatacccctggcacttgcctcatgatcatgataaatattctgtgtttatggacaaaaaagaggtggtacaaatgaatgtgaatgttgtggagaggctaaccaacatttcttctagagagagggaaaacatgagaaggtatattacatatgaactgttgcctggattggtgtatggggattacaacgctgagcttgacaagtttcaggatgcatttgccattacaatgaataatctgtttgagagggttaacagcgtgaacatcgagaatataccattgcattgcattctcgtgatccttaatctagaggctagtagaactacggattgcggtcctcaagttgttgttctctacttaccttga

SEQ ID NO: 79573 - DNA, 138 bp, Glycine max
  Peptide Sequence Number=SeqID_196351
atggcaaagtcttctactgaaaagaatggactgaagaagggtccatggactccagaggaagatcagaaactcatcgattacattcagaaacatggacatgggaagtggagaacccttcccaaaaatgcagatagttag

SEQ ID NO: 79574 - DNA, 828 bp, Glycine max
  Peptide Sequence Number=SeqID_196352
atggcagtgtctatatccagaaaaagatcaaaatcatctagaaaaccagaggctaaacaatcttacttttgccttaccatcgtatacaactttcttagtagaatttctgctttagtcttcctaataatccttatctacatgtggtcctccttctccaccttaataacaggaaacatcattcatgtttgcttttccacaaggaaggtcaacagcctctattgtctatctgcaggcactcacccctccttggaaattccaacctccacaacaaacaatagtagttctattattactcctggaattgatcagggtaatgcaactaatgaacctgctaagtttccagatatctcatatctggttactactagtagtagagtagatatcaaagatagagatgacaaagttgcaaatgctgttaaggtcgttgaggaacaattgcagctccatcgatcctggaggtcaaagtcaagcaaaaaccaagcaacttgtgatgctcaaggaatatatgtatatgatttgccatccaagtttaacaaggacttggtgggtcaatgtcgcgacatggttccgtggcagaacttctgcggctatttaagtaacgaggggttgggcgagcctatagccaagcttggcaaagggtggtataagactcatcaatactcactagaactcatatttcattcaagggtcatgaagcatccatgcagggtctatgatgaaaatgttgcaaagctcttctatgttccattctatggtggtttggatatcttgcgatggcatttcaagaatgtatcgaatgatgtgaaagacagcttgtctctggaattg

SEQ ID NO: 79575 - DNA, 141 bp, Glycine max
  Peptide Sequence Number=SeqID_196353
atggggtctatgtgtgatgagatgtcatcatcgccgtcatcggtaaagaaacttccgtcagaggttccaaccgggaaggttggaaaacgggtagcagtggcggagaacatgattaatagcggaggagaaaaattcatgtag

SEQ ID NO: 79576 - DNA, 3021 bp, Glycine max
  Peptide Sequence Number=SeqID_196354
atgaacaacttcaagttaggggtagatgtggttagtgctcacaatctattacccaaagatgggcaaggttcatccaatgcctttgtggaactttactttgatggacaaaagtaccgtacgaccatcaaagaaagggatcttaacccagtttggaatgagagcttctacttcaatatatctgacccttctaatcttcactatatggcacttgatgtctatatccactgccacaccaaagctactaactccacttcttttcttggcaaggttagccttaccgggacttcttttgtcccttactctgatgcagttgtcttgcactatccattggagaagcgtggtattttctctcgtgtaagaggagagattggccttaaagtttacatcactaatgatccaaccataaaatcatccattccaactcctgttgttgagtccatgccaacaaattattcaagctcaacacattcagaagttcgagcacctgcaagcacaatgacaaacagtttgccgaatgaaaaggttgagtcaagacacacatttcatcatctccctaacacaaaccatcaccagcaccaacagcactcctctggctttgcagatactcattatgtaacaaagtatgaagctgatgcaatgaaatctgaaccacagcctatgaaactagtacgcactgctacatcagtacaaccagttgattttgcacttaaagaaacaagtccatatcttggtgggggaagagttgttggtggtcgtattgttcataaagacaagactgctagtacatatgatcttgtggaaaggatgtactttctgtatgtcagagttgtcaaggctcgtgagcttcctgctatggatgttactggtagccttgatccatttgttgaggtgagaattggaaattacaaaggtattaccagacacttcgataagaatcagagtcctgaatggaatcaggtgtttgcattttcaaaggaccggatgcaagcatctgtacttgatgttgtgatcaaggacaaggatctcatcaaagatgattttgtaggcattgtgaggtttgacatcaatgaggttcctttgagagtaccaccagatagccctttggctccagagtggtaccgccttgaggacaagaaaggagagaagaataaaggtgagttgatgcttgctgtctggattggtactcaagcagatgaggctttttctgatgcatggcattcagatgccgccactcctgttgacagcacacatgcgatctctgcagtgatgcgttcaaaggtctatcatgcaccaaggttatggtacgtgcgtgtcaatgttgtggaggcgcaagacttggttcctacagagaaaaaccgtttccctgatgtgtatgccaaggtgcagataggaaaccaagtgctgaaaacaaagacagttccagcacgaacactaagcgcactctggaatgaagatcttttgtttgttgctgctgaaccttttgaagaccatttaattatttcagttgaagatcgggttagtccaggaaaagatgagatcattgggaggatcatcataccactgaactccgtggaaaggcgtgcagatgatagaatcattcattctagatggttcaacctggaaaagccagttgctatagatgttgatcagttgaagaaagaaaagttctcaagcagaattcagctccggttatgtttagatggaggatatcatgttcttgatgagtcaactcattacagtagcgacctccgcccgacagcaaagcagctgtggaagccaccaattggggttttagaacttggagtgctgaatgctgtaggactccatccaatgaaaacaagggatggtaggggcacatctgacacatactgtgtagcaaaatatggtcacaaatgggtcagaacaaggaccattgctgataatctgtgtccaaaatacaatgagcaatacacttgggaggtttttgatcatgccacggttcttacagttggtgtatttgacaacagccagctcggggaaaaagctaatggttcttcaaaggacttgaaaattgggaaggtcagaattcgcatctctacactggaaacaggcaggatttacactcactcatatccattgttggttcttcacccaaccggggttaagaagatgggtgaacttcacttggcaatacggttttcatgcacttcttttgcaaacatgctttacctatactcacgaccactgctgcccaaaatgcactacgtaaggccattctctgtgacgcagctagacatgctgcgtcaccaagcaatgaacatagtggctgctagacttggccgggcagagccaccacttcgcaaagaagtggtggaatacatgtcagatgtggactcccacctttggagcatgcggagaagcaaggcgaatttcttcagactgatgactgtcttctctggtgtgtttgcagttggaaaatggtttggtgatatctgcatgtggaggaatcctatcacaacagtgctggttcatgtgctctttctcatgcttgtttgcttcccagaattgatccttcccactatttttctgtacatgttcttgataggggtatggaacttcaggtatagaccaaggtaccctcctcacatgaacacaagaatctcacaagctgaggcagtgcacccggatgagttagatgaagagtttgacacattccctacgagtcgtagcccggacctagtgagaatgaggtacgatcgcttgaggagtgtggctggaaggattcaaacagtggttggtgatttggccagccagggagagaggattcaggcactgttaagctggagagacccgcgtgctacatccatatttattacattgagtctcctatctgcgttggtgctctatgttactccttttcaggctgtggctggtttggcagggttttacatcatgaggcatcccagatttcgccacaggctgccatgtaccccagtcaacttcttccggcgcctcccttcaagaacagataccatgttatag

SEQ ID NO: 79577 - DNA, 1003 bp, Glycine max
  Peptide Sequence Number=SeqID_196355
ggtcgggcacgacggggctctcacctctctgcgcccccttcaggggacttgggcccggtccgccactgaggacgcttctccagactacaattcggacgccgagggcgaccgattttcatggtgggcttttcccggtctcgttgggagcgtgcgtgcacgcaaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgtcgagagtcataatttgagtccttgcgcacgaagcgccggggtttgtgttgtcgcgaggacgaggagcgggcgcacggggcgccgtggtcatcccctccctcccgacggcatcgacaatgatccttccgcaggttcacctacggaaaccttgttacgacttctccttcctctaaatgataaggttcagtggacttctcacaacgtcgcgggcagcgaaccgctcacgtcgccgcaatccgaacacttcaccggaccattcaattcggctaggagcgacgggcggctgaggtctcgttcgttaacggaattaaccagacaaatcgctccaccaactaagaacggccatgcaccaccacccatagaatcaagaaagagctctcagtctgtcaatccttactatgtctggacctgccttgcgaccatactccccccggaacccaaagactttgatttctcatacggtgccagcggagtcttaaagcaacatccgctgatcctg

SEQ ID NO: 79578 - DNA, 1044 bp, Glycine max
  Peptide Sequence Number=SeqID_196356
attggggcactggaggacaggagacaacatcttttgcagggaatacttggaattcaaaaaagctttcgtggttatcaagctcgttgtcattatcatgaacttaagaatggagtgactattttacaatcatttgttcgcggagaaattgcaagaaggaaatatggtgttatggtgaagtcttctatgactattacttttgaaaatattgaggaaatacaggcagccacaacactacaatctgtaattcgtgggtggctggttcggaggcatgctagtggattgcataagtcaaagaaatctcctgaaaatgcaagatctaggcgaaggtcacgtgtgaagatgcctgaagtaaaggatgtgtccagtgagcggggtcagaatctgccttcagctttagcagagctccaaaggcgggttatcaaggctgaagctaccatagagcaaaaggaagaggaaaatgccgaattgaaggagcagctaaaacaatttgagagaaggtggattgaatatgagaaaaggatgaaatcaatggaggagatgtggcaaaagcagatgtcatctttgcaaatgagccttgctgctgctagaaagagccttgcttctgagaatgtcagcggtcaaattgcaagacgtgatgttgcgtcacctttaggctatgattcagaagatgctgcttccatgggatctcgaactcctcgaacacctcatgcaagcacacctttgaagtattctagtagtcttactgaagctggagcagggagagatgttaatggtactttgacttcagtcagcaacctgatgaaggaatttgagcaacgcagacacacctttgatgatgatgccagagctctggttgagattaaaacaggtcaatctgctaacacgaattctgttgaagaacttcggaaactcaaacataggtttgaggggtggaagaaagaatacaaggctagattaagagagacaaaagcaagactacataaatcagaaatggagaaaagtcggcggagatggtgggggaaattgagttctagagcactctag

SEQ ID NO: 79579 - DNA, 2550 bp, Glycine max
  Peptide Sequence Number=SeqID_196357
atgatgataacagcttccatgtcttctttaacgaggagttcgctggaggagatgctggaatcgcttcgccggagggacgaggaggagaagccaaaggacttgccgccggcattgccgtcgcggccgccgtcgagggcgcggttgccgccagggaggaggtcgttgcctaacaacttcaaggtggatggtgagaatggtttgatggggcacagaaggaagggtagttttggaaccaagaaggtgaagttgaatgttgaatccccttatgaagtccaatcagaagagatagtgagtgaacaactatcaccttgtccggtttctacatccgatgatgcgtctgctgggtgtgaagctcctcctcccaccggggagttggaggatgataatgttgtttatttcatcaaaaagaaacttcatgtttggtgtaggcaaccgaaaggaaagtgggagctgggaacaatacagtcaacttcaggagaggaagcatctgtttcactctcaaatggaaatgttatgaaagtatccagatcagagctcctaccagctaatcctgatattttagagggtgttgaagatcttatacagctcagttatttaaatgagccctcagttcttcacaatcttcagtctagatactctcaggatatgatttacagtaaatcagggccaattttaattgcactcaatccgttcaaagatgttcagatttatggagacgattatatttcagcttataggcagaaacttatggataagcctcatgtttatgctatggcagatgcagcttataatgagatgatgagagatgaagtgaatcagtccattatcataagtggtgagagtggatctgggaaaacagagacagcaaaaattgctatgcaatacttagctgctcttggtggtggctgttctggaatagaaaatgaagttcttcagacaaattttatactagaagcttttgggaatgcaaaaacatctaggaatgacaactctagcagattttctagagttgttcaacttgcattgggtgagaggtcatatcacatattttatcaactttgtgctggatcttcatctgatcttaaagaaagactgaatcttagggcggctagtgaatataaatatcttaaccagagtgactgcatgacaattgatggtgttgatgatgctaaaaagtttcataggctgatgaaagcattggatgttattcgaatgtgcaaagaggaacaagagttagtttttaagatgctggctgccatattatggttgggaaatatatcattccaagatactgacaatgaaaatcacattgaggtggtgaatgatgaagctgtaacaaatgctgctttgctaatgggttgcagttcccatgagctaatggaagcattatctacccgtaaaatccaagcgggcaaggataccattaccaagacattgaccttgcggcaggcaattgatgcaagagatgcattagcaaaatttatctatgcaagcttgtttgattggcttgtagaacaagttaataagtcacttgaagtgggtaaacgccgcactgggagatccataagtatccttgatatttatgggtttgaatcattccagaataacagctttgaacaattttgtataaactatgccaatgagaggcttcaacaacatttcaatcggcatctgtttaaacttgagcaggaggattacgaattagatggcattgattggaccaaagtagattttgaggacaatcaagcgtgtttggatctctttgagaagaggcctctgggtctactctctttgttggacgaggaatcaaatttccccagggccagtgatctaacacttgccaacaaacttaagcagcacctgcacgctaatccttgctttaaaggggaaagaggcagggcttttagtgtctgtcattatgcaggggaggttttgtatgatacaagtggcttcctagaaaagaacagagatccactaccatctgattccattcaactactgtcatcgtgtagttgtgaactgctacagttgttctcaaagacacttaatcagtctcaaaagcaatcaaattccttgtatggaggtgctctggactcacaaaagcagagtgttggcacaaagttcaagggtcaattgttcaagttgatgcatcagttggagagcaccacacctcactttattcgctgtataaagccaaatactaagcaacatcctggaatatatgatgaagatcttgtgctacaacagctcaagtgttgtggagttttggaggttgttaggatttcaagggctggatatcctactcgaatgacgcatcaagagttttcccaaaggtacgggtttctgctttctgaggcaaacacatctcaggatccattgagcatttcagttgctattttgcaacagtttaatatccctcctgaaatgtaccaagttggcttcaccaaactgtatcttcgaacagggcagccaaagagccatagaattgggagctggatcatgcttttagggtggcaattgggtccattgtctatgaccctccatatttaa

SEQ ID NO: 79580 - DNA, 363 bp, Glycine max
  Peptide Sequence Number=SeqID_196358
atgggacaggcaaatgcagcgtctggaatggctgtgcatgatgactgcaaactgaggttccaggagcttaaagcaaagcgagtctaccgcttcattacattcaaaattgagcaacaacaagttgtggtcgacaaaataggggaatctacggaaagctatgatgattttcaggccagtttgccagctgatgagtgtcgttatgccgtctatgattttgatttcacaactgatgagaattgccagaaaagcaagatcttcttcattgcatggtactggtctattacaggacatacaaatttgcacttggtcaccagacacttcaaaggtgaggatgaagatggtgtatgcaagttccaaggatag

SEQ ID NO: 79581 - DNA, 1053 bp, Glycine max
  Peptide Sequence Number=SeqID_196359
atgaagccttgcacttcattgttgtttctcgctttgatttccgcgctctcgtttgtggtttctgacatggtgccctcaaacgaagtttgggcgcttaggagcttcaaagaagctgtgtatgaagacccatatcaagttttatccaattgggatacggtggaatcagatccttgtaactggtttggcgtcttatgcactatgcttcgcgatcatgtcatcaagctgaacatttcaggatcatcattaaaggggtttcttgcaccagagctggggcaaatcacctacttgcaagaactaattttgcatggcaacagtttcattggaacaatacctagagagttgggtgtgttggaatctctcaaggtgttggatttgggaatgaatcagttaacgggaccaattcctgcagagattggaaatctaacccaagttgtgaaaataaacttgcagtccaatgggttgactggtaggctacctcctgagcttggaaacttgagataccttcaagaacttcagctggataggaataggcttcaaggacctgttcctgctggtggtagcgcaaattttgcttcaaatatgcatgggatgtatgcttcaaaggagaatgtaactggcttctgtcgttcgtctcagttgaaagtagcagacttctcatttaattttttagttggtagcatacccaaatgcttggagtatcttccaaggttaaactttcaagggaattgcctccagggtcaggatttaaagcagcggtcttctatacagtgtgcgggtgcttcacctgccagtgccaagagccagccagtggtgaatccaaatcaccaacctgctgaatatgtgtccaagcatcacagagcatcgaaacctgtttggcttttggctctagaaatagtaactggaactatggtgggctctctctttctggttgctgttcttgctgcttttcagagatgtaacaaaaaatcatctatcattattccttggaaaaaatctggaagccagaaagatcatacggcagtatatatagaccctgagttgttgaagatgtga

SEQ ID NO: 79582 - DNA, 543 bp, Glycine max
  Peptide Sequence Number=SeqID_196360
atgccagaacgcaaaccagttgttgggttatcatggcaaccacagttgcctattccatcatcattaaaagccactgatgggtctcacaccaaacctcaaactgaggcatcaagcactgttaggaaatccagttcagagctggttgatggcctttttgtccctccaaatgatcccaaaaaattaaacaagttactgagaaagcaagctaaagatactgctgggaaaaattggttcaatatgccagcccaaaccatcacccctgagttgcagaaagatttgaagttattaaagttgagggctgcccttgatccaaagcggcactacaagaaagattctccgttggactttttctcaggcagattaacaaagaaggagaggaaagcaacgcttgcagatgagctgctttctgatcaaaaccttgcagcctataggaagcggaaggttcgagaaattgaagaacaaaatcgaccagctgggaatgaaaagtggaagattaagggtagtaattcccgtaagcgagctaaggaaaggaggatttactga

SEQ ID NO: 79583 - DNA, 348 bp, Glycine max
  Peptide Sequence Number=SeqID_196361
atgagtagtgctaacgtaaaatgcaccaagcagcaggccatggtgtcactcccggttttagcgtaccagcgtgggaccaaaatcaacatacttcgcttacaaaggggcagttcaatgaaagcggccaatgtgttcgtcgaaacatgccatactgtttacaaccgacgctttggtaaaatcccgaggcatgattttgatgttcaccgcccggtggagtatgatgataatctggatctgatattcaccattcgcgagacgcgaaaggtctcaaaggcgctgaccaaacaatgcgataagatgttgtatctgattgaagaaattgaatatagtcatctagccattggttag

SEQ ID NO: 79584 - DNA, 195 bp, Glycine max
  Peptide Sequence Number=SeqID_196362
atgcagggcagtggcacgcatgactcatcagctatagccgtcagtcacccggccaagcagaggctgctgcgcaagacggtgttcacctgcctgaacgattatgaagctctgctggcgaaaggatacggcccgatatttcatccagaaatgttggggattaagcgcggatactgggtgggaagagtgtggaagtaa

SEQ ID NO: 79585 - DNA, 282 bp, Glycine max
  Peptide Sequence Number=SeqID_196363
atgggtgatcaagccaaaagcatgcataacataagcacaaatagaaacattgaacacataaaaacaacttcaaatagatacttttcctctgttcttcattcaacactaggctcacgtcgtctattcaaacctcttcttcattctctgcaattcaggcttaaaaagggttttttgtctgcgaaggcgcgcttagcgcgagtatgtgaaatttggcttagtgccattcttgcactaagcgcagaagagacaatcttctcgctgaatgagctgatgacacactga

SEQ ID NO: 79586 - DNA, 417 bp, Glycine max
  Peptide Sequence Number=SeqID_196364
atgggatcaagtcaaatgccttcgcttaaaaagaggttctatcaagtcaaggtcaagagcctagggaccaccagtctaaaggagttagggcagttaatgggtcagctccagtggcaagcttttcgcaaagcttacggtaaaatcttggacttagccatggtagaagtctccacagaggccattgcctccctcacccagtattatgatcagccgatgaggtgcttcacctttggggacttccagctatcacctatggtagaagaatttgaagagatcataggatgccctctagggggaaggaaaccctacctcttctcaggatattctcgcactgctgatcttcgaaggggtcctctttccgaatgtggatgggttggtggacctagcagcaatcgatgtttttctcgcctatcataa

SEQ ID NO: 79587 - DNA, 252 bp, Glycine max
  Peptide Sequence Number=SeqID_196365
atggggacgaggggttgcatcagctacaatcctgttcttgctataagacaactgggctaccctatgagaggggcgccactagaggatgagctcgtgcctgtcatttcacgaggtttcaataagaccaacgtggagacacttcagaaggtccacaaggcatgggaggtgttgcaaaagaaggacaaagaacttaggggcagtaacaatgggcccatcggtggctaccgtaagtggttgaagccctcgtgcaag

SEQ ID NO: 79588 - DNA, 504 bp, Glycine max
  Peptide Sequence Number=SeqID_196366
agggttgcatactctcgccttcagagggctgcacacccttgccttcaaagggcgacgcgccctaaacttcagagggctgcacgccctcgcctttagagggctacgcgtcctcactttcagtgggctccatatccacaccttaagaggatttaaggcgaccaactgtgcgagcacaaccagagagggaggcaagatttcacccgtgtcgctgcaaagtgacgagggttgcgcccacaagacacccagtggacccggaggagcccaacagggccctggggttttcagctcgggttacgagcctctggtcttggagttgccagctctgattacgggcctctgtcagttctacggagtgcttgtcgcccctagcaaggtcatcaggccccctactaatcgagctttcatcaagaagtactatgcccccaggcaggcgcagggcgaaacaccacagcagcctggggatggccggcagtgggcaatagacgcaccgccaccacctctaga

SEQ ID NO: 79589 - DNA, 811 bp, Glycine max
  Peptide Sequence Number=SeqID_196367
atgtcttccaggaaaagaaagagtggcggttcaaggcccaccactcaatatgatacaagaagattccactcttttgaggcttggaccagatacactgataatgtccagggaagacatatattagctgagaggaaagtggaaatatatcatacagtgctggatgaatttaaggctaaattggagaggcgtaacttccataagcacctcaccaaattagttgacagtagcattgacctagcattggtgaaggagttctacgccaacctctacagtcctgaggggccttcaccaaaacaaggtgaacctttatctgcttactcaagatactgtaggatgcctactgacattaaggaaattgagactgctttgtgcatacccggccgagggtttattttaaatgctgaaggtcaccctaggaagattctcataaaagatctaaccactcttgctcaggtctggagtgttctctcatacttcaacctggctccgacttcccactcctcgaatttgactgtggatagagctaagttaatctttggcctagttactcagctggacatgaatgtcagagctctcatctctggacagatcacatcaatggcccagtctaactcctctagactcgagttccctgctcttatcacagctttatgtaggtccagaggagtcgcttccgacagcttggtctttgaacgtttgagcccggtcattagtttggcctacataaggaaaaactattggaacccggatgatccaacaattattattaggggggccagaagaccaagggcaatgccagctgaggctcctt

SEQ ID NO: 79590 - DNA, 415 bp, Glycine max
  Peptide Sequence Number=SeqID_196368
cacgtaatggattgaagaggacctacgagtttagcacaacaacatttaagttaaatggatttaagtatgaaaacgtgaccgatattcctgaagctatagactggagggtaaaaggagctgttactccaatcaaagaccaaggtgatcaatgtgggagttgctgggcattttcaactatagctgcaactgagggtatccaccaaataagtacaggaaacctagtgtccctttcagagcaagagttagtggattgtgatagtgtggatgatggatgtgaaggaggtttcatggaagatgggtttgaattcattattaaaaacggtggaatcactagtgagactaactacccgtacaagggagttgatggaacttgtaacacaaccatagcagcctccccagtggctcagattaaggg

SEQ ID NO: 79591 - DNA, 255 bp, Glycine max
  Peptide Sequence Number=SeqID_196369
atgaatagcttacttgaattcaaagctactggtataatacaaggaagccttcttaacaacaaagagaagaacaagatgaaggattgcaaaactactagtggtgaggatgtctccttcacctctaggatctcacaatcactcacaaactcatctcaagctctcaaaccagctcttgtttcaagctctggtctctgcagatcttcacacatcaaaatctctcaaaactctctggaacttggacctttctctctctag

SEQ ID NO: 79592 - DNA, 165 bp, Glycine max
  Peptide Sequence Number=SeqID_196370
atgggtgtggatgacaatgtttgtctccacgcgccattagacttgattgtctccgaaatgggtgccgatgaccatgatttgtcttcgggtgccatcagacttgattgtctctggatagcaaaaagggtgtatgatgcaatcctactccgcaagggcattggatag

SEQ ID NO: 79593 - DNA, 1050 bp, Glycine max
  Peptide Sequence Number=SeqID_196371
atggcggaggaccggagtgaggcgagtgattacagttcggaggacgaaggaaccgaagattacaggcgtggagggtaccatgcggttcggattggtgacactttcaagaatgggagctatgtggtgcagagcaagcttggttggggtcatttttccactgtttggctcgcttgggacactcacaaatcgcgatttgttgccttaaaaattcaaaagagtgctcagcattacactgaagcggcaatggatgaaataaagattcttaaacaaattgctgacggggatccagatgacaagaaatgtgttgtaaagcttttggatcactttaagcattcaggacctaatggccaacatgtttgtatggtttttgaattccttggggataatcttctcacacttatcaagtatagtgattatcgaggggttccccttcccatggtcaaggaaatttgtttccatattttggtgggtttggattacttgcatcgtgagctttctgtaatacacactgatttgaagcctgagaatgtcttgcttttgtctccaatcgatccatctaaggatcctagaaaattaggcattccacttatccttccaaacacgaaggataagactgtgaccaagaatggggcaacaatagcaaataaaagtttgaatggagatctgaccaagaatcagaaaaagaaattgcggaaaaaggctaaaaaggctgctcaaagctgtgctgggagggaaaatgctgaggaagctgaggaggattccaaagcatctgatgagcaagatgattgtagtaatgatgtgaaacctagtgtagaatctggtgaagttaaacctaatagtcctgtgaggaaagatgaatcaacaaagacttctgaaaataaagatattccacaaggaagtcatggtaataggagaggtagccgctctacaagaaagaagttgcttgcagctgttgatcttaagtgcaagctggttgattttggtaatgcttgttggacctataaacaattcacaaatgatattcagacaaggcagtataggtgtcctgag

SEQ ID NO: 79594 - DNA, 1245 bp, Glycine max
  Peptide Sequence Number=SeqID_196372
atggcgttattttggccgcacgtgctgcagttccgttctcaaccttcgctcggacatgctaactgcgtgttcttctccgatctcactgaatcccgctctgtagaactttcatgcactgattccttcactctggttcgccggtgcaagatctccggtccggctccggcggcgctgaaaccggtgaaatgcctcggcagatctacgggggagaagcaatggagtgacgccgaaactgccgtatccgacaccgacgaagttgctgatgaaccgaatgaccggaaccaaacttctgttccgacaaatggtcgcgttgagtcgcagaggattgccaccacgtcttccggcgactctctctctctcggaattcgagaaccggttgttgaagtgaggtccaatgggaaagtatcaactagaaaaatcaacaggagacaattgttgaagtcaagtggtcttcgtccacgggacattcgaagtgtggatccttcattgtttatgacaaattcaatgcctgctttgctggtccgggagtatgctatacttctaaatctgggttcactacgagcaatagcaatgcaagattgtgtacttatatttgacaataatcgtataggagggaaagcttttctggagacattgctacctcgattgaaccccaagaacaacaatggagggccatcaatgccatttgaacttgaggttgttgaagcagcattgctttcaagaatacagcgattggagcagagattgatggacttagaacctcgtgtacaagctcttcttgaggcattgccaaatcggttaactggtgacatattggagcagcttcgtattagcaaacaaactttggttgagttaggttctaaggcaggagctctcagacagatgctgcttgaccttctggaggatccccatgaaatacgccgtatatgtatcatgggaagaaactgcacacttagtaaaggaaacaatgatatggaatgttcagtgccttttgaaaagcagaatgctgaggaggaggaggaggaaatcgaaatgcttctggaaaattatcttcaaagatgtgaatcttgtcatggtcaagctgaaaggcttcttgattctgcaagggaaatggaagattctatagctgtcagtttgaggaagttttgcgctcttctaaagccacgaatataccaaccatgggattgtgtttggagtgccatctttggatgcaatgtggtagcacagtctcataattcacattag

SEQ ID NO: 79595 - DNA, 1080 bp, Glycine max
  Peptide Sequence Number=SeqID_196373
atggcggttccggcagatccaatcattgaagtagaagaagtagaggaggatggtcccacgcaccaccctcctgctccttcacacgagttttttgatttatcaacgacagttgatccgagttacataatctccttgataagaaagcttctgccgttggattctgcttctcggagaagcttgagtgaagttgcttcacatggcactaaccaaggagaagaagaaagaggggctgcgccctcttcgtctgtttcgagtgatgaaaaccttaaatcgtccaagaataaatctgagaatatggatgttgatgtttccggtgaaatttcgcgtggagaatgtcaagataccggtgatggaattgaacattccagtgtctcggttggagaagatgcgtgggaggaatatggttgcattttgtgggatttagctgccagtaaaacacacgcggaactcatggtggagaatctaatacttgaagttcttttaggtaatctacttgtttgcaaatcagagcgggttactgaaattagcataggaattattgggaaccttgcctgtcatgaagttccaatgaagcatataatctcgacagaaggactgattgagataattctggacaaattgtttatggatgatcctcaatgcctatgtgaaacatgccgaaaatacattgaaccttcagcttttagagaagctatattagaaagtcagcagaaagttgtggatgctatccttccacctatgatgaagcttggtttggcaaatatattgatcagtctcttgacttttgagatcagcaaattaatgacagaaagaatacctgaaaggtactcaattctcgatttaattcttcgtgcaattgaagccctgtctgttatggatgatcattctcaggaaatttgttcaagttcagagctctttcaactattatgtgatctggttaagttcccagataaagttgaggtacattgttatgatcatccataccaccgcgcaccacaagaccttccatctgatttgcttactccgattgactcccacaagatgatgttgacaaaaatggtcgctgatagaatgaggtag

SEQ ID NO: 79596 - DNA, 993 bp, Glycine max
  Peptide Sequence Number=SeqID_196374
atggggttttctagttatttcttgacttccttgcttctggttgtagtgttcaatgtggctaaagggcagcctctggtccctgccctgttcatatttggggactctgtggttgatgtgggaaataataaccacttatacaccgttgttaaagcaaacttccctccttatggaagagacttcaagaatcacaatccaacagggaggttttgcaatggaaagcttgcatcagactacacagctgaaaaccttggatttacctcttacccaccagcttacctcaacttaaaggccaaaggaaataacctcttgaatggtgccaactttgcctctgctgcttcaggctactatgatcccacagccaagttatatcatgcaattccattgagccaacagctggaacactacaaagagtgccagaatatattggtgggaacagtagggcagcctaatgcttcatcaattatatctggtgctatatatctcatcagtgctgggaacagtgactttattcagaactattatataaatccactgctttacaagaatttatatgcacttggagcaaggaggattggtgtgacatcattacctccaatgggttgtctgccagcagccatcactctctttggctctgatagcaaccgttgtgtggttaaactaaataatgattctgttaacttcaataagaagctaaataccacatctcagagcttgcaaaaatctctttcgggtctcaaattggtcatccttgatatctaccaacctctctatgaccttgtcactaaaccttctgaaaatggattttttgaagcaaggaaggcttgctgtggaacaggcttgctagaaacatctgtattgtgcaatcagaagtccataggaacatgtgccaatgcatctgaatacgtattttgggatggttttcatccctctgatgctgcaaacaaggttttgtcagatgacttgttggctgctggcatctctctcatatcctaa

SEQ ID NO: 79597 - DNA, 183 bp, Glycine max
  Peptide Sequence Number=SeqID_196375
atgacgcaggatcacgagggcagaaacggtcgtggtaaattttgtttggttattctttcggggttgtgcacagcaactttgcccccctacaggatcatgttcaatcacaacacgcgtggctttgatttccttgttgctttaatgagggcgagtggctgccacttgctgtcgtttggtgagtag

SEQ ID NO: 79598 - DNA, 2043 bp, Glycine max
  Peptide Sequence Number=SeqID_196376
atggctcctgctgggaagctttctgggtttcgtcgagaaggcagtgactggttctgcaatgggggactgccaagtgatataactgtttccgtcgatggtgtcactttccatcttcacaagtttcctcttgtatcaaaatgtggaaaaattgctagagcacatgaagagtccaagaataccaatgagactctgaaaatggtgctggaagaatttcctggtggtcctgacactttcttaattgcagcaaaattctgttatgggtatcgagtggaactgacagccagaaatgtagtatcggtccactgtggtgcagaataccttgaaatgacagatgaatttggagaaggcaacttgttgtcaaaatcagagagttttttccataaaaacacactgcgtaactggaaagattgtattttggctctccaaagttctgagcctgttctaccaagagcagaaaagcttcatttagtgggcaagtgtttgaatgctctatccatgatggtttgtacagatccaagtctgtttgggtggcccatgatgatgtatgggagttttcagagccctggtggaagcattctttggaatggtataaatactggtgctagaattcggagctcagaatctgattggtggtttgaagacatctcatatctcagtgtgagtttgtttgagaggcttattaagacaatgcaagcgagaggtataagacctgaaaacttggcaggtgccataatgtactattctagaaagcatttgccgggtctaggtcggtggcagggtggacaaggtggcaagaccagaacagttgcaagtttcagcttgacgccagccacagttgatcagagggttctgttggaaagcattgagaaacttcttcctgacaagaagggaaaatcttattgtcgattcctgctcggacttcttcgtgtggctttgatattgaatgtcagtcaaacctgcaaggattctttagagagaagaatagggatgcaattggaacttgcaactttggatagtcttctgattcctacttattcggattccgatgcattatataacactaactgtattgaacagattgtccattattttgtatctacagaatcaaatttaactcccttttctccttcatcacttgacctgcaagcatcagcatcaccatcatctgaatcgttaagaaaagttgccaagttgatagataattacattgcagaaattgcttctgatgttaatttaaaaccagggaagatacgcaaacttgctgaggccctccccgagtcgtcaagattattgcatgatggcctttacagggcattggacatatatttcaaggctcatccttggctctatgatagagagaaggaagaactatgcaacatcattgactaccagaaactctcaatccatgcttgtgctcatgcttcccaaaatgacaggttacccctcagagttgttcttcaagtgctcttctttgaacaactgcatttgagaacagcattaaccagatgtctcaatgcattggacggtgaaattgctccggcagctcctgttcctataactgccctgggcaacacggcaggtgaaattgtacaaagagatggatgggtgactgttgtgcgtgaaaatcaggttttaaaggtggatatggataggatgagttctagagttggagaacttgaagaagagtttggtaaaataaagcaagaaatgaaaagtgcgacaaaatctcacagttcccgaagctcacctcggttggttgccaggaaaattgggtgtaagcttgttccacaaccttcagatgcgcaaccagaatccctcaaccacaccggatccacaccaagagcatccattgaactgaaagatgttgttttagacccctttgtgaagaacattattgccatcgaagaaagaatcatccaagttccacctagtgcagatgcaaagctgatgcacaaagtcgctttggccgagtggttaaggcgtgtgcctgctaagtacatggggtttccccgcgagagttcgaatctctcaggcgacgcttga

SEQ ID NO: 79599 - DNA, 543 bp, Glycine max
  Peptide Sequence Number=SeqID_196377
atggaagctgtttctcttatatctgccccaaagtatcctgaaaaacaggttgggtacattgtaacatcaagtttgcttaatgaaaatcatgactttctcaggttggctataaatacagtgcgcaatgatatcattggtcgtaatgaaaccttccagtgtctagcattgactatggttggaaatattggtgggagagaatttgctgagtccttagcacctgatgtacagaagttgttgatatcgagcagctgcagaccacttgttagaaaaaaagccgcattgtgtttgctgcgactgtacaggaaaaatcctgatgttgtcaatgtagatggatgggcggatcggatggcacaacttctggatgaacgagaccttggtgttttgacatcttctatgagtcttcttgttgcattagtatcaaacaaccatgaggcatataggagttgtcttcctaagtgtatcaaaattttagaacggcttgctaggaaccaggatatcccacaagaatacacttactacggtatcccatctccctggcttcag

SEQ ID NO: 79600 - DNA, 1701 bp, Glycine max
  Peptide Sequence Number=SeqID_196378
atgagggctcttcaatattttcctaccattgaagatcctaatgcaagaaggtcattgtttgaggtcttacaaaggatactgatggggactgatgttgtaaaaaatgtgaacaaaaataatgcatcccatgccgttctttttgaagctcttgctctggtgatgcatcttgatgctgaaaaagagatgatgtctcaatgtgtggctcttcttggaaaatttattgctgtccgtgaaccaaacattcgatatcttggcttggagaatatgacaagaatgttgatggttactgatgtacaagatatcattaaaagacatcaagctcagattattacctcattgaaggatcctgacatcagtattcggaggcgtgctctagatttgctttatggcatgtgtgatgtttcaaatgcaaaggatatagttgaagaactactgcagtatctcagcacagcggagtttgcaatgcgtgaggaattgtcacttaaagcagctattcttgctgagaagtttgcaccagacctttcatggtatgttgacgtgattcttcaattaattgacaaggccggagattttgttagcgatgacatatggtttcgggtggttcagtttgttacaaacaatgaagacttacagccttatgctgcagcaaaagctcgagaatatcttgacaaacctgctatacatgagacaatggttaaggtcagtgcatatatacttggagagtttggacaccttctagcaagacgacctggatgcagtccgaaggaactatttagcattatacatgagaagcttcctactgttcttctaatccatttgctcatctttagatatgaaagctcaattgaagtcgaaatacagcaaagatctgttgaatattttgcattgagtagaaaaggtgcagctctaatggatatattggccgaaatgcctaaattccctgaacgacagtctgcattgatcaaaaaggctgaagacactgaagtcgatacagcggaactaagtgctataaagttacgagctcagcagcaatcccaaacatcaaatgctttggttgtaacaggccaaagtcatgctaatggaactccacctgttggccaacttagccttgtaaaggtgcccagcatgagtagcaatgcggatgaggcagatcaaagattatcccaggaaaatgggactttgagtaaagtagattctcaacctccctctgcagatctccttggtgatctcttgggtccacttgctattgaaggccctcccggtatcagtgtccaccctcagccaagctccaattcaggattggaaggaactgtagttgaagccacggccatagtacctgctggagaacaggccaattctgtgcagccaattggaaatattgctgaaagatttcatgctttgtgcatgaaggatagtggtgttctatatgaggatccttatattcagattggcattaaagcagaatggagagctcatcaagggcatcttgttcttttcttgggaaacaagaatacttctcctcttgtctctgttcaagctttaatattgcatcccacgcatttgaagatggagctgtctctagtaccagaaactatacctccccgggcacaagtgcaatgcccacttgaggtcattaatctccacccaagcagggatgttgccgtttctttgacttctcctacaagtttggtaacaatatgg

SEQ ID NO: 79601 - DNA, 210 bp, Glycine max
  Peptide Sequence Number=SeqID_196379
atgaaggtgttggagaaaagggcgttggatgttgaggcttcgaacaagcttaataaggaggaagtggaatggttggaagctactttggccaccgccgagagggagaggaatgctgaaaaggaggagaggattgggccaactacccctcttggtgaaacccaaatgactaattcgactgaggaggatgtggacgaggcccctcgggggtga

SEQ ID NO: 79602 - DNA, 3372 bp, Glycine max
  Peptide Sequence Number=SeqID_196380
atggcgatgttagaatattggaatatttcagaaaagttcttacccatttgtgtcagtagactaactcctatggtcgaagaagagcataaagctgttagttcggtgaaggaagaatacagtttaatgtttgggaatgggatttgtggtgataatttggtgccatctcttgatgcttcattggttacaactcgaagtcctgctcctggaagcagtggcaatgcaagaactactgtgaatctgaagcttaatgaggaaactgcaatggattcgactgtttcaactgttaaccatcatcactctgacccaaagtgccaaaattctgttaataggtcagctgcagtaagccctgtcaagtgctccttggtaagcagacaatttaataattatgggcacgcaaatgacgtagggttgcctatgaatttgtctttgcaaactaaaggcgaccaatctggttttggaaagtgcaaaggcagtttaactaatgattttgtgtacatgggttgctcctataaaccacagtcatatattaattactatatgcatggtgatgttgctgcgtctgctgctgctaacctggccgttctttcttcagaggattctagatcagaaggtcatgtgtctggcaacttggggaaagcaacatctggaaacacttatttgctagcaaaagcattctcccaaacagcttcacgcttcttttggccaagttctgaaaagaagcttgtggaggttccaagagagaggtgtggctggtgcatttcttgcaaagcctctgtttcaagcaagaaaggatgcatgttaaatcatgctgctataagtgccaccaaaagtgcaatgaaaatcctttctggtcttgctcctgtaaggagtggagaaggaatcatccctagcattgcaacatatgttatgtatatggaggaaagtttacgtggcttaatagttggaccctttctgagtgaatgttatagaaagcattggcgtaaacaagttgaacgagccaaatcatttagtgatataaagccccttttactcaaacttgaggagaacattcgaacaattgctttttgtggagactgggtgaagttgatggatgattggttggctgaattttctacaatgcaaagtgctacatgtactcttggaacaacacaaaaacgtgcaacttgtgggaagcgtaagaaacagttatctatcaataaagttacagttggtggttgtcaggaaaattttgcatggtggcatggtgggaaatttaccaaatctgtatttcagaaagctgttttgccaaaatccatggtaaaaaaaggagcccgccaaggtggtttgaggaaaatttcgggtatattctatgctgatggctctgagattcctaaaagaagcaggcagctagtttggagagctgcagttcaaatgagtaggaatgcatctcagctggcacttcagcatgttggatttggcaataacttgatgatacctgattatttgcatcaggtccgatatctagattttcatatcagatggagtgatctgattcgtcctgagcataacctcctggatgtgaaaggtcaagatactgaagcttctgcttttaggaatgcaaatattcgtgataaaaaatttgcagagggaaaatttttgtacagagtagcctttggaatccagaaacatcttccttctcgggtaatgaaaaatgctgaaatagagcaaggtcccgaaggaatggaaaaatattggttttctgaaacacgcattcctttatatttggtaaaagagtatgaagtacgtaatggaaaagtgctatctgagaaagagtacatgcatattacatctcatatgcacaaaaggcggttgacagctacctacaaggacatatttttttaccttacctgcaagagagacaagttggacatgttatcatgctctttctttctaaggccacagtttttctcttggtttaatttcaggaatgctctcaagtgcagtgcttgtgaaggttattgtcacatggggtgttccgtgagttcgacagtctctacatgtgaagaagttgagttcttggccacatgcaaacaatgtcatcatgccaaattacttactcaaaaacagtcctgttatgaatctccaactagtcccttacttttacaaggacaagaacgtagcacttcggcagttctgaaggggccaaggcctaatggtgatggtcaaggattgatgtctgctaagacaaagaatagtcgacttgacatgaaacgagttgcttctgatttccctttggaaacaaaaggccgtagcagaagttgctcttggggtattatatggaaaaagaagaataatgaagatacaggctttgatttcaggctcaagaacattcttctaaaggaaggttcaggcctgcctcaactggatcctgtttgtcgtttgtgccataaaccatatagatctgatctaatgtatatttgctgtgaaacatgcaaacattggtatcatgctgaagctgttgaacttgaagagtccaaactttttgacgtgctgggcttcaaatgttgcaagtgccgcaggataaagtcgcctgtgtgtccttactctgatttgtacatgatgcaagggggcaagaagttgctcacaagggcttcaaagaaagagcactttggggcatattctgattccggtacacctatcgacatgagaacatgtgagcctgcaactcttatctatcctgcaggggatgtctctagacaagacaatgatcctctgtttttctccctttcaagtgttgagctgattacagaactccagttagatgcagatgatgcaggtaatcttcatgctgagttttcaacaagcaatgcaatggtgtccaaatctgtaaaagatttatcacctgtagaatatggctctgcggactgcaatcttctgaataactctgaaattgtaaattttgatgaattggtggattttgaacctaatacctacttctctctgactgaactgctccactcagatgataatagtcaatttgaggaagccaatgcatctggggacttctcagggtatttgaaaaattcttgtacattaggtgttcctgaagaatgtgggactgttaatttagcatccaactgtggatctacaaattcgttacaaggaaatgttaataaatgtcggcaatgttcacaaaaggaaccggcccctgatctctcttgtcagatttgtgggatttggattcacagccattgttcaccttgggttgaatcaccatctcggcttggtagttggagatgtgttagagttctcttgggtatggtggtgttgagggatgcggtcatttccggggatggtgagagcatacaaactgactctcaatttcagcattaa

SEQ ID NO: 79603 - DNA, 1407 bp, Glycine max
  Peptide Sequence Number=SeqID_196381
atggaacctcctgtcgtgagatccaggggccgcccacgcaaacggaggagagaagacgaagcaaccgtcactggtgacgcgaaaacgcttcccgaggcaaagaagacgacgccggttgcattgattggacgatacgtgctaaaagagtttcgaagaaacacggttcttctaggcaaagtcgcgcgttatgttagtggactgtacagagtcgtatatgagagtggcggtttcgaggatttagatagcaacgagattcgtaggatacttctccttgatagttatttcgacgacgatttgattcggaggaaggttgaattggaggaatcggtgttgccgaagatcacagcagaggaaccggagaaaggttcgagcgaattgcaaggtgaattatcggttgacaatgaagaggaacgagctgagacggatgatgatgaggccagggattcgagttccggtgcggaaatgccggaaaaggcgataccgtcgccgctgatgctgccgccgtcttccggaacaattggcgtgccggaaccgtgtgttttgaatctcttttcggtttacggatttttaagatcgtttagcattcgcctgtttcttagtccgtttactttggacgagtttgttggtgctttgaactgtaaagtttcgaatgcgttgcttgatgcaattcacgtttcgctgatgcgtgttttgaaacgtcaccttgaaaacatttcaccagatggctcgcggcctgcaacaaaatgccttaggtgcagtgattggagtttggttgatgctttgacttggcctgtttttgtgtttcagtatttagcaatttttggatacacaaaaggacctgagtggaaaggattttatgacgaaatcttttatggcgagtattatttattgcctgcaagtaggaaattgacgatattgcaaattctctgtgatgaagttttggcgtctgaggagctaaaagctgaaatgaacatgcgtgaagaatcagaggttgggattgatcatgataatgaagattgccttcctgctgaaaatgggcctagaagagtccatccaagatattccaaaactactgcctgcaaggatgctgaaactaagaagtatgtttcagaattgaatgctgaggaggatgatgttgatggcaatggagatgaatgtcgcttgtgtggcatggatgggaccttgctttgttgtgatggttgtcctgctgtttatcattcaaggtgtattggtgtgatgaagatgcatataccagaaggggcatggtattgtccggagtgcaaaatagatatgattgggcctactattgcacggggaacatcacttaaaggggctgaagtattcggaaaggatttgtatgggcaagttttcatgagtacttgcaaccacttactggtgtatgtttaa

SEQ ID NO: 79604 - DNA, 159 bp, Glycine max
  Peptide Sequence Number=SeqID_196382
atgaaaaatgacacaggacacgtaggtgcgattaatacgagcgccataaaacacatggcgggaaggcaaggcaagattttccttcttcctatcttttttccaaacccttggcgcgaaatcaggaacttagggttagggttccgatggggagcaaggtga

SEQ ID NO: 79605 - DNA, 1737 bp, Glycine max
  Peptide Sequence Number=SeqID_196383
atgacatgtttgtccacgtgtaaagggaggactataagttccggcgagaccgtggttttcaagtttccggcgaagaagctctccgcttcgccctctccggggaaggggttcgggcgggcagcgacttgttcggagatagttcgattctccacggaacaagctggggagattggtagaataccaaacgaatgggctcggtgtcttttgcctctcgtgcgggatcataaggttaggattgaggggcagtgtaaatatgcgcctaaagttttgggaatcatggactccattgttttgtcagtgagtgtatttatcaatagttcgatgtttggtaagcatcaccaggtttctctcaaggatgctgccaactccactgatgaatcggcggagttaactcctagtgatttctattccaacaaacgtcctctcactcaaagggagagatattctcttcaggtcacattaccatgttccaagtctgagcatccttctcaaaatggtcacgagagtgacaatgaggattccatttctgaaattgatgttgagaacattgttggtgttggatcgagctcagagttagaggaaatggacccccctggtaatcttatgtgtgaactgcggccctatcaaaagcaggcgctttattggatgatccagatggagaagggacaatctatggacgagacagcaacaaccctccatccatgttgggaggcatatcacctggctgacaagagggagcttgttatttatttgaatgcgttttctggtgaagccacaatagaatttcctagcacccttcaaatggccagaggaggaattttggcagatgctatggggcttggaaagaccatcatgaccatatcccttctcgttgcccattcaggaaagggtggatcaataggcagtcaacccataacccaatcctttattgaaagtggtgaagttagtgatacagtgcacaaattttcaaacatacccaagaaggcaaccaaatttgctggttttgataaaccgatgaagcaaaagaatgctctaacaagtggtggcaacttgataatatgtcccatgactcttcttgggcaatggaaggcagagattgaaactcatgcacaccctgggtctctgtctctatatgttcactatggacaaagtaggccaaaagatgcaaaaagtctcgccgaaaatgatgttgtaattactacatatggaattttggcctctgaattttccagtgagaatgcagaggataatggtggactcttctcaattcggtggtttagagtggttcttgatgaagcacataccataaaatcttctaaaagccaaatttcttttgcagctgctgctctaatttctgacagacgttggtgtctaacaggcactccgattcagaacagccttgaggatatttacagtcttctgcggtttctgagaatagagccttggggtcattgggcctggtggaacaaacttattcaaaaaccatttgagggtggtgatgaaagagggctgaagttagttcaatcaattttgaagccaatcatgttgaggagaaccaaacatagcacagatcgagagggcaagccaatcctagttctccctccagctgatacgcaggtaatttactgtgaacccacagaagctgaaaaggacttctatggagccctattcaaaagatctaagtttttcaccttattttttggcactgaaacaaaccacattgatccaactcgttga

SEQ ID NO: 79606 - DNA, 723 bp, Glycine max
  Peptide Sequence Number=SeqID_196384
atgtctactcaatcaggaaaatcatcaaatgggccagaaaaagattactctttaataggtgacacaacaaatcgcttatttggaatctttaatgccattcccatcattgccaacacttatggtagcggaatagttccagaaattcaggcaaagttagcacccccggtagaagggaaaatgctcaaaggactgtctatctctggcttgtgggcatttggatatcaagctgcaggcctcatttttagcaacttcatagatgattacagcaagcctttggctcccaagtggcttatttatttgcccaacatttgcacaatagctcaattattagctaatggtgtggagtacttgcagcctacaaatgtaatcctagagcaaatatttggagacccagagagcactgagttttctcctcgcaatgtaattccaagattggtttctcgttcatttgttgtaattacagcaactactatagcagcaatgctacccttttttggggacatgaactcgctaataggagcattttgttatatgccacttgacttcattttgccagtgattttcttcaatctgacatttaagccatccaagagaagctccattttctggttgaattcaactattgctattgttttctcgacattgggagctatggcagcggtttcaacagttaggcagataattcttgatgccaaaacttatcaattattcgctaatgtataa

SEQ ID NO: 79607 - DNA, 651 bp, Glycine max
  Peptide Sequence Number=SeqID_196385
atggaaaagctttgtgaatttttggccactcttgtgttccttggtatattgtttcatggagaaatggtatctgctttgaggactaaagatggatcagaagaatggggctatgtacaagtcagacccaaagctcacatgttttggtggctatacagaagcccctacagagtggacagtccatccaagccatggccaattattctctggttgcagggaggacctggatcttcaggagttgggtttggaaactttaaagagattggtcctttggatgctaatttgaagccaaggaatttcacatggttgaggaaagcagatctgctatttgtggacaatccagttggaactggctacagttttgtggaggattctaggctcttagttaaaacagataaggaagcagccactgacttgactacattgataactaagttgttcaacagtgatcatagcctccaaaagagtcctctcttcattgtggcagagtcttacggtggaaaatttgctgtcactcttggattatctgttaccaaagctattcaaaaaagaaaattaaagcttaaactcggaggtgtggtgttaggagacagctggatctcccctgaagattttgtggcaagtacaagaactgttgcagccattagtttataa

SEQ ID NO: 79608 - DNA, 528 bp, Glycine max
  Peptide Sequence Number=SeqID_196386
atgaagctgaaattattcaaagaaatatcaatgaggcgatactccaagcatcttacttcaactagatattctcctggtgttagtggtgatctttacagcttattaaatggtgtcataacgaagaagttgaagatcattcctgaaaaaattagatggtttgagcaatcagataatgttttcacaaatcttgaaggcgattttatgaagccaagaattgctgaggttgataagctcctagctcttggggtcaatgtgactgtgtacaatggacaagtcgatctcatttgtgcaaccaagggaacagaagcttggcttaagaaactaaaatgggcagggcttccaaactttttggggaaagacagaacccccatcttctgtggaagtgacagaaagaccaaaggctttttcaagtcatataaaaacctaaacttctattggatccttggagctggccattttgtacctactgatcagccttgcatagcactaaacatggtgggtgcaattacacagtcacctgcggtttga

SEQ ID NO: 79609 - DNA, 1560 bp, Glycine max
  Peptide Sequence Number=SeqID_196387
atgcagttgaacaagcgggtgacggaagtaaagggtctttttgttcaagaggcaagcgttttgcaaaaactagagttggctgattggatccaaaagctaggccttgccaactactttcaaaaggatatcaacgagtttctcgaatctatacttgtctatgtcaaaaacagcaacattaatcctagcatagaacatagtttacatgtatctgcactatgcttcaggcttttaagacaacatggatatccagttttgcctgatactttaagcaactttttagatgaaaaaggtaaagtgataaggaaaagctcatatgtttgctatggtaaagatgttgtggagcttcttgaggcctcacatttgagcttagaaggagaaaagatcttggatgaggccaaaaattgtgccataaattctctcaagtttggtttctctcccagttccatcaacatcaaccgacactccaatctggttgttgaaaaaatggtccatgccttggagcttccatcccattggagagtacagtggtttgaggtcaaatggcacgtggagcaatacaaacagcagaaaaatgtggatccaattttacttgaattgactaaattaaatttcaatatgattcaggccaaacttcaaatcgaggtcaaggatttatccaggtggtgggagaatcttggcataaaaaaagagttgagctttgcaaggaataggttggttgaaagcttcatgtgtgcagcaggagttgcttttgagccaaagtataaagccgtcagaaaatggctcactaaagttattatttttgtactaataatcgatgatgtttatgacatacacgcctcatttgaagagttgaagccgttcacattggcatttgagagatgggacgacaaagaacttgaagaacttccacaatacatgaaaatttgcgtccacgcacttaaagatgtcacaaatgaaattgcttatgaaattggtggagaaaataactttcactcggtgttaccttatctaaagaaagcgtggatagacttttgcaaagcattatacgtggaagcaaagtggtacaacaagggatacattccatcgttggaagagtatttaagcaatgcttggatttcatcttcgggaccagtgattcttctcctttcatattttgctacaatgaatcaagcaatggatatagacgattttctacacacatatgaagatttggtctacaatgtatctctcataattagattgtgcaatgatttagggaccacagcggctgaaagagaaaagggtgatgttgcttcgtcgatcctatgctacatgaatcaaaaggatgcttcagaggaaaaagcaagaaagcacatccaagacatgatacacaaagcatggaaaaagataaatggacattattgctccaatagagttgcttcagtggagccatttcttactcaagctataaatgcagctcgtgtggcccataccctttatcaaaatggcgatggctttggtatccaagaccgagatatcaagaaacatatcttatcactggttgttgaaccccttagatag

SEQ ID NO: 79610 - DNA, 252 bp, Glycine max
  Peptide Sequence Number=SeqID_196388
atggaaaaggaaatgataacaatgatagtagacacaatacctatgttctactatgagaagatgatgggatacatgcctttgagttttgcgaatttagtgtttgctggcgagaggattgaagtgggtctgagaagtggaaaatttgattatcctgctttgatgaattggaagcctggggaaaatggagagaataagaaggagggagaaacccatgttgtgactgttgttcctacacggccaaattcccactag

SEQ ID NO: 79611 - DNA, 339 bp, Glycine max
  Peptide Sequence Number=SeqID_196389
atgcattttgcggagcacgtactacctgcgggtgagctttgtctagtgcctgggcaggcaggtgaccagctgagagatgcaccagctgtagaccctgaggagtacatacagccgcccagcccccaggatccagtggcatttgacccccctccacatgtggatgattacaacggatatgaggcaattgcacagaggttggagcgtgtgctcaaccttaggatggtcactgcaggcacagagttatatgagattgtgcaagactgcctgacgatcgccagaaggggagctagtgctgatggaagtgtcagggctcgtcaaagacgccgcacggagcattga

SEQ ID NO: 79612 - DNA, 426 bp, Glycine max
  Peptide Sequence Number=SeqID_196390
atgccccgtactcatgacgcgatcctgtattacaatgggaaatggaacatgccaccgcagaacaaatttgttagatgcgcgttcacaggaaaaaatcctaagaaatttcaaattccttcaacatgtaccatcgatgaactgaagaatttaataaagcaagttgcacctaaagggattccccctcttggaattcacgaatcacaaacggtaagacgattgtttttccgccaaccagctcaccttgagtattcagatacgcttataaaatatgatataaatgagctgaggaccaacgaagaactgctgaaggtgttagtacaatctaactactggaaaaaatatggaccaatagaaattttagctgtctttgctaaatatgttgtgacaattgaagatgaggtcactgggacatcgctaaacaactga

SEQ ID NO: 79613 - DNA, 315 bp, Glycine max
  Peptide Sequence Number=SeqID_196391
atgcagacaacattaccccagctccttgcagtaggaaaaggtgatgaggacatgaccaagagcaagggcaaggatccacttgaaggacttggagggcctatgacaagggctagagcaaggaaagccaaggaagctcttcaacaagtgctttccatactatttgaatacaagcccaagtttcaaggagaaaagtccaaggttggctttaatgggtttagttcaagttgtactaagggcccaattggcaacctaggcaccagccttttgggagaccaaatggtggctgacttgttggctgttgggggtgacttttag

SEQ ID NO: 79614 - DNA, 138 bp, Glycine max
  Peptide Sequence Number=SeqID_196392
atggcggcgtcgtcgtggattctggcaccatgctcagtttctcgcggagccggcttacggaaagatcctcgcggcgttccggctacgcgtcaggcttccagcagtggagagcgcagccacgctcaggtgcctcactga

SEQ ID NO: 79615 - DNA, 357 bp, Glycine max
  Peptide Sequence Number=SeqID_196393
atggttacttccatgcttcaacttgacttgatgaactttttcgtaaaagcgcgagcttggttcaacccgataatccaaggaatggcaattctgattgccaatacttcgacaacatttcatagagatgaaagactcgggaattcgtatgctatgcatggcaaatgtaattatgagaggaaggcacaaggatcatgtatgagcaaacatgtagaacaaaaagttaagaaggtgatatggaccttccaacctcccgtgacaaaagatgagacccacatacaacgcatgtgtgacggcatgatgcagatgcgcaaaagcgcaacagggggatgcacagagtacgacaatatccataaataa

SEQ ID NO: 79616 - DNA, 1749 bp, Glycine max
  Peptide Sequence Number=SeqID_196394
atgaggcatattgagttgatcctgaaaggaagaataattgaatacatgaaccgaatcgccatgcatttcaccattgatctttctaataatgatctttgtggaaagataccggacaagttaacagagctaattcacttgggtaccctgaatttgtcgtggaacaagttaatgggaaacatatcgaacaacattggattattaatagatttagaaagtctcgacctttcacacaactttctttctggttcaattcctcctagcatggtttccatcactttcttgagctatttcaacttggcatacaataacctctctagtcaaattccagttgctaatcagttcggcacctttgatccatcaatttatgtaggcaaccctcaactttgtggaaattcgatgccaactaactgctcattatggttgcctggaaatggaggagagcaaggaacaaaacatgaagaagataatgataagactgaaaagttggggttatatggaagcataactcttgggtacattacaggcttctggttagtctgtggcagcttggtgttgaataggtcgtggagacatgcatattttaagcttgtgtttgaccttagagataagcttctagttttgactggtgttaatttggcatgcacaacacgctgcgcttgctattggcactggtcacgtgatcctcctggtagtgcggcctgcatattctccttttggttagtggccgtctccaccttgtctgctgctatttcttctttgctttgctgctccataacctttcctgctgcttgcaattgtgcctcatgtgttttgttcataacattcacatgcccttcaaaaacaccttgtcctcacggtgttgggatcttaaatccagactgcgaaacaacatgggtgaattgggcttgctatgggaaagatggaggtgttatggctcgtggaaacaccagcagctctaactgctgctccaatgagtgcaagccacgaagggaactcaccaaattgaagagatactgctgttgcatgttgaacatcactgtccacaaggcgcaaacccacgccgatcgtgctcgtggtggaggcggtggtttcggaggtggtggtggaggtgacggcagcagatacagtggtcgaaggagagaggcaagtgaatatctattagtggcgtgggggccgaatgctggcggtggcggtggcggtagtgttggtggtcaatgcgaaacacctctggcaaaaccactggcaccgccacgtgtcgtcactagagggggctgcttggccaagaactccgacgccgatacgggtcgcgacgacaaccacaccgcttgcgccgcaccgtgtgttatgggcagagggggaacctctgacgacaactgcgacgaacccacagagacaagttcctccatgaatggcatcgagtttggagactatggaatcgagagtcacgatggaatggagttgagcggcaacgaggttggcaatgagagcttagagacggtccaagcactcggaggagaacaacaggatctccttcgaccaatgaggggctgccagctcagcgcttgttattggcactggtcacatgatccttctggtagtgcggcctacatattctccttttggttagtggctgtctctaccttgtctgctgctatttcttctttgctctgctgctccataaccttccttgttgctggtgctgcttgcaatgtcgattgtgattatacttttgttgtgtatgttgcttga

SEQ ID NO: 79617 - DNA, 159 bp, Glycine max
  Peptide Sequence Number=SeqID_196395
atgagtcatcatgaagagaaggttcctaagaataagtctcataagcaagaagaacataagatggaccgtatttcaaggatgttgattggagcaggtgaacggagggatgagctctatttcttcaaaggagttcgaaatatgagagcttacaaaaactga

SEQ ID NO: 79618 - DNA, 333 bp, Glycine max
  Peptide Sequence Number=SeqID_196396
atggcacagtctagttgcaaaactttggtgcagtggttggtagcagcattgctcattgccttgttgggtggtgcacaagctgttgcaatatgtaacatagactcaagtcaattaaacttgtgtcgtgctgcagttactggtcaaaaccctccaccaccggatgagaaatgttgtgcagttgttcgccaagccaatttgcgttgcctctgcagttacaagtctaccctaccttcatttggaataaaccccaaaaatgctttggccttgcctggggtgtttatgaagaagttattaaatggtcctggactaccacttttctttgatatcgattaa

SEQ ID NO: 79619 - DNA, 699 bp, Glycine max
  Peptide Sequence Number=SeqID_196397
caggtcccaagttctggtacgacagaatgaatgcacatttgataagcttaggctttgaaaaaagtctaagtgagtctaccttgtatgtcaagaagagggatgttggaatagtcattgtttccttgtatgttgatgacttacttatgacaagaagttcaaaggagctgattgaagagttaaaaggaggaaagaaagaagcctttgaaatgactgatcttggaaaaatgttctttttccttggtatgcaggtgcaacaagatagaggtgaagtctttgtaagtcaagaaaaatatgcaaaggaaattcttagaaagttcaagatggaggaatgcaagccaattgcaacgccaatgaatcaaaaggagaaattcagcaatgaagatggagctgataaggcagctaaaagaaacctgagatatatcaagggtactattggttatggagtgaagtttcaaccaaagcaagatgtcatagcacaatctaccgctgaagccgaatacgtagcagctgttgcagctgcaaatcaagcaatttggctaagaaaacttatggctgatttacacatggagcaaaaggagagtacacaagttcttgttgataatcaagctgcaatttcaatttctaagaaccttgtgtttcatgggaaaacaaaacattttaatataaagttgtatttcccaagggaggtgcaaaaccaag

SEQ ID NO: 79620 - DNA, 498 bp, Glycine max
  Peptide Sequence Number=SeqID_196398
atgaaggaagagtacgaaggcagtgagaaaatcaaaggaatgcaagctttgaatctgattcgagaacttgagatgcagaggatgaaagattcggagacaatcaaagattatgcggacaagcttctcggcattgcaaacaaaatacgtcttcttggcactgaaattcttgactctcgaattgttcaaaaaatacttgtaacaattccagaaaaatatgaagccacattgacttccttggagaactcaaaagatctttctattatcaccttggcagagcttttgaccgcacttcaggctctggaacaaagaagactcatgagacaagaagcgcatgtgaagaaaatctgcaagtcatcacaaaaacaagagaatgtacaagatgttgttgaagaggtggatgaagaagaactttttgttgtttcttgctttgctatcgcaagatcaaaagaaagttggctaattgatagtggttgcacgaaccacatgacttacgattaa

SEQ ID NO: 79621 - DNA, 495 bp, Glycine max
  Peptide Sequence Number=SeqID_196399
atggtagtaaaggaggtttcagattccatcttatgtgtggtggctatttggtggttactcaagtcaactaaacttgtgtcgtgctacagtcgaaaccctccaccaccagatgaaaaatgttgtgcagttattcgccaggccaatttgccttgcctctgcagatacaaatctattctaccttcaattggaattaaccccataaaaggctttggccttgcctgtgtagtgaagcaattaatgaaggtcatgttcattagtcattacacgaaccttagtattcaattggtttcaggtgtttcattaacactgaagatgcaattaagttttaaggcagcatttgaattccctggaataaaggtgcagtttcttttaatcagtgtgttatgtatgcccaaaagtttgcaagcaggtgtggtgtggtgtgatgttgcaaaggtgtttgatgtacaagaatacagaatagcattactcttttccccatgtctacacttttaa

SEQ ID NO: 79622 - DNA, 963 bp, Glycine max
  Peptide Sequence Number=SeqID_196400
atgaagggcaaaggaaccatcgtgatcaaaggttgcacaggtttgaaattaattcctgatattctatacgttcctgaaattaaccaaaacttgttgagtgttggccaacttctagagaaaggctataaagttctatttgaagataaaagttgcatgattaaagattcagataataaagaattatttagagttcaaatgaaaggcaaaagctttgtcttgaatttgattgatgaagagcagcttgctgtgcacaaggttgaagacaacatgctggtttggcataaaaggatgggtcattttcatcatggcgctttgctctatttgaggaagaatgatcttgtacaagggctgcttgagttggaagagaaatcacccgtatgtgctgcttgtcaatatggaaaacaaatgaggttgccttttccaaaaggcaaatcttggagagcaacaagcaagctacagttagtacgtacggatgtcggaggacctcaagaaaccccatctctgaatggcagaatagaacatcaattgacaactccgtataccccacaacaaaatggggttgtggagcgcaaaaacagaatggtcttggaaatggtgagatgtttacttcatgacaaagatcttccaaaaaaattctgggcagaggcttcaagcacttttgtttttttgctgaacagattgccaacaaaagctctttcaaaatcgaccccatttgaagcttggtatggtttcaaaccaaaattgatgaacttgaaagtctttggctgcttgtgtttctcttatattccacaggttaagagagacaaacttgataaaaaggtggaagcgggaatctttgtaggctataactccacatcaaaagcctatagaatattcttgccaccaagtaataaagttattgttactagagatgtgctattctttgaagaagaaaaatggagcaaggaaagtgagaagctttaa

SEQ ID NO: 79623 - DNA, 210 bp, Glycine max
  Peptide Sequence Number=SeqID_196401
atggctttcggggctttcgggacacccagtgtttttcaaagctggattgcttctgggcaagctgggcggcaacctcctcccccttttcctatgaaaaggcaaaagggggttgttctaagcgtccctgattctcctggctatgcatttcaggtgttttgggtgaaaaaaattgttttcgtgaagaaaatccaagccgaggtgcttctgtaa

SEQ ID NO: 79624 - DNA, 243 bp, Glycine max
  Peptide Sequence Number=SeqID_196402
atgacagaacgatggtggtgcagcagtgcagtgttggcgcagggtgctgtttggatgggtgaggtgtggggctcgggcgctagcgatggggcctgggtggtgacgcggcggcgtggtggttgcgcaggaggtgaagttttgggactcttcggaggtgaagttggacttgcatggatttcacttgggttccacttatttgattgtgttgctttggttggaggagatgtgaagaaggttgaatga

SEQ ID NO: 79625 - DNA, 861 bp, Glycine max
  Peptide Sequence Number=SeqID_196403
atggtgatactaagtttgatgaaggtggttttgaaagtgggtatgagaatgataatgagggtgttcttttttaagatagtcaagaaaagagagcaattgcatggtggtgatgtgaatgtagaagaaggagatggtgaattgagtgagggatatgaaactgaagagctttacagtgctgaattcgaatttaatgaagaagacatacataacctacaggagctcaaagaagcaattgttgagcattctataatgaatgggatacaggataagacctgcagaccaaaacatcattgtggaagggactttagcaacaagaatgctaactctaaatgggtcttgaaaattgttgcaaagaagttgaagttcaacaatgatgtaaaattgacacaaataatggatgttgtgaagttcaagtatggtattggcataagtttggctattgcttggaaatccaagatgattgctaaagcaataatggatggggatgctattagacaatactcttatctagaagctcatggtgaggagctcaagcatgtttgtgaagggatcaactacaaaattatattagaaagaccaatagggttactattgcctaggtttgggagcttttatatgtgtctagaaggcagtaaattggcctttaagcatgcttgcaaacccatgataagtcttgatgggcgtcacttgaagtgtaagtttggagagcaattattgattgttgttggtagagatcctaatgaccaatatctccatatagcatttgttgcagtggaggatgaagcaaaggattcatggaagtggtttttggagcttcttatcaatgatattggagacatagaagccaacattcatcagtga

SEQ ID NO: 79626 - DNA, 2844 bp, Glycine max
  Peptide Sequence Number=SeqID_196404
atggctgaacacaccaccaggaagacgacaacggatagactagaggacgcaatcacacgactcaccaacagtcaagccttactctccgacaaatactccgatctctccggaaaagtcgactctatccttgaccacctgcgtctccgcgacgtcaaccacaacccagtcacctctagcgctccgttcaaccaccgcaaccatgtcaagcttgatatttcgaggttcgacggaagggatccattaggatggatcttcaagatacaacaattattcgacttccaaaacacacctgaggaagaaagaatcaccgtggcctcgttctacctcgacgacgctgcactaagctggctttggaataagggtttgcgtcgtccttctacgaggacacgaaaggagcgctattcaaactcacgcagcgcggttccgttaacgactacctcacagagttcgagaggtctttcgccagaaatacgccgggaagtcttggctcttcagcctatctccctcccacaggcaaccgcactcgcaaagcttcaagaagacaaactgcgtgaccgaagatcagctacatctcgaactaccaaccctcaacaacattccagctcattctcagccccaaaccccaaaccaaagcaaccatttgttcaaaggacaccggaggaaatggcctttagacgcgagaaaggtctctgctacaattgcgacgagaaatggagctctgggcatcattgtaaagggaagattcagttgttcatcgtggacaactctgccctagactctaaacttgactcagccacactcaccgacagcgatgcaacgaactccggcgaccttgaagccaccattgataccgaatgtccacacatcagtctccacgcattgtcgggcctctcctcctcggacacctcccgcctctacgacaccattaaccaggcgcatcttaccatccttattgacaacgccgttctcggcatagagtggcttaagcagtttgggcctataactactaactacaccacattcattatgaagtttagtcatttgggccgtaacattgagttacacgcagacgtggaaattgggcccgaacctgtctcagcggcccaggtcaagcgcttggttcagactgggtcaacctcagccctcttccatctggctatcctaacccctaacataacccacacacacccaacccctccgtcccaccccatctcatccattgccgccctgctccaccaattccaccatctcttccaaacccctcacggccttccaccaccccgtgacaccgcccaccgcattacccttccccccaccacctcacctgtaaatgtaagaccttaccgctacccacattatcaaaaagccgagatcgagaagcaaatatcggaactcctctccgccggtctgatacggccaagtacaagcccatactcgtctcccgttcttctggtcaagaagaaagatggaacatggagactctgtgcagaccatcgcgcattaaattcggttaccatccgcgacaggttccctatcctgacaatagatgagttgctggatgagttaggccacgcctcatggttctccaaactggacctcaggcaaggctttcaccagattccgatgcacgaagccgatgtcgagaagacagcgttccaaacacaccacgggcactacgagtacctcgtgatgcccttcgggctgtgcaacgccccatcaaccttccagtccgccatgaacaacctccttggccccttcctgagtcaattcgccaccgtcttcttcgacgatatcttagtatacagcgactccctcgactctcacatcacacatctgcgaacaatcttccaagctttgaggcaactagaatacctgggacatgtggtttccggcaagggggttgcacctgaaccatccaaggttcaagctatcctacaatggcctccaccttcctcggccaaggacctccgcaccttccttggcctagctgacttctacaggaagttcgtacgaaactacgcatccatcgcggccccactcaccactctactatgtaaggatgcttttgagtggtcctccatgtcgcaagatgcattcgaccaactcaagttggcaatgacaagtgccccagtcctggcacttccaaatttcgcagaacccttcatcgttgaaatcgacacgtcaggcaccaccatgggggtcgtgcttatgcagcaagggcacccactagccttcttcagcaagatgtttgggcctcgccttctccacgcttctgcttatatccacgaattacacaccatcatcacagctgttcaaaaatggcgacagtacctgctaggaaggccgttcaccatcacggcggaccataaaagtctcagggaactaatgacgcaagtcatacaaacccctgagcaacattactacctctcaaagttgcttgggtttgactacacgattcaatacaaaccaggtgcttctaacactgtcgcagacgccttgtctcgccaacccaccaactctggccaactactccttctctcggataaccctgctatcctctccctcttactcgagcatcatgctacaccgttaagagggcacctggtgttgccaaaacaacacatcgccttgagtcagggttcttttggtccggtttatgccacgatgttcgccgtttcgtacgagaatgtgaggtttgccagcaaaccaaagccagcactaaacgtccggcagggctccttcagcccctatcgacacccagtggcgtatgggaggatgtgtcgatggacttcatcactcacttaccatcctcacatggctttacagtcatacttgtcatcgtag

SEQ ID NO: 79627 - DNA, 303 bp, Glycine max
  Peptide Sequence Number=SeqID_196405
atgggtttggggttggggagatggctggaaaggagtggcggcgagagtttgaagggaggtggcagaaaaggagtgccatggcttttgcaacctccacctttgggtctgatgttattgatgaagtgcgagaaggttacagaaaaattatatggatttcaggtttcaatgcattacaattttcacaatgataagagaatggaacataaagtgtgtgttagcaaccagaaagaaccaaaaccctccacagctagactcgcgaggatagtcaccagacccaagcacttacgtgactacgtgagttaa

SEQ ID NO: 79628 - DNA, 711 bp, Glycine max
  Peptide Sequence Number=SeqID_196406
atgaagctgaagaaactgatcgccgcctcggtactgatgtgcatgctgccggccagcgtgctggcgaaagacatcaagatcggcgtttccatggcttacttcgatgacaacttcctcaccattctgcgccagtcgatgcaaaacaaaatgaaggccgacggcaacgtcagcggccagttcgaagacgccaagggcgacatcgcgcagcaaattcaacaaatcgaaaacttcgtcagccagggcgtcgacgccatcatcctcaacccggtggatacccagggcgtcaagccgatgatcaagctggccgagaaggccaagatcccgctggtgttcgtcaaccgcaagccggaagtggcgctgccggccggcatggcctacgtcggctccgactccaagctggccggcaagctgcagatggaggaactggccaagctgatgaacggcaagggcaacgtgatgatcctgatgggcgagctgtcgagcgaagccacgcgcgaccgcacccgcggcgtggaagaggtggcggccaactaccccggcatcaagattatcgataagcaaaccgccaaattcttccgcaaagaggcggtagacgtcaccaccgactggattttgtccggccagcagatcgacgccatcgcctccaacaacgacgaaatggccatcggcgctattttggcgctgaagcaagccaagaaatccggcgtgctg

SEQ ID NO: 79629 - DNA, 249 bp, Glycine max
  Peptide Sequence Number=SeqID_196407
atggagagggagacatgcagacatgtgagggcgacgcagagaagtgatttgacattcgaaggacacatgaaagtgggccccacttctgtgtgggttccttttcagaggaagctcaaatttgagacatggggtgggcgaaagtaccccaaaggaatcacacatatacgtacgcaaaggctaactgcatatggaaatatgctattcattatgtcaatcctttttcattttaaccaccatgtagatcactag

SEQ ID NO: 79630 - DNA, 726 bp, Glycine max
  Peptide Sequence Number=SeqID_196408
atggggaggatcaagcctcaggctctgctacagcaaagcaaaaggaagaaggggccttctcgcataagtgccaccattgttacattctatgcattgattcttgtcatgcttgtgtttatcctgtttgttacatacagacattggtccaacaggacaagacttcaaccagagagctacatatcagtctctgaggatgaaaatacatctgtggaatccaaaaaatctgatctacctggatatgctgttgtaattacctctaaaggttctattatagtagaactttacaaggaaagtgctcctgaagttgttgatgaattcatagatttatgtcaaaaagggcacttcaaggggatgctttttcaccaagtaattaaacactatataattcaggcaggtcataacaaagggcctggagctactgaagattggaacctgttaggaaagaaatacgcaagtatgagacacgaagcattcatgctcggaacatcgaagggaaaatactttaacaaaggatttgatcttttcatcacaactgcaccaataccagatttaaatgaaaagcttattgtgtttggccgagtcatcaagggacaggatattgttcagttaatattgacagtttcacaatccctctgccaggaaattgaagaagtggatacagatgaacattaccaaccaaaacttactattgggatacttgatgtggctcttaaacagatagtgtga

SEQ ID NO: 79631 - DNA, 1944 bp, Glycine max
  Peptide Sequence Number=SeqID_196409
atgaagccagagttgtacgaaatctccgacgacgaatgggagaaccactccttcaaaccctcgcaagttctgaagcggcctcgcacttcgtctcctccttctccgccacccatcgaatccttcgcttacacctccaactccaaggtcgacgtttcaagcgaaaacgacgacgacagcgattgcgtcgaaatcgcgccggaatccgctaatttccgcgacaatctcaacgacctcgaggacgctgacgtggacgacgaaccggtaccggcgtcccgcggccggaggttcgtaatcgacgacgacgacgaggaagacggtgaggaggagaacgggggaagggatggacacgtggcggaattgtatgatgttgagtcgagcgaggaggaagaggaagacgttgatgaattgaacgagaacgacgttgttggaagggctttgcacaagtgcgcgcgaatctccgcagagttgaagggcgaactcttcggttcctccgggaccgcgtgcgagaggtattccgaggtggaatcttcgtcagtgaggattgtgactcaggaggatgttgacgttgcgtgcgggtctgaggaggattcggattttcagcctctgctcaagccgtatcagttggttggcgtcaattttttgcttctcttgtatcggaaggggattggaggagccatattggcagatgaaatgggtcttggcaaaacagttcaggccatcacatatttaactttgctgaaacacttgcacaatgattctggtccacatcttatagtatgtcctgcttctgttctggaaaactgggaaagggaattaaaaaggtggtgtccatccttttctgttcttcaataccatggggccggacgtgcagcttactgcaaggagttgaactccctgtccaaggcgggattgcctcctccatttaatgttcttcttgtgtgttattcacttttcgaacgacacagtgcacagcagaaagatgatcgcaaaatcctgaagcggtggaggtggagctgtgtgataatggatgaggcacatgctttgaaggacaaaaatagctttaggtggaaaaatctgatgtctgttgcaagaaatgcgaaccaacgcttgatgctgacagggacaccacttcagaatgatctgcatgagttatggtcattgttggagtttatgctgcctgatatttttgcttctgaagatgttgacctgaaaaagttattaaatgcagaagatagagatttaattggtcgtatgaagtccatcttagggccatttattttacggcgactgaaatctgatgtgatgcaacaacttgttccaaaaatacagcaggttgaatatgttataatggaaaagcagcaggaaactgcttacaaggaagccattgaagagtatcgtgctgtgtcacaagctcggatggcaaaatgttctgatcttaattcaaaaagtgttcttgaagttcttcctcgacgacagataaacaactattttgttcagtttcgcaagatagcaaaccatcccttgttaataaggcgaatctacagtgacgaggatgtcattcgctttgctaggaagctacatccgatgggtgcttttggttttgaatgtactttggacagagttatagaggagcttaaaaactacaatgacttctctattcaccggcttttacttcattatggtgtcaatgatagaaaggggatccttccagataagcatgttatgctttctgcaaaatgtcgggccttagcagaacttcttccttcactaaaggagggtggtcatcgagccttgatctttagtcaatggacttcaatgcttgacatattggagtggactttggatgtcattggattgacctataaacggcttgatggaaggattattttggtcagcacttcaacaaacaaggagaaagttaagtcatctatgataatgatatga

SEQ ID NO: 79632 - DNA, 264 bp, Glycine max
  Peptide Sequence Number=SeqID_196410
atggattttaacccacagattgatagacaagccgaagatcgttgccatcgaattggtcaaacaaagcctgtaaccatacatcggctggtgacaaagggaacggttgatgaaaatgtgtacgagattgcaaaaagaaagctagtattagatgctgctgttctcgagtccatggaggagattaatgaagttaaaatgcgcaatgcggcatcatattcgtatttggaggaatgggaccgtatggactttggtgaaagcaagaaatag

SEQ ID NO: 79633 - DNA, 255 bp, Glycine max
  Peptide Sequence Number=SeqID_196411
atggtgttgggtagggttcagattggaagaagaaggcgaagaagaataaggagaaggagctttggaaatggtgatttggagggaagaagatgcattggaggggaaatggacaattgggaaatttttggtttccggattgggtggaaattgttgtgcaagaagcaaatgcaagatgtgattcttgatcttgcttacctagtgtataggtttatgtggagtggtgatgaatggacacctggtgaattagtcaattag

SEQ ID NO: 79634 - DNA, 1433 bp, Glycine max
  Peptide Sequence Number=SeqID_196412
atgaattctctcttttcgccggaaaaccttcctccaccaccgggaatcccaatccccgccacaattgccgccgccagcaccaccaccccaaacccaattctaatcccaaagctggaacctttcgatgaatggctcaacacccacacaccccaacaacagcaacaatctcaggaccccaattcttcaaatgggtccctcgacctcgaccttaagctcttcggcgacgaatcccccgaagatttctccggcgaccctaacttgctctccgacttcaaccgtctctctcagcttttcagaaccgctttctccaacaacaacgccgttcccgaccccatcacccaagggatccagcagctcggaaacgacgccgtttccaacccctttgccaaacccccccaaaacgaaaccaccgtggttccaccgccgagcttccaaaacggcaccgtttcggaccccgggatgctgctgcagcagcagcagcagtatccgaacggcgccgtttcagacccagattcgcgggcaattgtgccggtcccggaggacgggcggtcctcctcggtggcggtcaccacgccgcggcagccgcggcgctgcaaagagctggtccgcctgatggatgtcggcgggccggagcagcgtcacttccgggacgtggtccggcggacgaggatgctttacgactcccttcgcgtcctggcgacggtggaggacgagggccgggtggatgcccggcgggggcgcagcgatttgcgtgcctcggcggtgatgaggaactgtggcctgtggctgaaccgtgacaagagaattgttggtgcaattcccggtgtctgcattggtgatgtgttcctttataggatggagttgtgtgttgttggccttcatggtcagcctcaggctgggattgattatctccctgccagcatgagttccaatggtgaaccaattgccactagtgtcattgtttctggtggttatgaggatgatgttgatgagggtgatgttatcatttactctggccacggtggccaggacaagcattctaggcaggttttccaccagaagcttgaggggggaaatcttgcaatggagaggagtatgcactatgggattgaggtcagggttattcgtggggtgcggtatgagggtgctgcctctgctaccgggaggttgtatgtgtatgatgggttgtataggattcatgagtgctggtttgatgtggggaagtcgggtttcggggtttataagtataagctgtgtaggattgatgggcaggctaagatggggactgtggtgatgaaggaggcgcttatgcttaggaaggatcccttgagtttcaaacccatgtgttgtttgtctcttgatgtttcgaataggaaggaaaatgtggccattcggctttttaacgacattgatcgtaactatgaccctctgca

SEQ ID NO: 79635 - DNA, 709 bp, Glycine max
  Peptide Sequence Number=SeqID_196413
taatcagagtgggattctcttgagagggaagcctttggtttttgagtgtggcccgttttgtcattgtcctcctcattgtcgaaaccgtgtcacgcagaaggggttgaaaaataggttggaagtgtttagatctagggaaactggttggggagttaggtccttggaccttattcaagctggtgcttttatatgtgagtacacgggggttgttctcactagggatcaagcacagcttttgacaatgaatggtgattcgttgatatatccgaatcggtttactgataggtgggcagaatggggggacttatctatgattgactccaattatgtgcgtccatcgtatccgtcaatacctcctttggattttgctatggatgtgtcaagaatgaggaatgttgcttgctatatgagtcatagttcgactcccaatgtgttggttcagtttgttctctatgatcacaataatttgatgttccctcaccttatgctatttgcgatggagagcatccctccgatgagagagctcagccttgattatggggtagctgatgagtggacaggaaagctctctatagaggtaaagccaagttctttcatcgacttactcgttttcagaattttcatcattgtttttccatttcattttatgtcatatctcaatctttgtgtggtctccattataagctctgttaaccatatgaggttgtag

SEQ ID NO: 79636 - DNA, 228 bp, Glycine max
  Peptide Sequence Number=SeqID_196414
atggaggtgtactgggaggttggaagcagcaagagggaggtgacagaggctgtccagcaacagtgcaggttgcagtgctatgtctggcaacagaagaaatggaggagctactatgaagcccacaaaacgctgcaatttgcaccccaaatggctgcacaacatctgcaacagacaggggaccgccaactacactattgggtgtggaagactggtcccgctcaaccatga

SEQ ID NO: 79637 - DNA, 156 bp, Glycine max
  Peptide Sequence Number=SeqID_196415
atggaaggcggtgttagggttatgatcattgggagtagggagaggagatggaggtgggaagagataggggtggacgtgtttgggttctggtctttagtgttgatgagggaaggattgggttcagtagtcaagattgggtttaggttgtggaaatga

SEQ ID NO: 79638 - DNA, 306 bp, Glycine max
  Peptide Sequence Number=SeqID_196416
atgtcacaaacaattggccaaagcataggcaactgcctaggggaatatcttgagtatgatgagaagaacaacaatccatggcatccctatttgcgcatcagagttttcattgatgttaggaaacctcttaagacgacgaagaggataaagaagcaaggcaatgaagtggtagaagtgagctttaagtttgaacatcttggcacattttgttacctctgtgggctgttgggatactctgatgactattgtgctaagcttttaacacttgaaaatgatgatggaacacgtatttgggtccgtaattga

SEQ ID NO: 79639 - DNA, 315 bp, Glycine max
  Peptide Sequence Number=SeqID_196417
atggttttgactccctggtgtatctttggggatttcaacgacctttcattaaatgatgagaagattggcctccatgatcacccaaactggcttattcaaagcttccatgaagcaatctttgactttaaccttcatgatctccccatggaaggttacaaattcacctgggctaagaggaaagattcataccaaaaagaattggagacccttagagaagcttattatgaagagccaactcttcaattttccattatcaaatataagctcaaccatctccttgcccatgaggaagcatattggaagcaacgtccaaaa

SEQ ID NO: 79640 - DNA, 234 bp, Glycine max
  Peptide Sequence Number=SeqID_196418
atggtggaaagggagaaattagatcatatagaggaaaggctaagggccattgaaggaggcagagattatgcttttgctgacatggcagagttgtgcctagttcccgacgtggtcattcctctgaagtttaaggtgctggattttgataagtacaagaggactactttccccaagaattatctgaagatgtactgtaggaaaaaggggcatacgcgaaagatgaaaaattgttga

SEQ ID NO: 79641 - DNA, 114 bp, Glycine max
  Peptide Sequence Number=SeqID_196419
atggagaaagctcgaaaaaccctagtttttaagagatcaaaaggtccgggggttggttacgcaaagggaagttatgtaaagataagcctaaacgcgccggatcccttaaaatga

SEQ ID NO: 79642 - DNA, 551 bp, Glycine max
  Peptide Sequence Number=SeqID_196420
gcgaatgcgctgctgagcgaagccggactcagcccggcgcgcccgcacgcggtgcgctaagccaggcaaagcgccggctcttgtctatactgaatagcggtctgactaacaggaggaatgacatgaccattcacaagaaaggatcggcccattgggaaggcgacatcaaaggcaaaggcacggttagcactgaaagcggcgtgctcagcaaccagccatacggttttaacacccgttttgaaggcgagaagggcaccaatccggaagagctgattggcgcggcacacgctgcctgcttctccatggcgctgtcgctgatgctgggccaggccggtcatccaccgaaaagcatcgacaccaccgccgatgtttcactggacaaaaagggcgacggcttcgccatcaccaaaattgccctcaacagcaccattgcgctgccgggcatcgatgatgccaaatttgatgaaatcattcagaaagccaaagccggctgcccggtgtctcaggtgctgaatgccgaaatcaccctcgactatacgctgaataattaa

SEQ ID NO: 79643 - DNA, 2804 bp, Glycine max
  Peptide Sequence Number=SeqID_196421
ccaccgtgtcgcgcgtgctggcgggcaaccgctatgtcagcaaatccacgcagcagaaagtgtttcaggcgatagaggaaaccggctaccgcccgaatctgctggcgcgcagtctggcgacgcaaaaatcgcagaatatcggcctgatcgtcactcattcgctgtttaacggcccctatttcagcgagctgctgtaccagacggccacgctgaccaataactatggccgccagctgatcctcgccgatggcaaaaccagcgctgacgatgagcgcgcggcaattgagtttctgctcgatctgcgctgcgacgccatcattatctacccgcgttttctcgataccgccgcgctggaagcgatcatcgaccagcacgatatcccgatcatggtggttaaccgccgtctgacgcagcacgcggcgaactgcgtctgggcttcgcatcagcaaaatacccgcgatgcggtgaactacctgattgcgcgcggtcaccatgacatcgcgtttatcaccggactggcgggatcgcccaccgccgccgcgcgtctggctggctatcagcaggcgctggccgaccatcagctgccgtatgaagcggcgcgcgtactgccgggcgcgtggacgccggagagtggtcaggcagcggcacgccagttgctgagtgccggcgtacccttcagtgcgctgatggccagcaatgacgatatggcgattggtgccgcgctggcgctgaatgcggcgggcaaacggctgccgcaggatatatcgctgatgggctttgatgatattcgcatggccgaatttttcctgccgccgctcacgacggttcacgtgccggtggcggagatgattcagcacacgctggcgcagctggtggcgatgctggagggcgaagcgattgcgcccctgccgccgttcagcggacggctgattgagcgcgcctccgtggcagatggaccatttcgccgtaataggtgtgccggccacagtccagctggtaatcctccatggcgatcagcgtgcccgccttcagctccgcttccaccagcacgcgctgcgccagcgcaatcccctgcccttcaatggcggcctgataggccagcgccgaactttccatctgccgccggtgcggcagcgcgtccatttccacgccaaatgcttcgcaccagcgctgccagtcatcaggacgtccgcgcaccagcagcagggtatgctgcgccagcccggccagatgcatgctggcgcgccggtcagccgtcgggcggcacaccggcaccagcacgtttttcaccagcggcgtggcgtgctgctgcggaccacgcgcatgtcaatcgccggatgcgccagctgaaactgtgccagccgcggaatcagccagcgggtggcgaaggtggtgaaggagtgcagccggatgaccgtgcggccggcattgcgctgcagcgtggcgctcgcctggcgaataccgtcgaggtgctggctgatttgcagaaaataggcattgccgggcagcgtcagtaccagcccgcgcccctgacgctgaaacagcgccgtgccaaagtactcttccagcagacgaatctgacgactcaccgcgcctggcgtcaccgacagggcatcagccgctgcccgcacgctgccgctacgggcaacatattcaaatgccagcaaggcattcagggccagcccgatagcgctgactgccaggttgtcacattgattctgacactggagcacactggaatgattaaagtcaccaatcctgccgacggcagcctcgtcggcgaagcaccgttcatgcgccacgacgaggtcgcggccgctatcgatcgcacctgtgccgcgtttccggcatgggcggcaaaaagcgcgaaacagcgcagcgacctgctgcgtggctggtacgatctggtacgcgccgataagcacctgtttgctgaactgatggtcagggagaacggcaaatgcctgagcgaagcgctgggcgaaattgaatacggtctcggcttcattgagtggtatgcggaagaggccaaacgcgtcaacggtgataccctgccgtcgcacgatgctaacgcctccgtgctggtggtaaaagagccggtcggcccgaccgcggccatcacgccgtggaacttcccgtttatgatgatcacccgcaaaattgctaccgcgctggccgcaggctgcaccatgatcatcaaaccggcagaagagacgccgcttactgcgtataaactgctggagtatgcacgtcaggccggtattcccgctggcgtgtttgagatggtgaccggcgatccgcaagccatcggcgaagcttttaccagcgatacgcgcatccacaaaatctccttcaccggatctacccgcgtcggcaagctgctggcgcagcagtgcggggccacgctgaaaaagatgaccatggagctgggcggcaacgcgccgtttatcgtgttcgccgacagcccgctggaagagagcgtggccgggctggtcagcgccaaactgcgtaactccggccaggtgtgtatttcgcctaaccgcatctttgtgcatgacgcgatttacgatgcctttgtgcagcaactggtgaaaacagtcagtgagatccgtgtcgatcagggtatgcagcaggaatttgtggttggcccgctgattaaccgcatggcgctcgataaagtcaccgcgctggtggatgatgcggtagcgcagggggcgacgctgcgcctcggcggcaagccacacgcgaaaggcgggctgttctatgaacccaccatcctgtgcgatctggacgcctcgtttgcc

SEQ ID NO: 79644 - DNA, 669 bp, Glycine max
  Peptide Sequence Number=SeqID_196422
atgaccgaccctctcattgagtcaatctcttgctttctcataagggtggacccttgggtactagtaccctcaccttcagagggatacatgccctcgccatcagaggagtacacaccctcgccttcagaggactacataggactacacgtcatcctcaccttcagaggactacacgtcctcgccatcagaggactacacgtcctcgccttcagagggccacacgccctcaccttcagagggctacacgccctcgccttcagaggactacacgtcctctccttcagagggctacacaccctcgcctttagaggactacacatcctcaccttcagagggctacacgccctcgccttcagaggactacatgccctcgccttcaaaggactacacatcctcgccttcggaggactacacgtcctcgccttcagagggctgctcgccctcgccatcagaggactacacgtcctcgcctttagagggctgcacgccctcaccttcagaggactacacgtcctcacttttagagggctgcacgctctcgccttcataggattgcacgccctcgccttcataggactgcacgccctcgcctttagagggctacgcgtcttcactttcagtgggctccacatccacaccttaagagagtttaaggccctctgcccttaa

SEQ ID NO: 79645 - DNA, 261 bp, Glycine max
  Peptide Sequence Number=SeqID_196423
atggtgacaaaaaggacttgtagagcttcaaaacaaagaaaggggaacataggctcaaaggggctatcaaaagaattaattcaaggtagacttatttggctagaggcttataagaacaaaatgcctaaatcatctcccaacatgcatgtgaagcaagaagtatcaacaagagtcaagccaaggctattgtgcaagcaatcaatggggcaaaacacaccgaataaaacagatgatgatggctcaaattctcaccaagggtaa

SEQ ID NO: 79646 - DNA, 342 bp, Glycine max
  Peptide Sequence Number=SeqID_196424
atggagattgatgagcaaggtattgagaaaggaagatgtgttccagcaaccaaatataccaataataatattctaaggatacaaaattatttccaacaaccaaaactaccagagaaattgaaagtattcaaagcatgcagtttgttgaagccaagtgctgctaactcttcccctctcactcccctcggcttcttggacagagcagccaccgtccacgcgacttcccttcccttgtttataaccacatcaccttcacgtggtcccagacgtgctgccgatgaacatattctctctgagaaaagaccgagagagaggagtgagtaccgcaagagagaggaatga

SEQ ID NO: 79647 - DNA, 471 bp, Glycine max
  Peptide Sequence Number=SeqID_196425
atgatgttgaggcgtgaatttgcaaatgatgttgggtatctgaaccaaattctaccagtggagaaccatcttagatttattcactgggattttcacaagtttgcaaagagcaagtctgccaatgttttggaagttttaggagctgtagcaagtgaagcgctcgatttaactggtttttactacagtggtaaacccagcatcattaagagagccaacaagagcaatcaaacaagcacagggagggatacttcaccgagagatctgagagctagttctgtggatcttgtgaggattgggaacagtaatgaaatgataaattctgtggttaatcaagacaaagagactgacatgaatttaaatatagctccatcattaagcaagaaaagggtgaatggttcagtgatccactcaccatcagagtttgatgcagcttcagtggcttttgagatccctctcctaacctatggttaa

SEQ ID NO: 79648 - DNA, 288 bp, Glycine max
  misc_feature (257)..(257): n is a, c, g, or t
  Peptide Sequence Number=SeqID_196426
atgccagcgcataggacagcctcgtattacaaaaaagggtttgccatagcaccgcgccggcgaggaatcggcggcgacatcgcagtcgcggctagaggactcgacgatgctgctctagctggggctcaagttcttaacattttccaaagggagagggaagtttgtcttggccttagggccacgaaactctcgtgctgcggcgtcgtaggcacgcgctgtcgcctccgcagtgtcgaaggttccgagccagacgcggntcttctggctgggatctctaatctccgaggc

SEQ ID NO: 79649 - DNA, 609 bp, Glycine max
  Peptide Sequence Number=SeqID_196427
atgtgggtgtcgagggagcggttttcgacagatttcaggcgggaggagaaagagaagagcgatttcaggcaggaggatgacaaagagaagagggagggcaaggagcatcaaactctgtacgtggaccttccatcaccatggtcgagtgcgttccgtgctcgaactgaatgctccaacaacaacggaaggttcaactgcgccactgtcgactgcacctccaatcaagtcgcatgcaatggtgctggttcaatcctgccggcaaccaaggcagaaattaccgttgcagaaaacagaggacaagatttctacgacatgagcaacgtggacgacttcaacatacccatgtccttaaccgcacaaggtggaagtggcgattacaaaaccttaggttgtcttaggaacatcaaccatgtgtgtccttcgcagctacaacaaccagggcctagtggcaatgtcatcgcttgcaagagtgcttgtgtggctttcaatgcagatcgatattgttacttaggagattacttaggagatcgatattgttttgggcaaagagaaaatttcattaatcaagagaaatacaaggagtactggttatccacctcattccgatga

SEQ ID NO: 79650 - DNA, 764 bp, Glycine max
  Peptide Sequence Number=SeqID_196428
gttacagtaacaacgacggctttggcaaagaatttgtgggagaagttaagaagaagatagagtggccgaaagaggcatggattctgggtcaagatgtttctgccgggttcactcctagcattatatttgtcattttggttccggccttgcctcttaagcctcttaagagggacaggacgagatctaagaggtccttggaaattcaacaattgagggagcgtaagaaagagtatgacttgaagacagcaatatctttggttaaagagacagctaaaaccaagtttgtagaaacagtagcagcccatttccgcctcaacattgaccctaaatataatgatcaacaattaagagcaacagatatttgtgtgattcaaatttgtcaccatgagcaagtcaggacaaccacgggatttgaaaaagtcaaggcatttatctatctttgttgcttcttcagaacagtttctaccggtattagtggtgcaagctactacactggaactttcaatattgtcaatcgctctccggatggaagccattctggctgccacgtaatagagcagttgccagaagaatccagaacatgcgatggagagctgatggtggaaatgatcctggaaggaaatttttgcttgatggagaggtcactattgacacaatggcagataatgtggaattcacagattgtgacggatagttggatagagaatgctgtcaatgggctaatgggcaagcagaacatggttctgaccggactgagttcttga

SEQ ID NO: 79651 - DNA, 726 bp, Glycine max
  Peptide Sequence Number=SeqID_196429
atggggaccaatcaaatcggaaaaagattctatcaagtcaagattaagggcctagatgtcaccagccttaaggagttagggcagttgatgggtcagctcctacggcaagcttttcacaaagcttacggtaaaatctgggagctagccatggtagaagtctccacagaggccattgcctccctcgcccaggggaaggagaccatacctcttctcaggattctatcgataaaagcccacgtgcaaggtttagattggctcccgagtttgagaaccgctaaaagggaggaagttgaggcaccggaggaagacgaagaggccttggaacaagagaccaagagggttcgtagggaagagcacggcagggacaagttccgaggggctctgtggggcagcaacagcgagcttaagcgccggagagaggaaagagaccaatcacgagtacatagcatggtcttcaaagaggagttagctacttgctcaagatccaagaagagtttggcccaacacttagaagccacggagcaaagcatgctagctataatagggcagtacaaagaagagttaaaccagtctttgacccatgagcaaaagctagtagaggacttcgcacaagcatacgccgagaaggaagcaagagggagggtgattgatgcattgcatcaagaagcgaccatgtcgatggataggttcgccttgaccttaaatggaagtcaagacctcccgtga

SEQ ID NO: 79652 - DNA, 291 bp, Glycine max
  Peptide Sequence Number=SeqID_196430
atggataggcacattgatgtggccctggtcaaggagttttactcaaacctatatgatccagaagataaatcaccaaaacaggttcgagtccgagggcggctgattaagtttgatgcggcatcactgaatgcctttctggagacgccaccggtcattcagccaggggagcagtacctctcatattctattttttgcaagtcacacacagatcctcaggagcttgcctccaagctttgtattccagggcgagatttgttcttaatgctgaaggagcaccctggaagctcctga

SEQ ID NO: 79653 - DNA, 222 bp, Glycine max
  Peptide Sequence Number=SeqID_196431
atgaaaagtgataaagcctcacaagatatacactctatctctcaagtgtctaggctactgtttactctcgaagcacccatgaaaacaaacaccacattgactttgcaaaattctaaaattgacaaacaacttgacaaacacatgcacatgaggatcaaaaggtctttaaaggttgtaatggggccaaggacaagtacgcatttgcagaattgcagcaactga

SEQ ID NO: 79654 - DNA, 399 bp, Glycine max
  Peptide Sequence Number=SeqID_196432
atggcatttgtagctgttagatgtaggctgtggacaccttatactaactatgaaagcatgtgttattttgataaagcattgcctatgatgctcttgtacaaaaaagaacgcaagcaatataatgatgcaattgtggataatgtgtctccatcaaccatatatggtgctgaacatttattacgcctctttgttaagttacctgagcttttggcatatgttactattgaggaagaaacattgaatcgcttgcagcagaaattacttgactttctcaagtttttgcagaaaaatcaaagtaccttctttctttcagcatatgatggcaccaaagtctctgaaggaaaagcttacacagtactattatacacaatggaaacgtttggtggctcagctttttaa

SEQ ID NO: 79655 - DNA, 600 bp, Glycine max
  Peptide Sequence Number=SeqID_196433
atgttgagacagccacattcacatgcacatgtggcaaatgtaatgatcaacctaagctgtggttattgcactcctgctcaattggatggtgatattgatttaaatgtttctcctcaagcacttgataagctgttgggttatttccttgcacttaaagtcaaggttcaaccaaacttcaagaatgttgttgttcttagatgttcaaatgacttacatttgattagtgttgtgatggacatgttgtatgatgctgaggtgatgttttgtaaagcatgttccaagatccatattcttatgcttgactccaatgattcttcccaagttgaatctcaatttgtgtttgtgacagtagatcatgatccacttctaggtctttcattaacaccaacaaagcgaatgacatctgatgaatgtgaaatattattaaaaattttctgcaaagaaccatcagcttcacgcatcccgaaaatgaacataacatcgtcaacaatgtcaagtagggattatatactaataccagccttctaccatgaacaatgggcaccagactacccagactttgcccactttagctatgacggagtgatgtacaaaatatga

SEQ ID NO: 79656 - DNA, 405 bp, Glycine max
  Peptide Sequence Number=SeqID_196434
atgattattattacatgcaataatgcaaagggttacaaagaatcattatcattggttcaacatatttccaacagttgggacgaatgggtaggtgaggaacgtttgatgaaacatactgaagagaatgtaatgaaacaacaggccctagacaaaaagcaaaatgtagacaagaatgttaagtctgggcgttcatctcaaggaaaggccaaaagttctaccgatgccaaaatggataaagaggatgtcaagaataatgtgtcaaaagggaagaaacgaaagcatgatgcgggagttgagaagggcagcgggactgttgaaaagcttgtcaagattcaaattcctgcaacattaaagaaacaacttgttgatgattgggactctgttactcagcaagataagagttag

SEQ ID NO: 79657 - DNA, 282 bp, Glycine max
  Peptide Sequence Number=SeqID_196435
atgggaagcgttttacctcaaatggacagagagatatgtggtgatattcacggtcagttttatgacatgaaagagcttttcaaagtaggaggggattgccccaaaactaactatttgtttctgggggattttgttgataaagggttttactcagttgaaacgtttctgcttctgctcgctcttaaggttctgaagtacttttgcatggtgatgaggatcaatattgattacaatggctgctacataaaagtgaagagagcccttcttgatatgccagtttag

SEQ ID NO: 79658 - DNA, 360 bp, Glycine max
  Peptide Sequence Number=SeqID_196436
atgtccagccatgctacaagccttgagccaaaataccaatttaccataaaccttcacttacatgttagagctttcagatcttttcgggaatatggagaagttgtgctgaaacatttggagaattcaattggctctgatccaagtctactcaaggctcctgtgaactatgaaggggtccgagtttctggctatggtggatggttccttcttagattatcactccatgatcatgtacttccccttaacattgagcggaagtgtataacagaggtggaccttgaatatctttctatatttacactatatccaaaccatgatcccgtctacactgttggtgtatctgactatcacaatgactag

SEQ ID NO: 79659 - DNA, 627 bp, Glycine max
  Peptide Sequence Number=SeqID_196437
atggtttcaacaaaggcttcgttgagggagaccgaaggggttggttcagaggttcgaggcttaaatgaaggggtgctggaggtgttctccaacacatctgtctcggtaacggtttctttagcttctacttcggaaaaggatcgtcttctaacgatagtgggaagtggcaccatgaaaacatcggcgcatgttgacggagaaaaagacgatttggtcagacgccactccaccactgagtttgtattcatgaataaggaggttccctttgatgatttcaccattggtgtcctttgcattttgaatttggctccatctcagttacacccgaacagggtggcaacaattgctcaacaccttcaagggtcttctaatattgacaagttaaaggccaagagcccccttaattctgctcttcaagccaacattactttagttggaaacaattcaaacatgaagggatgtatcttagatcttaagagcaagatgaaggaattggagaaatgtgctcttattactaaggcttcgaacaagactaataaggaggaagtggcaagattggaggttgttttggccaccgttgagagggaaagggataatgaaagggaggtgaagctttggattgagtag

SEQ ID NO: 79660 - DNA, 228 bp, Glycine max
  Peptide Sequence Number=SeqID_196438
atggttacacacagtgatggattagatgtcatcacagctatagcttccattcccacatacctaccatctgagcgaattcgccagtttaatgacttggctcaattttttggagatgaaagggctcagaatgcacgtaacatatggaacaggcctcttaagagcgtttatattagtgattgtggggagctgaaagtgacaaagccttccctcacgccttctttgccataa

SEQ ID NO: 79661 - DNA, 288 bp, Glycine max
  Peptide Sequence Number=SeqID_196439
atgaagagaaagcaactgacggattcacgtgatggtgggtatgaggtatctcgtcaatgggagtggcggaacccatgcatgaagaagccgcttttcataatggcgggataccttaatccgctattggtgctggcgggatcccttaagaaaaagactccctctcaaatatgtttacaaacaaaccctctaaggataaaactttgtaaaactacccctctgacatcattttgccaaaccgaaccatgtgtctggagtcccaatcaaatcaaggtgccaaacttatattaa

SEQ ID NO: 79662 - DNA, 195 bp, Glycine max
  Peptide Sequence Number=SeqID_196440
atggtgaataacatctttacacaaactaggcaaacatcatggtgcaggggtgctcgcccaggcgagctcaagctgagctcgcctgggcgagctaacctgtactttacttttttttttaagggaagacataagtatggccctctacgggccggcgttcgcttactcgaaccccctcagggtagattaggcatctaa

SEQ ID NO: 79663 - DNA, 339 bp, Glycine max
  Peptide Sequence Number=SeqID_196441
atggaggaattggttgagtataggaaccaagttcaagctgaggcttcgccaactaagaaaaaggtcgagaataatgaagcgttgcagaatttattaaaaagtttgctctttgtcccaacctacccttcagcgggagggcgacgcggggctcacgggtgcgtcttccaagaaaggaaaatgcacggcgtcgccaccaacgtttatttgaggaaaacgttagaaaaaccggaaaggtttggtctacgaactttaatcgtgaaaggttcgggagttgtttttacgcacggggaagggtgtttccctcgctcctacgtatcctcaattgcgatgaggaaataa

SEQ ID NO: 79664 - DNA, 153 bp, Glycine max
  Peptide Sequence Number=SeqID_196442
atgaaaaatatgcgtaagaaaagaggggagatggctgcgttcgcacttgttgcaatgaccagtcaatcagtcgtctatgaggtgcacattgtcatttcggtcgaggtgaaagtgttatggagattcattggtggtgattgttgcggtggttga

SEQ ID NO: 79665 - DNA, 342 bp, Glycine max
  Peptide Sequence Number=SeqID_196443
atggcaccgggttggatgcacaccccatccaataactctatcgaactacgatccggtacgtcgttgtttactttttataattgtgagttcggttcaaaggtgatgtgcgttaacaatctgagcacagattcgctgaagtggttgttggaagctgatggtgcagctactgctactgaaaggtcgaacgtcaaagtcttttctagtcataaggacggtgctatgaaggcaataacacagcaaccatcactagacaatacagaaacagacataatgcaacaatcagacacgataggaacgagcacaagcatgaatcagagacccagaagaaacaccactaactaa

SEQ ID NO: 79666 - DNA, 1749 bp, Glycine max
  Peptide Sequence Number=SeqID_196444
atggatcgtgacgaggctccattcactgcactggaatcttcagttgcagcattgaaaacaacaaccagcgaattgaaggtgttgaaacagtgtgacgatattaaagatttgtgcaagatgatgaagatgctcatggaacaaaaaggcatcacgtataatgatgccgagaatgcatctacggagcaaaacagtgggttggaggatgaggagtccgcaatggaacccgagccttcatcaacatcggaggacgaagagagcaagtctgaggcggattcaatactgaattcgtcatgccattattgggcaaaaggggtgaaaatgccagtgtttgaaggagaggatccgttaggttggatcacatgtgcggagaagttttttgcagtgcaacatgttcaacagagcccgaaagtgagattggcctttatcagcatggaaggaaacaccttgcattggttccagtgttggaagcaaaagacaaagcgaaaaagttggtttgttttcaaggcagtgctgattaagcgctatggcggtaccggaaggggagatgttgacgagcgaattcgaggtgctggtggctcaagtctcgggtacaaaggaagcggaattgagaggatattttttggcgggacttcgcaaggagatccgggcaaaaattcgtccccacaaaccgaaggatctgtcaagtgccatggaggaacgtggatacacaatgttggaggatccgcaatgaacacctttcacaacaaccaatgtcagaatcgaactctaacaggggaggcacatagctctgcgaacgtaatggctgcaaatcagagtgagtctacaagctcgggaacgtggaatagtggagtccggaacctgtcctaccaggagtaccttcgccgccgcggagcaaaactttgttatcattgtggagttccatttgttgctggtgacaagtgccttgaaaaaaccttagtggctcctactcaaacctatggagtgagattgggtgatggaaacaagaaaaatgctcaaggttgttgtgagcagatgaaggttcagttaggacaaatgaccataacagagaaattctttctatttgatttaggtggtgtagatgtcatattgggggtagcatggttggaaaagttaggagatgtcaagcatatagatgttgaattggtcatgtttctatgggtattggatactatggattcacatggcaaatacaccctagagaatgacatattatactttaaaggcaagttggtactgcctaccaattcaagctggatctcactcagccatttaatgaatttcactcttccttggcaggaggccactcaggggtgtaggacttatagaaggctagcacaatcccttcattggaaaggaatgctcaaaactattacatatttagtggcagcatgccatatttgccaaagaagtaagtacctcacttcttcactagctggtttattacaaccattgccaatccccaatgttgtttgggaagatattagcctagactttattgtgggattacctaactctaaggggcatgatgctattcttgtgatggtggataggctaagtaaatatggtcatttcttactattgaagcatccctatactactaggagtgtggtggatatgtttactaaggaagtaataaggctgcatgggattccttcttcaatagtaaatgacagggatgcattgtttttgagtaatttctggcaggagttattcaaaaacaaggaataa

SEQ ID NO: 79667 - DNA, 669 bp, Glycine max
  Peptide Sequence Number=SeqID_196445
atgacattcaagcgcaggaacggaggtcgcaacaaacacggccgtggccatgtcaaattcatccgatgctccaactgcggcaaatgctgccccaaggacaaggccatcaagaggtttcttgtgaggaacattgttgaacaggctgcagtcagagatgtgcaggaagcctgtgtctatgaacaatacacgcttccgaaactatatgtgaagatgcagtactgtgtttcctgtgctatccattctcatgttgtgagggttcgatcccgcactgataggaggaagcgtgagcctccacagcgattcatcaggcgcagggatgatgcacaaaggcctggtcagcctggtcaagctcctcgtcctgctggcacaggagcacctatcttattaaattttattatattacgtttactgattttttatgccattggccaagggaacctcgaaattcactatgcatacgccccttcacataaccatctatttacacttgatctagccatatatatatgtgaaccaccacatattgtaccaggcaagccaaatgcaaaagcttgtttctcgaaatttgctcaacttcccaagttaagctcatggcatatggatgagatgaggaatccgactaaggatttctatgtggcacggttaccaatttggttctgtagaggataa

SEQ ID NO: 79668 - DNA, 846 bp, Glycine max
  Peptide Sequence Number=SeqID_196446
atgattaaaaatcaatttggagtcaatattaagagaattaggtttggtaatgccaaggactactttaatcttgtgcttaactctttttgtcaaaaggaaaggataatccatgaatcttcatgtgttaacacaccccaacaaaatgggattgcagaaaggaaaaatgggcacttactagaccaaactagagaactttttcttcttcaaaataatgtgcctaagaagctatggggggaagccatacttactgccacctacctaatcaataggttaccttctaaaatcttagaatcaaaaagtcccatggaagtcctatcctcattctactcacatgtggcccttacaaataaactccaacctagaatatttgggtgtgtatactttatgcatgttcataggaatgaaagcagaaaacttgatcctagggcagtaaaatgtatattcttagggtattccaccacacaaaaaggatatagatgctttcaccctccatcaaaaaaattctttatgtcaagggatgtcaccttcaacaaacaaaagagccacttcaagcagcctcatcttcaaggggagaatgtaagaaaggaagataagcctctcatgcttctaaatatgtcatttggaccagaaatcaaaggaaatggtgttgttgaatcagaaaatgggggacaagaaattgggacagatagcgctattgtccctgaaatcgagaaaggaatggaacaagcacttgaactcataacaatgggaccaatacctgaacttgcacctaatagtaggaagtttgaaaagaatcggacatattcaagaagagaaaaggccattccaggatttgtccatgtctaa

SEQ ID NO: 79669 - DNA, 252 bp, Glycine max
  Peptide Sequence Number=SeqID_196447
atgcatgcaggacccaaaccgccagaaccagtggcgagtttggtgtccttgagcaaatcgccagcatcaatggcgatacgtgcatgcagagaccaaatcgccagtccaaatggcgacatgcacagatgcttgggaaccgccagtcaaactggcgagttccatggagtgagggtgcaggctagagaaggggagttgcaactgccattggcgagttgcctgcaagttgcaactcccattggcgatttagggtag

SEQ ID NO: 79670 - DNA, 240 bp, Glycine max
  Peptide Sequence Number=SeqID_196448
atggacatggagctagagcaacttaataagaaaacattttttctccatggaaagttagaggaagaagttttgacgaaacaaccagaaagttttaaggtgcaaggaaaagaaaattctagctgcagaagtccatatgattcatgtgtttatgatagtgaggtggaggatggtacatacttctatttatttctctatatggatgacatgctcatagcatctcaagacaagtatgaaatttag

SEQ ID NO: 79671 - DNA, 549 bp, Glycine max
  Peptide Sequence Number=SeqID_196449
atggctcgcacaaagcaaacatcgaggcatcatagagtgattgcatcagcgtgtgatcgacttgttgatgggcgacagcagcagccaacgacaaatccagagctagagccacatccacaaccaaggctagctactgataggataattggacctccatttggaggaggtctagtagattcatcccttattcgatcatataagacctactgtgttggtcatgtttggatccatcagaagtggctagagctaaagcttgtcagttattgtgcccaggtgctaatgtaccttactcatttgcaagctagggcttatattgaccagtcagggttatcaactcttgttacaatgtggtatcctaccacaaataaaggcttagtgaatgcctctgttgagaggtgtcactatgagacatcttccttccacctgcctatcagagagatgatcatcactctggattatgtgtcttgtctattgcacttgcctgtgacagacagaggttgcaggcatgaggttgacgtagctggcatacttgtatcagagatatgttaa

SEQ ID NO: 79672 - DNA, 240 bp, Glycine max
  Peptide Sequence Number=SeqID_196450
atggaagaagaaggagctggtgtctctggtggtgctgaagtagtgagggcctctgacctcttacccctagccttccttggccctctaaatgtcactattggatcatcaagattccaacagttcttcttaatatatgccaagttaatggcagggctcaagttctccaaggatctagaatctgactggactcctctggccttgcatagagttgtgatcaaggcagggaatccaagtctggat

SEQ ID NO: 79673 - DNA, 210 bp, Glycine max
  Peptide Sequence Number=SeqID_196451
atggatgagttttatgcgcaggtggcttggctaggagcccagccttctccttctggagggggtggggcctccgcagcccaggagcctgttcctgaggagccaccattagaagagaatgagcatgtgattggaagtgtgactgaaaatgttagtcagtttgtcagattgattgtgaaggaatgcattaaccgtatcccagtgagagtgtga

SEQ ID NO: 79674 - DNA, 192 bp, Glycine max
  Peptide Sequence Number=SeqID_196452
acactggttttcacattactgttaacaagccagtcctttcacagaagatcaactgctataagggcaaagagtttttccttgaagatgaggaagttggtgtctcagtgtgttttgttaaagctcgcccagggcgaatgcttaaacacgagcttgcaatgcttcaacataaatatgagctcacatttctagatg

SEQ ID NO: 79675 - DNA, 1227 bp, Glycine max
  Peptide Sequence Number=SeqID_196453
atggaggatttcatgctttataaaaagcaatgtccaaagtcatctgacaagaagggtctgatcctaaggaataatggaataggaatctctgtgatggaaccatctagaggaaccacacagctcaaaggtttgacctttgttaaaatgggaatattcgataacttccctgaaaatgctcaaaagcatataagaagaaagaaccatctaagcaaactcagagggagaaagctcaaacgaagcctaaaccctccaaacctagccagtccaaacttaaactccctaccaaaagaaaagatccacctccatcatctaacccaaaaccctttaacctatccaaaagatccaagaaacaaccattttccaacctttttaaacaacacacaagaggaaggaattaaatctgtgtatgaacctgaatctcaacccccaccaaagagatcaaccataaaaatcaaacatccccaacctcaacctttgcctatctcaccacccaaacaaccttcaccatcaagcactcaagattatgaactagaaatcctcgacactccaacccctcaacctttaccttccttagtgcttcctcttcaaccgacacccaaacctacctctcccattacaagcaaaaaaaaaaggaaaaatgctctacagatagaagttggtattattgcatttgttgaagctatgactatagaagagaataagaagaaagcagctgaagagactaccatatttgttgtcaatgatgagccaattccaaaagatcaacttcaatttgcaattgggcatgacactgaagtattctctatagatgcagcttcacgccaagtagaacttgaagtggcagtagtcctagaagatttagaccctctagagaaggaagctcgtgaagaggagttagttcaatctgttattaaagcctctcttcaagagtctgaggatcatgttattgagacaaactctggagacaccatcagacaaatggacattgtcttatcaaaagtactaagtgcagacaccattagacgctttaaggttatctatggaccatcaaattctaatagtattgaagacatccaagaaggtctagaacacatgaaatggctacttccttcaagatcattcccttcctctattacttcttttgttgtttctgttgaactagatgtcaatgttagattctaccctggtttcagaggacatcgcatcttggaatggcaaacctacaag

SEQ ID NO: 79676 - DNA, 165 bp, Glycine max
  Peptide Sequence Number=SeqID_196454
atggagccacgaaacccttctccgtcactgtcaccggttcgtgtcctcattcgcccttgtcgtctccgtcctcctcctcctcctcctccgaccatccctctctggcaccagtgtcgtggctccctcgctcctccgacggcgagaattataagcaattgggcttga

SEQ ID NO: 79677 - DNA, 294 bp, Glycine max
  Peptide Sequence Number=SeqID_196455
atggtagggtatggtagaaatttgcagttggctcagcaggagctctctgtcatcataaatctcattaacattgtatgcacatgttactctctgtcattcatgggaaagacctcaataagtcaagatcacctcccttttttcaatgtcgtgcatccatatacttatcgaaatgagttcccatatatgcatttcaacttcagtcaagatcggtatatggagtatgattattggatcaacaagacaagcgttgatggtctctttacaatcttcactagtagtcttcatcattattag

SEQ ID NO: 79678 - DNA, 177 bp, Glycine max
  Peptide Sequence Number=SeqID_196456
atggaaaattgtcttgtgaagttgcagaccaaatttcgagaagatccaacggttaacgaaggctgggcagcgtttttaccgaggcagcttcatggtgttacagttggggcaggagtaggtgtggccgttgatgacattggaggtttggggtgtggcggaaagagcattagggtttag

SEQ ID NO: 79679 - DNA, 447 bp, Glycine max
  Peptide Sequence Number=SeqID_196457
atgaatacatcatcatcgaacgcgtctgatgttgaacttaggagaacccatggcattcacgaaagtgttgtcatgcattttgttgcatgggacaaaaatactactttcagtgtggacgttgtgggacctctacatagacaaacacaccaaagggcagccacaaccactaggcgccatgtttttaccattgatgtctctgaggatatgatacaacacaattatcaattggtagattgtggtcgtggtagacatcacgaatggatgatcaccatgaataatggcctatcatgtgtttctgagtcctggatccattatttagctgactttcatttgaagcctggagatgaggtcgtcttcttctacaacattgaccaacatttatgggagttcctctataggaagcaagttaaatgggatcaggaagaggatgaagctgactccacttga

SEQ ID NO: 79680 - DNA, 432 bp, Glycine max
  Peptide Sequence Number=SeqID_196458
atggccccgaaatctaccctaaggcttatgagaaccctagggctttctcttgcatctccggtccaatcttcttggagtcttctatccaatgcccttgggggggcccaaatagatcaaaactcactcaggaaatttagtgacacggtagagaaatgcttgcaagaagatggttctgataggccaagcatggatgatgtattgtgggacttggggtatgcgcttcagcttcagagaggtgcaaatgcaatacataaagtgcagcatgaggatagttctagtagtgtttctgcatcatttcaattgcccaatgttagacatcttccttcattctccacactaagtgaagcagatgactccgttgtgaggggtgataagtccaatagtgctgaggattttgttttctcccagttgaaaatggaagacgccagatag

SEQ ID NO: 79681 - DNA, 2730 bp, Glycine max
  Peptide Sequence Number=SeqID_196459
atgaatattcacaacttcaaagaatatgagatcccaattggggtgattgagcaaccttatgtggagatggctgtcttggtgtaccataacacaactggagtatttgggggcaatggtggattccccgagaattttccaattcttgatggcaagaattgggagcaatggagcgtgcagatgaatgtcttgttccagtttcaagatgtgcttaaaattgtgcagaacggataccaagaaattggtgataatcctacggttgcacaaagagttatacacaaggatgcagtaaaaagtgacaacaaagccttgttcttgatccaccagagcctagatgcaagtatctttgacaagatctctaagcatctacaactaaggaagcgtgggatatattggagaggtggttcactagtggatagaagatttgaaagtctcacaaatgcgatgaagggttgtagtgaacaaatcacaaatcaaatgatcatagacaagatcatgtgcacccaaactcagaattttgatcacatagtggtggcgattgaagaatctaaagatgcacaggtgaaaggtgattttgcaaaatggaaaggaaaaaaattacaaggaaatttttttaagagaaattggaattctaatcaaagaaagaccaaggttgaagataaagtagaatcttctcataggggagaggttggttcttcagatcagggaaagcgaaagaaggaagatagaaggaagattcaatgttttgtgtgtgataagtttggccactatgttgaggagtgttggctcagaaaaggaaaaggaaaacaaaaagtagaggaccaagaagccaatgttgcacatgaggattctgatttagacccagttttgcttatggttacaaccaccgaatgtgcttcgtctttagaagcttgttatctagacactggatgctctaaccatatgacaaggcatatggagtggctcattgatttagatacaagtagatacacaaagtgcaatctcatgagtgtgggacaactagttgaaaatggattctcagtgattatgcagaatgaatctcttcagttgtttgactcaaacaaaaggtttagccatttaaattttagaagcctaagtcaattacagtctaaagacatggtgataggtctccccaatgtgcatgtgcttgataaaatgtgtaaggtagctagactaggtggcaacaaatactttgtctcttttgttgatgaacacagtagaatgatgtggctatacttgataaaggctaaaaatggtggtggagagtatacctctagggagtttgaagatttctatgaaaaatgtggcattcaacatgcaaaatgcttgccacataacttctggggtgaattagtaactactgcagcttacttgctcaacaagtgtcctaccaagagactaaaggagaaattgattcatggaattggcaagatggagctagcagcagtcaaaatccaagtgtttaaattcagttacaagatggaaaggcacattccctctagactctcagattatgagatacttcatgatagtgaagtcacacctgatggagacttagtacattttgctcgaatagctgatgcagaaccaattgatcatgaagaggctatgcaggaagatgtgtggaagaaagccatgcttgaagaattagaaacaattaagaggaatcacacctgggaattgactaagttacctcctcacaagaaagccatagatccaagggtggactatattgaagtgtttgctccagtagcaaggttggagacaatgagattagtgataactttggctagtagaaatggccactctctattccacttggatgtgaaatcaacatttttaaatggatttctggataaactggtttatgtcactcaacctctaggttttgagatcaaagggaatgaaagaatgaatgaattcaaagttgtgatgatggttaagtttaagatgtcagacttgggcaaactgtcatacttcttaggaatggaattccttacaacttcaaaaggtattatcatacataaaaggaaatatgcaactgatgtattgaagagattcagcatgattgagtgcaatctagctaccacactagcaaaagtgaatttgaagctagatgctacaagtgatgatgatgaagaagttgatccaaccttgtttaagcaattaattggttgtctaaggtacttatgcaatagtagaacaaacattgcattatctattgggttggttagcagatacatgtctaagccaaggaaaagtcatttgatggcagccaagagaattttgaggtacatcaacgacacactcgagtatggtgtgttattttctagcaagctagtgcagcaaaagaatgaattgattggctattctaactctgattggtgtggggacaagtcaaacaagaagagcacttcaggttacgtattcaagttcttagaggcaccaatttcatggtgttctaagaagaagccagtggtggtactctcaacatgtgaagctgagtatatagcaggggattttgctgcttgtcaagctatgtggcttgtttcagtgttgaagaaattgaagattgaagtgaagaacccaatacaactgttagtggataacaagtctactattgatttgcctaagaacccggtttcccatggcagggtatgtcaagtgttgagtcagcctcgtgcaaatgggaaagttagtaatatgtgttag

SEQ ID NO: 79682 - DNA, 1203 bp, Glycine max
  Peptide Sequence Number=SeqID_196460
atggagatccaacctccacgaccttcaccctatatcacattcactaatgcgaacttcaaaggtgtctctccacatgacaacgatcccattgtcatctacacagtcctgatggcattcaacgtcttgcccattctaattgacggaggggttaagactaaagttcgagattatgtcaatctggaaacaacttttggtgataaaggagccaaaactcccacgattcaatatatggtggtgaacaccccttccacctacaacatcttgctaagacgaccattgatgaataagttagaagaaattgttttgacagcctatttgaaggtgaagttcccgctggatcatgggttagtcggtgttatcagtgttcatcgagaaatcacttgcaggtgctattacgaaatccttagagccaagagagagctctatggactggcaaagcattatggggtccatttcgtagaacttgatcctcgaagagatttcatagatcaatattcgacttcgatggaggaagtgaaggaattagagattgggaaggggaagaaggtgaaaatcggcacgacccttacacatcatcttgaagataaccttttagaggtactgaagcataactcgaatgatttcgcatggagttcaagtgacatgttaaagaatgcgagggcaacctaccaacgtctgatggacaaggttttggccaaacttatggagaaaatcattgaggcttatgtcggtgatatggtgcccgtcatagtgcaagaggtggcagctgagcagtgctcgatatacttcatgagccaggttgccctcgcattcttgaaattgtccgaatacgacatcatatttgaccccgttggcttgtacacttcccttgtccatcagaaagggcgaaagaagattatcaagccaaggatccctagttggcaaatactaggagaaaacaaggagttagctcaatcttttacaagatttgaccccgataacctattaagggatgagaatgatagagccgatatattatttaggttgggtgtggaagcaaagctttccaagtttattttgaagatgccaaagactcaagtcgagaatcaagagtcaaacaagtttcaagaatcaaagagtcgttcaatcaagaatcaagattcaagtgaagattcaagagaagactcaagatatgcaagaacttcaagaaaagcatcaagataa

SEQ ID NO: 79683 - DNA, 288 bp, Glycine max
  Peptide Sequence Number=SeqID_196461
atgaggctctctgttttacttctagtgttcctcgcagttctggctgccacaaggcctagccttgtagactgtagggtccttccttcaccaaaaaacacagagaaagcccctcatgagcctctcaaagtgattcgatttctcatcaatttagtgatggcagaaaaggccaacactagtgagggtaatataagcaacagggttttgactgagaacaaattccaaaccatgtcttcagggccaagcagaagaggtgatgtaagcgctaaatcaaatcagcaaggagactaa

SEQ ID NO: 79684 - DNA, 414 bp, Glycine max
  Peptide Sequence Number=SeqID_196462
atgaagcgtatggtggacataaggagggagagcacaaaagaaaagagggtcgcagtggagcaaacaagggatttcaaccccttcacaatggtcatgttgaacacagaaatcccgatgaacattcagatcccaaaactaccattgttcgatgtgcaagctctttgttggaaccctgattgggttgctttggattggttcactagattgccaaacaattccattgtgcgctttgatgatttatctcatgcttttgttacacaatttgtagccaacaatgagaggccaccatcgacagccgacctatttgatggtcgttcagtgacaccaatttgttgtcagccggacaccatgacggacgtctgttcccaagtgacttgccatatagaagttaaggattcaatggctaggaaatga

SEQ ID NO: 79685 - DNA, 588 bp, Glycine max
  Peptide Sequence Number=SeqID_196463
atgaaggagtttttaggatccatattggaggtcaatcgttggggactaaaattgtctgagcagggtattattggcctacacttcaatctgactacatggaattttttaagaaatgcaatgcacatcaacgacacaccaatctgtatggtcttccaaccgagtatttgcattcttggtcttcctcgtggcctttcaacaagtgggaaatgggcaaaagctgaatcggttgccaaaatcaccacagaaagagttaagaagttcctatggcaatcgattatatgtagatttgaagtccctaacactttaattgccaacaacaacacgcaattcaaccacgacaatgtcaaggagttctacgaaatccataacataaggttgatatctacattggtcgagcatccacaatcaaatggtcagtcgaaaggagatcaacttgttgaccttgacactgtcagagaagtacatggagtaacacccgttcaagaggcaatgactaagcttcgagccaaactgaggtacaattcccgagttgtttcacgggaattcaaggaggtggatttagtgatgaaaaaggctcaaccaaactag

SEQ ID NO: 79686 - DNA, 1453 bp, Glycine max
  Peptide Sequence Number=SeqID_196464
atggcgattcttcagctccatagaattcaacactctgtgtgtgtgctacttgtttttcttattcatttctcatcactgcagttcccttcacacgggtacaccgttccggataagtactttaacaattgtggctcagacagcagtgctagcaaaagtggcaagaattacgttggtgaatcaaaccttaaaaccagttttggcagcagcaacacagaaaggagtgagtcacaggtgccttctcctctttaccaaactgcaaaaaaatttcgaagtgaggcttctgggtataagttcaacatcaacgtggcacctacctgtttcaatgtttctgttcccggtttctggttgttgcgaaatttcaatggtagaaatgatagcgataacaactctgctgtagtaaaagagtttttcatgcaaattacttccggcagcttcaaaatcacttttagacctcttccatcatcgtttgcgtttgtgaatgctattgaactcttcatactccccatccatttgactgccaatcaagtatcacgtttcacttatagtggcaatacgtctttagatcccctcagcggagatgatagctatatcttaaatacggaaaacgccaagaatcgttccccttacctgggtccaattcagtaccgtgtagggaatgactcagatggttcaaacgcaaatgaatatactgcgccaagtgatgtgtacggaactgctaaagaaattaatagcagctcttccagtgctggaaacataacatgggctcttctcgtggacaacaacgcagatcatcttcttcggcttcacttctgtgactattggagtccacaaaatgatcttaaatacttcgatctgtccatttacgacacctatgtcatgtccgtaaatattgataaccaggagttgcctgccccttattattatgattttgtggtacactctgatgactctgggtttatgaaggtcagcatagcacctgatgcatccgctcccatacctaatgcatttttaaatgggctagaaataatgaaagtgattatgacatcaagttctgttcccctcgaccaggaaccctattccaatcataatagtcttccagtggtgctgggttcagttattggaggtttagttgtggtttttgctgtagtgattctaggctttctttggcgttttaaaatgagaaaggaaaagcccgttgagaattcggactggttgccaattcccattactgctggagggagttctcacggcagattgactgatggaaccagccacggctctcctcttcccaacataagcctcaggctgaaaagtcccttgattgatcttcaattagcaaccaagaacttccatgcaagtcagctaattggcgagggtgattttggcaacgtctataagggagttctcagaaatggcatcatattcgccgtgaaaagaagccagccaggatcag

SEQ ID NO: 79687 - DNA, 420 bp, Glycine max
  Peptide Sequence Number=SeqID_196465
atggagatcacagtcgttgggtttcatgacagggttgcggttgagatcatagtggggtttgcaatgacttactatgggtttcatgtttggagagtcggtggtgtcaacgccattagcttttgttttcttgacactctcggtggagtccctaacaacgagtgggagctttgtgacaaactcgacgcggtggccacgggaggggatggaggaggcagtgatggcaaagacgacgatgtagcgcttctagctccctggccgggcgcagtgtgttttgccgccgggaacacgggggatacgggagacgacatgaccagttccctgcgacttgttgaaggtctagtggctagcgcagtggctgacgacgtagggttgtcgattgttcttggagatgttggagtgtatgaagttgattatgtctga

SEQ ID NO: 79688 - DNA, 204 bp, Glycine max
  Peptide Sequence Number=SeqID_196466
atgactctcgcaaagctggaatccacttttggcgctaagcgcaattcctctcaactcacttttcactctaagggagatgtcaaaaagtgttattttgcatatcccaacggtcaaaccatggggatatgggttacgaaccaacagtccaaatataaaggcgatgcaacggttaacgaatcttggattatggttttaccagaatag

SEQ ID NO: 79689 - DNA, 186 bp, Glycine max
  Peptide Sequence Number=SeqID_196467
atggcggttttgtggtggctactggtggctgaaagaggagaaggaaatgacgtttttccaaggctacacgaaaagcaaaggctgaaacactcaagtgcttcttctcacgggaaaggaagcattcctcacatgccagacgtcgtatcaaagatctcgacggtcagatcgtggacatctgtcctatga

SEQ ID NO: 79690 - DNA, 213 bp, Glycine max
  Peptide Sequence Number=SeqID_196468
atggcggtggataatattggaacaaatgaagcaaaagaaaatggtagcactaatgaacaagctatatggccaacaagacctatcaaggtggctatcaatgatcatttgcccttttctcccattagaccaagtgtaaggaatgccactagtgggaatgtgagtcaattgttaagagtccgtacaactctaaagtcattagagtccaagctctga

SEQ ID NO: 79691 - DNA, 447 bp, Glycine max
  Peptide Sequence Number=SeqID_196469
atggcattcttgggagagacaagcagtcagacagttgtgaactccacattaggttttatttttccaaatggatccattgttcacaacgacagtggtgtttccttccaagcttccactccagttcccattcgagtacctaacggcattgctagaaccccagatggtattttaaacttacttgaagctactatgacccctactcatgatgccctgctatattacaatgggaggtggaacatgtcacgccaaaatgagtttgtaggttactcgttcataggaaaaaatcccaaaaactttgacattcccaccggatgtaccatggatgaactgaaggatttgatcaaacaagttgcgcctcgtgggattcccccttatggtgttgatgaaacacaaatgataacacgattgttttttcggatagtcaatcagctcaagaatgaaaagtga

SEQ ID NO: 79692 - DNA, 483 bp, Glycine max
  Peptide Sequence Number=SeqID_196470
atggaaggggaaaggaaagaaaagaagccgccacgacgctctacgccctctgctccttccgtgataaccggcgtaaagcggtggagtgcggcgccgttcccattctgcttcgaagcaccgattctagacttgagaggagcgtgtgcagattcttacgcgtgttttgcgggttttgtcaaaatccaaagaggggagggagcagatggaacggttttgcgggtgtgtgcagattcttacgcgtgttttcaggaatggaagctcaaggggagttcagactgggattcacaatttgtctgcagtactgtgaaaaaaaagggaaatgagaaaaagaaggaagatttggttagagcagtttgccagcttgaagcttctatgattcaaacttgcaacttaactccagaaggagcttgtggtaagcttagtcatgatatgaaagctattcagcatcagattagtttaaaattatattcattgtccccataa

SEQ ID NO: 79693 - DNA, 327 bp, Glycine max
  Peptide Sequence Number=SeqID_196471
atggagcccgggaagactccgatggtggccttgttaacatggaggacagtgaggctggtgaggagggtggcggcgagggcgcgacagtcggagggggaggcagaggagaggaggagagagattaaaggggagaggaggtcctcgacaatgaggccgaccttagcgtcgtcgtctagggagaggtggaggaggagggaaagggagggtggggacgagggcgccaacgtagatgccaccaacgaatacgtgcggcagggcaaggaagcggtagtcgaggacgacgtcgagctcgtcgcggaagcgggtgatgctcttgtgcgggcgtga

SEQ ID NO: 79694 - DNA, 438 bp, Glycine max
  Peptide Sequence Number=SeqID_196472
atggtagccataaccctagccaaggttcatcaacctccatttctccgagaatacgactcgaacgcaacgtgtgcttgtcacggagaagccccggggcgttccattgagcattgtagggctctgaagcgtaaggtgcaaggtctaattgatacgggctggctgaaatttgaggagaatcgcttgttgaatcctaacattaacaagcaacaccatacatggggcaattctggaagctgttgttatgactcatcaggattttcaattgatatctttgtccctcatcctctcacaaacgcatgtttgcttattcaactttcaccggaatgtgggtgtaagccattggtctgtttgctcaagcaacctgcgctcctgagtgttgacttccaagaccgttcaatcagagattactcatcttgcacgttggtgggggtgccgtaa

SEQ ID NO: 79695 - DNA, 295 bp, Glycine max
  Peptide Sequence Number=SeqID_196473
atggtgggagcaggtttgaaaaaggatcttagagtgtctagggttgtgccaggagggtctcttaatgccttcctttttcttctcatcggagttatttcacaaagacttgccatgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 79696 - DNA, 267 bp, Glycine max
  Peptide Sequence Number=SeqID_196474
atgcctaaaattattgcacataaatggaagtttggtaacctattgcaggctcccaacacacttccaatgaaaggcctttttgttacaaaacttgaaagcaatgaagtgcttcttagtccaatagctcttaaggtggttggcgccatgcttattgactcaaattcttcatgggatggcaccaatcttccttccaattccctatatggcaacccacaaacatggaaacaaagagacaagcaacaaccaaagaccaaaaaattgaaatga

SEQ ID NO: 79697 - DNA, 159 bp, Glycine max
  Peptide Sequence Number=SeqID_196475
atgtctatgaacttaggatcgataatggaacgagaggagaaaaggaagaggaaatggaggagggaatctgtgtttcctgagcctcagagtgtcattggcttcaactcgaagaacccttgcgcttttttgatggttctgccatttgagggagttgtttga

SEQ ID NO: 79698 - DNA, 482 bp, Glycine max
  Peptide Sequence Number=SeqID_196476
gaatcaacaatgtcaacaatgtccaaactggggaatcaatgagagcaataacttctccagatgacggatcggaaagatcggagattcctccaactggggaagtaggaaggtcagctgtttctcctgctggtgaatcagaaggggcaaccgcttcatctgatgatgcatcggagatgataattagaggtggagatgggggcaccacttcacgctcgggagaagacagtggattcaccactggagattgtgggtcagctggctctggatcaacctgcacaggtgtgggctcaagtggagcagcctcgctacacatgagaataaattgccctcagaataagctttgcaacataggaattaaagaatgtgcttgttgggcatctggttccatggatgctgtcgaaggaaatgggttggatgatgaagggatgtcctcagttctcgctctctttcttgattccatctgtaacttaaaaagaacttaa

SEQ ID NO: 79699 - DNA, 180 bp, Glycine max
  Peptide Sequence Number=SeqID_196477
atggtgacagagaaagtgttaacagttaaaatgtggatggaagatagttgtgagggaccaagtgggttcaatgatattgatgaggcgacgttggaggctgttggtgatatatctatggagatggaggaattaggtgaggatgatttgagtgaatatgaatttgattatgaagattcttga

SEQ ID NO: 79700 - DNA, 1472 bp, Glycine max
  Peptide Sequence Number=SeqID_196478
tggcgcggcgcctgtctggctattgccgcgctgctgtgtctggcggtgctgccggcttacctgtatgcgctgccggcgccgcgcacgccatcgatgccaaaaaccaggcaacagcataccgcacagaattcactggctcccacgctgttctggctgctgtgcagcatatttaccctcgcgtcggtgatcatgacggcgatatcggtgcagctgattaccctgctgcaggcgagcgggcattcgctgagcgccgcgctggcaatcagcacgctgctggggccgtgccaggtggcgtcgcgcattgtcgatatggcgttcaaacgcggccatcccatctggaccactttcttctcggtcgggctggtggcactgggattactgctgctggcctgttatcccgcgtgggcgctggtgagtatggtgctgtacggtgcagggaatggcttgcgggctatcgtgcgcggtacgctgccgctggcgatggtaaaaccggaagagtacgccattgtggttggccgcatggcgcgaccggcgctgattggtcaggcgctcacaccgctgattggcggctatattttccagcattccggtgcgcaggctacgctgtggctgttatgtgcgctggcgcttatcaacgtgcttttggtggtggtgctgaagcggaaattgccggcaggcgctccggaatccgcaggcaacacaacgcgcttaacagcagagtgcagccagccgagacaatgaaaggcagcggtgccatccgtacgcattgccataaggttggcgcgttcaggcagctggttgccgccgtgatgatgcccaccgtcagcgggagaacggttgcgcacacggcgcaccacgcgtgcagaaattatcttccctttgtcacaacatcctttgccagcccgcagctacagcggtgggggcaaaaaagtgacacatcgcgcatattgttgcgcaaggctcagagtgctaaagcggaaacagaaatgctagattaccgcttcccgacagctttgcagatggttttgagcgtagcgatggcggagcaactgggtaaacgctcgaccagtgccattctggcgtacggtcttgaagcgaaccccagtttcattcggaaactcatggttccgttaacgcgcgatggcatcattgtctcgacgcttggccgtaccggctcgatccatctgggtcgtccggccgctgagatcacgctgcgcgatatctacacctcagtgattgaagacaaaaaactatgggcgtcgcgccccgatgtcgcaccgcgctgcctggtcagcgccaacctgtgctggtacttcaaatcgatcgcggagcaaacggaagaggcgtcgcttaaagtgctggaaacccgcaccgtcgccgatgcccttaacgagctgaaaaagcacgataccagcaactgtgaaccgctgcctgacctcgaaatcgccgaactctgcaaaaaagaccgctaa

SEQ ID NO: 79701 - DNA, 216 bp, Glycine max
  Peptide Sequence Number=SeqID_196479
atggttggagcattctcgcaaaacatcgtgaccctgactggtcttcctatgatcttacttagtgagagtgacctgacaaacccattgtgtggtgtgtcttgttatgtactcctaagcgccccagggtggtttttcactgacatgatgaataggtggatgactataaagaacctcatgctagaggacacgggaacacaacgctctgataggatgtga

SEQ ID NO: 79702 - DNA, 222 bp, Glycine max
  Peptide Sequence Number=SeqID_196480
atggttcaaggaaaatttgtcccaaatttgggggaggtattatcaaggtatgaaagctatgtgcctaagaaaaagggcaagtatggggaaggaatgaatgaaaaagtgacggttattctatggatgaatgctctcctagaacctaagcttttgaatcctagaaaaaccatgaattgttggcagcctaaccccattacaagcctagaaagtccttcgaattga

SEQ ID NO: 79703 - DNA, 942 bp, Glycine max
  Peptide Sequence Number=SeqID_196481
atggagcaaaccactctcgaagccattcagttcaacgaggaaatccaaggtctcatggctgctccggcgccggaaaccgccaattccttcaccgcgctgctcgagcttcccccgacgcaggccgtcgaactcttccactcgccggagcgcgccgggaaaccgccgcgccacagtcccaaatcctatccgttgacctccttcgccgcctccgcatccgcccccgccaccgccaccgccaccgccaacgccaacctcacctttccctccaacgccgcgctgatcgatcgcgccgccaggttctccgtcttcgccggccagagctcgaactcgaactcgccggaggtgaagcgagagctgccggagaccgattccaacccgagctccactcacggcggcggcggcggaggctccgtctccgatctcgccgtggagaaccagaatctgaaaactgcgaagaggaaggagcgagagaagaaggttaaagcgtcgtcgaagaagagcaagagcgtcgccgccgccgacgagatttccggcgacggcgagaagcttccgtacgttcacgttcgagttcgtcgaggtcaagccactgatagccatagcttagcagaaagggctaggagagagaagataaatgctcggatgaagcttttacaagagctggtcccgggttgcaacaagggagtgactccaatggactgtaacttccctccgacagttgcacctgtcatgtggccagaaatcccacagaacggaaacagacaacaatatcagcaaccatggccgtttgatgcactccaccaacccctttgggggagggaagaagacaacactaatttcatgactccagaaaactcactcttgagttatgactcatcggcaaattcagttgaagatggagctctaaagggaaactacaaaggtggtggtaccagtagcaattag

SEQ ID NO: 79704 - DNA, 399 bp, Glycine max
  Peptide Sequence Number=SeqID_196482
atggctaactacaaagccaagaagttcttccatgatgctcatttctatgtctgggatgatccccatttattcaagattggagcagataatctgttgagaagatgtgttaccatggaaaaagccataggcacattatggcattgccacaattctccttgtggtggatactacagtggggatatgacagttgctaagtacatcttggttgttgttgattacgtgtttaaatgggtagaagttgtcgctactccaaagaatgattccaatattgttattgatgcaatcctccctaggaaggggccattcactagagccatgagcaagaggctccaaaaggattgggctagagctgctgaagaaggccctagggttctcatgaaccttagggtagatttctga

SEQ ID NO: 79705 - DNA, 948 bp, Glycine max
  Peptide Sequence Number=SeqID_196483
atggcttgcacgaagcagacattgtacgttgcggaggcaaaggcaaagccacagccagggctagctattgttaggattgttggacctccatttggaggaggactggccaaaggtgaagcttgtcagtcacggtgctcaggtgttactgtaccctacttatttgcaagtatgggcttacgtggacaaatcggggagatgtcttccttccatttgcctgtcagagagatggtcatcactctggatgatgtgtcttatctgctgcactttcctatgacatgtagacccattaatcatgtcctttcactctttgacaaagaggcagtgaagatcttgctgatgagtcatttgggcattttgatagagacagaggcttctgcagcaacaaacacaggtgtcagggtgaggttgatgtggcaagaagacctttaccactactatgttgagtcagactctacgatatttggtgacaagtcctccactcatgtccatctcactaacgctcattacatcaacaaattggatgcttgccacgagtacacatggggagtaactgcaatggcatacctctacgaccatcttgcatatgcgagcaagactgatgtgaggccttattgtctggagagggtgttgaggcaatttggccttgtccagatgattccatgccagccacctccccatcctacatatcagctttgtggtcaaacatggcggactagcaatagcatatcattcctcttgacgatgttgtgccacctaggtacaatcatagcttgggcaaccactaacagactatgtactaggtggagagtaatcttgccaggattgattccagatatcatcagaagctatacagagcttgttggacctaagagttgtgctagagggcacaagtcatcatcaactcatacaacaagctatgcaactgttgcagaagggtttagcagttag

SEQ ID NO: 79706 - DNA, 648 bp, Glycine max
  Peptide Sequence Number=SeqID_196484
atgtataacatacaagataaaatcaacctatccctagtgatgaagatacgacaccttggcgagctccaccagcaccgtctcgggcttcttgacgcgcacgatgagatcggagttgcgcgcttggaggctgcggcggaggtcggagacagagtcgataaggaaggcggcacgatagggcccagtcttgtcaaagtcggatgccgacttgccgtagtcagatgggtcgaagaagtagatggggaggacggagagggagtcgttgttggtggcggtgaggcactcattgtcaaggaggcggaggtcgttgcagaaccagatgagggcggcgcggcggaggggggtggcattgggagggtcgcgggggcggtggggagcaatggagagaggggcgtggaggggattggtggatttgaaggaggttttggaaggaggaggagtggtggtggagagagaaaggtgtgtgcagttcagcttggttttcatgcaaccttcgcgccaagcacgattactgcgcttagcgagtacggcggtattcgtgttcagtgtgtgtctcgtgctaaacgcgccttcactttccagaaatatctatacttcttggcactaagcgtgtgttgtccgctaagcctgtgcattgcactaagtgcctga

SEQ ID NO: 79707 - DNA, 195 bp, Glycine max
  Peptide Sequence Number=SeqID_196485
atgaagaacagtgaagaatctccacgaaatcgctcacggaaacgtcatggaagcgttacggaaggaaaaagagggaggtcgcctagctcgcccaggcgagctgggttgcttccaccagaaggcaccgccttctgttggaaccccctggaatgcccaagtgggcctggttgctatttgcacacccttttttactaa

SEQ ID NO: 79708 - DNA, 1590 bp, Glycine max
  Peptide Sequence Number=SeqID_196486
atgactcctttttacttcctcctatttgccttcatccttttcctctccataaacttcttgatccaaacaagaaggttcaaaaaccttcctccgggaccattttctttccctataatcggaaacctccaccaactcaagcaacccctccaccgcacgttccatgccttatcacaaaaatatggccctattttctccctctggttcggctcccgttttgtcgtcgtcgtttcgtcgccgctcgcggtgcaagaatgcttcaccaagaacgacatcgtcttggccaaccgccctcacttcctcaccggcaagtatatagggtacaacaacaccaccgtcgccgtttccccctacggcgaccactggcgcaacctccgccgcatcatggcgctcgaggttctctccacccaccggataaactccttcttggaaaatcggagggacgagatcatgaggctcgtgcaaaagcttgctcgggactcgcgcaatggcttcaccaaagtagaacttaaatccaggttttcggagatgacatttaacactataatgaggatggtgtcagggaagaggtactatggtgaagactgtgatgtgagtgatgtacaggaagcaaggcaatttagagagatcattaaagagttggtgacgttaggaggggctaataaccctggggacttcttggctttgcttaggtggtttgattttgatggtttggagaagagactaaagaggattagtaagagaaccgatgcgtttttacaaggactcattgatcagcatcgtaatggaaagcatcgtgccaatactatgatagatcatcttcttgctcaacagcaatcacaacctgaatattacaccgatcaaatcatcaaaggacttgcactgttgtgcctgtggccccaagagacccaagtgttgacttgtgagcctgcactggtcctgagaccaatgggagtgttggaaacgaaaacttggaaagtaatgctacttgcaggaacagatacatcagcagtaactttagaatgggcaatgtctaatttattaaaccatccagaaatattaaagaaggcaaaaaatgaattagacactcatataggacaagatcgtctagtagatgagcctgacattccaaaactcccttaccttcaaagcattgtttatgagacacttcgtttgcatcctgctgctccaatgttggtaccccatttgtcttcagaagattgcaccataggagaatataatatcccacaaaacacaattttgttggtgaatgcttgggccattcatagagatcccaagttgtggagtgacccaacacactttaagcctgagaggtttgagaatgaaagtgaagcaaacaagttacttccatttgggttagggaggagggcttgccctggagctaacttggctcaacgcacactgagcttaactctggccttattaatccaatgttttgagtggaaaaggactactaaaaaagaaattgatatgactgaaggaaagggacttactgtgtcaaaaaaatatcccttagaagctatgtgccaagtgtgccaatcactgacagttaaggatatttataacttctag

SEQ ID NO: 79709 - DNA, 2052 bp, Glycine max
  Peptide Sequence Number=SeqID_196487
atggacgacgcaaagaaattgtacgaatcactcttcgaccaactcaactccaccttccgccgatttttctccgctctgcctcagcgccaccatgacccttacgctcggtctcttcggcctccgcctccgcctccgcatccacggctgtggccaattgttcaagaactttctctcgttctgcggagctgtcttcttctcctgacgctcccgcgctccgaccagaagttcctcctcctcaagtgccgcttcctccttcgcgttttgaagtccttcctctctcttgatgtcgccgaacatggcggtttgcgcttccgcaactttctctccggcgttgacttggagcttcctgattcttgccgttcgtatctatgcgcgctgcttgaggattttgcaaaaggggttgtccggtgcatgaggctcctacctgatgaacttttaagaaatcaatctttgagaagatatcttatgaaggttgattcagtgtcttccaccagtgaaaaactttttatgtgccatttcaaccaaggtgatattgccagtgtcctggaggtgataactacccatttcatcatgtcagtttctaatgagaaagcattcgaggatttcacaagtggattatttttacaatgtaacatggattttagatttcctaaacttagccttgcgccctccatgatgttgctgcttgaccctgttgtgctttctgcaccgaagatgtttcaggcacacacattttcaatggtttctgaagccattggttcaggcttatcttcagagattttagctccagatatgaattgccacctaacagcacttcaaaaatctgttatcttgtactctacgcatgtgtctagtttgcaaataaatggcttttgtgttgagttgaaatgttcctataattcatacctgcttgagagaggtcagccaacttttgaagcttatatcctgcaaggcacaaggaacagattaaatcaagtcttatcaaaattagataattcatgggactcctatcattgcaaaatgtcttccaaatcaaaagctgaccttttggctgactacattgcatttatgaaagagagacagcacatatttgttgattcatgcagggatgcgactaccttaatcttagattgtattatccatcaagctttctctcaggatgccactggagatgcagtataccatataaaggaaaatactagtgcccaagacatacaccttcttgcatccatattgaagttgatgagtgtttcattgctacagacaattaagtatctaagcaatagtggtgattcagattgtttaaaatccatgggaagtgcctctgtgcgcgagaaatatgatttcttgatcagcatcattgaccattttcaacaatttaagttctgtttaccaattcaaacattattgtatgatgcgatgaaaactcagcaatcaaattacaaagtctccaaatcaatgcttgtgcactttataggcttgctatctttaagttttagcaatggatttgatttgcttgctaaggggtgtatactcgtacttatggcactgatgtgtctatttgtttttgaagagggagatttagttgctttggggtcattgaggggtctgtcattgcaaccttgctcgtctgaaattccatctgataagaatggaaaggggtctagagataagcgacctgtctataaagttgccgcagagtttcgtagaattcaagcatgtaatttaagaacggtttccttcacctcctataacttacaggatggaacagagaaaacctgcaatggggaagtgttccttaattgcatattagaagaccccaaaaaggtatctgattatgatgatcttgcagatttccttgagtgtaagacggggaaaaattattccaagtggttgaatggccgagaagtatatagaaaccggaggtatcagagaaaaatagatttaaggaaaaagaagaaggaaacattctggaattcttctaagtatagaaaaattggcaagtctttgaagcgacagaacatttgtacgtttatgaagcattggaagtga

SEQ ID NO: 79710 - DNA, 825 bp, Glycine max
  Peptide Sequence Number=SeqID_196488
atgaaaccctacacgtcatcaccatcatcctccaagtccaaaaagaagccaacaacaacacaacaagatcatgaaacagcatggggaggaaggtaccttggagtgaggaggaggccatggggaaggtatgcggccgaaattcgcgacccttccactaaggaaagacattggttgggcacgtttgataccgcagaagaggccgccctagcatatgataaggcggcccgctccatgcggggctcacgtgctcgaaccaacttcatctatccggatactcctccgggttcttctgtcacctccatcctctctccagacgagcaaacccaaacccaaatccaccaggcccaagaagagctctcctctctattcaacccaaacccgtttccacaacctgacccgaacccgcaattttccttatgcgggttttcgggtatcccgaacactcctacattttctgccaccgaagaaattgcctcatccggtggctatagctacagttatggatacaccgaaggaggaaccggcgtggagagttcacattttaagctctttgatgatggtgaaacgcagcttccaccattgccaccggatatcacaagctccatgggctatgaaatgagtaatgggctttatggaaacgatgtcgggttttcggatccaagttgcggagctaatgcttccgggtcgggttacccgtattcggggttcgaatcaggtgattacgtggtgcatagtccactctttagtgcaatgccatcagtgtcagataatgtggcaacgggccatgagggttttgatttgggaagctcttcttatttcttctga

SEQ ID NO: 79711 - DNA, 234 bp, Glycine max
  Peptide Sequence Number=SeqID_196489
atgatctgggaaaacattgatccacacccgcatacagaagtgacacttgccatgaaatttttctcagagcggagtttggtcaaatcgaagtcagcagccatgacaagtagcattgtacagaatagggtcactacatggattcctcttcctccgggttttgtaaaatgcaatctcgatgcagctatttttaaagagcaattgtctttcaatgtgggcatgtggccttcaggatga

SEQ ID NO: 79712 - DNA, 312 bp, Glycine max
  Peptide Sequence Number=SeqID_196490
atggtgaaggttatcaactatacctgtgattatgatacactgttgttaggtgggacattcgctctttattcgctgctctgtaggcatgcaaatattagcttactccctaatcaacaagcagctgatgaggagatgtcatgctacaaaaatggtctctcaccagaggctgcggaatcatcttcattgaagaggtttttggagaatcatagaagtttaaaaacagccctgctggttgtggtgttgctaggtgcttgcatggtcataggtgatggtgtgttttctccagcaatttcaagtaagatacttttgtaa

SEQ ID NO: 79713 - DNA, 1125 bp, Glycine max
  Peptide Sequence Number=SeqID_196491
atgaatatgcatcttttgaaactatggtactgggctggccttgcttgtatgacggttatgtttgtgactacatttctgatggcactagtcataatgtttgtctggcagaaaaacattctgattgccacaatattccttctgtttttttgggtgatagagggtttatatctatctgcagcattgataaaagtgtttcaaggaggatgggttcctcttgtcttatctttcatcttcatgcttgttatgcatgtatggcattatggcacttgtaccaagtacaactacgatctaagcaacaaagtttcattgaaatggttactggctttgggccctagccttggtgttgcccgtgtccccgggattggtctcatctacacagaacttgcaacaggaatacctgcaatattttcccactttgtaaccaacctccctgcatttcacatggtgttggtctttgtttgtgtgaaaacagttcctgttccacatgtattaaccaaagaacgtttcctaatcgggcgagtttgtccgagaccatatcgaatgtataggtgcactgtcagatatggatacaaggacattagaagggatgatagagactttgacaaccatatcatacgatgtatagccgagtttatccaaatagaggcgcaggaattacaactctcgatttctgaaacttcttcattcgatggagggacaactattataagtgttagaagcttcgaatcagtttcaagttggacagtgtctgagaatgaagatgttggtgtggacaacaacattgctagtggtagatctttctctcgacaaccatcgatttccacttatgacaaagaaaacccacattcaagaaggcgccacgttagtttcctggtacctgatgatcctgcattggatcatgaagttaagcaggagcttcttgatttagctcaagctatggaggctggggttgcatatataatggggcacacacatgtgaaggcaaggaaatcatcctcattattgaaaaggcttgtgatcaatgttgggtatgcatttcttcgaacgaattgcaggggtccagctacggctcttaacattcctcacatcagtctcattgaagttggaatgatatattatgtgtag

SEQ ID NO: 79714 - DNA, 895 bp, Glycine max
  Peptide Sequence Number=SeqID_196492
atgtcttcaaacctcaccattgaacaaaggctcgaacagctgcaaaaggcaaaggaaagagcacaaccccaaccacccaaaggggccaaaatccaacgggtagcacatcatctccgagaccgaaagcatttcaccaagcattacgagccgaaactgatgtcattgggtcccatccatcacggtgctgaaaaactgcagctgggagagcagtgtaagcaaaggtgggcagcaacgtacatcgaaagcactggaaaaaccccacaaactctacacaaaagggttgtggacgattttgaaaaccagaagaagttgtttgacgatgaccttttattagcatcgacccaacaggagaagagaaatcttttgggtcctattcgtcacaaatgcaccttgctcgaaactcaagcgccatggaaagtcatgtctacaaaattccacagtaaaaagtctccgtcactcatcgaacaaacaaatgacattaacgtatcagaagcaaggcttcacaaccatggaagaaaagattcagtggatgctgttcgtggacgcgtgtgccctgctgcaaattctggaacatgcaaatcttcacgcaccggagaaaatgaaaatcaaggtcgatcaactggttctggtgatgggggacgtgctcttgttagagaaccagcttcctttctctttgctgaaactgttgtggaaaaacgacgagagcgagttgatgaaaacaatgaaaaagtttcttcgcgctctatcatcctctatgatcctaacaagagaaaacagactcaaaataatgataatcaaaatcaagacactaacaaggggaatgaggctcaaaatgatccaaacataaacatggccaacatgggaaatccgactccaaatgaaaaccctgtgcaaa

SEQ ID NO: 79715 - DNA, 321 bp, Glycine max
  Peptide Sequence Number=SeqID_196493
atgaggaaaggaaaggagggaacatacaagtatgctaaagccagtgacatctgcaaaggaagtggccaatgcaatacctgcaagggagagttcgccaagatgaccgaccagccatcatcaatgacaccacctgtagcaaaaactgtgacactgagaccacaaccattgccttatcaaggatacgagaaggtgaagaatgaaggtcaccctcttgttttcttttatgatttctcgtgcaaaaagtgtgtgccttcaaacaagaggattagtccaagacagaaccgacaatgctcagattattcgagagacagagacgactag

SEQ ID NO: 79716 - DNA, 315 bp, Glycine max
  Peptide Sequence Number=SeqID_196494
atggcaggtgctttggaaactcaatgtggccaatcatttggaaccgagcagtttcataagcttggaaactatgtcttctgtgcaatactctttctcattttaagcagtgccccaatatctatcctatggattttcatggataaactgcttgttcttttggggcaagatcatgctatttcactagtagctggaaactactgcatttggctcattcctacactctttggttattcaaggtttgattgttcgagaccatggatatgtggtggttccaaaccatgtaacaatttcttgtataattggggaggccaatga

SEQ ID NO: 79717 - DNA, 210 bp, Glycine max
  Peptide Sequence Number=SeqID_196495
atgtatggaggtcacggcaaggtgaaggttgaagggcgaaagggagatggaaagacatgcgcgtaccaagacttaataaaaataactacaaatgagacaaaggcggtttttgtaaaaaaccgtagtaataggcttacaaacaaaggcggttttataaaaaccgccttcgtaacgtttgtatcaaaagcggtttacaagacccgtcgttaa

SEQ ID NO: 79718 - DNA, 1536 bp, Glycine max
  Peptide Sequence Number=SeqID_196496
atggaattagctggcgtggcgctgcaggagcggcaggaaaaagcgctcgacgcgctgcgtcaggtcgggctggaaaattatgctcacgcctggcccgatgaactctccggcggaatgcgtcagcgtgttggattagcccgcgcactggcgattaatccggatatattgctaatggacgaagccttttccgcacttgatccattaattcgcacggaaatgcaggatgaactggtaaaactgcaggcgaaacatcagcgcaccatcgtgtttatttcccacgatctggatgaagcgatgcgtattggcgaccgcatcgccatcatgcagggcggcgaagtggtgcaggtcggcacgccggatgaaatcctcaataatccggccaacgattatgtgcgcaccttcttccgcggcgtggatatcagtcacgtcttcagcgccaaagatatcgcccgccgcagcgccggcgcgctgattcgtaaggccgccggtttcggtccgcggtcggcgatcaaactactgcaggatgaagaccgcgaatatggctacgtgctggagaaacagaaattcatcggcgtcgtctccactgactcgctgaaagcggcactcgccgcaggtgaagggctggataacgccctgctcgacgcaccgctggcggttcctgccgatacctcgcttaacgatttgctctctcacgtcgcgcaggcaccctgtgcggtgccggtgatcggcgaagatcagcagagcccagccatgagtgcacaaaacgccaatccatgggaaagcgccagccagaccagcgcaccatccgccaccagcaacgccgccgcagccagcagcgatccgtggtccacgacaggcagcagcacgccggctgacagcagcgccagcgccgccgatgcctggggcaacgccgccggcagtgcaccggatgccgccagcagcggcgcacacgatgccgtcagcagcgccgccagcagcagcgactggctgagcagcgcaccggctcccgcgccggagcactttagcctgctggatccgttccacaccacgctgattccgctggatcgctgggtcaccgaaggcatcgactgggtagttacccacttccgcccgctgtttcagggcattcgcgtgccggtggattatatcctcagcgctttccagcaactgctgatgggtctgcctgcgccagtggcgatcgtggtgtttgcgctgattgcctggcagattgccagcccggcgatgagcctcgccacgctgatatcgctggtgctgattggcatgatcggcgcctggtcccaggcgatggtgacgctggcgctggtgctcaccgccctgctgttctgcgtactgattggcctgccgcttggcatctggctggcgcgcagtgagcgcgcggcgcgtatcgtacggcccctgctggatgcaatgcaaaccacgccggcgttcgtctatctggtgcccatcgtcatgctgtttggtatcggcaacgtgccgggcgtggtggtgacgattatctttgccctgccgccggtg

SEQ ID NO: 79719 - DNA, 312 bp, Glycine max
  Peptide Sequence Number=SeqID_196497
atggataaccgctggggtatcaccgtacgtcacctgacttcacaggtcaggaggacaaaaagcacggaagacaacatagcaaacgagacttatacggataaccacttgggtatctccgcctgccacctaacttcatgggttatgattaacagaaattgcctttgtacggataaccactcggggtatctccgtacgtcacctgacttcacggggtatctccgtacgtcacctgacttcacgggtcaggatgaaagaaagcacgaaaggcgacgtaaatctccgcgtgtcaacgggctcgttggccacgattga

SEQ ID NO: 79720 - DNA, 431 bp, Glycine max
  Peptide Sequence Number=SeqID_196498
atgtacaacatcaaagatgttcttgatgaagacattatcattggtatcaagaatatgctagataacaacaatcattatgcacaaaagttcaaaatagcaagggacaaactacaatcttctgcggtttctaacctcaagctgaaactcatttgtgataggcagtcagatggaagattatataacatgccaaatactgctgaagttgttgctttgattattggtgatgagcacatagactgcaatcaagggacaatgaagctcaaacaatactacattcaaggagattgtttcaacaatggattgttgatggctagtgaactcagagttgacaagtacatgaatttgagtgcctataataatgaccccgaaacacttggcaatcaaaaaggaatgagagttatacttcctagttcttttgttagtggtaagag

SEQ ID NO: 79721 - DNA, 552 bp, Glycine max
  Peptide Sequence Number=SeqID_196499
atggatgggttggtggacctggcagcgattgacatttttctcacctttcatgaccgcaatgaaagcctggttgtcgctatcttagccgatctatatgacaccttcgaccgaagatgtgaaaagaacagtacaaggattgtttgctgtactccggccctctacgtatggttggtttcccaccttttccgccaagaggtgagacatgcttgcccgctagaaggccaccgctcatgcacagagaaaaaagaggcaagttgggaccgactcttagcaagcaaagaaggagcgtctgtcaactggttcccccgatggaaagaaggaagaaccgagattcttatttcgtgcggaggatttccaaatgtttccttgatggggacaaggggttgcattaattacaatcccatcctcgccataagacaactgggctaccctatgagaggggcaccattagaggaagacctcacacctattattgcacgaggtttcaatagcaccaacgcgcaaggcatgggagatggtgcaaaagaaggacaaggaactcagaggcagtag

SEQ ID NO: 79722 - DNA, 236 bp, Glycine max
  Peptide Sequence Number=SeqID_196500
ggagttgtgttgatccctcaccaaccgatccagagacgggtgactcggacgaatgcgggttgtacatcgaagaaaatccttcccgcctggttgccctaggaagagtttatgagggatccaccgctgttcacaacacccctttgttgcatggccaggtgaaggttggtgttaaggaggtgaaagatgcggaggctcccgttcctgtagccactgacgaggttcaactagtggggtag

SEQ ID NO: 79723 - DNA, 186 bp, Glycine max
  Peptide Sequence Number=SeqID_196501
atgaccaccatctgccagtgtccgctgcagtggaacctaaaatgggtaggctctaagatacacattgcatccaactctttatgtaactttcagattcaaactgcgattgcccagacctctgaatggactgaggctcaaggaatccatagatatcagaattccccgctcgcatacatgtttcagtga

SEQ ID NO: 79724 - DNA, 456 bp, Glycine max
  Peptide Sequence Number=SeqID_196502
atgaaggcgaggacgtgcgaccctctgaaggcgagggcgtgcagtcctttgaaggcgaggtcgtgtagccctatgaaggcgaggtcgtgtagccctatgaaggcgagcccctttgaaggcgaggacgtgcagccctctaaggcgaggatgtgtagtcctctgaaggcaagggcgtgcagccctctgaaggcaaggacgtgtagtcctcttaatgcgagggcgtgtagccctctgaaggcgaggacgagtagtcctcttaaggcgagggtgtgcagccctctaaaggcgaggacgtgtagtcctctgaaggcgaggacgtttagccctcttaaggagaggaaatgtagtcctctgaaggggagggcgtacaaccctctcaaggcgaggacgtgtagtcctctgaaggtgagggcgtgcaaccctctgaaggcgagggcgtgtagccctttgaggtga

SEQ ID NO: 79725 - DNA, 284 bp, Glycine max
  Peptide Sequence Number=SeqID_196503
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaatattgagtgatgtggtcgtagggcaggaagatctgtctatggtttttgcattagcaagcacatgggccatgttccttgcatttggcagtttagcctgtgttggtcccgtatcatacactgttggcatggcttaa

SEQ ID NO: 79726 - DNA, 1414 bp, Glycine max
  Peptide Sequence Number=SeqID_196504
cggcgagccgtcggtgcgcgcgtggccggtgaagatcgaacagggcaaagtgtgggtcggcaaccaggcattgctgctgcgcgcggaggcgagctgatgagcgaaacccgaaccacctgtccatactgcggcgtcggctgcggagttatcgcccgcgttgaacccagtggaaccgtcacggtacgcggcgatgaaaaccatcccgctaactttggccgcttgtgcgtaaaaggggcagcgcttggggaaacgacctcgcttagcgggcggttattacaccctgaagtcgatggccgggcggtcggctggccgcaggcgctggcggaggcgggttcacgtctgcgcgacattattgagcgctacggcccgcaggcggtggcgttttacgcttccggtcagctgttaactgaggattattacgccgccaacaagttgatgaagggctttatcggcgccgccaatatcgatacgaattcgcggttatgtatgtcatcggcggtcaccggctataagcgggcgctcggcgcggacgtcgtgccgtgcagctatgaagatgtcgagcagagcgatctggtggtgctggtgggctccaacgccgcctgggcgcatccggttctctatcagcggttggcgcaggcgaaacgcgataatccgcggttgcggatcgtggtggtggatccgcgacgcaccgcgacctgtgatattgccgacgatcatctggcgttggcgcccggtagcgatggcgggctatttgtcggcctgctaaatgccattgccgccagcggtggaatggcggcgggttttcgcgaccagcggcaggcgctgaccatcgccgcgcagtggagcgtggaaaaagcggccgctttctgcggcctggcgccggagcaagtggctcgcttttatcgtgattttatcgctgcaccgcgcgccatcacgctgtacaccatgggaattaatcagtccgccagcggcagcgataagtgcaacgcgattatcaatgtccatcttgccagcgggaagtttgcccgccgcggctgcgggccgttttcgctgaccggtcaacccaacgccatgggcgggcgtgaagtgggggggctggcgacgatgctggcggcgcatatgaattttgagccgcaggacctgcagcgattagcgcgcttttggggcagcgagcgactggcgcagacgccgggactaaccgccgtcgaactcttcgccgcgattggacgcggcgaggtcaaagcggtgtggattatggggaccaatccggtggtctcactgcccgatagccacgcggtgagtcaggcgctgtccaggtgtccgctggtgatggtctccgatgtcgccgccaatactgatacggggcgctttgcccatatccgctttccggcgctggcatggggcgaaaaaaacg

SEQ ID NO: 79727 - DNA, 1351 bp, Glycine max
  Peptide Sequence Number=SeqID_196505
gagattcttgtgcgcttggatgatttggaagaaagccagcatgttgaagacagccgtggtcgtagcatggtgggaggacgcagtataggcataggcaccattgcgattgcgctgatagccatgtattttggcgtggaccctaatctggtcctcaatatcgcacagcaggcacaaccagccgccgagtctcaagccgtgcctgcagatagccgtgatccaaaagtgaagtttgtttcacgcgtgctttggagtacagaacaggtctggcaaaaagcttttgcagacgcagggcaacaatacacagccccgaatctggagatttttggcggcgcaacgcaaactgcttgtgggcaggggcaagctgcgatggggccgttttattgcccggcagaccagaaagtctatatcgacctgagtttttaccaggaactgcaagagcgatttaaagcacctggtgattttgcccaagcctatgtgattgcgcatgaagtcgggcatcatgtacagaatttgctcggcacctcggctaaggtacagcaagccaggcagcaggcacgttctgaagctgagtcgaatgcttactcggtcaggctggagttacaggcggattgttatgctggagtctgggcgcatcatgccgatcagcaattccgcattctggaagagggcgatattgaagaagccttgcgcgctgcaacggccattggcgacgatgcgttgcaaaagcaggcacaaggctatgtagtccctgatagctttacccatggcagctcggcgcaacgtgtgcgttggtttaagcaaggactgcagtcagggcgggagcagcatttaatcgaaacgaccgtatcaagcgagattttggcaaagggcaaaatgctgaccgtgcgctacgacgaagcccgtttgcccaacggtgtcatcagtggccgcgaatatgtgatccatccgggtgcagtggttgtgattgcattaacgcaggaaggtggagtggtattggaacgtcagtttcgttatccactgaagcaggtgtttattgagttgccggcgggtaaaattgacccggatgaaccggttttgaccaccggccaacgggaattacttgaagagacgggttacacggcgcaggaatgggtcaaattaggcgtacaacacccctgtatcggctactccaatgaagtcattcatatctatctcgcgactggcttgtcattaggggcgcatgccagagatattgatgaagccatggatgtctttgtctggccgtttgagcaagtgatgcaagcgattgaggctggagaaatcactgatagcaaaaccatgtcggcaatgttgctggccgagcgctatctac

SEQ ID NO: 79728 - DNA, 639 bp, Glycine max
  Peptide Sequence Number=SeqID_196506
atgggaacaaatcaaaccggcaagaggttctaccaagtcaaggtcaaaagcctagataccaccagcatcaaggaattagggcggttgatggaacccctccaaatgcaagccttccgcaagacttacggaaagatcttagagttgaccatagtagaggtgtccatagaagccgttgcatcacttacccaatactacgaccagcctttgaggtgcttcacattcggagacttccaattagtaccaaccattgaagaatttgaggaaattctaggatgtcctctcgggggaagaaaaccatatctttcctccgggtgtctcccctctttgagcagaattgcaactgtggtcaaggattcagcaagaggtttggaccgcataaaacagactcgaaacggcatagcgggcctaccacagaagtacctagaagacaagccgaggggtatggccaatcaaggagattgggtcccgtttatggatgtgttagctttgctaatttttggggtcgtcctcctttccaaacgtggatggtttggtgcgaaaagagtagcgcacggatcatctgttgcttacccgccctctgtgtttggttggtttcgcacttgttccgacaagacacaagacatccatgtccgctcctga

SEQ ID NO: 79729 - DNA, 480 bp, Glycine max
  Peptide Sequence Number=SeqID_196507
atggattcactcattgtccccgatttggcgctgttgcggcgctggctggatcagtcgggcatctctttctttgagtgcgattcctgccaggcgctgcacctgccgcacatgcagaacttcgacggcgtgttcgacgccaagatagatctggtggacaacgtcattctgttctctgcgctggccgaggtgaaaccgaccgcgctgatcccgctggtggcggacctgagccagatcaacgccagttcgctgaccatcaaggcgttcgtcgacattcaggacgacaacctgccgaagctgatcgtctgccagtcgttgagcgtggcggtcggcatcacctacgagcagtttacccacttcatgcagcagggcgaagagcaggtctcgatggtgatcctcgaggcgcgggcgaacgatctgctgtttatgggtgatgaagaagagatccccgctggcgccgtgcgtcagccgatgctgcactga

SEQ ID NO: 79730 - DNA, 297 bp, Glycine max
  Peptide Sequence Number=SeqID_196508
atgagggaaatttcaatggggagtgtcgcaacctacccttcagtgggagggcgacgcgagactcacggttgcgtcttccaagaaaggaaaacgcgcggagtcgccaccaacgtttattcgaggaaaacatcggcaaaaccagaaaggtgtggtctacgaactttaagtgtgaattgttcgggagttgtatttactcacggggaagtcgacaagggtgtttcccttgctcctacgtattcctcaattgtgatatattgtgaccaaacaaaaagtcgtttaaggagttggaccatttaa

SEQ ID NO: 79731 - DNA, 276 bp, Glycine max
  Peptide Sequence Number=SeqID_196509
atgattgtcatcgtcaaaaagggggagaatgtgaatcatgcagcttttgatgatgtcgaaaagaattcacttgataatgattgtcatcatcaaaaagggggagaatgtgaatatcaagcaaacaagatcaagaaaaagataaggcctcaaacaatctcattggttgatcaagctctttcctcaaaacacattgtttccaacatccaaggctctagtaatcgattaccaggcagtgtaatcgattaccaaaagacaattttgaaaatcagcttttag

SEQ ID NO: 79732 - DNA, 807 bp, Glycine max
  Peptide Sequence Number=SeqID_196510
atgtgtactgcccgagttttgccattctccccagcggctatttacgatgcttttgcatcgccagagttactcgctcaatggtggggcccagaaggctttagcaatacctttgaggtgtttgaatttaaagcgggcggtcagtggaagtttgtgatgcatggccctgatggtaatgattatccgaatgaaagcgtgttcgccgtgcttgagctgaatagcaaggtcgtcattgaacatgtttgtgcgccgctatttacgctgacggtaacactaaatccggtggaaaatggaactcagcttagctgggagcaagtgtttgctgatgaggcaacggcgcaagcggtcaagcatattgtagagcctgccaatgagcagaatctggacagtgagtgtaaaggggccctcttgaagtttgttgtttgccagcatgcggtgcatgcgcaacaaatcctcgatatatttaacgaggcaattgttaactctacggcattgtatgattatcaaccccgtgcatttgactcaatgctgccatggtttcaaaccaaggaatctaacggatttccggtgattggtgctgtcgatagcacaggcgttttgttgggatttgcgacttacggcacttttcgcgcatggcctgcctacaaatatacggttgaacattcggtctatgtacataaagatcatcggggaaagggcttggggctggcgctgatgcagcaattgattgccgaagcgaggagcacgtcaggtgcatgtgatggtgggtggtatagatgtagcgaatgtgggcagtattatcttgcatga

SEQ ID NO: 79733 - DNA, 462 bp, Glycine max
  Peptide Sequence Number=SeqID_196511
atggcttcccgtaagagaaaagccacaacttcagtgtcccatgccggatatgacaaatcaagacttgtatcacaggaggcctgggaccgttactcagataatgtgcttgccaggaacattctgccagagagaaatgtcaagttgtatatcactgaatttgatgattttagaagagaactaattagaagaaactggcatagacagcagaccaatttggctgagggaagcattgatgtggcaattgtgaaggaattttatgcaaacctatttgtccatgatgacacgtctcccaagcaagtcagggttcgagggcaccttataaaatttgatgttgattccctcaacaccttttttgagacttcaatggtagtggagcaaggggagagcttaccttcttactccaggtttgctagactgaggcctgatcctcaagagcttgcagcccggctttgtatcctctga

SEQ ID NO: 79734 - DNA, 439 bp, Glycine max
  Peptide Sequence Number=SeqID_196512
gatcccagctagcccacctcaattagaccttgcaccttacgcttcagagccctacaatgctcaatggaacgccccgtggcttctccgtgacaagcacacgttgcgttcaagtcgtattcttggagaaatggaggttgatgaaccttggctagggttatggctaccattgaattatcaagtagatatgggagcaagtttagcatatgacaccagaatttgggatgaatcctacaggctttttgctgcaaaattcctttttggctttgtggttgatttagggatggcctttatggataattgggtggtggggaatgagaagggtgccacttgggctgccaggtctctccacctttgggcgtattctttgaaagatctgtgcccctttttgcacatgttctgtagtcgcatcctatccggaaccatatcaaaattgtactga

SEQ ID NO: 79735 - DNA, 277 bp, Glycine max
  Peptide Sequence Number=SeqID_196513
taatagtggagggtacatccacttggttgttcaaagagaacaagggagggtacatcccttgtggatctttgcttttaaaggtttttacaaggttgaaaagaaatctcaaggaccgcaggtcgcttggggagtggatgtaggcacgggttgttgccgaaccagccatttgatccaacaagcgcgagttagtgaagatccactaagtgagctgagcacgcttagcacaaaaagagacaagcgactcgctaagcgagttgatgacgcgctaagcgcatag

SEQ ID NO: 79736 - DNA, 189 bp, Glycine max
  Peptide Sequence Number=SeqID_196514
gtggagaagatagcagtgagcgactccgctcttgttgaagaagctggagtggatgatgattcgacgttctctagagtcagtatccgtagcggggacagctcttgtttttcctgggctattgaatcaactgagaacggaataacagctgttagagtgagcgctgctagtcttagcaagtctgggacttaa

SEQ ID NO: 79737 - DNA, 523 bp, Glycine max
  Peptide Sequence Number=SeqID_196515
atggctctccctcttataattgaaaagaaagcccctaaggctagtatgcaagagaagactagctctataaagtgctttaaatgtcttggaagaggacacattacttctcaatgccccaccacgaaaaccatgattatgaggggccaagacatttatattagccaagatgatgctactacttcaccttcctctaatgaaaatgaagaagcaataggggaagaatctagggaagaaatctatccccaagaagaaggacaacctttaatggttaaggaggagtgtaaggaggtaagtgtctccttcaagaggttagctaagaaggaaagtcattttgaaataaatacaaatattaaagaaacttcccctcttaaacaacctccacatcttctcctttgtaaaaagacacttgttagcactgccacacctcttgggcttgaggttattccccaagtaaaggagttgttggatgagggtttggttcgtaagagcttaaatccttgtgctttgttggtgcccaaaatag

SEQ ID NO: 79738 - DNA, 228 bp, Glycine max
  Peptide Sequence Number=SeqID_196516
atgaacagtgcacataacataacacactttgggggcggatatgaacttgtaaaatgtcttaaatgcccttactcgatcacatcagcagagcaactactagagcggaaggaaaaagaaaaggtagaagaagagacaagaggcgttaggtgcccttcacttactattcgtgaagtgaaagagcaagtgggggtgtttaagcatggagctgtaacgggtcctctcaagtag

SEQ ID NO: 79739 - DNA, 621 bp, Glycine max
  Peptide Sequence Number=SeqID_196517
atggcttccgattcttctcccctgaatttcaacaacggaccttcatcccccgacgactccctttccagccctatcggcaacaccttctcctcgccggcaagtagacgccggcgccgctcatccaccccctccgcattcgccaccccgtcggagcgccgctcccgattcgcctcctccgatgccaccccaaccgcgccgcgctcccgccagagaggtggcagtggaggcggcggagggcacgttcccgccactccgacctccaccaccgacgacgtgccggtctcttcggatggcggcgacggcttcgacatggacgatgccaggcccaccttcgtgtggggcaccaacataagcgtggaagacgtgaacgacgcgattaaaaggtttgtgaggaacttcagagaagcgtcttcgtcgcagggtggtgacgatgatgacgggttgcacttgcacaccgaagggaagtatgagaaactgatcagacaggttattgacgttgaaggagattctcttgatgttgatgcgcgtgatgtgtttgatcatgaccctgatctgtacactaagatggttaggtaccctcttgaggtgcttgccatctttgatttggtcttgatgaacatg

SEQ ID NO: 79740 - DNA, 159 bp, Glycine max
  Peptide Sequence Number=SeqID_196518
atgggggagcagtggagacagtttaagtctgatttgatgtccaaatgggcacttgcagccaacaaggacaatatcgatgacactgtatgcgaaaagtacggcattagcaaggagaagtgggcccaattttgtcagacccgcagagaacctttgggggag

SEQ ID NO: 79741 - DNA, 524 bp, Glycine max
  Peptide Sequence Number=SeqID_196519
atgggtaccaagtacaatatcgagaagttttctggaaacaacgatttcgggtttgtagaagatcatactaagctcctgtatgtagatgatattcttatagatagctcaagcaaggatgagattagtacgcttaaggagaggttaagttcggaatttgagataaaggatcttgatattgcaaggagaattcttgggatggatattgtaagaaatcagatgaagggagaattgttcttatctcaacaaggctatttgaagaaggtagtggaaaggtttaggatgcatcaatctaaacctgtaagcacacctttgggacatcacactaaactctcaattactcaagctcctaatactgaagaggaaaggaggaagatggatactattccatatgctagtggagtaggaagcatcatgtatggtatggtctgtagtaggccaaacttggcccatgctgttagcattgtaagcaggtttatggcagatccatgtcaagctcattgggaggctttgaagtgggtattgag

SEQ ID NO: 79742 - DNA, 2176 bp, Glycine max
  Peptide Sequence Number=SeqID_196520
atggactcgctcttcaacaccactgacgcgctccccttcgcctccgatctcgaattcggcatggatttcgacaacaacggggaattcgaaatcaccttcgacgacctcgacgaactcgacgacatcttcatcccctccgacgccgaggatttcctcctccccgacgtctgtaactctaattatgactccgcttcgccgccgatcgacgcaaagaattccgattcgccggattccgacgtgtccgcggtttccggcgagggcgattccgcggataatgttagggtttcgagcgttccgtcgccggaggctgagttttgcgaccgggaggagtcttctaacggaccggtttcgtcgcagggttccggcaacggcggatcgggtgtatacgaggccatgcactcgccctcacctgattccggcccttacgagagggacataacatcgtctcatgcgcatgcagttacaaacaatggtgtgaaaatggaggaaactccagcttttgatctgaagagaaagaaagaaagttgcgatggaagtgctaccaagcacagaaggttctcttcctcggtggagaataataataataacaccgagaaacagtctcagtctggtttgaatggaattgacgatgaggatgagaaaaggaaggcgaggttgatgaggaacagggaaagtgcacagctttctaggcagaggaagaagcattacgtggaggagcttgaggagaaagtgagatcattgaattccatcattgctgatatgagtagtaagatgtcgtatgtggtggctgagaatgctacacttagacagcaagtgggtgctgctggtgtcatgtgtcctcctcctccagcacctgctcctgggatgtaccctcatcatcctccaatggcacctatgccttatccgtggatgccttgtgctccttatgttgttaagcctcaagggtctcaggttcctttggttcccattcctaggttgaagcctcagcaacctgcttcagcccccaagggtaaaaagagtgagaacaagaagagtgaggggaaaactacgaaggttgctagcattagtttgctgggtttgtttttctttatcatgcttttcggtgggcttgttcctcttgttgattttaggtttgggggtttagtggagaatgttcctggtactggtaggtctaattatgttagtgatagggtgtatggtcaaggtggagggaaggtttggtctttgaatggtcgtaggaatgggtctgaaagagatgaggatgtagggttttctaatggtgggaggtttagtgtttctgacagagtgaattatgagcgaggccggaattttagagaagaaaggcatgatcgtcggaaaggctcggatgatttcggtcgtcagggcaatgccagtgagcctcttgttgcttctctgtatgtacctaggaatgataagatggtgaagattgatgggaacttgattatccattccattatggccagtgagaaagccatggcatctcaaactgccgaggcaaagaaggacaagagagaaactgggttggccattcctaaggatttggattctgcactggctattcctggagttggaagaagcagaggtcaacatccacatgtgtatagtgtttctcctgaacagaggaaggctcttggctctggttcaaccaaagttttgaaggaccatatgaagtcctctgtaactgatggtaaaatgcaacagtggttccgtgaaggtctcgtagggccaatgttaagttctggcatgtgcactgaagttttccagtttgatgtttctccaagtcctggagcaatagttcctgcaacatcagtagccaatgtttccactgaaaaccgtcagaatgctaccagtgtcaaaaagaccaggaatagaagaacccttcatgagctcccagagccgcttaatggatctagtctgaacataactgaagaacgagtaaagaatttgcagaaagaccacctccatggtaataagtcttctatggtagtttcagtccttgttgatcccaaagaggctggcgatggtgatgttgatgttgacggcatgatgagaccaaagtcactctctcggatttttgtggttgtgctaattgatagtgtcaagtatgtcacttactcttgtggtctgcctcgtgcttctccccatttggtgactg

SEQ ID NO: 79743 - DNA, 399 bp, Glycine max
  Peptide Sequence Number=SeqID_196521
atggtgcctaacggggatgctgacaaaggccctatagaggcatgccaagctgcaaacctcaccaacgacgatggtagtgtggagatcgataagtctaccataatggcccctgacttgcaacggatactacacttccaccccaccctcaccgtcggagctcgctacaaaatcagtgtcgccgtcaacctctccgacacatgcaaaggcgaaaaaatggagaggaagcggaaaaccccatcatacaccgtgccgtcaaaaccttcatctccatttctcgcctttgcatgtgttggagaggtcgacgacgacatcgattttgcagtaggcaccggcagtgaaggtgggggtggaagtgcaatatccactgcaaggcggagaaattcgaagaaagacgactga

SEQ ID NO: 79744 - DNA, 939 bp, Glycine max
  Peptide Sequence Number=SeqID_196522
atgagggaagacgattcgaattggttttcgcgatgggaagaggaacttccgtctccggaagaactcatgcctctatcgcaaaccctaattactcccgatctagccatggccttcgacatccgaaaccctcacacctccaacaccgcacagaatcaacaccaccaccaccaccaaaaccaacaaccaccgcaactacaacaaccttcgaacccttcctcgctccctaacccgcaacagcagcagcagcagcaacaacaacaacaacaacaacccacctccgccgagttcgccgactccggtgaactcggctccggcaccgccggcgaggagccggcgcgtaccctaaaacggccccgcctcgtgtggaccccacagctccacaagcgcttcgtcgacgccgtcgctcacctcggcatcaaaaacgccgttcccaagacgataatgcagctcatgagcgtcgacggtttgacccgcgaaaacgtcgctagtcacttgcagaagtaccgtctttacctcaagcgcatgcaggggatatccgccgccggtcctggcggcgcctccggtgccgtcgccgaccccgccaccgaccacttgttcgccagctcgccggtgccggcgcatttcttgcacccggccgcgaggccgaattcggatcatttcctgccgttcgtgccggcgctccaccaccaccaacagcagcagcagatggcggccgcggcgcagtaccaccggcaggtggggcatttcgggtcgccgccgaacgggcacttcgagaacccgtttatgtctaggccgaatcttcagaggatggggggtggtggtggtcctgtgcacaacaaccaccaccctgtgagtggttatgtggaggacatggagtctgctaatgctgcctctggaggtagaaaggttcttactctgtttccaactggagatgattga

SEQ ID NO: 79745 - DNA, 462 bp, Glycine max
  Peptide Sequence Number=SeqID_196523
atgtcatctccttctccaacaacaatcaccaccaccgtgccacgaatgccatctaacccaacgccacaaccgttgatcaaaatcgacgtcgatactgacagtggcagggagaatgagaaccccgttgtgaagacgtgcttctactcctgcatcaagctcttcctctacctctctgtggtcctcttggttttcgaaatcgtcatgtacttcgaagggtggtattttggcatggcaaggtttcagctgaagcatttgttgtgggcatcgtccttcggaatccggtttaagaagatcaagcatgtccctataggtggaggtgtcgtagatcttgaatctggagaaggaaagagtttctctttttccccaatggtgctcgtgcagatccccatgtgcaatgagaaagagttggacgacggtagtggcacgatggtggtggtgatttccgttggagaagggaaatga

SEQ ID NO: 79746 - DNA, 588 bp, Glycine max
  Peptide Sequence Number=SeqID_196524
atggactttgactatgccaatacctttggttttcctacttcgttttatcaaggcatcagtcccagatcaggagcatacatatttatcctcaacaatgttgaccatgagcttgctactgtggagtatattgatgacatttacaagttctataagcttgttgaggttaatgaattagtccgcctcacagattacactcatgaacaggtactggtcatggagaaaaccataatggggaagttagaaaacatggcccattttttgtctgagttgggaatgatgcactatgccaccataaagtactttccatcaatggttgctgcctcagcagtctttgcagctagatgcgctctgaataaggctcccctttggaatgagacacttaaactgcacagtggttattcacaagaacaacttatgcatgtgaatatgaattgggattgtgctagattattggtgagtttccactctacggttgcgaatagagaggagaaggttgtgtacttaaagtattctgatcctgagaaaggagttgttgctatgcttccaccagctaaaaatcttctgcccgaaggttctaactctcaatag

SEQ ID NO: 79747 - DNA, 516 bp, Glycine max
  Peptide Sequence Number=SeqID_196525
atggcatcaagacccatcgttcaacaagaagctagaggtgttgcacgtgaatctgtgtgtttagtgatatatttttatgatcctttgaggatttttggtgccaaactacttggtaatgcaccagcaccagcaactgctgaaaataacaagaaacaagcttgtgctaatgtggctggttctcctactgttgctaatggaggagttgtggtggccaaaagaatggcccccaaacctgatcagaagaaagtggtcctaaaacctaaacccaaaaaagtcattgacatcaaagctagtccaaacaagaaggaggtcctgaaagacaagaagaaggaaggagattccaacttcaagaagaaatcacatcacactcttactttagtgttcaccactagaagcaaggcaacatggggcataactaacaagttgaaggagcggattattgatattgattccgatgatgttgacgatgagcttgttgttgtggagtgtattgatgacatttacaagttctattag

SEQ ID NO: 79748 - DNA, 2553 bp, Glycine max
  Peptide Sequence Number=SeqID_196526
atggattggaatatcattagcaatgaggtcagggcgaagagcaacccgcaatccccaaacgttcccaacgcaacgcaggctcaaacaatgccttcgaattcaaagcagaaaaagaagcaatccaagcttttgcagcagtcatcattgtcctccaatgccgccaccacgccttccaaaacgctccaaccttctgaacttgcctccttgtgcgaagaagcttctcgaaagttcccttctctcatcgctaaatccgcgttcatcgccgaactcgcccaggtcgacgacactgttcccgtttctaacagaatttggctctccgcaccttccatgctctccctctctctcccccccggttccacagtctcggtgtctattccatcttcgggggagaaaatttcgcaattgcatagctttcctctcgcatcgttagctaatgaatgtgaaaaactctatggattggaaagtagcaaggcgttggatgattatgcgggaaactacttggtacttgcaaccgtgtttccttctagtaaggttttgaagaatggagtacgcctgtcttcaaacctttatcatgccatgggatgtcctgctttgggcacaagtgtgtttgttcatccaatatctagtgctgcaaatgggatcaatgaacaacattctacaggaaatagttgtctgtctatatataattgcaaggaattgtatcttcagttggttccttctaagaatggtctaccattgaaatttaataactttccctcattgggtgtgtctaaggtgaaatttcatgtccaatctgagaatgatattgttgcatctcctgcaacaccttcgaatggatcaaagttttctaatgcttgtgggatgtcttctccactgtttgacaattcagcatctagtctgccaaatcagaatagtcaatcattgaattcatttgatgttagcttagcattagggaatgaaagttctaaagaattactactgacgggtgctatgaagcagccagttaccaaatctgatcattatccatcaaatggaaacggtgatttatatcctgaggattctgatatagcagatagtggaaatcaggctttcactgttaatgatgaaacaaaggtgtttttatctctgccatcaaatgccgcatctgaagagccaattcaaagggatataccttgtgtgaaactagaaagcaaagttgctaatgctagcttacatgataaaatctctaaattgggtggtgttcttcttcatggtccacctggtacaggaaagacttccctggctcaattatgtgctcatgaagttggagtcaaaattttcccaataaatggacctgaaattgttacccattattatggggaaagtgagcaacaattgcatgaagtttttgattcagccattcaagctgcacctgctgtggtattcattgatgaattagatgcaattgcccctgcaaggaaagatggaggtgaagagctatctcaaagattggttgcaactttattaaatctgatggatggaattagtagaagtgaagggttacttgtaattgccgccactaaccggcctgaccatattgagccagctctcagacgaccaggaagatttgacaaggaaattgaaattggtgtgccatcacccgaccaacgttcggatattttgctcactcttctcagtgaaatggatcacactctctctgagtttcaaattgaacaccttggcaccgccactcatggttttgtgggtgctgatctagctgcactttgcaatgaggcagccttgatttgtctaaggcattatgccaattttaagaagacttatggttcttgttctgattatataacagagcaacctgctctgatgaatagtgcaacaaactcaagagatcattcgggtgatgcaatttcatctgtttcagatatgtcagtggcctccagtcgtgtgttaccttcctccagtcttgctgtaactcgtgggaaggaaagtgatggtgtttcagtgtcagatagggtcatgagtcaacttcttgttgagttggatggtctacatcaaagagttaatgtcactgtcatagctgctacaaataggccagacaagatagaccctgcccttttaaggccaggacgctttgaccgtctgctatatgttggacctccaaatgaggtggacagggaagagatatttcgcatacatctgtgtaaaatcccgtgtgattctgatgttagccttaaagaacttgctcgactcacagatggttgtacaggggctgacatatcattgatatgtcgggaggcagctgttgcagcaattgaggagagacttgatgcttcagttataacaatggagcatttaaagatggcaatcaaacagatccagccatcagaagttcactcctacccaaagctgtcaacaaaatttcaaagggcagtccactgctgtgatataaaggatgaattcaatgatatgcagtgcgacagtagatctactcagttcaacatttgtgactgggctcatgtgcattacatgggatcatctgcactgcaaactggctag

SEQ ID NO: 79749 - DNA, 300 bp, Glycine max
  Peptide Sequence Number=SeqID_196527
atggaggagttgaaacggattgagtggatgtggggttcattttctatgtcgatacttgtgaatggaagtccaacaaatgacttcattgtacaaaaagaactccaccaaagagatccattggcaccatttattttcttggtggttgcgaaaggtttgagtgatttgattagagaagcggaatcaaagaattttttatccggggtggaggttggaaataataatttgagaattgctctccaatttgcggatgacaccattttttttcttgagaaatgctttgacattgaaggctatccttag

SEQ ID NO: 79750 - DNA, 285 bp, Glycine max
  Peptide Sequence Number=SeqID_196528
atgagagcgaatggagagagagagaaagagagcaaagagttgcatgcaaccaaaacggaaatgcgagagagagagagagagagtgggggccaccctgcatcgctcacgcgccgtccccacctcctccgtgcccgggccacgcttctctgcggcttttactgcagggcggggactgatgtttggcggggtgtcgttcttttgactcctttgtccgcagaatgtccttccgtttctctcgtatttacgcagatgccaacacctgaaacaatggataatacagtataa

SEQ ID NO: 79751 - DNA, 246 bp, Glycine max
  Peptide Sequence Number=SeqID_196529
atggcaagaaacgctgagcagcgactaaggaagggctataagaattgtaaaatcataaatgaaagagagcaagtaaccgtcgtagaagtcgcgcgtggagtgcacggtctccctgaactttgggaagaagagaacgacagtagtgataaggcgcgtggcgttggcttttggaagagcaacgaaggagacaaaagtagtttaagaatctgtagcaagccacatgagataaggtacagttacatgtga

SEQ ID NO: 79752 - DNA, 212 bp, Glycine max
  Peptide Sequence Number=SeqID_196530
atctagagagagagaaccggagaagaaacgaaagaggaagtacctgtgttggagcggagcttgatgaagagtgcagagaattggttttggaagaacaagagttagtgagcgagatttttatagtgagactccacgggagcatggaaggggaatgtttggacctcgtaactgcctgtgctgtgaagtctttgtcggcgtcgacaaatcactga

SEQ ID NO: 79753 - DNA, 1341 bp, Glycine max
  Peptide Sequence Number=SeqID_196531
atggaagcgaaggtggaagcacttgaaggagaaatgtctgaagtcagatcaacgttggctgacgttcagaacgccgtgaaggagaaccacgcgagtctaatcgcgatgctggagaagtgtttgggaaaatccctgagtggagaggaaggaagtgctagtttcgccggcaaaacgacatcggagattccagtttcatcggagaaggcgaaaggaacgagttccagtgatttacgaggtgacgtgttggcggaattccgtcaatccgtcaagaaggtggagcttccaccgtttgatggtgaggacccagctggatggatatcgcgagcagaggtttactttcgcgtccaggacaccagtccagaggtgaaggttagtttggctcagatttgtatggagggatctacgatccacttttttaattctttgattggcgaggaagaagggttgacgtgggaggcgttgaaggaagctttgctggagaggtatgggggtcatggtgaaggtgacgtctatgagcagttgacggaattgaagcaaaccggaacggtggaggagtacatcacagagttcaagtatttgacagctcaaattccaaaactcccggaaaagcagtttcggggttatttccttcatgggttgaagacggagattaaggggaaggtgcggagtttagcagcgatgggagagttgagcagagcgaagcttctgcaagttactagagctgtggagaaggagataaagggtggaagtggatcgggctacagtcgtgggcctagacctggaaatgggtcgtttcggaccgggtcacatggtatgggtaagtctggatccgattgggtcatggtaaaagggagagaagttggatcgaatgggggtgtgaaaagtggagttaatgggcctagaggagataagccagcccatggtgacagaaaacgtgttgggcctcgtgatagaggttttactcatttagcatacaatgagttgatggaaagaaaacaaaaggggctgtgtttcaaatgtgggggtccattccatcctatgcatcaatgtcctgacaagcagcttagagttttggtggtagaggatgacgaagataatgaagaggaggccaaaattttagcagtggaggtggaggaagctaatgacgaagagaagggggagatgagcgtgctggacttgcatcacatagcacatgagaatcatcacactattaaattccaaggctcaattcggggtgtggaggtgctgattttggttgatagtggtgctacacacaacttcatttctcaaaagttggtacatcaaatggactggccggttgaaattactcctcaaatgaat

SEQ ID NO: 79754 - DNA, 1779 bp, Glycine max
  Peptide Sequence Number=SeqID_196532
atgcagcagagaatcattactgcagagcagcagaattgggctgctaaactgcttggatttgattttgagattatttataagcaaggcagattgaataaaggtgcagatgctctgtcaagaatttatgaaggaggggatttgaatgttatgaattcttgtgtgaaatggatccaagaggaacaaatcaagacagaaattcagcaggacgaaaaattgcagagaataatagaggaaatgcagcagaattcagtttcatggcctggttatgagtacagacagggtgtattattgtatgaaggtagattggttatttccagcaaatccgggctgattcctacactgttagaggagtttcattcaacaccacagggaggacattcaggattttacaagacttacagaaggctggctgctaatgtgtattggataggcatgaaagggactgtacaggagtttgtgagaaactgtgatatctgtcagagacagaagtatatggcatcatccccagggggtttgttacagcccttacccattccagagcaaatttgggaggatttatctattgatttcattataggcttaccaaagtcaaaagggtatgaagctattctagttgtggtggacaggttgtctaaatactctcattttattccacttaaacatccttatactgcaaggagtattgctgagatattctgtaaggagatcgtcagactccatggcataccagtgtccatagttagtgacagggatcccatattcatgagtagtttttggagggaattattcaagttacaagggactaaactcaagatgagtactgcttaccaccctgagtcggatgggcaaacagaagttgttaacaggtgtttggagacttatttaagatgctttattgcagaccagcctaagacatgggtatcatgggtacattgggctgagtattggttcaataccacctttcatgctgctactgagaagacaccttttgagatagtttatgggagacaaccaccaatactgactaggtgggtacaaggtcaaaccagagtagaagctgtgcagagggagttgttggacagagatgaggctttgaggcaattgaagagtcaattattaagggcacaagagaaaatgaaaaaccaggccgacaagaagcgtattgacaggagttttgtgtgtggagaatgggtatttgtcaagctcagagcacatagacagcagtctgtggttactagaattaatgccaagctagcagcaagatattatggtccctaccctatcatagagaagataggagcagtagcttatagattgaagttaccagaaggatctagagtacatcctgttttccatgtttctttattgaagaaggttgtgggtcggtatcacgaggaggaggagttaccggatttgctggaagaacaaattgacatgtatgtaccagaggcagcactagctaccaggaaggtgaagcagcagggtgaagaagtcagacaagttctaattcattggaagggaaggactgtagaagaagcaacatgggaagatgagataatgatcagaagtcagtttccaaagtttagccttgaggacaaggccattgcagaaggagagggtattgataggacccagctaattgaagaattgccacatgagcagctgattcaccagagatcaagtggacccaagacttggaaggagagtaccattgcacttcctggatataaggagtgggagggggaatattcaaggggggggattattgtaatattctag

SEQ ID NO: 79755 - DNA, 1282 bp, Glycine max
  Peptide Sequence Number=SeqID_196533
gtatggcggtggacctacattggcaaggaaagttattagttcaggtctttcccagactgaattggcagtagaggtgtatcctttacggcttcaattacttatgttgccaaaaaatgatcgtttccctataagaataagcaagaaggaaaccattggacagcttcacagaaaagcttgtgaaatatttgatcttcagccagaccaagtgtgtatttgggattactatgcccgtcgaaagcatgctttgatgaatgacatggacaaaactctcgacgatgctaatttacaaatggaccaagatattcttgttgaggtcatcaacaatacaaacaacacaagttttgctcaagaaaatgggtctgcacagagggaaatgaattctgctcttgtggagccttcaaaatctagcttatcgattgctggtggcttatctgctagcagaggtgcatctagaggccacaacatggacctttcttcatctcagaacctaaattctccagttagagatgtggaaaacccttatggaaccagtggtgtcaccacaagaggttcattcggtggtctcactggattgctgaatcttggcaatacttgttacatgaatagtgcaatacagtgccttgttcatacaccggaatttgctaggtacttcagggaagactatcaccgagagataaattggcaaaatccattgggcatggttggtgaactagccctagcatttggtgagttgcttcgaaaactatgggcacctgggcgaacaccaatcgctcctcggccttttaaagcaaagcttgttcgctttgcacctcagttcagtgggcacaatcaacatgattctcaggagcttttagcatttcttcttgatggtcttcatgaagacttgaatcgtgtaaagcacaaaccatatataaaatctcgagatgccgatggccggcctgatgaagaagtggctgacgaatattgggcaaatcatattgctcgtaatgattccataattgttgatgtatgccagcgggttttagggaaaacgcaatcgcgacggggtcgcgttgtggactccacaaaaattgcaatcgcgggtgccttacctgtcgcggaatctcattgcatcgtggttgttgcattgtcggtttccgacaaagttgaatccggagtgaaactgcatcgatgcgcgtttagggttcatcgttctgaaagaggaatgtggtcaggtgcggattgcggatttgggtcaggtacttcagagttgttttgggcttgcagtccacaaggtttttag

SEQ ID NO: 79756 - DNA, 1332 bp, Glycine max
  Peptide Sequence Number=SeqID_196534
atgaatctaggatgggtgagatttaccgggaaaagatgtgggattatgatgaatgcattgggaataaaaatgcaggatatgtatccagggagtatccgtattggatacatatctgatactggtacgctgcccaaaatagagtatccatgcttcagactaagagaccaatggtgtttcctaactagcggacaatacaagtcaactttggtttgtccagtttgtaataaagtctctgtcacatttgatccttttatgtacctttccctgccactccagcccaccaccaatagaaccatgacagtgacagtttttgcttgtgatggagccgcccttccatctgcttgtacagtaactgtccctaagcagggacgatgcagggatctcatacaggcacttagcaatgcttgctcattgaagcacaatgagaggctagtacttgtggagatacgaaaccatttgatccatagatattttgaagatcctcttcaattgttgtctaatattaaagatgatgaccgtcttgctgcttacaaggttccaaagatagacaagaacacaaagtatctccagttgatacatcgccgaagagagcagagtagtgactcacacatcatatccggatggaaaccatatggaacacctattgtttcgttgatttcatgtgatgatacagtcacaagaggtgatatacaagtaatagttaatcgtatgctctctccactgctaaggaaaggtatcaatgtagaacaagctaccacttctgaaacaagcatcccaaaagcaacatctgatcaatgcagttttaattcttctgatgatgcatgtgctgccaacatggtgtcaaattcagtaaataaggatactaccaattcaaaggcgccgccagtgccattgccaacattacctcttctcttggtagatgataacaatgcttgcattgatctttcaatgggagaggaaaaagtagttaaactgtcgccattgtctccaaagattttagtgtatattgattggtctcagaagcttctggagaagtatgatactcatccacttgagactttgcctgaagttctaaaatatggacctgtaaccaagaaagctcgtactgaacctctctccttgtacacctgcttggaagcttttctgcgtgaagaacctctggtgcccgaagatatgtggttagttcatcctgcagctcactctaactctattctctcttcatatctttctttctcatgcttagcaagcagtccaaatggagtgtacattaataattgtgagctaaatctgtcaatgacctattttattaatgttccctattctgcaatttaa

SEQ ID NO: 79757 - DNA, 363 bp, Glycine max
  Peptide Sequence Number=SeqID_196535
atgctacctcatgactggctaaggtggccaaggtcatgcataagacctattggtggcatactacacattgaattgttcaacgagggtgtcgaagctatctatggacctaggtgggagtccaccgtaccagaggttcgcctaggtcaggaaggcatccaaatgctcgtttggatctgttgtcctatcgtactgctcgaggttgagtggttttcaccccaaggacaatgtttgagcggagttcttgtcgccccggggacgtttgacacgagcctccaattgatcatggagagtgttgacgagagattgtggggtatgttttacctagcgctacgatgggcgccaaatgctcttgccaaaatctga

SEQ ID NO: 79758 - DNA, 201 bp, Glycine max
  Peptide Sequence Number=SeqID_196536
atgacagaggtgccgatgtgtatcgccagcgtctctgagctgagtccagatgaggagaggatcttgatcagagacattgctctcactgcccaagctaacagcaaagaaggcgacaccttcttcttaatcactcagaggaggtatagggttaaggcgttctttgcagctgattttgcagtgcaggcttcttcaaatccctag

SEQ ID NO: 79759 - DNA, 1833 bp, Glycine max
  Peptide Sequence Number=SeqID_196537
atggagatagagaagagcactaagagcaatgcggaaatgggggagaaagaagagaagaagaagaagcatcgacgaggaggcatcagaacattacctttcattcttgcaaatgaagtgtgtgacagatttgcaagtgctggttttcatggtaacttgataagttacttaacacaagagctgaacatgccattggtatcagcctcaaacacactgacaaactttggaggaacatctagcttcacccctctcattggggcaatcgtggcagattcctttgctggacgcttttggaccattactgttgcttctctcatttatgaattgggattgattagcatcacagtatcagctatactgccacaatttcggcccccaccatgcccaacacaagtgaattgccaagaagccacatcctcacaactgtggatactctacatctccctcctcctcacatctgttggatcaggtggcattagaccatgtgttgtgcccttttcagcagaccaatttgacatgaccaaaagtggtgtagcatcaaggaagtggaacctcttcaattggtactttttcagcatgggcttggcttctcttagtgctttgaccattgtggtttacattcaagacaacatgggctggggttggggccttggaattccatgcattgccatgttgatatccataattgcctttgtgttgggctcaccactttataagactgtgaaaccagaagggagccctttggttcgtttggcccaagtaaccgtggcagctataaagaaaaggaaggaggctttgccagaagatccccagcttttgtaccataattgggaacttgatactcctatttctttggaagggaggcttctacactctaatcaatataaatggttggacaaggctgcaattgtcacagaggaggaggcgagagatcaaactacaacaccaaacttatggaaattagccactgtccacagagttgaggagctaaaatccatcatcagaatgcttccaatttgggcatcaggaattctgctcataacttcttcatcacatctacacagctttgtgattcaacaagctcgcactatggaccgtcacctttctccctcgttccaaatttcccccgctagcatgtccattttcagcgtgctaaccatgatgtcaggagttgttctatacgaacgccttttcgttccctttgcgcgtagattcacagggaacccttctggaatcacatgcttgcaaagaatgggaataggtttcataattaacatcatagccactgtggttgctggcctaatggaaatgaaaaggaaatcatttgctgccaagtaccacttattggatgatccaaaagccactattcctattagtgtgttctggttggtacctcagtattgtcttcatggggtggctgaaattttcatgtctgttggacatttggaatttctctttgagcaggcacctgaaagcatgagaagcagtgctacagcactgtactgcataaccacagccattgggaactacatgggtacattgctggtatcattagttcataagtatactggcaaggagaataattggttgccagataggaacctcaataggggtggattggactactattattttcttcttagtgggattcaagttgtgaatctcgtttattatttgatatgtgcttggttttacacttataagcccgtggatgaaattagtgaaaggaccaaggaagaagatttggaacaagccaatgaacatatctcacctgatgacaagttattaaaggatggtagggatgaagaaaagagagaattaacgaaagatgaatga

SEQ ID NO: 79760 - DNA, 861 bp, Glycine max
  Peptide Sequence Number=SeqID_196538
atggatgcgggtttgattcctcctgatgatgagaaaatcccccttggtgagcaacctcctcaggaaggtctcctagcacccaagtttgggccgtgcagcaatcatctaggtaggcctatattggcagccgtagtatgccattgcccattggtgccctacttggtagtattggggtgtctccctattttaccacatcatcagcacaaaaaaagaaaaagttcaggtctatacaaatgggtccttagaagtatcaacctgataacaagtttacccttcatctctcaacgtactaatttgtatggacaaaacctttcaggatcaaagcagtacaagttgccattcactttcactgattcatatattatagtcaatagtagttatgagccatacaagtttatcctccccccgacgtggaaacaggctcgtgtagcaaatatactatctggaaattactgccagcctaaatgtgcagagccctgggtggaggttaagtttgaagatgaaaaacaaggaaaagttcaggtagtggcttcgcccttgatacgccttaccaacaaaccaaatgcaacaattgaggacattgggagcccagaaaaactgattgcttctcttggaccatttgtcactggaaacacttttgatccagaagagctccttgagacttcagttgaaaagcttggtgatcagacatactacaaatacgtgctcgaaacaccatatgctctcacaggcacacacaatcttgcaaaagcaacagcaaagggaaacactgttgttttgtttgtggttagtgccaatgacaagcagtggcaaacttctgaggagactctaaaagccgtgcttaattcctttgaagtttag

SEQ ID NO: 79761 - DNA, 502 bp, Glycine max
  Peptide Sequence Number=SeqID_196539
atgagtcttcattcttcatctagtgttaatggaagacatagggcacatcttagacctcactcccattggagagaaaaggaaagaaagcctcaagaggctaacattaacctcccatacttccataggaaggacaatgtagaggctaacttagattgggaaataaaggtagagcaacaacttgaaaggaagtctacttcaaaatcttatggctcttactcttatccaaataaagaccaaggtcaaggcatcttaggggtgacacctcctaagcccaaatatgataaggggaagacaatagaaaagcaaccccttaaggctagtatgcaagagaagactagctccataaagtgctttaaatgtcttggaagagggaacattacttctcaatgccccaccaagaaaaccatgattatgaggggccaagacatatatagtagccaagatgaggctactacttcaccttcctctggtgaaactgaagacgcaaattgggaagaatcta

SEQ ID NO: 79762 - DNA, 690 bp, Glycine max
  Peptide Sequence Number=SeqID_196540
atgaccgaccctctcgatgagtcgatctcttgctttctcataagggtggacccttgggtactagtatctatcgccttcagaggactacatgtcctcgcctttcgaggacagcacgtcctcaacttcagaggactacgcgtcctcgccttcagaggacttcacgtgctcgcctttagagggttacacaccctcgcctttagaggactacaagtcctcgcattcagagtactgcacgtcatcgccttcagaggactccacgtcctcgccttcagaggactgcacgtcctcacctttagaggaccacacgtcctcacctttagaggaccacacgtcctcgccttcagaggacttcacgtcctcgccttcagaggacttcacgtcctcgccttcagaggacttcacgtcctcacctttagagggctacacgccctcgcctttagaggactatacgtcctcacctttagagggctgcacgtcctcaccttcagaggactacacgtcctcacctttagaggactacacgtccttgccttcagagggctacacgccctcgccatcaaagaactgcacgtcctcgcctttagagggctacacgccctcaccttccgaggactatatgtcctcctcttcagagggctacacacccccaccttcaaaggactacacgtcctcacctttagaggactacac

SEQ ID NO: 79763 - DNA, 492 bp, Glycine max
  Peptide Sequence Number=SeqID_196541
atggactggcaaagtgcacctgcaagtcctagttcgttcactgttaagagaatcttgcgcttggaaattccagtagatacatatcccaatttcaattttgttggaagacttctggggcctagaggaaattctttgaaacgggttgaagctacaactggttgtcgtgtgtatattagaggaaaagggtcgataaaggatccagacaaggaagagaaattacgaggaagaccgggctatgagcatctcaatgaaccactgcacattttgattgaggctgatttacctgctaatgttgttgacataaggctcaggcaggctcaggaaattattgaagaactgctcaagcctgtggatgagtcacaggactacatcaagaggcagcaattgcgtgaacttgctttgctgaattcaaatttcagagaagagagtcctggaccaagtgatgatgagtattgtggtcctccagccattgattgctgggaatatcttcca

SEQ ID NO: 79764 - DNA, 516 bp, Glycine max
  Peptide Sequence Number=SeqID_196542
atgtcaaatattcaaggaaaaaccttcatatggaaaacattaacttcggcattaagaagtcagcgccagattgttttaacagtgacttcaagtggaatagcatcattgttgttacctagagggcaaactgcacactctaaattcaagattcttgttcctacttttgatgactcaatttgcaatattcaccaagtggcttcaagtggaatagtgtcattgttgttacctagagagcaaactgcacactctaaattcaagattcctgttcctacttttgatgactcaatttgcaatattcaccaaggtagtaaattagttgagcttttgaaagtgacaaagttgattatatgggatgaagcacctatgggccataaattttgctttgaagcactggataaaagcctaagagacatcatgggacttggtaatgaatcatctacaatatttggaggaaagatcattgtttttggtggggattttcgtcaaatgttaccattcattccaagaggaagctga

SEQ ID NO: 79765 - DNA, 531 bp, Glycine max
  Peptide Sequence Number=SeqID_196543
atgtcaggcttgtataatcccaacttctctcctgctagagctgcttctcctcagattaggagcaatccagaagtggacagatcaaaactgaaaaaaagaaaaaggacacaatcttggactcttggtgaaacaccctttggatttggccatccagtacctatcagagttgctggcagaacatcagaagcttggacccttcatgcaagtgcttcccatatgcagccgcctcctaaatcaaggtctagctcttcctgtttgtggatctctatcacgtcttgtttttgctctcttgttgtttatggaagcatgcttgatgaaatgtaccttcacagtgttaaccttatgctaccggcgatgaatttgatgattgtgattttgaggacttatgaaaaatcctatcctttcaaagcatgtactcttgaaggtgttctcaataatgctggtgccattaacattgggactgttgacttcagtagaccttcatccactcagaaatttagggcctgtctatttgctcccttttatcaatga

SEQ ID NO: 79766 - DNA, 1056 bp, Glycine max
  Peptide Sequence Number=SeqID_196544
atgaaaaattcaagaggacgcagcatgaaacatgcacatttatttcattgtgaagatcaaagaagtcaagaacacaataaaattataagggacagactggagagtaatactaataatagttttaggacaagggagattccaataaagaggttgttcaacgtagggcattttactaatgcttcaggagacttgtcaaggtatagcaagggaaagaacttttctgcaggaataaatgtcatggactatgatatacctgagcttgttgtttttattcaagaggaacatcagcaatttgtcaaggatacttgcattggtaagggagtgtcaccagaaggcaagtgtatgtcagaagattgtgcagtaaatcatgatccaatgtcatgtcactttgagaatgacttgaacaccagaagagattcaaatctaagaactatggaagcaatgtcaatcaattcaaatgggccagagtatgaatctaaacctcttacccttaaggatgccatggaattttatgattcaagaggtttagtgatggatggtgaagaggattcaggatacaatatttcaattgaccacctcacaaagaagacaataccagagaccattagagaggcattaacaaaggaagcagaattttcaagatctttcaagaattggcaaataaattcatttttgggtacaattggcagcagagtggagtttccaagttgttcagattgtgtacaagttgctgacacaatcatgtgtagatctgagattgctaactcacacagtccatcaggttcaggcaaaagacaagaaaatgatcctcaagagactacttgttcctgtgatgtaggcccatcaccatatgctgctcctgcaacaacatctagcagtgcctctcatcactctaatgatagcataagcagtactcattcatttgcttttcccatattacctgcagaatggaatggaagtccagagagaatgttggaagctaataaaagtcaattcagaaaagacagatggcagaagataagggttttgttttcctgctgcaaagttgattgctaa

SEQ ID NO: 79767 - DNA, 243 bp, Glycine max
  Peptide Sequence Number=SeqID_196545
atgaggcccaataataagaaaaaggcaaagagtgaagagaagagagagagagagagagttggaagaagaagaagggaagatgaacttgagatggatggaagcggtgctgccgctgggaatcatagcgggaatgctctgcgtcatgggaaacgctcacctaagcacatcgggaacgatatgtgggacgtggccatggaacgaagggacaagaagcttgtcgagcaagcctctccctccaattaa

SEQ ID NO: 79768 - DNA, 939 bp, Glycine max
  Peptide Sequence Number=SeqID_196546
atggagcctgttcttcttccaagtctagtaataatgcttgttcttgttctgtgctttgaatcacttcctagtgttagggctcagtctactactacttctcccgggtcatcttcaacaagggaagaagcaaaggctcttgatgcacttctccaacaatttgcttacaaggacttggtgaatccaaaaacaggtatcatttacaatgcaactcaacttccttccaatttgactgggattgaggttgcagcattgagattaaggagtggaagtctaaggagaaaagggttccaggcatacaatgagtttgaaattcccaagggactcattgtgagtccttatgtggaaaggcttgtgttggtgtaccaaaatctggataataggtccagcagttactactaccctttgcctaattatacttatttggctccagtgttgggactactagcttatgaaggttcaaatttgtcggctacaaatttatcagaactagacatagatgcatctgagagccctatattggtcaagtttagggatgtaaaaccagctcctcatggtgctgttgcaaaatgtatttggtttgatttgcaaggttcttccaatttcagcaatgtaacaggaggcaacacatgttctactactcaacagggtcatttctctatagtggttaaatctattgctcctttagcaccttctccagctccggcaggtgctgctcctaaaggggaaggtgagaaggggaataacaataatgagaaagtgtggatcattgtagggtctgttgtgggtggactagtattgcttgtgttgttgtcacttctagttttgtggatgagcaagtacaaacagaagatgaaaatgcaacagatggaaagggctgcagaggtgggagagcctcttcaaatgtcttcaattggggatacaaaagcacctgctgcaaca

SEQ ID NO: 79769 - DNA, 219 bp, Glycine max
  Peptide Sequence Number=SeqID_196547
atgcataatgattctttaaccagtttgggtttacaccattgtcctgcatatggattggccacatgcagtgctcacaaatcccctcccatacaaggcacaaaccagaatcagggaatattagacaaagtagaatcaccaattcattcaaggagcaagaggcaaatcaccaaaccacatttcctaagtgatttcgtaactaaccctgacaaagggagttga

SEQ ID NO: 79770 - DNA, 480 bp, Glycine max
  Peptide Sequence Number=SeqID_196548
atggctgatcttttagaagcattagtgctttcattcataggtagatgcatgcacgtgagcatgacgcatcatgtacatcgactgccttgtattgagttttgcatgaaagaatatctctcaataaggcatcaattggagacacttctagctgagaaggctcgtctggcaagcgagaatgagaaatattctcgggaaaaccgtttcttgagggaaattgtggagtaccatcagctgactatgcaggatgtggtgtatatagatgagggcatggaagaagtcaatgaagtttaccctgtggatgacagtaggatcacacggttactatctgtctctccacactcatctgatgaggatgttctggtctcaccaagtccacctatgctgtcaaaagaaatatttactgtgccggaagaagatagtaagagcatatcaaaagatggggctccttctactgtctcagtttctccacatacaaaatga

SEQ ID NO: 79771 - DNA, 204 bp, Glycine max
  Peptide Sequence Number=SeqID_196549
atgcagccggtgatctttgtgctatttgtcaggagaagatgcataccccaatattactatgctgtaaacatattttctgtgaagactgtgtatcagagtgctttactttttcaaagtagcaaccacgatctatatacatcaacacatgtaaaatgctctggaggcaatcgtggggatccctctgagaaagatgaatgcagctga

SEQ ID NO: 79772 - DNA, 540 bp, Glycine max
  Peptide Sequence Number=SeqID_196550
atggagaagatctcctcgaggccttggacaaagaactcacgagcgattttgaggaaaggaggtcttataataataatgaataaaattgacatgcggtgcatgtgtacgtggtatgctgggcatttcctttctatctacgagggtgttccttgcatggttctggtggaaatagcatgcactaggtcctctgaccaagtgtttgatgtgaggaaggcttaccatactctttataagaagtctcttgaggaggatgttgctcatcacacagcaggagacttctgtaaggatctgaaggcggatccaaaggacgagttcctgtctttactaagagcaactgtgaagtgcttgatccgcctggagaagtaccttgagaaggttgttcagtttgctatcaacaagcgaggaaccgatgaaggagcccttacaagagtggtttgccatcaaaggaggaatagtgtccctcttgaacgtgccattgttaaggacacaattgctgactatgagaaaatgcttgtggcacttttatcatgcatattttaa

SEQ ID NO: 79773 - DNA, 894 bp, Glycine max
  Peptide Sequence Number=SeqID_196551
atggcgtacaggagaaggcaaggtatatccaagtcttccaccttcaaggaagaatttcatgatccatcattggaagatgacaatgcttctccttcaatcttctcatcttcttcaacaccaccaccatcatctctcgctgctcaagccatcaaagctgctgcttctcgtcgtgaaccttctctttcctttgcttttgcccccgccgagtttgaccatcaaagatccaagagctttggggcttatggaaatggcaactccaagtctggtggtttctggggtgtgattgcgcagaaagccaaatcaattctggatgatgataagccaaccccacaacatgacaccatgcctcaaacccaaacgctcaagtcacactcatttaataccttttcagatccttctgcagttcagaactccccttcacaattcaagcctggatatgaatcccttgactcgagtagaaaaatggacaatcctaaatttcggaagggcttggataaaatcacttcgtccctcaatcaactaggtgacacttttgagaaagcttttgaggaaggccgaacaattgtggggagtaagacagcagatctgagaactcaaataaggcgaaaaggaagtaactttggggacacaaaccaaacttcagatttgagaaatccgtttcaagaagcagaccagacacagactcaatctagccatgaaacaaaactcaaggcatcacgcgacgtggcaatggcaacagctgccaaagcaaaattacttcttcgcgagctaaaatccgttaaagcagatttggcttttgctaaagcaaggtgtgctcaacttgaggaagagaacaaagtactccgggaccgagagggcagcgataagggacagaaccgtgaagatgatgatctg

SEQ ID NO: 79774 - DNA, 255 bp, Glycine max
  Peptide Sequence Number=SeqID_196552
atggggggtctggattgcttttggaggaagcaacccagctcgcctaggcgagctgggcggcaacctcctccccctttttcctataaaaaggcaacaagggttgttctaagggtccctgatccccctgaaaatccagcccgaggtgcttccgcaacgcttccgagaggttttcataagcaaatccgtgaagattttcctctgttcttcaccgttcttcattcgtttttcatccgttcttcgttcttcaacgggtaa

SEQ ID NO: 79775 - DNA, 144 bp, Glycine max
  Peptide Sequence Number=SeqID_196553
atgtttgacgttataactggtgctcttggtggtcctgcctttggtggccctgaagttgtaatcggtgctcttggtggccctgcctttggtggccccgaagttgtaatcggtgcccttggtggacctgaccttaggtggtcctga

SEQ ID NO: 79776 - DNA, 501 bp, Glycine max
  Peptide Sequence Number=SeqID_196554
atgagggatccactgttgtttcataacactcctttgttgcctggccaagtaaaggtgagtgtggaggaggttagagatgcagatgctccagttcctgtacccactgatgaggtttccttagtggggcaggcacttcacaccttccttgcttggccgacacatctgaaaaaagtctttatcacagcagagcttttcttgaggccttatcaggttagatgggatgccaccgtgttcggggtcattaatccagatttccccctgtacataaagcacgaagacctctctgaaatcgcacacggtggtcaatgtctcagcatatcagtgttacagttgtggattctgcatctcactgaaacatgtatgcgagcgaggaattctgatatctatggattcctcgagcctcagtccattcagaggtatgggcaatcgcagtttgaacctgaaagttccactgcagcggacactggcagatggtggtcatcctgcccaaggaacacttag

SEQ ID NO: 79777 - DNA, 1656 bp, Glycine max
  Peptide Sequence Number=SeqID_196555
atggccgcaaattctgggaatatctcgtttgcgtcgtctcagtctagttcacagattcatgggagcactgatactgtccaggttgcagtgtgttctctttgtcaaaaggccctatcacctgataatgagatggcaagcgatcttgctagcagtggtgtgtgtggtgattgtaaatttttgttacttgaagactttgggaatcatacagttacccaaagctcacgaaggaggcttagaggaagattcaggcacaatagttctgaatccgttgagaataatttctcacaacagattccccatgtggttaatactgtgagacaacatcagtcagctgtgtctggggaggatgatcaacttgtagatggtgatacccctgcttggtcattgcaatatgctagtacacatactacccctagtgggtctagaaggtggaggcaggttctctctgacactgacagtgatggttttgataattggaattctctttatggtgaaaatgaatctagtgcgagttttagacagtacagagttccccatggcgagactgattctttctctcacagtgcttatggaggcgactcagatatctctatggatactcatagttttgaaggcactggagtctttaatttaccagatgaaggagatgagtttgacagtgatactgacatagatccaatgcatgctggtctcagccaatggatttctactgatgaagatgatgaagaagaggaggaggaggaggaggagggggatagggaatgggaattagccgaggctgaggaagctgaagccacatcccaccttcaaatttttttcacctctagtccaagtgagagcagggatcgcattaattctactgaatctgggggaatgtttagccagataatccgagagacctggcatggttttgaggatgttgatttacctcatggagcaaactttggggattatcttgatgctagacattttgaagatctgcttgagcatctggctgagaatgacagctcaagacgaggagcgcctcctgctgctgtgtctttcgtgaataatctgccacgtgtagtcattggcaaggaacatgagaagcacggcgaactagtttgtgccatttgcaaggatgtcttggcaccccgcactgaagtaaatcaacttccatgctctcacctttatcacatcaattgcattttgccatggttgagtgcccgaaattcatgtcctctttgtcggtacgaacttccaactgatgataaggactatgaagagggaaagcagaacattgatagtagaaatgtgatccatgagaggcaacgaatagatgtaacagatgatagttattctgatgtttctgatggagatgaggtgaatggtagtggtcaaggtggaatacggcaaagacttctgagctcaggttccactgtggattcttctgcaacaagaagtggtagaggaagatggttttttcttgctgcagctccaattgttagtctagtgggcattgttcttgtcttgtggttgggtaacaactctcagaatgaaggaagtagacatctgggcagtcactacttatccgggcaaaaccaacacgctgttcatgcttattcctctccaaaccagagggagagtagaagcagaaggtggtggtgcccattttaa

SEQ ID NO: 79778 - DNA, 351 bp, Glycine max
  Peptide Sequence Number=SeqID_196556
atgacaggagacacaaaagatagtgtgaggaaactagatgttctttacatcactagagaagacacacatgggaggatatacagggctggaagttgcttaaaaatcaatcgcattccagaagatgagaagatgcttaaaagtaaacttctcatggttttagtggtgtttttcccatattatgagcttgaatcagaaactgaaacttgtagaacaaagattgcccaagaaaaacagaaactacctgatcttgatgtcttaaacattctatctgaaatcgagtatagcaaggtgtggtctttaattaagatcaaagaccttgtaaatactgagcattgggcgaaagtgtgttag

SEQ ID NO: 79779 - DNA, 636 bp, Glycine max
  Peptide Sequence Number=SeqID_196557
atgttattaattttcaatagaatcagtggtcatattcccctcaagattacatccattgaaaatggtacagttctcaaaacattcaaacacctgcttcatcagaataaacaagtggacttcatagagctatttcatgaaaagcttctagtcaagcaagaaaatgagaatcagttgtttcttactttcataaatggaacagtatctgtttggagcttttgtggggagcttgttacccaatttgaggatcaccagctgtggcatccagattgctatacaaataacacatacataacaaaagaccaggatctcattatctcttattgcaaggcagattctgatgatcaatggatggaaggcaatgctggctccattaatgttagtgatatcttgaccgggaaatgcgtggctaaactgaacgcaacaagtagcagcatcaaggcggacgagtgcaacaacagtgcttgcaactgcaacaagcaaaacatgatcttgatcatgtatggtctaactaatgacaagagtttctggtttcttctggctccatggccccaggaatcccatgtttggttttgcaattttgctgatattgtttcagcaccggatttctctaaaatccaagctgcctcagcattgtaa

SEQ ID NO: 79780 - DNA, 654 bp, Glycine max
  Peptide Sequence Number=SeqID_196558
atgatccccactaggcacaatgaagaagggatctgctggctgcaaaggaagcattgtgtgcctgatggtagcattatgtgtagcgattgcacttgtattgttaggggtgatcttagcattgacagtgttcaaaccaaggcaccccattaccaatgtggattcagtaaggcttcagaacatgagcttgggcatggacattcaacaaccctaataaacttggattcaattactacaatagctctgcccaacttgacattggaagctcctatccccaatggagacatattagctgaggagattaagggactcaacttgacactcactgttatggctgatcgtttggtctccaattctaaggtcaccaaggatgttgcattgggttcattgcccctcaacaccttagtgagaattttttcccaagtcaacgtcttagggtttattaaattctatgtggcttccacctcatcttgtgatttcaccctcaatctttcctatagaacaatagtgaacaaaaagtgccaagagaagacagattttctggttgatttgttcggtttggagaagggagaaaagattcaaagaaaagaaattgatgtaaggaaggaaagagcttattggatatcgatctattttccctcaacttccacatattga

SEQ ID NO: 79781 - DNA, 2211 bp, Glycine max
  Peptide Sequence Number=SeqID_196559
atgacaggctcgaatggaaatctcatgggcaatcttccaattcttgatggaacgaattggggcgaatggcaaattcagatgcaagttgtatttggatttcaagatgttcttgaggttgtggaatgtggaattgcagaacttgaaaagcaatcaagtgatccgcagaaagccacatgcaaagatgccaagaaacgtgattgtaaggctttattttttattcatcaaagtgtggacaaggcgaatttccagaagattgatcatgcaaagacagtaaaggaggcatggtacatattggaaaaggcatattcaagagatgcaaaaatgctcagcattgccaatttgatgaagggctgtggagagaagcttgatgatcaaatggttgtggagaaaatcttgaggtcactctcacctcggtttgattacattgtgtgtgccatagaagaatccaagaatcttgagggtttgaagatagaggagctgcaaggtccattggaggcacacgagcaaaggatgaatgatagagacataatcatactatgcttagacgtggacgaccttttaatcacaggcaataatgaagttgtgattcaaactgtcaagaagcaactgcaacgggaatttgatatgacagacccgggagtcatgtcttatttcttaggaattgagttcattcacaagaatagaggacttgtgatgcatcaaaagaattatgcattggaagttcttaaaagatataagatggaagaatgcaacctagctaagagtccagttgagtttggattaaagctaggtgttggtcttgatgaaaagccaatggatgccacattgttcaagcaaatggtaggaagcttgaggagtggtgatgtagaggacaacaaaagcaccactggatatgtcttcaaattacttggatcaacaatctgctggagttctaagaaacaagaagatgttggacattcaacttgtaagtcagagtacatggttgctgtcttagcagcttgtcaattagcctggttggagtcactctttgcagaattgaagattcaacttgattcagttgttcaacttaacatggacaacaagtctgctatatgtcttgccaacaactcaattgcacatggaagaacaaagcatattgggacaaagtaccactatctcagggatcaagtgaggaaaggaagaataagtttggcttattgcaagccagaagaacaagaagctgacattctaaccaaagcgcttcatggggagaagttttacaagttcagagaaaaaacttggcgtagtgaattgcttaaactagaattagggaggattgttgaagaaaacaaagagctatggaaattgcagaaagaggtggaaatgatgatactaaaagtgatcaaagaccgtgaagcagataaccaaaagagtggcacacatgagaatcaaaaggatctattacaaataatactagaaggtgctgccagtgccaccaccgatactagtcgaaagggtatttttaggcctcggtataacataaaccagctgattctagacatctgcaaaaatgtttactttgcaggctctgagagcactgctcttgcaactatttggacattgctgctacttgccttacaccctgagtggcaacaacgagttagatctgagattatggagacttacgaaaacatggttcctcattcctttcatgacaaggacaaacttcgaaacttgaaagcactaacaatggtgattcaagagagtctacgactttatggaccttcaactatggccactagggaagtgttggccaatgaggtgaagttgggggaacatgttctgcctaaaggcatcaacatgtggttgttcacacttgcattgcaccgtgaccctgataattgggggccagatgctagggaattcaagccagaaaggtttgctggtggtgtttctgcagcatgcaagtacccccaagtttatattccatttggcctcgggagtcgaatttgcttaggccaaaactttgccatgctacaaatgaaggaagtgctgtgtcttcttctctccaacttctcctttgctgtttcaccaaactattgccattgccctgtggatggtttgctgttgatgccaaaatatggtgtaaggcttcttgctagcaaggttcacgagacttgctgcatagttaaggttttgttctgtgttactccaacatgtgaccaagactag

SEQ ID NO: 79782 - DNA, 1632 bp, Glycine max
  Peptide Sequence Number=SeqID_196560
atggaaggaaggatgcgtggaggttatagtggtcgacgcatagtagcaagcagaagagggagtggcaaaggcaatgtcaacatcatcatcaacaacaacaacaacaacaacaacaaaaacaacaccaatgtcatcaagaagcttcagagccgtgagatttgctcgaagcctcatcgagcttttgcttctgtcactgcctctcacagattccgctcaatgcgcttgacgcaccaatacgacactcatgatccctccaagactcgctcttccctttggcccttcttgatgaaaagaactaaagttgtggaaattgtggctgcaaaaaacgtggtctttgctctttaccattctggtttgtgtgcagcttttagtagagaaaccgatgagaggatttgctttttgaatgtttgccctgatgaagtcattcggagcctcttctataataagaacaacgactcactcatcacagtatccgtttatgcttctgagaacttctgctctttgaaatgcagatccacaaagattgaatacatacgaagaggcaagccggatgctgggtttcctcttttccaatctgaatctttgaaatggcctggatttgttgagtttgatgatgtcaacggaaaggtcctaacttactctgcacaagattgtatttacaaggtctttgatcttaagaactacaccctgctatattcgatttcagataggaatgttcaagaaatcaagatcagccctggcatcatgttattaatttacaatagaaccagcggtcatattcccctgaagatcatatccattgaagatggcacaattctcaaagtgttcaaccatctacttcatcggaataagaaggtggacttcatagagcaatttaatgaaaagcttctagtcaaacaagaaaatgagaaccttcagattcttgatgttcgtagttctgagctgatggaagtaagcagattggagttcatgactccatcggcatttatctttctgtacgagaatcagttgttccttagtttcagaaatcgaacagtttctgtttggaacttccgtggggagcttgttacttcatttgaggatcaccagttgtggcatccagactgcaacacgaacaacatatacataacaagtgatcaggatctcattatatcttactgcaaggctgattctgatgatcaatggattgaaggcactgctggctccattaatgtcagcaatatcttgaccgggaaatgtgtggcgaaaataactgcaataagtagcagtgccaaggcggacgagtgcagaagtagtggttgcagctgcaagaaaagtcattcatgcctaatgaggagtccagttgcggaggctttggaggacatcactgccctcttttatgacgaagacagaaatgagatctatactgggaacaggcatggtcttgttcataatggaaagaaggaggtgacaagtaaaagagggagtgacaatggcaacggcatcaacaacgacaacaacatcaatgtcgtcaagatgcttcaaaaccgtgagatttgttcgtcacaaattctgcaatattacacctatgatccctccaagtctggtttggctgcagctttaattttagcatgcaagattcttgctttgtag

SEQ ID NO: 79783 - DNA, 1440 bp, Glycine max
  Peptide Sequence Number=SeqID_196561
atgtggttcaccatgtggtcaagcttcttgcttcgggtaccacctagtcattctggatctcggagccctttggtcgataatgtgcccatgctaagtgctgtcctccgtggcacttcctctatcgatactattcatatactttctttatatggtgtaaaattctttgtgaaggtccctgcaattgctgcttctttattaccactttgtgagacatttggctcaattaaaccgacttcgcatagcactggcgatgagtgctcctcaacatcaacatatatggccttttctttagcctttcttttccttattcgtttatggaaattctgtagaccccctcttgacccactgtgcatcacggaattaggagttgcagctggactgctggaggtttggaccctttctggcatttctactggaaattccattcatcaaactgctaatatgatttaccagaagataaccaaagctggaaattcatcaagtaattcttcatcaccgactactaatagcagtaatgcatgtctgagaaaccttgttgattttcttccggcgtcgcttgctgctattattgattacttttcttcagaagttactcgtggtgtatggaaactagttccaatgaatggaacagattggcccagtccagcagcatttattcaatcaattgaatcagaaatgaaagctatattaactcatgttggcgttgaggttccaaaccgttcttctggtggtgcaccggtaatgcttcctctaccaatggcagctctcgtcagtttatccattacttttaaacttgacaaaagccaggagtacatgcatgctattactggagcagctttggaaaactgtgcatcaggttgcccttggcctagtatgcctgtaattggctctctgtgggcccaaaagggtcgccactggcacaacttcattgttgtatcaggttcccgttctgtgtttaaacatagcaatgagtgtgtagctcagctgttgagaagttgtttcacctcattccttggaacattgtgtgtttcaaccgagtgtaatgtgaatggcctgttgggtagcaccattagtgcccctgagtactctaatgaattagccagttctcgccacgtaaaatccaacaaagcatcactatccttagccgtgcagagtgcaaaagaggtggcaacacttggagcaagtcttcttatgtgcggcaggtcaagggatgtgaagcaaaacaatgatagtgttgggtcgcacatacttgagggttatgctatgggagaaaatagcaaatctacaagtgagattgaaattgctagagtattttctcccaatccgggtagtatgtactatggagccgtagtggtagtatgctcctcgacaatgggagatgcaacaaggctacaccattctccccctcaaaacacaactttctcttttctcattcaatga

SEQ ID NO: 79784 - DNA, 1776 bp, Glycine max
  Peptide Sequence Number=SeqID_196562
atggctactcgtaatcttctctcaggattcacgtgcccaactttttctccaataattgcggctgacacccagaaagaaagaaagcaggaaaaaaacaaaaaggcgcagatgggtagcacaggtttctcatggaaattggcggatcatccaaagcttccaaagggtaagactgtggctgtggtggtgttggatggttggggagaggccacacccaatgagtacaactgcatccacaaggctgaaacaccctgcatggattctcttaaaaagggtgcccctgaacggtggagattggttagggctcatggtaccgctgtaggccttccaacagaagatgacatgggtaatagtgaagttggtcacaatgctcttggggctggtcgcatatttgctcagggtgctaagcttgtcgacctagctctagcctctggaaaattttttgaaggaggaggtttcaagtacataaaggaaagttttgaaaatggcacattgcatctcattgggttactgagtgatggtggagttcactccagacttgatcagttgcaggagttagcgagcgaggtgttaaaagagtccgtgtccatattcttacagatggccgtgatgttttggatggttcaagtgtgggggtttgtggaaaccctagaaaatgatcttgcaaacttgcgtgagaaaggtgttgatgctaggatagcatcaggtggaggtcgtatgaatgtcacaatggatcgttatgagaatgactggaatgttgtgaaacgagggtgggatgctcaagttcttggtgaagccccttataagtttacaaatgctcttgaagctgtcaagaagctgagggcagaaccaaaggccaatgatcagtatctgcctccttttgttattgttgacgagagtgggaaacctgttggtccgatagttgatggagatgctgttgttacattcaacttccgagctgatcgtatgacaatgattgctaaagctcttgaatatgaaaattttgacaaatttgatagagttcgtttcccaaaaatccgctatgctggaatgcttgaatatgatggtgaattgaaacttccaagtcattaccttgtttctccaccagagattgacaggacttctggtgaatatttagtgtataatggtattcggacttttgcttgcagtgagactgttaaatttggtcacgtcacattcttctggaatggaaaccgctctgggtattttaattcagaattggaggagtatgtggaaattcccagtgactctgggattacattcaatgaacaaccattaatgaaagcattgcagattgctgaaaaggctagggatgctattcttagcgggaaatttgatcaggtacgcgtcaaccttccaaatggtgacatggtggggcatacaggtgacattgaagcaacagttgtggcttgcaaggcagctgatgctgctgtgaagatgattcttgatgcaatagagcaagtgggtggaatttatgttgtcaccgctgaccatgggaatgcagaggatatggtcaagagggataaatctggaaaaccacttctaggcaaggatggaaaaatccagattcttacttcccatactcttgagcctgtgccaattgctattggtggtcccggattggcccctggtgtaagattccgaaatgatgttccaaccggcgggcttgccaacgttgctgcaactgtgatgaatcttcatggattcgaggctcccagcgactatgagacaactctcgtagaagtggttgataactag

SEQ ID NO: 79785 - DNA, 159 bp, Glycine max
  Peptide Sequence Number=SeqID_196563
atggaagctagacaaattggaggaaatggaccagggagaaagggggttgagggaagtgatcatgtagagatcaaagaaaatgaagaggttctaaagaagattattgcaactcatcctttgtatgaagttttgattcaatcccacatcagctgcttgaag

SEQ ID NO: 79786 - DNA, 246 bp, Glycine max
  Peptide Sequence Number=SeqID_196564
atgtttgatagggaagcaaaaggaaaaagctggtttggaggaccagtgcctccagaaaagaagaatagaggaagaatattggaacatcagagttggttaaacttgtctcctcctagaagaccagcaagataccctgacccagctcattttttatacttagtccttgagaaagcgaaggagaacaagcagagagggcgcaaacatttcagaactcggggacgaagacaatcaaataaaaatcactga

SEQ ID NO: 79787 - DNA, 1368 bp, Glycine max
  Peptide Sequence Number=SeqID_196565
atggcatccagatcgagaaaatcgaagcgcaagctcgagccggagccacatccgctcgtcatcaccaagaagctccggcagaagctccctcgccggcgccgtcaaaacatctcgccagtgctcctcgtcggcatctccgcccagaatcctcgtttctccgtcgattccagctccgtctccgacttcgccgtaggcgaagcctcgtgcaactccagcagagcctccgtcgccggcaagggaaacataaactcgagaaacgaattctcgaccgattcaacgagaaatcggagattcgagaagcggaacgagaacgaagttgaggtgtcggagtcttcgtgcgttgactctgcttcgttcgcgagcgaacgtaacagaagcttgattctgaagtttaaaagagaagataagaatctaaacgaaaacgacgacgtttcggaagcgtgcacgaaatctgagattactactgttctgaagttcaaaagcggaagcgagactaagaatgcaaaagaagacgacgacgtttggtgcgcgaagtcagagattacttgtagcgaggaacagttcaattcaaactcaaagtcctccggtaacggtaacggaaacataaaagtctcttcggattcaaacgcaaacgacttcgtgtcgtttagttccggtgttcgcgcgtcgtcgtttcatgaggaagcgaacagaaacaaggaaaacactaaaaacagagcatcggaatctgaatactctgaagtttctagaagcctccacgtggaagagaattgcgctgatttaatagcgcaatcgatgacgaaggaggattcggatgtatacgacgtcgttgcggatctcgcttgctctgaggatctgcgtttctcgtactgcaacgacgacgacgacgacaacgaatcggagtactgttcgagtcagggaaccgtgttatccgaatttcattccgagcttttcggcgaatgctcgcagaatgagctttcggattactgtccgtcgtcgctgttcgtggattccggaagccagttttcggaaggatccgtcggagaaactccttcgccgacgcatttgttgttccttcagtacagcaaggagttcgcagagctagtttctgctcctccgttgaagaacgcttcaaacgttgaagatgttgtcaattttgtgagatttgaagatttggatgacgaagacagctaccagatgctgaggaagagggagaggaggcaaggctatgtgttgaattatggtgatggatatttctctaccactgaattcggagacaccgtgattgagcaacgtgcgcaaatggttcactggatcattgaggtagatagtcgctctttattgagtcaggttttggatggtgagtga

SEQ ID NO: 79788 - DNA, 1053 bp, Glycine max
  Peptide Sequence Number=SeqID_196566
atgcccaaggagagtgtaccgggtgaaaactcgatcttggccatggtggaacatacggatcaaagagctgaagctattccccaatccacagctgcaccaaattggactattcatgtgtcagacgtgaggaagaaatttttacatagtaacattgtgacaaatcccatcatggagaaatttccacattcactccgttgtgatttcttacagataaaaacagttaaggttagcaacatatcattggttactttcaagaaggacattgaagaattcttttcattctcaggtgatattcgatatattgagatgcaaagggaaagtggtcacactcaggttgcttatgttacattcaaggatacacagggagcagacacggcagttctcttaacgggttccaagataggtgatctatatgtcaccatcacacctgtggagaagtatcagctgccccctgaagcacttccctcaagtccaacaaaccaaagccctgatgcagttaagaaggctgaagatgtaatgagcaccatgcttgctaagggtttcattttaggaaaggatgctatcaacaaggcaaaagcctttgatgaacatcatcaattaacctcaaatgcttcgtccacagttgcttccattgatcgtaaaataggtttaagtgataaactaagttttggaacagctgttttcaatggaaaggtgagagagatggatgaaaggtatcagctttctgaaatgacaaagtctgctatggctgctgcagagcaaaaggcaagtagtgctggatctgccatcatgagcaatccttacgtaaaaagtggagcttcatggttttctagtgcctttactgctatagcaaaggcagccgaggatgtcagcacgatgaccaaggaaaaggttgaacaggctgtggtggaaaggaacgagatcatttatggtgaaaggaaagggactgttgatgaatttgcaaagacgcacttagaggaggcttcagacattggccctgcagtagttcctgttaattcagatgatgacagaaagctggcaacaattttataa

SEQ ID NO: 79789 - DNA, 609 bp, Glycine max
  Peptide Sequence Number=SeqID_196567
caatcttgtcgaagacagcttcggcaagagactctgtttcttggagtcaacctacttgatcgtttcctaagcaaaggatacttcaaagccaaaagaaaccttctaattgttggaatagcttgcctcacgttagcgaccaggatcgaagaaaatcagcaatacaacagagtggggcaaaaaaatttctacataggaagcaatgtgtacagtagaagcgaggtggtagctatggaatgggtggtgcaggaggtgctcaagtttcagtgctttctgcctaccatctacaatttcttgtggtattacctaaaagcagctaatgctgatgcagtcgttgagaagagggtcaagtatctggcagtgctggcactgtcaggtcatgagcaactgtgctactggccttcaacagttgctgcagcacttgtaatcctggcttgtcttgaattcaatcaaatttcatcccacaaagtcatagggattcacgttagatcaaaagatgagaatttgtacgaatgcatagagtatatcgatatagaagaaaaacatatacacattttttcagaagccgtgagaaccttacaacagacaggaaactcagctgttaactgttaa

SEQ ID NO: 79790 - DNA, 285 bp, Glycine max
  Peptide Sequence Number=SeqID_196568
atgggatttggttgctgcaagtatggtttcgttcatggtgtcggacaagaggctcgtgaaagtggtttcgttgctgctgatgttgaattcgagtgcgccggagaagaacgaggtgttggagtagctagcgaaccatgcactcgtcgtaatagattacggcttgttcgggggtccgaggatggaaacgaagggggtcttgaggtttgtttggtaagtggtgttggtggtggtgtcttggcaaaatggggacatgatgatgggagagtcctgtgctttggtgcttaa

SEQ ID NO: 79791 - DNA, 949 bp, Glycine max
  Peptide Sequence Number=SeqID_196569
atgggcaattgcggaagcagagaggaatctgccgtagtttccaaggctcaagttgttcagcagcttcaccatgcgacgtcgttgggcgccagtgccaggaccgacaagaagcacgctcacaggcacaatctcagcgagtgcgcttcggatctcagcgagtcctgttccacaccgcgcggtaacaatagcagcaacacgctgctctacacgcacgtcatcgctttcacgctctacgagttggagaccataaccaagagcttccgcgccgactacatcctcggcgagggaggcttcggcaccgtttacaaaggctacattgatgagaacgtcagagtcggactcaaatcgctccctgtagctgtcaaagtcttaaacaaagagggtttacaaggacatcgagagtggcttacggaggtgaattttctcgggcagctgaggcatcctaatctggtgaagttgattgggtactgttgtgaagatgatcacaggctgcttgtgtatgagttcatgttccgagggagtttggaaaatcacttattccgaaccactgagttagtgcattactctctgaatgcatttgaatttctaccaaggaagtggatgtttggttgcactggttctggagtggagatgattactgttgtttcctcatttcaagataatagcattacatctaatgatagacacatgcagtatttgatcagtgttgatttagaatctggatggaaatatgaggcaactgtccctttatcatgggctacaagaatgatgattgctcttggagcagccaaaggacttgcctttctccacaatgctgaaaggcctgactatacagccaaactttctgattttggactagctaaagcaggaccacaaggtgatgaaacccatgtatctacccgagtcatgggtacctatggttatgctgcccctgaatatgtaatgactg

SEQ ID NO: 79792 - DNA, 696 bp, Glycine max
  Peptide Sequence Number=SeqID_196570
cgagccaacaaagagcaatagtggtacatccttgtaattccgaagatggaaatgctttaaagataagtgttgcagctgcaggttcgggtgcaagtactggtgttgatagtgatggtggtggtgctggaggaactggtgtatttagttcaactaatagtgttcaacatgtagaagctggtaatatggtgatttcaattcaagttttgagggaagttacaaacaatttcaataagggaaacatactggggagagacataaagcctgagaacattctactaggtgatgatttttgtcccaagatatcagatcttggccttgataagttgaggaaaaaagaggacatagtgaccatgtcaaggaggaggggcacaccaaggtacatggcacttgaatggatcactatagacccaattacctcaaaagctgatgtgtatagttttggcatggtgcttttggagcttgtgaatgggattaggaactttgagatacaaggctctgtggagattttggatgggcagattagggatgcttatgatagtagggcacattttgagacggttaataggatggtgaagactgcaatgtggtgtcttcaagatagacctgagttgagacccactatagggaaggtggccaagatgttggaagggactgttgagatcactaatctgaacaagcccactattttcttccttg

SEQ ID NO: 79793 - DNA, 885 bp, Glycine max
  Peptide Sequence Number=SeqID_196571
atgacaaaggaaaaggtgaaagagggagaatatgatgggaaggatcaacacaaaggggagaaggatagggcgagtgataaagggaagtgttcaattatcccttttcaacaaacagacacctatgcaaacacaacaattcaaccaccaatcaactcaaacaatggtggtccaattcctagtttggttctgcgagataagagtaagatgccaattacaaatgtgacaaaaatcacaggtcagattcttccaaataatgcaaaaatttcatatgatgccatggatatgattcaacaaggtgctacaaagtacataaactttgtaacgagaaaagccaaggagcaatgccaaagtgagtatagaaagattatgaatgcagaggacctattatgggccatgaagaaattgggctttaatgactatgttgagcctctcactgcttttgtccaacgctatcgtaacattgaaggaagtgatctcttcactagccataaggagcccattcctcacattgaaaacaatgagcctaggcctaaccctatgcccactttggagatacttcactctccagtaccaccgccagttcattcttctaagccatacttttccattgacaccagccatagggagctcattcctcacactgaaaacaatgggcctagtcttgggcttgagcctaaccatatgcccactttcgagatgactccactatcaccatcagttcatccttttgagtcatacttttccatcgatcctgacacaaatttagaaatacttgacccaaatgacatcaatgagatctacctagatgaatttggtgtcggttgttcaaatgatgctttcaacaatgttgatgtttccgctctcttcaaacatgatcaaccgtga

SEQ ID NO: 79794 - DNA, 159 bp, Glycine max
  Peptide Sequence Number=SeqID_196572
atgaaagtcccacaggatacgggaaagaagcgcaagcaaaaggtagaaaaagaatgcacttgcaaattgcaacgggtagtcaaggcagtatcaatgcctttgagtgaaaaggcaatgggtcccggctcaaaattgacaagttttgagacaaatgtatga

SEQ ID NO: 79795 - DNA, 3054 bp, Glycine max
  Peptide Sequence Number=SeqID_196573
atgggtcttagcttgaagatgcagaaccaccatcctgtggctttgaggttgcatgatcaaatggggtctaagagaaagtacactttcattcaagctcatagagcttggcttccaaagtttctgctgctgtggatcctgctaatggctttgatcagttggtgcatctatagcaaaatggatgatgacactaaagtcagaaggaaagaggttttgggtagcctctgtgatcaaagggcaagaatgttgcaagaccagtttagtgttagtgttaaccatgtccatgcccttgccatccttgtttcaaccttccattactacagttacccttctgccattgaccaggaaacctttgctgagtatacagccaggacggcctttgaaaggccattgctgagtggtgtggcctatgcacaaagagttgttaactctgagagggagagatttgagaaagaacatggatgggtcataaagacaatggaaagaaagtcttcactggttagagatgagtatgcgccggtgatcttcgcgcaacaaactgtctcatatcttgagtctattgatatgatgtctggggaggaggatcgagaaaacattttaagggctagagccactgggaaagcggttctgactagccctttcaggctgttgggttctcaccatcttggtgtggttttaacattccccgtgtacaaatctaagctcccccagaagccaacagtggaagaacgcattgaagcaactgcaggttttgtagttgcttacatcgacaagcctcttaaccttggttcaatcttgtggctttatgtttactgtaagcttcttagtgtcctaatatatgttggaggatcctttgatgttgagtcccttgtaaagaatttacttgggcaacttgatggtaaccaagcaattttggtgaatgtatatgatgttacaaactatactaatcccctaatcatgtatggcaaccaatatcaagaaggcgatatgtctcttgcccatgaaagcaagcttgattttggagatccatacaggaaacatcagatgatatgtagtgctggaaatcatattgttaaagtcgaagatgatttccatgaaatgcaggaattgaaagtccgagcagaagcagctgatgttgccaagtcccagtttctagctacggtctctcatgaaattagaacacccatgaatggtattttaggaatgcttgctctgcttctggataccgaattgagttcaacccaacgagattatgctcagactgctcaagcatgcggcaaggcactgataacattaataaatgaggtgctggaccgtgctaaaattgaagctggcaagttagagctggaggctgttccatttgatcttcggtccataattgatgatgtcctttctcttttttctgagaaatctagacacaaaggtttagagctggctgtgtttgtttctgacaaagttccagatattgtcatgggagatcctgggagattcagacaaataataacaaatcttgttggcaactctgttaaatttactgaacaagggcatatatttgttaaagtccatctagcggacaaccgaaagtccatgatgaatggaaaacacgagacttttctaaatggagaatcagatgaagttttctatatatctggtgattatcatttcaaaaccttaagtggatgtgaagcagctgatgaacggaacagttgggataattttaagcatctaatagctgacaaagaatatggccttgattcttctagagaaacaatggctgcttgtgaatcttccgagcaagtcacattgagggtatgcgtggaggacactggaattggaattcctttctcagctcaggataggatattcatgccatttgtgcaggctgacagctcgacctcacgaaattatgggggtactggaattggcttgagtatcagtaaatgtctggttgagctaatgggtggtcagataaacttcataagtcgaccccaggttgggagcaccttttcttttactgcagtttgtggagcatttaagaaaagttcagttactgacaagaaggaaaatttggaagatctgccttcaaattttagagggatgaaagtcattgtggttgatgggaagcctgttagagcttccgtgactagataccatttgaagagactagggatactagttaaagttgcaaatagcatcagtaaggctgttgctttatgtggtaaaactggttctttgacatcaggaatgttccagcccgatattatcatggttgagaaggacacatggatatctggagaggatggcattttcaatatatggaaacagaatggtcgtatgtttaagatgcctaaaatgatccttctggcaaccaatattattagtgccgaatttgataaagctaaggccacaggttttactgatactgtgatcatgaagcctctgagagctagtatggtggctgcttgtcttcagcaagttttggggatggggaagaggaggcagctagggaaagacatgcctaatggttttctacatagccttctctatggaaagaaaattttggtggtcgatgacaatggggtaaaccggagagttgcagcaggtgcactaaaaaagtttggtgctgatgtgaagtgtgctgaaagtggcaaagccgcacttgaaatgcttcaattgcctcacaattttgatgcttgcttcatggacattcaaatgccagaaatggacgggagaagaaagggtgctagttcatgtgaggaaaattgggatatgcttgcatggacttggggaaaccatctaaatagaggctacacattttgcagatttgaagcaaccagccgaattcggatgatggagagcaaggcaaatgaggagatgaataatgggaatgagtggcatgtgcctatactggccatgacagctgatgtgatccatgctacatacgacaagtgcatgaaatgtggcatggatggatatgtctcaaagccatttgaggaagagaatctgtatcaggaagttgcaaagtttttcaaatcaaaaaccatgtcagattcatga

SEQ ID NO: 79796 - DNA, 1770 bp, Glycine max
  Peptide Sequence Number=SeqID_196574
atgttgcgagcaagaggaagaagagcttcccttcattggttccatcttcttgttcgacacttgggttctttttccaatccaacagactttcgttcttcttcaaccttcacaaacagagcccaattcctcgattccatgagaagcctcaaaagtgaagagtctgctctgagtttcttccacaaaatggttgccatgaaccctctccctcccgacaaggatttcgccacactgttcggagtcattgtgaagatgaaacattacgcaaccgcaatttccctgatcaaacacacgtattcattaggggtgaaacccgatgtgcacactctgaccattgtcatcaattgtttgtgccatctgaagcacacggtgtttgggttctctgtattaggagccatgtttaaaattggtgtggagcccacagtggtgacttttgccacactgattaatgggctgtgtgcggaaggcaatgtgggtgcagcagcgaggtttgccgatagtttggaagacatgggctatgaatctaacagttacacccatggcaccataattaatggattgtgtaaggtcggtgacacggctggtgcaatctcgtatcttgagaagatcgagggaagaaatcgcggtttcgatcttcttatagcttacagcacaatcatggacagcctttgcaaggatgggatgctatgcctggctttgaatttcttctcgggaatgacctgtaaaggtattcaacctgatctcgtcgcttataattcattgattcatggcctttgcagctttggtagatggaatgaggctgcagctcttttcggtaacatgatgacaaagggaatcgtaccaaatgtgcaaacttttaatgttttagttgacaatttctgcaaagaggggaagatttcaagggcaaaaactataatgtgtttcatggtccatgtgggtgtggaacctgatgttgtcacgtataattcagttattagtggtcattgtttgctaagtcaaatgaatgatgccgtgaaagtatttgagttgatgattcacaagggcctcttgccaaatgttgtaacttatagttcattaatccatggatggtgtaaaactagaaacataaataaggctatctttgtgttggatgagatggttaataatggactaaatctggatgttgtcacttggagcactcttattgggggcttttgcaaagcagggagaccagaagctgccatagaattgttttgtacaatgcacgagcatcaccaacttcccaatctccaaacatgtgccattattttggatggactattcaagtgtcaatttcattctgaggcaatatcattgtttaggaagatggagaagatgaatttggaacttaatatcgtaacatacaacattgttctggatggaatgtgtagttttggaaaattcaatgatgcacgagaactcttttcgtgtttgccaagtaaaggcatacaaattgatgttgttgcttataccacaatgattaaaggtctatgtaaagaaggactattggatgatgctgaagacttattgatgaaaatggaagagaatggctgtcccccaaatgagttcacttataatgtcttagtccgaggattgctgcaaagatatgatatttcaagatcaacaaaataccttatgctaatgaaaggcaaaggtttatcagcagatgctactacaacagaattgcttatcagctacttctctgctaataaagaaaatagtgcattacaagtgtttttgcagaagtttgtttga

SEQ ID NO: 79797 - DNA, 1011 bp, Glycine max
  Peptide Sequence Number=SeqID_196575
atgtctcttcattggtgttgctttgtgtgtctctttctcttggtgggattgagagcagaggtagctaatgctcagttttatagaaatgttggaaataaacatttaccttactggtcaatagtggtggatcaatcagggcatggaaacttctctaccatacaatctgccattgattcagtgccttctaataacaggtattgggtttctatcaaggtgaaggcaggtacatacagagaaaaagtgaagattccttacgataagcctttcatcatactaaaaggggagggaaagaggagaactttagttgagtgggatgatcacaatgatatttctcagagccctacgtttgcagccatggctgacaatcttgttgtcaaatgcatgagctttaggaactcatacaacaatccaataaataataaacacgagaatgtgcctgctgtggctgcgatggtaagtggcgacaaggcttattttttcagagttggtttctttggtgtacaagacactttatgggatgttgcaggaagacattactacatgctttgtaccatgcaaggtgctgttgattttatctttggtgctgcccaatctttatttgagaggtgttccatatctgttattggtggggccctagctccgggcctctcgggttttattacagcacaaggcagagaaaattcacaagatgcaaatgggtttgttttcaaagactgccatgtgttcggaagtgggtcgagttacttggggaggccttggagaagttatgccagggttttgttctacaacaccaccatgaccaacgttgtacaacctagtggttggacttcatcggattttgctggatatgagggtcgcataacatttgcagagtatggaaattttgggccaggttctgacccttctaagcgagtgagttggaccaagaagttggatttgaaaacaattgagaacatggcaagcctcaagttcattgacactgaaggttggcttcaaaaccaacagttctaa

SEQ ID NO: 79798 - DNA, 846 bp, Glycine max
  Peptide Sequence Number=SeqID_196576
atgtatcttggttggtatcttttgacatttttcttttttttgacgagtgttaaaatagtgttagtgcatgctaatcacaatcatcatcaccatcatcatcacgaacaaagaaacaataaacaaattgcaaacaaaacatcccattcttcttccgggacaattattgtggacttatcggggaatggagacttctctacgatacaatctgctattgattcaatttcttctgacaacaagaattgggtttatatctatgtgaaggcaggcacctacagggaaaaggtgaagatcagttttgacaagcctttcatcgtactagaaggcgagggacaaaagaacacttttgttgagtgggatgaccatgattcaagtgcagagagtcctacgttcacaaccatggctgacaatgttgtcgtcaagtccattagctttagggactgtaccatatccgctattgatgctaatcttggtcctggcattattggttttatcaccgcacaagggagaacagatccaaacgattcaaatgggtttgtttttaagcaatgcaatatcattggaaatggtacaacttacttgggaagaccatggagaggttatgctagagttattttctataatactaaaatgtccaacattatacaaccattaggttggcagccatggggcttcgctggccaagaggatcacataacattcgctgagtatgggaattctggacctggttctgacacttccaagcgagtaagttggttaaagaatttggattcatcaaccgttagtaagatggcaagtactagcttcattggcaccgatggttggctaaagaccctgacgcagctctaa

SEQ ID NO: 79799 - DNA, 1776 bp, Glycine max
  Peptide Sequence Number=SeqID_196577
atgcagtgttcaaaactactgaagggaacatacatttctcttctcaaaagctgcaaatccatgtcccaattgaagcaaattcaggcccacatattctgttttggccttcaacaagacagagacatcctcaacaagctcatggccttttccatggactcatccctaggggattttaactatgcaaacagaatcttcaaccacattcatcacccctccttgtttatctacaacctcatgatcaaggcctttgtgaaaaggggtagtttaaggagtgccatttctctttttcagcagctgagggaacgtggggtgtggcccgataactacacctacccttatgttttgaagggtattggttgcattggggaggttagggaaggggaaaagattcatgcttttgtggttaagactggccttgagtttgacccttatgtgtgtaactccttgatggatatgtatgctgagttgggcctggttgaggggttcacacaggtgtttgaggaaatgcctgagagggatgcggtttcttggaacatcatgatttcgggttatgtcagatgcaagaggtttgaggaggctgttgatgtttaccggcggatgcagatggagagcaatgagaagcccaatgaagccacggttgtgagcactctgtcggcttgtgcggtattgagaaatttggagcttggcaaggaaatccatgattacattgcaaatgaactggaccttactcctataatggggaatgctttgttggacatgtattgtaagtgtgggtgtgtgagcgtggccagggagattttcgatgcaatgatcgtgaagaatgtgaattgttggaccagtatggtaactgggtatgtgatctgtggtcagttggatcaagctcggtatttgtttgagaggagtccaagtagggatgttgttctttggacagctatgattaatgggtatgtgcagtttaatcattttgaagatgcaatcgcattatttggggagatgcagatcagaggtgtggaaccagataagttcattgtggttactctccttacaggttgtgctcaattgggagctctggagcagggcaagtggattcataattacatagatgaaaacagaattaagatggatgctgtggttagtactgcccttattgaaatgtatgctaaatgtggttgcatagaaaaatctttggaaatttttaatggattgaaggatatggacacgacctcatggacttcaattatttgtgggctggccatgaatggtaaaacaagtgaagcacttgagttgtttgaagcaatgcaaacatgtggattaaaacctgatgatattacttttgttgctgttttaagtgcttgtggtcatgcaggattggtcgaagagggccgcaagttatttcattccatgtcaagtatatatcacattgagccaaatttagagcactacgggtgtttcattgaccttcttggtcgagccggacttttacaagaggcagaggagttggtgaagaagttaccagatcaaaacaacgaaataatagttccactttatggagctttgctaagcgcctgccgaacttatggcaatattgatatgggtgaaaggcttgctacagccctagcaaaagttaaatccagcgattcaagtcttcatacacttcttgctagcatttatgcttctgctgacagatgggaagatgtgagaaaggtgagaagtaagatgaaagatctaggaatcaaaaaggtgccaggatatagtgccattgaggtggatggctag

SEQ ID NO: 79800 - DNA, 324 bp, Glycine max
  Peptide Sequence Number=SeqID_196578
atggaaccaattgcctccctcgcccagtattatgatcagccgttgaggtgcttcatctttggggacttccagctatcaccaatggtggaagaatttgaagagatcctaggatgtcctctaaggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggagcgatcgacgtttttctcgcctatcataaccacaaggaaagtccggttgtcgctatgctag

SEQ ID NO: 79801 - DNA, 1242 bp, Glycine max
  Peptide Sequence Number=SeqID_196579
atgagtagttacgaggcggtgacggagacgaagtgggtggtgacgtgcatggtgggaggggtgatcgtgggggtgtcactgctgggtgcgtattcgagccagctctggaagagccgaagacgcaacaagaagcccgttcgcgtctacatggacggctgcttcgatatgatgcattatggccattgcaatgcccttcgccaagctcgtgccctcggtgaccagctcattgttggggttgttagtgatgcagagatcattgccaataagggtccccccgttacccctcttcacgaaaggttggtaatggtgaatgcggtgaagtgggtggatgaggttattcctgaagctccctatgcgataactgaggagttcatgaagaagctttttgatgagtacaagatagatttcattattcatggggatgacccttgtgttcttccggatggaactgatgcttatgctcacgctaagaaagctggtcgatataagcagataaagcgcactgaaggggtttccagcactgatattgttggtcgcatgcttctctgtgtaagagaaaggtctattgctgaaaaaaatcataatcattcttctttacaaagacagttcagcaatggccatagtccaaagtttgaagctggtgtgtctgctgcaactgcaagtggaactcgtatatctcattttctgcctacatctcgtagaattgttcagttctcaaatgggaggggtccaggacctgattctcacattgtatatatagatggtgcatttgatctctttcatgctggacatgtcgagatcttgaggcttgctagggatcttggagattttctacttgttggaatacacacagatcagacagtcagtgcaactagaggatcacatcgtcctatcatgaatcttcatgaaagaagtctaagtgttttagcatgtcgctatgtggatgaagttataattggtgcaccatgggagatttccaaagatatgctcactacatttaacatctcgttagttgttcatggaaccattgcagaaagtaatgattttaagaaggaagaatgcaatccatatgctgttcctattagcatgggcatcttcaaagttttagaaagtactttagatataacaactactacaataattagaaggattgtttctaatcacgaggcataccagtttttgatagcattagacttgttatcaaaatatgccatgatcctactttttaaggacatgtcttaa

SEQ ID NO: 79802 - DNA, 123 bp, Glycine max
  Peptide Sequence Number=SeqID_196580
atggacaacacatggaacaattcgaaagttgaattcaacctccaacaactaactcctgatcaagcctataaattgatcaaattccaaggagcaactcccaaggaagggttgccaaagaagagg

SEQ ID NO: 79803 - DNA, 324 bp, Glycine max
  Peptide Sequence Number=SeqID_196581
atggtcttactctgcgacagaggtggctttgtcggcgacggcgatggtgcaataaggctgatgggcttgatcggggaagaatggtcggagaagacgaagatgcaacagaggcgctttgatgataacttggtaagtgaacccatgcctctgaacatcaacaatcttacaagtgttagggaattactattccttaataatatgcctgatgtacactactacaaaaaggctttctacattgattactcgagtcattctacatcgattttcaaccgtagtcatagcggacgatgtaaaaaggggaaaccttttctacaacggtcgtga

SEQ ID NO: 79804 - DNA, 114 bp, Glycine max
  Peptide Sequence Number=SeqID_196582
atgacaggtcctggattggtattggtactgcgtcggcaacgaccaaaacatcggaagttggatagctggctgtgcgacacgttagccctggcaatgccacgtcagcattgttag

SEQ ID NO: 79805 - DNA, 255 bp, Glycine max
  Peptide Sequence Number=SeqID_196583
atgaggagcatggaaagggtagtagtgagggtgaaggcagtggaggttgaggctgccacatcagtgcaagtttcaatcatagaaagcagcatgctgttggagatcgagtggccccacagagaagggtttcttatcgacgtgatgcacatggtgagggaattgagggctaaggtgaaggaacatgtgaacgggaaggtcagcattgtggaagtgaagagggcatttaatcaaaatataccccacgctgttgactag

SEQ ID NO: 79806 - DNA, 174 bp, Glycine max
  Peptide Sequence Number=SeqID_196584
atgagctacttgctgagtactcggaagagtgggagatggtgggcattgaagtgggatgacaaggaggaaggaaaagaagtgactcagcagtgggaggatgattgggatgatgatgatgttagtgatgatttttctctccagttgaaaagggagctggagagcaacactaattag

SEQ ID NO: 79807 - DNA, 981 bp, Glycine max
  Peptide Sequence Number=SeqID_196585
atgtgttcccatagcctcattttccatgctaacttgtttcttctgctgctaatagttggttgtcatgctcaacttcgagttgattactacaaaaacacatgtccaaatgttgaatcgattgtacgaagtgcggttgagaagaaacttcagcagacatttgtgacagctcctgctacacttaggctcttcttccatgattgttttgttaggggatgtgatgcatctgtgatgctagctacaagaaacaacacatcagagaaggataatcctataaatctttcactagctggtgatggatttgacactgtgatcaaagccaaggctgcggttgacagtgtacctggctgccagaataaggtttcatgtgctgacatattggcattggcaactagagacgtcatagcattggcaggaggaccatcttatgcagtagagttgggaaggctagatgggagagtctcaacaaaagccagtgttagacaccatctacctcatcctgaattcaaactagaacagctgaaccaaatgtttgcttcacatggcctcacccttacggatctagttgctctatcaggagcacatacaatcgggttctctcactgcagccagttctccaaacggatttacaacttcagaagaaggaaaagcattgatcacacactgaatcctacgtatgcaaaacagctccagcaagtgtgtccaaaaaatgtggaccccagattagccattgacatggacccagttacacctaggacatttgataaccaatactacaagaatcttcagcaaggaagaggactccttgcctctgatcaagctttgtttactcataaaagaacaagagacctagtgaacttatttgcatccaacaacacagcctttgaagcttcttttgtaagtgccatgatgaagctaggacggattggggtcaaaacgggaaaccagggtgaaattaggcatgattgcacaatgattaactga

SEQ ID NO: 79808 - DNA, 516 bp, Glycine max
  Peptide Sequence Number=SeqID_196586
atgctttgcagcagtatcatcatctataacttaatcgaaaacgatccatcaactccagtgtcaaccttgatagcacatatcaaaagcactgaaggatacaccaccaagtaccacaaagcatggttggcaaagaaaaaggatattgaagacatctacggcaactgggaaagatcgtaccatgatctactgagattgttccgagctatgcaacaatttcttcctagcatagtggtggagaagaaaaaactaccaatgtcaccgcaaggaggtcaaccaatagagggtttcatcatggtccaccatcatttttggagttttagactgtgtatcgatgggtttcaatactgtaagcccatagttcaggtcgatggaacatggttgtgcgcctttgctgttgtcgagggtgaatcaatgggaacatggcaattgttcctccaaaatctaaaaagacatgtcaccccggaacatggtaaaactacacaaatattataccaacaattacatcgcaaaccttaa

SEQ ID NO: 79809 - DNA, 335 bp, Glycine max
  Peptide Sequence Number=SeqID_196587
atgccgacgacaaccgtcacgactaccttgaagccacctgatgcccgaggagtaacaatgggtttgggtggtgcggcgatgtactctgattcggccgctgcttcggcctctgattccgatgagaatgcgtgcaacgacgctattgaggatgttgcgatacgcataatcggggccgacgagcaggagagtagttcgtcgccgtcctcgtcgaggggccgaggtggggagctgggcggtaaggaggcggtggagagggtgttgttggcgtctttggatgatgggattgttggtgctagggattcttcttcttcatcatcgtcctctacttaccagag

SEQ ID NO: 79810 - DNA, 174 bp, Glycine max
  Peptide Sequence Number=SeqID_196588
atggctgtaagagccttggaggagaaagtacaaccttattgtgatgggatactgacccaacttcttaaggatttgtctagcaatcagctccgtaggtctgttaattctataatgcctatgcttcagagtgataaccaccccctcctcatacatctggtgctgatgacgatatga

SEQ ID NO: 79811 - DNA, 255 bp, Glycine max
  Peptide Sequence Number=SeqID_196589
atgatgattacacagatgcaacgtttgttgaactgtaacattgaagagatctatggacgaattgaaggattggagaaccaactgaatcagaatgctggaagacattatggtgggaacagatggggcaatgacggatcctggcaaaacagaatggaggggcaaaacagaattgagggagtaaaactcaatgtaccccctttcaaaggcaagagtgacccagacacctaccttgatttggagatgaagattgagcat

SEQ ID NO: 79812 - DNA, 486 bp, Glycine max
  Peptide Sequence Number=SeqID_196590
atgcaccatttacaaaaattccgagtagaaatttccaggatgtcacaagaggcatactcacggatcttacaaggatttaaaggttcaccaaagacccacctattgatgtcttatacttctaatgtgctgcaattgttggatagtttgtatatggagaaggacatggatgatgttgtgactaagatagcaatcatagtccttggacattcagctgatactttgggcaacgataaccaaaacaaaaaggaagaaagttgcaaaacctttgaacagaaaaatgcgttcatgagaagatttctcgacctgggtgaggagaaaaatggaaaaggagcggtcgatcagcatctgaggattgcaactaataactactcttacttattaggttctggaggttttggaaaagtctataagggaatttttagcaatggaaccattgtggcagtaaaggttctacaagggctttctgacaagaaaatggaggagtag

SEQ ID NO: 79813 - DNA, 1317 bp, Glycine max
  Peptide Sequence Number=SeqID_196591
atggaaaatacaataaccaaagtaaaatcaatccctgtggtttgcgacaatgtggacaagaaattgagacaaatatttgatttgactgaggatgaagccaacttccacatgaaacagagtgcattcttatataaacttaatgttcagacaatgccaaagagtcatcactgcctgtcactgaaactaactgtagaatatttcaaatcctcgcattatgacgaaaaggctgatgaagaaaagtttattgattcttcattgcaccattatgttattttctctaataatgtgcttgcagcttcagtagtcatcaactccaccgtatttcatgcaaaagaaagttcaaatcaggtttttcatgttttgactgatggagaaaattattatgcaatgaagctctggttcttgagaaaccattataaggaagctgctgttcaagtgctgaatgttgagctggacatccaaaaggaaaatccgttgcttctatccttgcctgaggagttccgtgtttcaattctcagttatgataatccatccacaaaccagattagaacggagttcctttcaattttttctgattcacactatttacttcctgatttattcagcaatttgaataaagttgtggttctggatgatgatgttgttatccaacaagacttatctgccctgtggaacacagacttgggagataaagtgaacggtgcagtgcagttctgctcggtaaagctgggtcaactgaaaagttatctgggtgagaaaggtctcagtcagaattcctgtgcttggatgtcagggttgaacataattgacctggtgaggtggagagagcttggtcttactcaaacttacagaaagttgataaaagagtttacaatgcaagaaggatctgtggagggtattgcatggcgggcaagcttgctcacctttgagaatgaaatatatccactcaatgagtcgtgggttgtgtctggactgggtcatgattataaaattgatactcagcccattaagacagcttcggtgctacactacaatgggaaaatgaaaccttggcttgatctgggaattccacagtataaaagctattggaagaagtttctgaacaaagaggatcagctcttaagtgattgcaatcaattgtttagaagtaactactctttgcaattcactattgtttaccgtatcaatgaaacgcgcctttcatggggagtaggagccaaggtcggagtgtggtatttcgctctctggatgtacgctgaggcaatgggattgggattgtctacaggattttgcaaaatctgtagacaacctccataa

SEQ ID NO: 79814 - DNA, 2376 bp, Glycine max
  Peptide Sequence Number=SeqID_196592
atggctgcctgtgctttgttcagtggtggcggtaacattaccgaagatggcaatgttaatggaagtggaagtgctaatagcactcctttgacaagtgcctctaactctagcaacatgagcaacgaagaacaacaacaactacatgctggtggcatcatgccacagccttattgtgagagaaaaatgatgaggaaaagaatggcttctgagatggaagttaacgttcacgccactccaccacacaactcttcctccacaacaagtgattatcctaggtttcctcgtcgaagcaacaccaacacgaacatgttagaaaaagggtcccccacaacaacatcatcaacaacaacgttagccgcagataacgttgctattccaaattaccccactgtgacggtcacaaccaactactccactatgttgctaccttcttccctcaattcctctggtgttgctccaaactacaacagcactcatcaacaccatcacttccaaggactcgttgaaagccaggaccagcaaaactccgtgcctgcagtttgtggattctcaggtttaccactttttccatctcaaagccaaagaaaccgagacaacataagaaacagtggtggaaacattgttgacgtggttgcttcctcttctccttctccttccatggacgacacttcaggagcagcaacgacaagtggttggatcgatggtatattgaaggatctcattcacagttccaacagtgtttcgattcctcaactaatcagcaacgtgagggagatcatatacccttgcaacccaaacctcgcaatggttcttgaatacaggcttcgccttcttctcaccgagtctaccaccccgcaacacaaaagaggcacagaaggggtgcctcttcttccttctgtttcctcagtgaagctcatgaataaccgtgttgtggatggcattgctcctaatttgcacttcacagatgcttcaggtggtgctgtggttgtgaatcagcacatgttgtccaattggggtgtgcctcaaatcactcctcaccatgataacaccaacaccaacaccaacaccaacaataacaacaacccttcagtttctttggttactttgccttcaccagcacctccacctcattactcaccaccagaagagaagaaccctcaagaagaagatctagcagcagcaaccaccactgctcatgaggtggcactttcaagaaagaagaaagaggagctgcgtgaacagaagaagaaagacgaagagggtctgcatctcctcactcttctgcttcagtgtgcagaagcggtttcagctgagaatctagaagatgccaacaagatgcttctggagatttctcagttatcaacaccgttcggcacttcagcacagcgtgtggcagcatatttctcagaagccatatcagcaaggttggtgagttcatgtctagggatatacgccactttgccacacacacaccaaagccacaaggtagcttcagcttttcaagtgttcaatggtattagtcctttcgtgaagttctcacacttcacagcaaaccaagcaattcaagaagccttcgaaagagaagagagggtgcacatcatagatcttgatataatgcaagggttgcagtggcctggtttgtttcacattctagcttcaagacctggtggagcaccttatgtgaggctcacggggcttggtacctctatggaagcacttgaagccacgggaaaacgtttgtctgattttgcaaacaaactttgccttccctttgagttcttccctgttgctgagaaagttgggaaccttgaccctgagaggctcaatgttagcaaaacagaagctgttgctgttcactggttgcaacattccctctatgatgtcactggctcagacaccaacaccttgtggctcttgcaaagactggcacctaaagtggtgactgtggtagagcaggacctaagcaatactggttcattcttggggaggtttgtggaagccatacactactactcagcattatttgactctcttgggtcaagctatggggaggagagtgaggagaggcatgtggtggaacagcaactattgtctagggagattcgaaatgtgctagctgttggggggccatcaaggactggagaaccaaagtttcacaattggagggaaaagcttcaacagtgtggttttagaggcatatctctagctggtaatgctgccacacaagctagtctactccttggtatgttcccatctgagggttataccttggtggaggacaatggcattcttaaacttggttggaaggacctttgcttgctcactgcttcagcttggagaccacctttccatggtgccattacccaccacaactag

SEQ ID NO: 79815 - DNA, 849 bp, Glycine max
  Peptide Sequence Number=SeqID_196593
atgttgagatctttgaagaatcttgacaacatgtcccttgaagaactttttggaaccttaaagatcatcatcttggtcattgtccaaagcactaagtgtaagaagcttgtccaaggaaccctcatcttgaaagatttgaaagatgtggaagaacaagagtgggttaagaccgaactcctccaaaaagagaagtccaaggacaagtacaagcattacaagtccaaaagtctcatgagcagttgggaggacatggacaacaccccctttaatgaaaaagtagaaggggaagccaacctatgtctgatggatgatacaacttctgaagagtcagaatcagaacaagagaagactcatcttctccttgaagtggcgtctcctatctctcttccttctccattctgctgtcattcatcttccaagaagcaaaggaatccattgatgaagaagatcctaggcctacaagctccacatggagcttacatcattagtgatcattggtctttttacaacaaggatgatgccgacaaggctttatttgtgaaaggaactttgttgagtgatatttggtgggataatgttgattacacactttctttcactgctcctatctatcataaaggaagaaatgctttaaaaggtaatttgttgatgtggatggatgtaaggagacacgtgaatgtggagtttgcaaatttttctaatggaagagaaggcttttatgatgtttactctttaagggatagaggtatattggatgcaaaatattggtggctagttcatgatgctcatgcaccaatacttcaaaagattgcccttaagctacttgggcaaacatgttcatcttcatga

SEQ ID NO: 79816 - DNA, 207 bp, Glycine max
  Peptide Sequence Number=SeqID_196594
atggaaaaggttaaaggtctgcgtattttgaaaatgagggttcgggagttgtttacgcatggggaagagataacttgcggcgctaatgacagattatggtatgaacggtcggtcaaaactcgctttaaacaaagaaaaagatcaccgatgctcgaagaaggagatgaagatgcacaaagaataaaggggacccctaagggtccataa

SEQ ID NO: 79817 - DNA, 459 bp, Glycine max
  Peptide Sequence Number=SeqID_196595
atgcagttggttatgttattgtggtgttactttgctgttgtgtttatggatccggggactgtgcctcctaactggaagcctgctgctgatgaggagagaggagaggttgatccgttgaatggggtctacactttccttgagaccactcttgtgactatatcattactgccacatttcaaaacatacttttctgacggagaaattcctggaacacctggcactcttgccacaacttttcttacttttgttttgaatctggccttttccttgagtgtcttgggatttcttgtcttgcacgtgtcattggtagcttctaatacaaccactattgaggtttttggaatggacaagagatactggttcatccctgcttattcagaggaagatatacgaaggatgcctgttcttcagggccttgagtatccatcaacaccagacttcaatgcccaagagttctga

SEQ ID NO: 79818 - DNA, 264 bp, Glycine max
  Peptide Sequence Number=SeqID_196596
atgttgagttcatcaacaagaagaccctacgaggttttggtagtgaaggtcatactgtcaagtcacaccattgctaaggatcaaggagtctatcatgtgttcaacaagatggacgaggaatccaagcataccttaatagttaaaggttcagtagtcactaaacaacaaaattttagcaaaactaacctgaaggctatgaaggtggccttggaaaaaaccttgaaggagactctagaagttgacgtggaagccatcgacaagtga

SEQ ID NO: 79819 - DNA, 651 bp, Glycine max
  Peptide Sequence Number=SeqID_196597
atgaagagcggtggtggtggtggtggtggtatgggcgcgcttccgtcgtacggcgtcccggcgaaaaggcggtggaaagggctcgtagttgcggtgctcggtctcgtcattctctccatgctcgtccctctcgtcttcctgctcggtctccacaacggtttccactcttccggtacgatctcgccgagatctctctctataaattcccttccattctcccacattctccctccgcaacagatccacgtcaatttcacctccgatttctatcttctcacactgcgacgtgctctagatctatccttttctcgcgctgcacgtgaaacggcgtcgttgaatcctcgcttgttccgaatcgacgaatcgagtttcctcttcgtctgtgcttgtgttacttcgagctcgatgaaagatccgtgtgctcgttttcttttttatagtgaaaaaagatatatatatgaacagaagagtactccttcgaatgagaaaagtcttgaaagatatgatagacatgatgttggccataatgagtctgaggaaggacaatcaaatcatgtggaggatcttatcacaaagtttgaaccaactcttccaaagaaaaccgaacagtggttggctggaggggaatggaagggagggaaggggaaataa

SEQ ID NO: 79820 - DNA, 1082 bp, Glycine max
  Peptide Sequence Number=SeqID_196598
aacctttccaagacatggctatgtttgatctcaatgttgacatcaaccactgtgatgctgatgctgactcaagctgtgatcaaaagggattggtgctgcaaagtttcccacctgaaatctcagattccaggacctccagctcctctgtgtggaaccctgtagaggaagattcctcaaacaattcctctcccttgatttttgacatactcaagaaagagagggatgagtcagagtttgatgcagccactgaaagggtcaataaggagcaaaacatggcaccacaagaggcagagatagtggcaaggacacttttccctgtgactgctgctgttgataaaggagttagagtgcctgatttcaaattggggctgtgggggaagactgaatgcttgaacttgtccttaccagagcctgatggacaaaatggactcagaaccttacagcagaaggtacctcctgtgaggaaaaataggagaggaccaaggtctcgcagctcgcagtaccggggtgtcaccttctaccgcaggactggtggatttgacactgctcaagctgctgcaagagcatatgatagggctgctataaagtttcgtggagtagatgctgatataaactttagtttgagtgattatgaggaggatttgaagcagatgagaaatttgagtaaggaagagtttgtgctcttacttcgtcgacaaataaatggaatctctaggagaagttcaacatacagaggtgcattagcccttcgcaaagatgctcaaggagaaccacgaatgggaccatttgttggcatgacatgttatcctaagccatccatcaattgtgatgatggaaaagcggaggcaagttttaagccctgttcctataagggagaaataattgtgaattccaacatgacaggcacttgccataatcttgatttgagcctaggaatttctccgtcttctaaaagattgaagaataatgactatagtggagggtattcctttggatgtatgacttgtaagatacccgaggaaagaggaccaatggtactactctttactttccttgtagttgcaatatttttttatgggtga

SEQ ID NO: 79821 - DNA, 447 bp, Glycine max
  Peptide Sequence Number=SeqID_196599
atggcctgtaacaagtatgttcatgccaagacagtaacagcaaatgggagaccagacccgagggaggcagaagcatgggcttttctccaagctctcaaatggattcctcaactggacctcgctaatgctgtcattgaattcgaatctgactgcaaagccgttgtggatgtccttcacagtagttttaatggagtttctgagttttattccatacttgcaaattgtaaaaatcatctatctctctatccaaaatcaaggatgagtttaattagagggcaagctaaccaagatgctcacatcgtagctagagtatctagctcatgcattctactgcatattagccagggattttgcgaaagaattgcaagggaggagtgtggaattagcgaaggaattgtgagggtctccgtccgttgttactttgcagctcgtttaagagacggctaa

SEQ ID NO: 79822 - DNA, 258 bp, Glycine max
  Peptide Sequence Number=SeqID_196600
atgggatgtttttgctcccgagcaccttctgttggaagttgtcatcatcatcatcatggagatggtggtggtggtggagggtgcggaggtggtagtggtggcggcggaggtttcaaattaagcaccgccatatccggtcgcgtgtttcctcgttcggggacattgatgattctgcttgttccgccactggctgctgttgtcgtgttccgcttctgggatcaccgcccagtgcctaaaggaacaatcttttggcgctaa

SEQ ID NO: 79823 - DNA, 717 bp, Glycine max
  Peptide Sequence Number=SeqID_196601
atggtagagggaaaaggcagaatttgtgtcactggaggcacaggattccttggttcatggatcatcaagagtctccttgaacatggatatgctgttaataccactattagatctgacccaggacgcaagagagacgttagcttcctcacaaacctaccaggcgcatcagaaaagctaaaaattttcaacgccgatctcagcgaccccgaaagttttggtccagcagttgaagggtgtgttggaattttccacacagccaccccaatcgattttgcagtgaacgagcctgaggaagtggtgaccaaaagagccattgatggagcactaggcatattgaaagcaggcctaaaagcaaagactgtgaagagggttgtttacacttctagcgcctccaccgtttccttcagcagccttgaagaaaaagatgtggtggatgagagtgtttggagtgatgtggatttgcttaggagtgtgaagccttttagttggtcatatgctgtttcaaaggtgttgtcagagaaggcagttcttgaatttggagaacagaatggattggaagttaccactcttgtgcttccttttgttcttggaggctttgtttgtcccaagcttcctgattctgttgaaagagcactgcttttgccgttaggtatgaatgctgcaccttattttactctgtttcttcttccacttctatgtttcgtgttctcaaattga

SEQ ID NO: 79824 - DNA, 981 bp, Glycine max
  Peptide Sequence Number=SeqID_196602
atggaagaggagaaaggaagagtttgtgtaactggaggcacggggtttattggttcatggatcatcaagagactccttgagggtggttacactgttaataccactattagatctgatccagggcgcaagagggatgttagtttcctcacaaatcttccatttgcatccaaaaagctaagaattttcaatgctgatctcagcaacccagagagtttcagtgaagcaattgaagggtgcattggcgtgctccacacagctactccaattgatttagaagtgaacgagccggaggaaatagtgaccaaaagaaccattgatggagcattaggcattctaaaagcatgcctcaattcaaagacagtgaagagggttgtttacacttctagtgcttctgctgtttattggcagggcaaagaagaggaagtgatggatgagagttattggagtgacgaaaatcttcttagagatttgaaaccatttgcttggtcgtattcaatttctaagacattggcagagaaggcagttcttgaatttggagaacagcatgggttggatgttgtgactctaattcctacttttgttcttggacccttcatttgtcctaagcttccaggctcagtttatacttcactggcttttttatttggtgagaagaatccacttggtgcctctcgtatccacatggtgcatgttgatgatgtagcacgagcacatatattcctgcttgagcatcctaatccaagagggagatataattgctcaccattcattgcaactgtcgaagaaatagtagaacttctttctgccaaatacccaaaatttcaaataccaacaccggacgaggtgaagaaaattaatggtcccaagcttccacatttaaactcgaagaaacttattgatgccggatttgagtttaagtatagcttggaggaaatgtatgaggatgcaattgaatgctgcaaggaaaagggtcatctatga

SEQ ID NO: 79825 - DNA, 962 bp, Glycine max
  Peptide Sequence Number=SeqID_196603
atgtcgctgaaactgcggcgggtgtttgtgaacacttgtttgttgctgatgcttttgttcttcagctcgccacttgcggtgatcagtgctgctaagagtgctgggaggattatcaatgctgaggctatggataatgcgcagctgtggttggcttgggtgcagagctctagctggcttgcaagccttatttttcagtttttacccaatgtgatcatatttgttagcatgtatatagtgatcccttcagctctttcgtatctctcgaagtttgaacggcatttgacggtgtctggggagcaaagagccgtgcttatgaagatggtttgcttcttccttgtgaatctcattctcttgaggggtttggtggaatcgtcattagagagtacgatcttgaagatggggcggtgctatttggatggagaagattgcaagaggattgagcagtatatgagtgcttcgctcctgtccaagtcatgcctctcctcacttgcatttctgatcacaagcactttcttggggatttcttatgatctcttggcacccattccttggatcaaaagaaacattcagaagtttaggaagaatgacatgcttcaattggtgcccgaacaaagtgacgaataccctttagaacatcaggccattgataatcataatagtcttcagaggccactgatgcatgacaatgcttatgacattgccaatggggataatgttgagggacaagatctttttgtttatccaatcactggaagctcgcctgctcccaagcagacatttgattttgcacagtattacgcctttaatttgacaatttttgccctgactctagtatactgttcatttaatccccttgtggttcctgttggtgccatttattttgggtatagatatgtggttgacaagtacaattttctgtttgtgtatcgagttcgtggcttccccgcaggcaacgatgggag

SEQ ID NO: 79826 - DNA, 327 bp, Glycine max
  Peptide Sequence Number=SeqID_196604
atggttgtatatattaaaaagagctttgaaccaactatcaaaatcgatgtcagcacactttgtccaagagctttcattgaagatttttcgaattattggattcataggatgctccattgcaagtgggcatttgagaagattcacaaggttcatcatgaatatgtagcaccaattgggctctcagcaccttatgcccattgggccgagataatcatattgggtatcccctcgtttctaggcccagcactggttcctgggcatataacaacctattggctatggttcattttgcgacagctagaagccatcgagactcatagcgggtaa

SEQ ID NO: 79827 - DNA, 327 bp, Glycine max
  Peptide Sequence Number=SeqID_196605
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagatccaatgcctcgaaacccaagggttcctccgcaaggttcgtccacggagggaggctagttaccgaaagatggttatcggttcaagacgcaag

SEQ ID NO: 79828 - DNA, 318 bp, Glycine max
  Peptide Sequence Number=SeqID_196606
atgacactttgtagcacgttttccaacttcaacattcacatattaaaaaacaacaagggttccttttctcgtcgatttcaactctctcagaagctggatgacgataatttcattgataaaatcaaacgaagagagctcatactggaaagtggagaattagcaaccattggtgccatcttcaactttagaggcaaaaagccagattatcttggagtgcagaaaaatcaaccggcattagcactatgtccggcaactaagaactgcatatcgacatctgaaaatgtcactaacctcacacattacactcctccttggtga

SEQ ID NO: 79829 - DNA, 105 bp, Glycine max
  Peptide Sequence Number=SeqID_196607
atggcggaggtgttatattggatctcaacgtttgttctaattttgacccttctatgtatcctcggttaccagggcttacggcttaccctgggcttgtgcgtatag

SEQ ID NO: 79830 - DNA, 468 bp, Glycine max
  Peptide Sequence Number=SeqID_196608
atggggagcggggtactggtcagtcatcaacttggcttttacgttagaaagaaaaagaaggagcccgcaacccaaaagttgcatagtattgacacaccacataatttagttttccttattattctcaccatacttagcacccaaggttgcttccatgctgtcaattatgccgaaagtgttgagggaatgagtagttttggaagtactgattctgacatagttgagatttaccaatgctccggtgcgtcaatgcaagcacgatgggagctgttccagaagcaagctgaaattaccaaaaagaataatggggaagctaacattcggtatgcttggcttgcttcttctaaaggagaactatctacaatgatgaactatggactaagtcattatggattatctggaccaaagtgcacatatggcattggtgttcattatgcaagattgaaaaacacccttaattcattataa

SEQ ID NO: 79831 - DNA, 378 bp, Glycine max
  Peptide Sequence Number=SeqID_196609
atgcatcatcaagcaatgaaaaacaaccttgccgatttaggcatggagaggaaaaaggttggatcacaacccctttgccctaagcctagaaagctttcaccttccatacatgaattcctcaagccaatcaagtgtaccaaacacagccagccaaatattaacgatgaaagtggagttctcaatatgatcaccgaaaagaatgcagaagcaagggaattccaatgtaatgggtgcttgccttgttgttattctggctctcctccacgtagaacagagaacccattggttcatgatgtggagtttcttcatcaagtggaagttgcttcaccgttggcacgaaccaaactctcagataaatttggtttcacctctgcttaa

SEQ ID NO: 79832 - DNA, 1132 bp, Glycine max
  Peptide Sequence Number=SeqID_196610
ttcaaaaaaaaccgtcacgcgcgatccgggcgccttgggcgttctggggcgggcggtaacggcgacagggcaggcgcggtgcgggttttctgtagcaaagtcagtgtgtattgcccctggtttctcctgcgccgttgcgctttccctggcgcgcgggacgattaacgccgcgccgccggcgagtggccaggcgacagcggacttgaaaagagggcgtgacatgaaaaccgtgggtaactttattgacgggcaggtgtgcctgagcagcagcaatcaaaccgtcgacgtgcacaacccggccagcgggcaggttgagcggcgcgtcacgcagagcaccgccgccgaagtcaagcaggccatcgacgtggcccatcgggcgtttgccgattggtcgcgcaccacgccgctgcgccgcgcgcgcatcatgttcaatttcaaggcgctgctggaacagcaccgcgacgagctggccgagcttatcgtcagcgagcacggcaaggtgtactcggatgcgctgggcgaactgacgcgcggcatggaagtggtcgaattcgcctgcggcatcccgcatctgatcaagggcgagtattcgccggacgtcggcagcggcgtcgacagcttctcgctgatgcagccgctgggcgtggtggcgggcattaccccgttcaacttcccggcgatggtgccgatgtggatgttccctatcgcgctggcctgcggcaacaccttcatcctcaagccgccggcgctggtgccttccgcctcggtgcgcctggcggaactgctgaaagaagccggcctgccggacggcgtgttcaacgtggtgcactgcgccaatgaagacgcggcgcagctgtgcaccgatccgcgcattcaagcggtgagcttcgtcggctcctccaccgtggcggaacatatctataccaccgccagcgcgcacggcaagcgggtgcaggccttcggcgcggcgaagaaccaggcgatcgtcatgccggacgccgatctggacgccacggtcaacgcgctgatgggcggcgcgttcggctccgccggcgagcgctgcatggcgctgccgatcgccgtggtggtcggtgacgacaccggcgataaactgatcgccaaactgaagccg

SEQ ID NO: 79833 - DNA, 350 bp, Glycine max
  Peptide Sequence Number=SeqID_196611
tgcatactgaagcgaaggctgaagcaaaagccgagctatcagtagcagcacatcttgtgcaatcacagggtacccagaacaggtcacttcccgtatcaagcgccaccatgaacttcactcccggtggagtttccgtcggagaaggcgaggccgtcgtcgatttgggagagcttgcggccgcggaggaggcggtcgcggtcggcgagttcggcgtagtactcgacggtgcccttctccggcggggcggggattccggaggcggtggagtgggaccacttcctgacaggctccgagtggcggtggtgcatcgtgaaggtgtagacgtggccgtggcagagggagaggaataa

SEQ ID NO: 79834 - DNA, 168 bp, Glycine max
  Peptide Sequence Number=SeqID_196612
atggctcaagattcatgcagtttgcattatacgacagttcaaatagggacaccgggagtgaagttcatggtggcgcttgatacgggaagtgacctgttctgggtaccctgtgattgcacaagatgtgctgctactgatagctcggcttttgcttcagccttcgcttca

SEQ ID NO: 79835 - DNA, 897 bp, Glycine max
  Peptide Sequence Number=SeqID_196613
gatttcgaccttaatgtatacaatcccaatggatcttcaacaagcaagaaagttacttgtaacaacagtctgtgcatgcaccgcagtcaatgcctagggacgttgagtaactgcccctacatggtctcttatgtctctgctgaaacatctacatcgggaatactagtagaagatgttctgcacttaacacaagaagataatcaccatgaccttgttgaggcaaatgtcatatttggatgtggacaaattcagagtggatcattcttagatgttgctgctcccaacggtttgtttgggctaggtatggagaaaatatcagttcctagcatgttatcaagggaaggatttactgcagattcattctccatgtgttttggacgtgatggcattggaaggataagttttggggacaagggaagttttgatcaagatgagactccatttaatctgaacccatcacaccctacctataatatcacagtcactcaagtccgtgtaggaacaactctaattgatgtggaattcacagcactttttgattctgggacctcttttacatatttggttgatccaacctatacgaggcttactgagagttttcattcccaagtacaagacaggcggcatagatcagattcaagaatcccttttgaatattgttatgatatgagtcctgatgcaaatactagcctcattcctagtgtgagtttaactatgggaggtggaagccattttgctgtttatgatccaataattattatctcaactcagagcgaacttgtatattgtctagcagtcgtcaaaactgctgagctaaacataattggactgcagcattgctttcttttttcctctgctgtattgtatgctcattctcatgctcgttatcctaaatga

SEQ ID NO: 79836 - DNA, 2439 bp, Glycine max
  Peptide Sequence Number=SeqID_196614
atgcataaaaattccgactgcactagaatcgattatccggtttccctcccaaaaccgattttgattgtcacacttttgccccttctcactctcaaaaatccatctcttcttcattcttcaaattgcattccaatttcgaaaaccctaaaaaaatcccaattctttgtctccgtgttgaatctgaagagttttaagcttagatttaataggaattttccatgtttgatgattgtatttaacatacttgttcctatgtacagcaatcgtactagcagtcagtttggtcaacaagaaacaacatgtcatttgttgctaaaagaactccagataatatgggatgaagttggagagtctgattctcgaagggatgcaatgttgcgggaaattgaacacaagtgtctggatttgtatagaaaagaagtggatgaagccaaactgtgtagagcacaaattcagcaagaaattgctgataatgtggcagaaattgctggcatctgtgcagcaatgggtgaacaaccattgcatggagattttacagttgacaaacttttattggtgtgccctcagtttgatccaaagtcttgtggaagcttgaagaaagcacgtgaaacagttgtttcacaacttgaggagatgcgcaagctgaaaaccaaaaggaagaagcagttttcagaagtcttatatcacttgaagaatatttccagtgagctttatggctccatggtggctaatgcatatttagaagagaacaacctgtctttgaaaagactagaggaattacagaagcagctacttcaattacaaaatgaaaaggccagtcgactgaagcaggtgtctgaccaactgaacgctctcaattcattgtgcttggtccttggtttggatgtcaaagacaaaatttgtgagatttgccccactatggttaattccactgtgactaaagatgtcagtgacaatacaataaagaatttgacatctgaaatacaaagtttgagagaggttaaaatacatagaatgcagaagttttatttcatgtaccatttctcactttacatgctgcctcagcttcaaagttttgcagctgcgctattagagatgtgggatttgatggatacaccaatggaggaacagcagaaatttcaccatgtgaccagtaaaattactgctttggaatctgaatttactgagtctaaaatactttcaattgactccgttatttaccttgagaaggaagttgaaaggcttcaagtacttaaatcaacaaaaatgaaagaacttttacggaaaaagaagttggagttagaggaaatatgcagaaaaacacatctgactacacaaacagtttttcaaagccaacattcacttgagcttctagactatgatcaaattgagcacctaattactaagacaaaagaagaagctcttaacaggaaagaaatccttgaaaaggttgagaagtggttggttgcatgtcaagaagaaagctggctggaggagtacaatagggatgataatcgttataatgctggaagaggtgcgcatcttaccttaaaacgtgctgagaaggcccgtgctttgttaagcaaaattcctgggattgtggagacaataattttaaaagttaaagcatgggagaaagaaagaggacaagagtttatgtatgatggaagccggctactttccattcttgaagactacagcaccttaaggcaggagaaagagaatgaaaggcaactacagagggatcaaaagaaacttcagggacaactgatggccgagcatgaaacacttttcggttcaaaacccagcccagcatttaaaagtgggtacaaggtttccagatgttcaacaggaattccaagtatcacaatgcttcaggatccaagacatgcctctcttattcaccaatctaataaaaagggtaatgttaccaatcagaaaggctccatccttcgcaacaagaatatttaccattcaactcaatcctcaggaaaggataactctaaagctattggtcattcagtgaagctgaagaagactgcaagcagtgcagaaaagggcactgaaattcagtcatcattgactaggaagcccctctctcctgtttctcccgcagtcttgtctaaagccaacatatcaaattttcaagaagaccatagaaaatcacagaatgtagcaacacagcaaaaaagtcaaatgctaacagcaactccaccctccaggccatatatagctggagatgaagaaaacatgaccccaaagaatatggcacttccagtgcctaccactcctttgacttcagtccctatgctgactgccattaccccagacagtgtgtattctggtcctactgctgcttcaaagactagtcaatcatttgaatattcatttgaggaggtgagagctggttttatgctacctaaaacctatgctcaatga

SEQ ID NO: 79837 - DNA, 333 bp, Glycine max
  Peptide Sequence Number=SeqID_196615
atggagagaggtcttgctggaactcttccaagggaaatcactaatttggttaataggtctttccttttaaaagttgatgttaaaagtggatgttgctcaccgtttgagaaaactttgaatttgatgcccaattttcctgatgttgttgaaaatgatttgcattgtggtgaaagagaagcaattaatttatcaaaggattctgaagagttaatccctaccaaacacaatttctattgcgaatcaactatgggagaattaactctaaatgaaatgaaaggaaagacagatggtgttagtatgaatgttgaaccgatacagagtcaatcttcataa

SEQ ID NO: 79838 - DNA, 1242 bp, Glycine max
  Peptide Sequence Number=SeqID_196616
atggcttcttcggaagctgattcccgtctgaagcaggtgctcgttcccgcgctcgagaaaatcatcaagaacgcgtcgtggcgaaagcacgcgaagctctcgcacgagtgcaagtccgtggtcgaaatcctaacctcgccgccgaagcctcaatcgcctgcctccgacgaagccgctgagccggaggcctcggtccccggcccaatccatgatggaggtcccgtggagtactcccttgccgagtcggagtcgatcctccgcccgctcattgccgccgcgtcctccggcgtcgtgaagatcgcggatcccgccttagatgccgtgcagaggctcatcgcgcacggcttcctccgtggcgaggcggactccagtggtggagcccccgaggcgaagctcctcgcgagcctgatagaggcagtgtgcaagtgccacgacttcggcgacgatgccgtcgaattgctcgtgctgaagacgctcttatctgcagtgacatcgatttcgctgcgaattcacggtgattgcttgctcttgattgtgagaacttgttatgacatataccttggtagtaagaatgtggtgaatcagacgacggcgaaagcgtcgttgattcagatgttagtgattgtgtttaggaggatggaggcggattcgtccacggtcccgattcagcctattgttgtggctgaattgatggatcccgtggagaaaaccgatgtggataactccatgacgcagtctgttcagggttttatcaccaggattgtgcaggacattgatggagttttgaatccagtgacgccgtcggcagcggcggccgcgcacgacggcgcgtttgagaccaccatcacggcgacggtggaggctgcaaatccggcggatttgttggattccactgacaaggacatgttggatgccaagtattgggagatcagtatgtacaagactgcgttggaggggaggaaagaggagctggtggatggggaggtggtggagagggacgatgatttggagattcagattgggaataagctcaggagagatgcctttttggtgttcagggcgctttgtaagttgtccatgaagacgcctcccaaggaggcgacggtggatccacagttgatgaaggggaagattgtagcattggagttgttgaagatcttactggagaatgctggagctgtcttcaggactagtgaaagtttaaactttaaagttgctagcatgtttggtcagtcagggtga

SEQ ID NO: 79839 - DNA, 1119 bp, Glycine max
  Peptide Sequence Number=SeqID_196617
atggagcaaattgttaaagaagaagtgaaagaaggaaatgagagaaggtataggtggattgaggttggcaaaaatgtcacaaaagaacaacaacaggccatatctaaacttcctttcaggatggccgatcgatccaaagccttgatgagacagattatttgtttttctgcggaaaagggcaccatatctgatcttttgagatcatgggtgaagttgatgaagcctaccagagcagactggctttcagttctgaaagagttgagaacaacggaacatcctttttaccttgagctgaaagcagttttttcctctagctgtctaaatctcctggtttgtctagtggcaaagcatactcttctagaagaatcctttgaagtcaatattcgtgactacacaaaaataatacattattatggcgagcacaatctactggaagatgctgaaaaatttctcacactcatgaagcaaaggggcttcatctatgatcaagtaattctgactaccatggttcacatgtccagcaaggctggtaatcatgaccgggccaaggagtactttgaagagatcaaattgctcggcgaacctctggataaaagatcgtatggctcgatgatcatggcctacatcagagctggaatgcctgaagaaggagagaatttacttcaacaaatggaggcgcaagaaatactcgcaggcagtgagatttacaaggcactgcttagagcctactctatgattggtaatgctgaaggagcacaaagggtgtttgatgctattcaacttgccggtatcaccccagatgataagatttgtagtttgcttgttaatgcttatgctatggctgggcaaagtcagaaggctctcattgcatttgagaatatgagaagagcaggtatcaaacctagtgataaatgcatagcttcagtattggttgcatatgagaaggaaagtaagataaatacagcattagaatttctaatagatttggagagagatggcattatggttggggaagaagcttctgcggtactagccaagtggttccgaaaactaggggtggtggaagaggtagagcttgttttaagagactttgctattatagaagttgcagcattataa

SEQ ID NO: 79840 - DNA, 150 bp, Glycine max
  Peptide Sequence Number=SeqID_196618
atgaaaaagatattcagaaaatccaaagaatgtgttgttagggcgatggattggagcatctgggagtacggaatagaaggagattacaaggatgtcaggttacaacttacaagccacactccgtgtatattgtccgcaggttgctactaa

SEQ ID NO: 79841 - DNA, 2865 bp, Glycine max
  Peptide Sequence Number=SeqID_196619
atggcgtcgaaccgtaacggcgtccaaaggggaagcgccaagttcgatcgcccgctcaagccccgcccccgcccctcttccccctctccgggatccgcccttcgccgccccaacgccgccgccagaaacggcgacgccgcctctacttcacagggttttcctgttccatatgtagatgatatggaactgatcgaagctcctgtgttgatcttggaaagagcactccattcatgcttgggagtggaccaacttggttttggtaccacttggtgtagaagagaaactgatatggaagaagagcagaacagggagcattatgcagcaacagaattaaaagatgcagaagtagcagcaaagacagagcaagtaaaaggaccaaacaaggaagaactacctggaagagttcgagtggctgtaagattgagaccacagaatgctgaagaaatgatagcggatgctgattttgctgactgtgttgaattacaaccagagcttaaaagactgaaacttcgtagaaacaattgggattcagacacatatgagtttgatgaggtgcttactgaatttgcatcacagaaacgtgtctatgaagttgtggctaagccagttgtggagagtgttcttgatggttataatgggactgtgatggcttatggtcaaactggaactgggaaaacttttacacttggacgacttggggaagtagatgcctctgaccgtggtatcatggttcgttccatggaggatatttttgctgacttatcaccagataccgattctgtcactgtctcttatctgcaggacttgctgaatccagcaaatgataatattcctatagtggaagacccaagaagtggtgatgtatctatgcccggggcaactcttgtagaaatcacagaccaacatagttttttggagttgttaagaataggtgaagctaatcgagtcgctgctaacacaaaattgaatactgaatcttctcgcagtcatgctattctaacggttcatattaagaggtctgtcttggaaaatgaagatattgtgtctagtcaaaatggtgatgcctctcatttgactaaaccttcaaaaccacttgttcggaagagcaagttggttgtggtagacttagcaggttcagaacgtgtccataaatcaggaagtgaagggcacatgctagaggaagctaaatctatcaatctttcacttagttcattgggaaaatgtattaatgctctagctgagaacaatgctcatgttccatttcgtgattcgaagcttaccaggatgcttcgagattcttttggaggcacagctaggacttcattgattgtgactgttggcccatctccacgtcaccgaggagagacttctagtactatattgtttggccaaagggctatgaaagttgagaatatgctgaaaataaaggaggaatttgattataaaagcttgtctcgaaagcttgagatacaattagataagcttattgcagaaaacgaaagacaacataaagcttttgaggatgaagttgaaaaagtaaatttggaggcacaatgtcgtattgctgaggttgagaggaactttgcagatgcgttagagaaagagagactgaaatgccagatggagtacatggaattggtaaaggagttggagcagaagttggtgttgaatcaagaacgaaacgactgcaatagttttgtggctgataatggagaggggcctgcatcatcttctacagatgaagttgctgaggtcaaaatgctgcttgaaactgaaagaaatcggaggaaggcagctgaagaagaggtaggacatctaaaaagtcagctggggaaacatatgccatcagaggcaggaggtgatgtggagattataaagcttcgcaacatcctggaggacgaggctaatcagaaaaaaagacttgaagaagaaatcataatactaaggagtcaattattgcaattgaactttgaagctgaccagatgagaaggtgtttggaaaatggaagctctgggagcacattttctgccttggattcctccacgactcaagttaggcattcccaatttaaggatgttgcaaatggccaaaagtcatctgttgctacactctttgagcaagatgatgccaatgtacgaattcatgccgtgaaagtggtggccaacctagcagctgaagaggctaatcaaaagagaattgttgaagctggtggtcttacttccttgttgatgcttcttcgaagatatgaggatgaaactgttcgcagagtagctgctggggcaattgccaatcttgctatgaatgaagcaaatcaagaacttattatggctgaaggaggaattactctgttatcaatgactgcatctgatgctgaagatccgcaaacccttcgaatggttgctggagcaattgctaacctatgtggaaatgatagaatactgatgactctgagatctcagggaggcattaaggctttactgggaattgtaagatgtggacatcctgatgttctttcccaagttgctcgaggaattgctaactttgcaaaatgcgagtctcgggcttctaatcaagggataaaaagtggcagatcctttttgatagaagatggcgcacttccgtggatagtacaaaatgctaataatgaagctgcaccaatcaggcgtcacattgagcttgcactctgccacttggcacaacatgaagtgaattcaaaggacttgattggtggaggtgctctttgggagcttgtccggatttcacaagattgttcacgggaggacatacgaaatcttgctcgtcggactctcagttctgtctcaacattcaaatctgaattgcggcgattgcgtatagattattga

SEQ ID NO: 79842 - DNA, 276 bp, Glycine max
  Peptide Sequence Number=SeqID_196620
atgagaagaagaccaggaattggagggttgcagacgcacgccgctgcaagagatcaattccgtttgctgggtcaaaatgtcgcaaagatcataactgatttgatgaaggagcaacttgccacctttcgctctcagctcgaagatttcgctcgcaaacacagctcgaagaaagttagagcgagaaagcgagagagaggctgcattgtaagggatgttgtgtgtggagaaaaagggaagaggggaataagaggaagtttatttttaagaggggaataa

SEQ ID NO: 79843 - DNA, 280 bp, Glycine max
  Peptide Sequence Number=SeqID_196621
atgggtgccttcgtcgaggtttacccacagtcgcacacgaaggtgctatccctgaacaccttgttgttagggttatgtttctgtcctaccaatgaggagcttattgactactacctctgctcgaagatcaatgaaaatggtgatgatgtttggattattcatgagattgatgtctacaaatgtgtgtgttttttgctagagaagcaggaaaattccattgtggtgcggaagaggtttctagaggaacatgagaggttagatggcacggttgacgatggtg

SEQ ID NO: 79844 - DNA, 468 bp, Glycine max
  Peptide Sequence Number=SeqID_196622
atggatagtgtatttgttcttgtgtattgcaacagtgacataatttcatcatatgaagggataaagtttgaatgtcatagtggtcctaaagtcatcacaataagtgaggacatgtctcttgatgccttaaggaaaataattttttacgccaacggaggttgcagaattttacttaatcttttttaccatcaacaaattcacgtaggtgatggttgtgttgaatacgactatgtggagctcaaacacaacgatgatgtggggaaaatgtttttcatttattcgaaatttagtactaaaggtccgattgagttgaatgcaacttttgggcgttctccagtcattgtggtgtgtgactcaaaatcacaattggcacaaaaaaaaaaaagaagagtttttgagaggctgcaaacaaaggagttgcaggaaaattcagaagctcttaaaggaggtagtgagctaggtgattga

SEQ ID NO: 79845 - DNA, 264 bp, Glycine max
  Peptide Sequence Number=SeqID_196623
atggcccataatttcacccccaagaagagggtgtcgtttcgtttacgaaggacacagcttcaccgcaccgaacaacaatcaccaaaaaataaaataaaagtggcggtgaaggtgttgttcttctttggccttagaaacagagagagaaaaagagtttcagagtctgagagaaagaaaagaagtattttagagagagagagagagaggaaaaagtgcaaaacgtgtgtgaatgatccaatgctgaggcagacaacatttctttaa

SEQ ID NO: 79846 - DNA, 423 bp, Glycine max
  Peptide Sequence Number=SeqID_196624
atggacttgagcaatgtcagcaagggcagcttcaggctccgtgcggggatggaacctgccacagctcctctggaggaacaacctttccctgtcataacaatagttcccttttcccttcaggaggttgtggaaaagggtgacaatgatgaagttatggtaagggatgacattttgaagtatcaatcatcaataatgtcccctatgagtgctggtgccttgtggaatcaacttgagttggccaaactaggtgacacacataagatgactttagtggctttcgaggaagatgagcacctattcacgcgtcttgcccctgatggtccccctacttctatgtttatcagtgtatgtctgaataactttcaatgtgccttgctcaggcgcttgaacatggatccctcccaacttcaccccaatagctag

SEQ ID NO: 79847 - DNA, 2304 bp, Glycine max
  Peptide Sequence Number=SeqID_196625
atggacagattcggtcggcttgttgtccaaatcatgaatctcaaccccgaggacaagcgtcagccccttccaaagggacgaaggtacaagcattatacacccttgacaacaaatcgagccaccatcatcgacgaagctttcaatgcgaaggtacccagacagttacctccatacctcctcccagacctggtctggatagaaccaagcactgcaaataccaccacaaccatggccacaacactgaagactattgagctctcaaggacaagatcaaggaacttatacatgcagggaggtagaggcatcacccacaaaggcgtgaacaccaaccccaacaagagcaggaagacgaacaagcatcatatccacaccatcaaagaccttaatgtcaactgtgtcaacatacaattgccaagaagtcttcctcccataaccttcacaaagagagatttcaaaggcatcaaccccattaatcagaacgactctatggttgtctctattgtcattgccatcttcatagtgtctaaagtccttatcgaccaaggaagttccacaaacatactctattggaagacatttcaaaggcttggaatctcacccgccacgattcaaccatattacaaaccactcctaggttttgctggcgagagagtggaaactagaggttatgtggacttaatgaccaccttcggtcagggtaaactctcacatagtttcactataaggaaaaaattgaatgagttcaaagccatagtctctacaccacatctcaagataaagttccctaccttgatgggagaaattgtcactattaaggcagaccagaagcaagctcaacaatactatgctaagagcctaaaggtgggcccttatcctcctaccaaagagcccggtaagcctcattccccctctagtggcagcaacagtcaagtcataagcattgtcaaagaattcctaataagggccctggccgtctatgagataaccaggggaaatcttggcgatacatccaacgtggaccctcgggatgacaccatcgacaaaggcccaaagcaaatagaagaacttatcaagctacagcttgggcccaagtccggggaagagatcgacaagctgctcaaagcccagtatattggagaggttagatactcgacctggcttgctaatgttgtcatggtgagaaaagacaatgggaaatggcgcatgtgcactgactacaccaacctcaacaaagcgtgtcccaaggatgtgtatccctttcctagcatcgacaagctcttggataacatgtctgatttccatttactgagcttcttggatgcttattcagggtacaaccatatcaggatgcaccccgagatgaagaaaaaacctccttcatcactgaaaatgccaatttatgttacaaggtcatgccttttggactcaagaatgctagagccacataccaaaggctcatggactaggaagtattcaaagcgtaaatatgacatgcgcctcaatcctaaaaagtgcatccttggggttcctcccaaaactgagtcattctcgtgggacgtggcttgcaagcaagctttcttagcttttaagaaaacaattgcaacaccgccagccctcaaatttggttttatggcatcaaataaccaggctgaatatgaggcactcatagcaggactaaagttggcaaaaaaagttggagcaaggaagctcagatgctatagcaattcacaacttgtccatggacaagttgcaaacagatatcaagacaaggaagcagctatccttagatactatcatgccataaagacccttgttgatgactttgattgtttcaaaatgtaccacataccaagggaggacaatactacgacagacttgctctccaagatagccagcaccaagaagaccggacacctcaaaactatcatccatgaaacactccaagcaccgatgatagatatcaatgaggtcatggcaggggaagaagaggaaccagattggatgaccccttataaaaatttcttaactcaaggggtgttaccatcaaacaaaaatgaagcgcgacgtctaaaaaggaaggccagttactatgttattcttgatggggaactattcaagagaggaatggacatactggggcaatttccaaaagctccaggacaagttgagttcttgttggtcaccgtagactattttaccaaatggatcaaagcaagaccattgcaagcgatttcagccaacaccatgatccttgtagaagtcggggagccctcaatgagaagactatttttccaggctcagtag

SEQ ID NO: 79848 - DNA, 531 bp, Glycine max
  Peptide Sequence Number=SeqID_196626
atgtttgagttcaactcggacgtgtttcgtaggttcaaggaccacttctttaaggtcaaggcaaccagtgtcatctctgaagggttatcgttgatgcatgaagagaatgaggaaccttgtttccctttttattggcaatcagaccatgcaaggaataatgggcgaattagaataatgaccctagtgaagcaggttggacctactgaaggtgatgtgactcctcctccaacaagtgtcaatgaaccttctatagaggaaggatatttgactgaagtcggggtcaacctaccccatgcctcgggctctatcgaggctaattttgttgaggttatgcctgacgtgcctcctcctgcaactaggaaaaggaagcatagtggtcggagggaccagacaacgactactagttgtcgaggtccaccctcaacccccttcgccactcaagctgctgccaatacaaccaacatttctaatcctctggctcctccatctccatctactcaggcagtctctgtaccttcttcctctatgtag

SEQ ID NO: 79849 - DNA, 435 bp, Glycine max
  Peptide Sequence Number=SeqID_196627
atgcctcctccctcctccgttttgccaccctcggctcccactgtcttgcctcctactatgcctttttcctcttcatgccaaatcgtttcattggatcagagaagcctgactatcttagaagaaaatgggaataggcataaggaggccatgagtgtggcgagtgaagtgccccaaggtgaagtggagcgctctgctgaggagaaggaagcgcttaacgcaacggtggcagaatccgctaagttgattagtgatcttcaagcccaattgagggattcagagttcgcttcgtgcaacctccagaccaaactgaaggagtccaagcttgaagtggtgagggagaaagagttaaataaggagcttgaggatgaactccttatgtttaagaaagaggttgttgagcagcacatgaaagggtttttcaaggccgtaaggtag

SEQ ID NO: 79850 - DNA, 435 bp, Glycine max
  Peptide Sequence Number=SeqID_196628
atggagttggtcctccgtaatttatacttagcggtcaaaattatcaccctattgggagtttattgcctgaagagggttgtaaacccaaatttgcacaactatatatatatacatgatactcaaaaggagctacaaaacaaagtatctcactttgggggtgaaaaaggttatgaagtttttgataaaacattagttgaggatctaactaaaacagatgatcaatttaactgtcttgctaaacattttaggaaggttagagattttgttgaaggtaatgcaagaaaaagattttgtttgaggttgtaccgagatcgaagaaaggatccaagtgtttataatatccctgatactgatgaggttgttgctttgatagtaagggacttagacagtatgaactttgggagagacattgttctcaaaagcatttttggttaa

SEQ ID NO: 79851 - DNA, 279 bp, Glycine max
  Peptide Sequence Number=SeqID_196629
atgatgaataggtattgttttgaggctttggattgcactttgtgggatttgatgcattatgacaaaggtgaaggtgacattgaaataccaactaatcttttggttttagacaatgataaaccactgctttcattggttgatgttgtgtattcaaacatattggaaaatttgaatgtttcaaatttctttgaagatagagcaatccttgctccaacattaaaaacttctgaagaagtaaatgaatttatgttgtctttaattccaggggatgaagaatag

SEQ ID NO: 79852 - DNA, 2031 bp, Glycine max
  Peptide Sequence Number=SeqID_196630
atggtgactaatcttcctgcaacaaagtccaccaacacaacgacgtcgttacaggagaaacgacaccgttctatcttcgaagttccaccgaacttcttcgattgttgtcgccttctcccttctcctcactcatccgtttccgaccactacagcgtatccagaacccaaaccctcgaaccatcctcaaacgacgacgtcgttttggatgcccctcaaaacgcggtcgtttccgcgcctaggtggacctgcaatacctgcaagactcaattcgattcccttcaggaccagcgttcccatttcaaatccgacattcatcgattcaacgtgaagctgacaattgctggaaagaatattgtgaaggaagaagattttgaggttctgacatctgaatttgtcaaagactatgatgtgtcaagtatatcaggatcagaaattgacgatgatagtgaaactgagtctcagagtcaaagtgtattgtgtgacaaatctagcaaaagttttaaaacgaaactattcttccgtcttcagacagggcagagagtttctgtctggaagtgtttgattatgaatgtgactgaaaatgtattgtatgataatgaaaaggctgagaatcaagtggttgagaagttgaaatctttgactgctgagcccagagacaatacctatttgaggattgttctgcttgcgtctggtgggcacttcgcaggttgtgtctttgacggtgatgctgttgtggctcacaagacatttcacagatatgttgtaagggcgaaggcaggaaaaaaacaatcatctaaagatgcttctggcagggctgctcattctgctggggcttcacttcgtcgatataatgaaatcgcattgaagaaggaagttcatgaactgttcactgattggaaaccttattttgatgcttccaattgcatttttatacatgcaccttcaagtagtcgtcaactgctttatgatggagagagatcgtactttaccaatcagcagtgtgctattagaaatattgctttgactgttcggaggcctactttcagggaagcaaagcgggtatatagccagttgatccaggtaacctatgaagcagatgaaaaggaagttttgcaaagcaaccaagaggattcagtatcaattcacatttctaaaataaatgtcagtccaacctccagcaagggggacatggctgagttggatgacaaagataaagctgaagctttttcaagtaaacaaaatgatgaactcccaatttcaagtaatggagaaagtgaggatgatctatcttgtaaatcaactcctttacatcaggcagcacaatcggatgactctctaaaggttttagagttcttggaacagggcttggatccctgcatcaaagatgaaagggggaggaccccatatatgttggcacatgacaaagaagtgaggaatactttcagaaggtttatggcgtcaaatcttgacaaatgggattggcaagctgcaaaagtgcccagtgcattgaccaaagaaatggaagaatcacaagctgctaagcaggcagaaaaagatgctaagagaaaagctagagcaaaagaattaaagaaattgcgtaaagcaaaagaaaagaaggctcaggttgaagccaccttgcctaagaatgattcgaaaactatagagaagcaagtaactgcttcaacatcggttaagggacaatctcaactaaaaagtggtgtgcaattatccaaagaggaccaaataagaatggcacaggctgctgaaagagaaaagagagcagctgctgccgagaagagaatagctgccctcaaaattcaagctaatagtgcaaccactgcaccaaccatgtcagaacctaaaagtggattagccggtgacatttactgttcctgttgtaattcatcacttgctggtaaagttcccttccaccggcatcgggcctcaaagtatcgtgaatcctctggtcttaggcagcatgtattgcctgttttaaaccagatcagggaggttgattcgttgaggacttga

SEQ ID NO: 79853 - DNA, 420 bp, Glycine max
  Peptide Sequence Number=SeqID_196631
atggcagagctgctacgtaatccaggtaaaattgacaaaagaaaagagttatctcaagcaattggaaaagatgtaacaattgaagaatcacacatcttaaagttgccatttttacgagcagtggtgaaggaaacccttcgtttgcaccctccaggtccatttttagtaccccacaagtgtgatgaaatggtaaccatatatggcttcaaggttcccaaaaatgcacaagtcttagtcaatgtgtgggccatgggacgagatccaagggagaacccagaagtgtttaagcctgaaagatttttggagcgtgagattgattttaaagggcacgattttgaattcataccctgtgggacaggcaacagaattgccattagctcacagaacaatgcatttaatggtggcatcccttgttcataa

SEQ ID NO: 79854 - DNA, 576 bp, Glycine max
  Peptide Sequence Number=SeqID_196632
atggatttacttgttgctgggattgacacaacgtcaagcacggtggaatggattatggcagaggtgctacgcaacccagataaattggtaaaatcaagaaaagagttatctcaaacagttggaaaatatgtaacagtggtgaaggaaactcttcgcttgcatccgccaggtccacttttagtaccccataagtgtgatgaaatggtaagcatatctagcttcaatgtgcctaaaaatgcacaaatcttggtcaatgtgtgggccatgggaagagatccaaccatttgggagaatccaacaatttttatgcctgaaagatttttgaagtgtgaggttgattttaaaggtcatgattttgagctcataccctatggggcaggcaaaaggatatgccctggattgccattagctcacaggacaatgcatctaatagtagcatcccttgtacacaactttgaatggaagctagctgatgggttaatgccagaacacataagcatgaaggaccaattcgggttaaccttgaagaaggtccaacctcttcgagttcaacctattccaatcaagcacgactaa

SEQ ID NO: 79855 - DNA, 2085 bp, Glycine max
  Peptide Sequence Number=SeqID_196633
atggaaattctgtattcgaagctctacgacaagtacaccaaactcaagtctaagaaactctccgatttggatcacataaacaaagaacaagagggtaaattcgtgaattacttgaccgctgcggaagagttgatagagcacttgaagagcgagaaggaagggcttgttgaacaagtcaatgagttgagaactgaattttcttcacttaggcacgaatgggctgccaaagagaaagaggttgcggattatcaaaagcttttgatggaggaaaaagaaaaaaatgaagctctttctgaagaagttgagaaattgctaaagcttcaccaggaaagaacatctcatgttttatataataacagcaagatcaagaccgtagatgatcagtttaaggcaaactctaacagctcatctataagaatgacaagaaaacatacaaagcagattgctttggagaaagaagcaaggtcaatatctttggaaaatgaaggtaattctgtggagagagagtcaacaccaaatgcctgcaaggagactgtttctgacaatgctaacgatcgatcaggcattgatttacatgaaagtggtcatggtaactggcttattcaaactctttttgagtatgcactgagcatgaaattatccttggattatcaagcaggacgaatatgcctgtctgcactgcatggatcaagcggttactccttcagtttatcgtggatcggcaaatcacctggagaggaggaagcagaagcagagctgctgtaccatgttatatctctaggcacatttgaaagagtggcaccagaatggatgagggaggacatcatgttcagcccaagcatgtgccccatcttctttgaaaggatatctcgtggaataattgattccttcaactccatcttcacacatgataacaacaacaattatcacaacaccaattctccttcttcttcttcctcaacgaatcgaatggaagcttctcctcctccttcggtttcgaacgagcgcgttgcatacaagctcaaaggctacttcgatttagcaacgcaagagatcgcgaagggcgttagggcagaggaatggggcttgatcgacgacgcgcttcttcactaccgtaacgcgcactcgatcctcctcgaagctaattcaactcccgttccttcctacatcactaccagtgaacagcagaaggtgcaatcgtatcgagagaagatatctaaatggcagagtcaggtttctgagaggttgcagactctcgctagacgagctggcagctcatctgcaaatcagagcacctcaaaacttggtcaaactgctgccgctccaattaagacattgagtactagaaaaaatgtgttacaaaagccccctcaaagaggaggtcaggtgaataaagttggaagcccaaaatctagtcaagcatctggtgtaaattatgatgacaaactagttgaaatgattaacactgccatagtagatagaagtccttctgttagatgggaagatgttgctgggcttgaaaaggcaaagcaagctttaatggagatggtcattttgccaactaaaagaagagacttgtttacgggacttcgaaggccagccagaggtttgcttctctttggtccgcctggtaatggaaaaaccatgcttgccaaagcagtggcttcagaatcacaagcaacattttttaatgtcacagcagcttccttgacatcaaaatgggtgggtgaagctgaaaagcttgtccggacactattcatggtagctatatccagacagccatctgtaattttcattgatgagtttgatggggtgacctccaatcctgatgatattgtgattgtaattggtagagatcttgagaggcttgtaaaagagactgaacgatattctggcagtgatctgcaagccttgtgtgaagaagctgcaatgatgccaattagagagctgggtgttgacattcttactgtaagaggactgagatacgaggattttaagaaggcaatgactatcattaggccgagcttaaacaaaagtaagtgggaagagcttgagcgttggaatgaggaatttggctctaattga

SEQ ID NO: 79856 - DNA, 971 bp, Glycine max
  Peptide Sequence Number=SeqID_196634
atggctcacctgctccccttcctcgtcctcactctcctcgccgccaccgcctccgcccacaacatcaccgacattctcgccgccaaccccgactacagcgacttcaacgacttcctctcccaaaccggcctcgccggcgacatcaacacccgccagaccatcaccgtcctcgtcctcaacaacgccgccttctccgccgtcgccgcgaaacaccccctctccgtcgtcaagaacctcctcagcctccatatcctcctcgactacttcgacaacacaaagctccaccagatcaccaacgggaccactctttccaccactctctaccaaaccacaggtaatgccaacggcaacgtcggctccgtcaacatcaccgacctcaaaggcggcaaggtcggcttcggctccgcggctcccggctccaaactcgactcctcctacatcaaatccgtcaaaagtatcccctacaacatctccgtcatcgaaatcagcgcgccgataatggcgccggggatcctcgcggctcctcctccgtcagccgacgttaacataacggcgctaatcgaaaaagccggatgcaaaacgttcgcctcacttatctcctctaacggactcattaaaacgtttcaggcaacggcggataaaggtttgactattttcgctcctaacgatgaagcgtttaaggcgaaaggagtacctgatttgagcaagctcacgaacgctgaagtggtttcgctcttacagtatcacgcagccgctaagtaccttcctgttggatctttgaaaacaacgaaggattccattaatactctcgcttccaatggcgccggaaagttcgatttgaccgtttccgtcgccggagattccctcacgttacacaccggtgttgattcgtcgaggattgcggacaccattctggattcctctccgctttcgatttattcagtcgacagcgttcttcttccgcaggaact

SEQ ID NO: 79857 - DNA, 465 bp, Glycine max
  Peptide Sequence Number=SeqID_196635
atgacggagatgttccgcggagccgaagccgaccttgccgcctttgaggtcggtgatgttgacggagccgacgttgccgttggcattacctgtggtttggtagagagtggtggaaagagtggtcccgttggtgatctggtggagctttgtgttgtcgaagtagtcgaggaggatatggaggctgaggaggttcttgacgacggagagggggtgtttcgcggcgacggcggagaaggcggcgttgttgaggacgaggacggtgatggtctggcgggtgttgatgtcgccggcgaggccggtttgggagaggaagtcgttgaagtcgctgtagtcggggttggcggcgagaatgtcggtgatgttgtgggcggaggcggtggcggcgaggagagtgaggacgaggaaggggagcaggtgagccatgatggagagagtagagagtgggaagtgggagtgaaaagttag

SEQ ID NO: 79858 - DNA, 1410 bp, Glycine max
  Peptide Sequence Number=SeqID_196636
atggatggttctgattccattgttgaggcaggaaaaaggattcgttcctttgaaaatggtgaagggcgaagaaatgcatatcgcacaattgttcaagcacgacctccccatttaaacaatatatatttggctactcagaggcctgaacaacttttaaagagaattcaacttatggaacgctgggctaggtgggagatcagcaattttgaatatctaatgcaactcaatacactggctgggcgtagttataatgatattacccaatatccggttttcccctggattctttctgattacagtgcagagagcttggatctttctaatccttcttcttatcgagacctttcgaagcctattggtgcactcaaccctgatcgtttgaatagatttcaagagagatatgctagctttgatgatccagtcatccccaaattccattatggatcacactactcaagtgccggaacagttttgtattatcttgttagggttgaaccgttcactacccttgcaatccaactgcaaggtggaaaatttgaccatgcagatcggatgttttctgatatttttgctacttggaatggagttcttgaggacatgagtgatgtaaaggaattggttcctgagctattttacctacctgaggtcctcacaaatgaaaattcaattgattttggcacaacacaaatgggaggaaagcttgatactgtaaagcttcctgcttgggctgaaaatccaattgattttattcacaagcaccggaaggctctagagagcgagtatgtatctgctcatttgcatgagtggattgacctcatatttgggtataagcaacgaggcaaggaagctgttacagcaaataatgttttcttttatactacctatgaagggacagtggatcttgataaaatctctgacccagtacaacagcgtgccatacaagatcagattgcttattttggacaaacaccatcccaacttctgactgttcctcacttgaagaaaatgccattagcagaagttctgcatttgcagacaatattccgtaacccaaaagaagtcaaaccatatgctgttccattcccagaacgctgcaatcttcctgcagctgccattcatgcatcttcagatacggttgtggttgttgacatgaatgcaccagcagctcatgttgcccaacacaagtggcaacccaatacacctgatggccagggtactcctttcctctttcaacatagaaaagctacattagcctctgctggtggtacaattatgcgcatgttcaaagcaccggctgcatctggtggggagtggcaattcccccaagcagtagcatttgctgtctctggaattagaagccaagctattgtttctataacaagcaacaaagaagttattactggtaaataa

SEQ ID NO: 79859 - DNA, 1062 bp, Glycine max
  Peptide Sequence Number=SeqID_196637
atgcttttttgtaccattaatgactttccagcatatgggaatttgagcgggtacaatgttaagagctatcgggcatgccccatttgtgaagaagacacaagatacatacaactgaaacatggtagaaaaacagtatacgctaggcatcaacattttcttaaacctcatcaccccttactgatgattagaaaaacattttatggaagtcaaaagcatgaaaatgcgccaatactgttagctagtgaccaagtttttcaacagaaaatcaagctcatttgggtagagagacccctggtctatgtgtatcttgtgattgggaaagtcgatggtccccacagaaagaagttaagaacatatttggggatcgtcgctttcaataaggtagatgtgacatatgagaattggaaacaagtccctgctacccagaaggatttgatatggaaggatattcaggttgaatttgatatcgctgaagcatgtgatttgaggacgaaaaagaaaatacttcaaaccgtgggggagcggtggagacaattcaagtttgatttaacgttgagatggacacttgcatccgacaaggacagtgtcgactgtttgcaaaaagatgttcgaatgaaggcacaggccattcaaaaacaaaacactacccctcacgtgttgtctcgtgagggttatgaattactagaaaagaagttaatatatgagaagaaaaagaaacaactagaggaagttgctaaatttggaagtactaacaccttgattgatcctccctcttccatcagacgacacgtgaagtggaagatggcccgcaccaagaaaacttaccaaatgacatgtgaggcaacaaaggaaattggtgacaagattaattccttggaggagcaggtctcacagggttcctttgtctcctatggatgtcaggatctccaaggacctgccacatttcttcttccacgactcccaagacctagagcaatgacgcaaaagatcaaggaccaattggaggagtcgatcacagaaaaagtgactcaacaactaatgttgtccttcagccagatgtag

SEQ ID NO: 79860 - DNA, 267 bp, Glycine max
  Peptide Sequence Number=SeqID_196638
atggataaacaggtaccaaagaaaccgatgaattctgctgataggctggaacttgatgatgatctcatataccaaatgactttgataacctcgcaacttttccttaagcctatgcaagtgtcatgggatgcaaatatgtttcgggtgtacaatgataatattcccttgtacataaagcatgaagatcttggggaaataacacacaatggtcaatgtttgaacattgctattatacaaattgcatattacggattaatgaagcattga

SEQ ID NO: 79861 - DNA, 318 bp, Glycine max
  Peptide Sequence Number=SeqID_196639
atggtgggagcaggtttgaaaaaggatcttagagtgtctagggttgtgccaggagggtctcttaatgccttcctttttcttctcatcggagttatttcacaaagacttgccatgggtttcctcatttgggatcctggggaagaggatcaagctggccattgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 79862 - DNA, 4528 bp, Glycine max
  Peptide Sequence Number=SeqID_196640
atgggatcaaccaatggtaacttccctgcaaaccttcccattcttgacggcaaaaactggagcaagtggagtgtccagatgaaggtgatattcgcatatcaagaagtccaagaagtggttgatgaaggttatcctgcacttgtagaaggtgcaacagaagcacaaagggctgtgcatcgggaaaacaagaagaaagataataaggctttgtttttcattcatcaatgcatagataatgcacactttgagaaaattgcttcagcaaagacctcacatgaagcctggaagattcttgagaagtgtaatgagggtgccgatcagttgaagaaagtgcaattacaaaccctgagacgccaatatgagctgatgcagatgaacgtgactgaaaaggtagcagagttttttaatcgtgtaatcgccttgacaaattcaatgaaagtttccggtgaaacggttacagatcaaatgattgttgaaaagattcttcgcactctgattcctaagtttgatcatgttgttgtggcgatagaggaatcaaagaatcttgcaactctaaaagtagaagaattgcagggttcattagaagcatatgaacaacgtatgctggaaaggcaaagtgacagatctcaggaccaggctcttcaagctcaaacttggaagagaggtggtctttctggtaaaaaaggcaatcgaggaagaggaagatccagagagtatagaagcaattatggaagttctggaaaacaatctcagaacaatgaggaaaatgatcaatctgaatcttcttcaagaagaggaggatcacaaaattggcaaggaggaaaattcagtaatgaagccaatcttgtgagtgaaaagcttgatcaagacgaagaaccaatcactcttatgatgatgacaaaagaaaggagtagcaattcaggaatttggtacattgattcaggatgtaccaatcacatgactggccacaaagaatggcttgtcaatcttgatcttagcaaaaagagcagagttcgatttgctgatgatagacacattacagcagaaggaattggtgatgtctatgtcaaaaaggaagatgggaaggatgttgtgattacagaggtgctctatgttcctgggttaaagagcaatcttatcaacatgggtcagttgcttgaaaaagggttttcactgtacatgataagtggtcatcttggagtatatgatactcatcaaagaaggattttgaaggttcccctcactagaaacagaacctttcaaatcaaggtgaatgctttagaatcacattgcttatcagctgaagtggacaaggatggctcttggttatggcatctcagatttggtcacctaaacttcaagagtttgagtcttctgaattcaaaaggaatggtgtcaggaatgactccaataaagcttccctcaaaggtgttgagaactgatggaggtggtgagttctgttcacatgaaatggagaatttttgcacagaaaatggaatattgcatgaaattgtagctccatatacaccacaacacaatgggatagctgaaaggaggaataggactatactaaatatggtgagaagcatgttgaaaggcaaaaacatgtctcatacattttggggagaagctgttatgacagcagcttatgtactgaatttgtgtcctacaaagaagcttggatcaaaagtaccagaagaaatctggactagaaagaagcctaatgttaagcatcttaaagtttttggctatttatgccacaaacacattcctgatcagaaaagaaagaagctggatgataagagtgagtcaatggttttcataggatatagctctactggtgcatacaagctgtataatcctagaaccaagaaagatcaaacagtggctgagatagatctggatctagatcagactgcacctgatttagataatggagaagaacttggagaggaactcaatttaccacttgcaccacctgtggaatcaaatgcacctcagaatgaaaggctaagaagacatgctgaagtgcctgcaagattacatgactatgaattgttccaggattctgaaattgggaatgttggtgagctaatccacatggcattacttgctgatgttagtccagttagttttgatgaagctatagttgatgaaacttggaggaaagctatgaaagaggagctggtattcaaagtgaaactgaatccaaatggttctatctcaagacacaaggccagacttgttgttagaggcttcaagcagaaagagggattggattactcagaagtgtttgctcctgtagcaagaatgaagacaataaggctattggtggctttggctagttggagaggatggaaactttggcagcttgatgttaagtctgcatttttgaatgggcctttggaagaagaggtttacattacacaacctcctgggtttgagcttaaagggagtgaggacaaggttcttaagctcaagaaagcgctttatggtttgaagcaggctcctagagcttggaacaaaagaattgatgcattcttaagcaaaactggtttcagaaaatgttctgttgagcatggcttgtatgtgaagaaaagtgattctggtggaatattgcttatatgcttatatgtggatgatttactcatcactggaagtagtagcactgaaatagcagaaattaaaagatgtttgagcattgagtttgaaatgactgatctaggcaagttgtcatacttcctagtggaagcaaatttgaagcttggaagttgtgagcaggagacaaaggttgacagcactatgtttaggcagctagttggatgtttgaggttcttatgccatagcaggcctgaaatatcttttggtgtaggacttgttagcaggtatatgaagtctcctaggcaatctcatttagttgcagccaagagaattctcagatacttgaagggaacacttaatcatggagttttatttccaactcacttgccaaatcaaaaagaggatggtaatctacatctagtagcatactctgactctgattggtgtggagatcaagtggataggtgcagtacaatgggttatgtgttcttccttggtgaagcaccattctcatggtcttccaagaagcaagatgttgtggctttatcaacctgcgaggctgagtatatagcagcctgcagtgctgcttgtgctattaagataatggtggacaacaagtctgctattaatcttgctaaaaatccagtttctcatggtagatcgaagcatatagaaactaagtatcatttcttaagagatcaagtcagtaaagagaagataaagctgcaacattgtggtactgatttgcaagttgctgatatattgactaaacctttgaagattgaaaggttcaagtcattaagagataagatgaatggaaacataaccacaccaagcctcacaaaggtggaatatggacggagtggatataattggcatatgagtgaagataattggcatatgctgaatggagatgattggcatatgatgagtgaagatcattggtatgacgaccttaatactactgttagaacagttttcactaaaaaggatcaatatccagactgggagaaactggatatcagaaacatgttcaacaatagtttgaagtccatatggcctaatcaagtgactccaaattcctttcctaacctgacgaaaattgtcattgattcctgtagaagccagtatgtctttcctatctatgtggctaaagtgcttcgccagctccaagttcttaaaataagcttttgtaccatagagaatattgtcgaagaaagtgatagtacttgtgatatgatggttgtttatcttgaagtacggaagtgtcatcatatgatgaccatagtcccatcctctgttcagtttcattctttagacgaattgcatgtgtacaagtgtcatggactagtaaatattataatgccatcaacaatcacaaacttaccaaatctccgcattttaaggataagtgaatgtgatgagctagaggaaatctatggtagcaataatgagagtgatgatgcaccactgggcgagattgcttttatgaaattggaggaattgacattaaaatacttaccgaggctcacaagcttttgccagggaagttacaacttcaagttttcatcattacaaaaggtacatttgaaagaatgtctcgtgatggagactttctgtcatggaaacataaccacaacaagccacattgaggtgcgatgcctatatggatggagtaatgaagaatcagaagatcattgggttggtgaccttaatactactattagaacaattttcactaaagagccacttagcaattcttccgtcacggtcaaatatgaagtcttggtgaattccatcgccacattaattttcatgaatgtgattgtgtccattattgtgttttactttggagagacaaagcttgcaaatgcaactccttatgtgctattatccaacttgtctgcggttgtgaagaaaattgtgg

SEQ ID NO: 79863 - DNA, 2463 bp, Glycine max
  Peptide Sequence Number=SeqID_196641
atggatggtcaaattgggtacatatcctcctacgaggaaaacattgaaaagcttataaccgaggttcaaactctgaaggatactcaagaaagtgtgcaacaccgggttgttgaggccgaaaggaacggagacaagattgaaaatattgttcagaactggctcaagaaagcaaatgaaattgttgctgctgcaaataaagttattgatgttgaaggaactagatggtgtctgggacaatattgtccctatctgtggacaagatgtcagctgagcaagagttttgaaaaaatgacaaaagagatttcagatgtcatagagaaaggaaaatttgatacaatttcttaccgtgatgcccctgatgtcacaattacaccattttctagaggttatgaagcactggagtccagaacatcaatgctgaatgagattaaggaaattcttaaggatcctaaaatgtacatgattggggtgcatgggatgggtggcgtgggtaaaaccactcttgtgaatgagttagcttggcaagtaaagaaagatggattatttgttgctgtagccatagccaatataaccaattctccaaatgtgaaaagaattcaaggccaaattgctgatgctttgttggatcggaaacttgaaaaagagacagaagaagtgggaattccttttggtgatgaacacaatggttgcaaattggtgataacttccagagaacgtgaagtgctgataaagatggacactcaaaaagattttaatcttacagctttactggaggaggaaagttggaagttgttccagaaaatagcaggtaatgttgttaatgaagttggtataaaaccaattgcagaagaagtggcaaaatgttgtgctggtttgcctcttttgatcacagccttgggaaagggtttgagaaaaaaggaagtccatgcttggagggttgccctgaaacaactaaaggaatttaagcataaagagtttgagaataatgtctaccctgctttgaagttaagttatgattttttagacacagaggaattgaagttactattcttattcattggttcttttggactaaatgagatccacactgaagatttgttaatatgttgttgggggttgggcttttatggtggcgtgcacacattgatggaggcaagagacacacattacacattcataaatgagcttagggcctcttcattattgcttgaaggtaaacctgaatgggttggaatgcatgatgttgtgcgtgacgtggctaaatcaattgcatctaagtctcttccgaccgacccgacctatcccacctatgcagatcagtttcgcaagtgccattatattagatttcagtcttctttgactcaagtccaagctgataactttttctctgggatgatgaaagaagtgatgactttgatcttatatgaaatgtccttcacccctttcctacccccttctctcaatctcttgataaacgttcgctcattgaatctaagaagatgtaaattaggtgacataaggatggtggcaaaactctcaaatttagaaattctttccttggcggggtctagtattgcagagctcccaggagaaataaaacatctgactcaattgtacatgggaggttgctataacattgaatgggaggttgaaggaagaaaaagtgaaagcaacaacgctaaagtacgtgaattacagaatttgcataatttgacaactttggagatatcattcaaagatacttcggttttgccaagggacttccagttccctgcgaagctcgaaagatacaaaatatggattggtaatatttcgaaatggtattggtctcaaaattggtatggtgaagctcttggaccctcaagaatgctcaaactcacagactatcggtggacgagcagattgttgttcaccacagttgaggacttgagctttgctaaattaaagggtgttaaggatttgttgtatgatttggatgtggaaggttttcctcaattaaagcatctgtatatccaagataatgatgaattgttgcacctcattaacccaagaaggttgatgaatccccattctgcattcctcaatttggagactttggttcttaacaatctatgtaagattgaagaaatatgtcatggtccaatgcagacacaatcttttgcaaagctaaaagttattaaagttacatgttgtcattggttgaagaatctatttttgtattccatcacgggaaacctttctcaacttcatgagatgaaaatttctggttgtaaaggtatgacaaagatcatagatgtggaaaaacaagaggatcagaaagaacttctccagattgttctccctgaattgcattctgtcactttactaggtttacttgagcttcagagtttctattgttctgtagcagtcgatcagggtaatccatccagtcagagcattcctttggcactgtttaatcaacag

SEQ ID NO: 79864 - DNA, 501 bp, Glycine max
  Peptide Sequence Number=SeqID_196642
atggcggtcttcggggatcacaacgggtattgttcactcgtgaaaaaagcaaaaagatacatcaaggatgcctggagactgacctccacccttatccctaacagtggtttgagttggctgtgcatgtggatggcgtggtggtcttcactgatgggcgacagtggcccggcaaaagacacaatcctggaatggcctgaaactgactgggctttgtgtgcctcagttcagggaggagggcgtgtgagagagcgtcagagctctgatgagatggaaaggtcatcaaagctttggcagcggttgccaacaaaggagaaaatcgctggaaagggggacagtgagcaaaaaaaggagagaagtccactggaatgtggaaataggacgccagaagggaagccagtgttagagatggaggaagcacaaatttgggctaagaaggtggagctgccagtgttcatggggacagacccaattggttggattgctagggctgaaaaattctga

SEQ ID NO: 79865 - DNA, 531 bp, Glycine max
  Peptide Sequence Number=SeqID_196643
atgacacatcagtcgcgtcactcaccatgtcatatgtggaccccgaacagtacaccagccccccaagctctaagtcgaatctgttggcgaaaaagattgttcagtgtcgagggtagtaaccttgatgaatttaataactggaggcttgacaagcctgctagcttggacaagcattgtccaggctatgttttcccctttcctttttcgatttcaacttcactccaggtatgcccctgtttccctactatgtctattgtttctgattctgcgttgggcatgggagaaagtgactctaggggtttcgtttggcaacccatggtagagtgggaagtggttcccatcgaggattcttcatcagaggaggttccttgcgaggtctctgataatgggtcctcctcttataagaggttgatagacttcgacaatgtgggtgagggcaattccgagctgcccacggggattgaatctctcatgactcctaggaaggatcaaccttcccctattacgacggtcgtgcccccacccccttag

SEQ ID NO: 79866 - DNA, 688 bp, Glycine max
  Peptide Sequence Number=SeqID_196644
atggctttttctgccactgaaaggtataggaatagggatgctccaggcttaggtcaacttagaacaggtggtgttgcaatagttttctttaaagctaggaaagcttgcttacaggcttcgtttcacaagaacgactcgctccatcattttgagtccaaaaggcatgaccctataacagaagttggcgtcttcagtgatgaagtccgtgcacatgcaccatttttcattggctttcctcaccatgacaatgttggccaaccaagtcgagtatctgacttatctgataaattgggctttgagcagcttgtcgatctcttccctgattgctttacctacatgtctatgcttgtggttagtgaggtcgttgttgagatgcgtgcattgcctaggcttaggtccttatttggaatcttcgacaatgctcatgaattgattgttgctgccaccagaggaggaatgggatttgcttggctctctaataaatggataaggggccaccttcaggatctttgcatagcattgtcgggcttgcttttggtctgccttgacaatgacaatttctcttgtcaaggtaggcaacttcattttgaggactttggccaccatgaagttgtcaatgacgatagagacaagcatagggtcgtcctggttgatggggttgatgccttcaatatctttgtcaatgaag

SEQ ID NO: 79867 - DNA, 219 bp, Glycine max
  Peptide Sequence Number=SeqID_196645
atggagcgctctgctaaggagagggaagcactcgatgccacgcatgagaaagggttcttcaaggctatgaggcaggcggaactctttattgagggtctcgatctgaacctcttagacccattcaaagacgagaaggacgggcaactttttgatgaggatgagattgccgctatggaggaatctgatggaggagagaaggatgatggggccgatgtttag

SEQ ID NO: 79868 - DNA, 402 bp, Glycine max
  Peptide Sequence Number=SeqID_196646
atgggaatcgatgttggactttgtgggttgggagtcctgggaagaagggaagagggatggcttgaaccaaacatcaaccctgtcgcttgctttagggctcgaagactaaagggagccatcaacttcttgtgtagtctggttcctccaacttcttcattgtgtttcctcttagcagccacagaaggaggcacactaggtgtaaccttgacaacatcaacctcgatagtgtcaacaatgttgagctggtcgaccctagcttcaattggatctcctccccctccagagggcaaggacaagatggctcgcacatcaagcaatgccggcaattgttccaatattgttgtgtctaccctctctgatggaagcttgcttgtggagcttttatggaggctggatctttga

SEQ ID NO: 79869 - DNA, 435 bp, Glycine max
  Peptide Sequence Number=SeqID_196647
atggagtctccttggttgttgtttggggcaaacagtggctttaaggatgaccttgttcggtgcttcagtttggtcatttgtcagaggatgcttgacaaaggtttcagccttgaattgagtgttgctgtcggtgacaatggcataggggagtccatagccgcatatgagtctacggtgaccatcaagaacttgacttgtcttggagcctttggcaatggccctagtatgtccatccctcacatggcaaaaggccaaggagagctcaagttgtggaggttgtcaagcggtacatggggtacatatgcaaactttggacaatttctgaacttccttgtgaagttgaggcaccttcttgatggggtgatccttcttgacgatgatctaggggctctggaagtagggcttgaggcgttgagcagaggttatgagtgctag

SEQ ID NO: 79870 - DNA, 297 bp, Glycine max
  Peptide Sequence Number=SeqID_196648
atggccacctctcaaatgaagttgactgggaagattggctgggtgtcgttgaatagtatttacaagaggatattcgagtttgactcgaacgcattccgtagtttcaaggactgcttctttaaggtcaaagaaactagtgtcgttttttatgggttgccattaatgtatgaggagagtggggagcctcgtttccccttcctttggcagtcggaccctataaagttcaagtctttcgaagaacaactaatgtcttcaaaggagagtgatgcaatcctaccccccaagggtattggatag

SEQ ID NO: 79871 - DNA, 732 bp, Glycine max
  Peptide Sequence Number=SeqID_196649
atgcaggaagaagaggaaagaccactcataagaaagagaaagttaccttcgacttcgaccaagtccgctgaacaaacagagacaggcaattctcaggctcaaatgcctaagaagaaaaagaaagtgaagcaggtcgagcctgaaccttctgtggctgttgagggtggtgagccaatcaagaagaaaaagaaaaaaatcaagccctcaaaagaacaaggtgacaatcagactgttgatgtccaaccaccttcgaccgatattgacggcactgaagtagaggctactccttctgttgctgagatggacaaccctgtcgatcaaccggactcatcaccagcacaacctgccgtcgaggtacaacaaaatgtttctgtagaagaaataccctcacgcgctcgaacatctcccgctcctgagacggatgcagtgcatgttgaggaacagggtgaaggtcaaggtattgggtccatcagtccttatggatcgagtcagaaaagttcatctgaagaaaacttttccgatgaagaggccatacaagaggctgaagctggaggttcggacatttacccggcgtcttcaacatctaagctttccgctagcatagggatcgcagaagacacattcattaaaatgcaagacgaagacccagctgcagcccttcgactcctgctgaacaccagtcaagccaacacttcgagtgaaaagattcctggtgcttcgtccctcatctga

SEQ ID NO: 79872 - DNA, 198 bp, Glycine max
  Peptide Sequence Number=SeqID_196650
atggcaacccaagttacatgcacatcgaaatgcgaactcatgagattgaatcaacatgaggagaatgatacgaaaaagaaaggaattgctcttaaagcttcatcttcaacccacgaagccagtgataaggaggattcgattgaaatagacgaagatgatgatcttagtctatttgtaaaagattcaacaaatttctag

SEQ ID NO: 79873 - DNA, 552 bp, Glycine max
  Peptide Sequence Number=SeqID_196651
atgagcacttccagattccactcaattgctaatgttgtggaggtgccattctcttttaataggcaatggatgtaccattacccaaagtatgttttattcgactgtgatggcaccaaacattttattagggtgcagagatatggtagcaaatgtttttttgctgatgggctcaaggatttcagaagagtccacaatgttaatgagagtgtcatggttcgttttattgcttctgacaaaaatactactttgcgcgttgctgtcatgggacctatacacagacagattcttctagcagcagcttccagattcgtatatggcttcaaaaaatatattacgcttcagcaggggctaggaaaatgcacccaatggcatgtcatgatccacgatgatgtgccatcgattgctaacccatggttccggtaccttggtgaaaaaaaattgatggttggagatgaagttgtcttctacttccgctttgagaagcatgcatgggagcttttgataaggaaagaaattgaatgggaggaggaggacctccagctcgaagactga

SEQ ID NO: 79874 - DNA, 1023 bp, Glycine max
  Peptide Sequence Number=SeqID_196652
atgtctaatggcattttgttcaactgctgcaatgccgtcatgggatggtgctgccatggcacagtggctgctaatggagagcactgtgacatggtgatgttggttgtgggatctattcatggtatcagtctcttcattgatgatagtatggttgtgtacatctatttcagtttaaaccccacacttgttgctagggtgttgcatcttttctacaggttggttgtccagccaaatacatctagagctcatacatttgcggaagaattcctagcatgtggtggcatagaaactcttcttgttctgctccagagggaagctaaagctggagatagtggtgttctggaatcattgtcaatgaatcctgaatctcaaaaaactgagattgctggtggtaatgaaatgataaaagaaagtcagaaggatgaagggttaaaggagaaaagcgaagccatcatacaagacaatgaccaaggttctatatctgttgatagtggtagtagccctgatcctagttctgatgttaacagtgacaggatatttgaaataacttctgccaagaatttgggaggcataagtctatccattagtgcagacagtgctagaaaaaatgtttacaatgctgataaaagtgatggcattgttgttgggatcataggtctcttaggtgctttagtagcttcgggacatctgacatttggttcccgtgctggtcctgatacaacaagcaaccttttgggtgttggactccatgacaaaggtggtactatgtttgaagacaaggtttctcttctactttatgctttacagaaggcatttcaagcagcacccaacaggctaatgactaacaatgtttacacagctttgttggctgcctcgatcaatgcctcttcttcagaggatgggctaaacttctatgattctggtcatcgctttgagcattcacaacttttattggtgcttttgcattcccttccctttgcacctaggtcactacagagcagagcgctacaggtattagcctaa

SEQ ID NO: 79875 - DNA, 129 bp, Glycine max
  Peptide Sequence Number=SeqID_196653
atggtttctgcaagctccttctcttttctgcaacctctccatgcatcacgttaccatcgaacaacgtcccacaccaccaaactacagatcgtgacgccagaacaccaccacgacatgaacacgggctaa

SEQ ID NO: 79876 - DNA, 243 bp, Glycine max
  Peptide Sequence Number=SeqID_196654
atgtcacaagatgccaataaagaactcagcctcttggactgccatgctcactacttgtgcgcaaaacggccaaataaaagatgctcgcaaagcaaagcttatgagctgttttcagtgttggttgaacgcaacttggtatcatatgctgccatgatcacaggttttcttaaggcaggaaagttccacatggctgaggaactatactgtgatgcccctcacgagtttcgggaccttgcttgctag

SEQ ID NO: 79877 - DNA, 954 bp, Glycine max
  Peptide Sequence Number=SeqID_196655
atggattcgtctggtcctgcaagggaaaagggcaaggcaaaagctgtggcaagaagaactagggcaagagctaaggctaaagctaaggctaaagctaaggcaaaagataatacaaaagctaatacaaaagctaaggcagaagctaatacagaagctaaggcaaaaactaatacagaagctaaggaaaaaactaatacagaagctaaggcagagtgtgctcctcctccagagaagcctcgggttctgcttgcttgttgtggaagtatttgtgcagcaaaatttgagcgtgtttgtagacattttttagaatgggcagaagtgaaggtagttctcacaagatcagctttgccttatattggagatcaaacatttcccgatgatctacttgcatgtattgatgagcacgagtggcttacttggaaacagataggtgatcctgtggtccacattgagcttcgtgaatgggctgatatcatgatcattgctccattgtcattaaacactcttggcaagatagcgggagggttgtgtgacaatcttctgacatgcattgtgagagcatgggactacgagaagccattttttgttgcaccatccatggagtcttctgagtggatagactcattaactgaagatcatgcgatggccattgatgagcttggcatccatctcatcccacctgttcctcagagggcatctgagtatcacgcaatggcacaacctttcaccatttactcaagtgtgagagcttcttatgagttaaagatgaaaggaaagccatctcacaccaaatgcctagacctggacgaaaaagggaggtgggcagagaaaagaaaagatgaactgaggagaagaatggaggaaaaactcagaagaagtgaagaggaagaagaaaacttccctttttatagttttctggaatcttttggtgatcgaaaggacgcaccgctttag

SEQ ID NO: 79878 - DNA, 621 bp, Glycine max
  Peptide Sequence Number=SeqID_196656
atggattgctcagaggcggggtgtgctattccaacgaagcctcggattctacttgctgcttgtggaacttatgatgcttgtaaatttaaggttgttcattggaaattcgccgaatgggcagctgaaataaaggtggttatcacaaaatcagctttgcgttatcatggaactcccaggaatgaacttgcatctgttgatgagaatgattggcttacttacagaaggccaggtgttgctatgcttcacgttgagcttcgtaattgggctgatatcatggtcatcgctccattgtcaacaaatactcttggcaagattgctttagggttgtgtgataatcttctgacaagcattgtgcgagcatgggactacaggaagccactttttgttgcaccatccatgagcacttgtatatgggaagactttttcacagaacgacatttaaatgcaattgatgagcttggcatcattctcatccgacctgtatctattacaacagctagtggggaacgtgagcatgcaatggctgagccttctaccatttgctcagatgtgaaagcctcttattataagcaaatgcaaaagatgatgcagaaagaggctagtactactagtactagctag

SEQ ID NO: 79879 - DNA, 429 bp, Glycine max
  Peptide Sequence Number=SeqID_196657
atgggatacctgcgaaaacactttgatgctcaaattagaatcatagaatgtttgtggagcggaggactcactcctacaaccaacaattttcaggttcaggagatgtcaaggaagttgcaccctctgcgagcttggcatagtaggaaaacaaaaataatgtggttgtgtcgggatatacgcgcgcacgccaatttatacgtgtcacactctggtccatatgacatggaagtgtctcatgatgctcaagaattcatagtgaccctagtgaggtttgatgcgagaggtaatgtcctaagttggagattcgagttagtacgtcccgtgcatgtcactaaagaccaaggagatcacaccgacatgacacccgaggagggggaagagtattacgagctgccacaagacttagagccttcatttgaggaggattga

SEQ ID NO: 79880 - DNA, 294 bp, Glycine max
  Peptide Sequence Number=SeqID_196658
atgggagaatggttcctagctatggtattcgagtgtttgaggcttggtggatatcaacagaatacccacccgggtaggcaaattaagacattggtaacaccatggcgtttgagaggctctatgactaagtcagtgttttcttttgagtcacaggtttggcagaaggtgcctgtaattggaatacgaggaaaaagagaaattaagaaacgatggagaggctgtgcaaacaatgtacgtcataacttagcaatggagcatgcatgcaatacagcagaaggcaaaaatcttaaatag

SEQ ID NO: 79881 - DNA, 294 bp, Glycine max
  Peptide Sequence Number=SeqID_196659
atgcagagggagaaacgaaactgttgcaagagaaagagaagagtgaaaaacttagcaagaatgaaggatcgagagagaacctatcaaaatcctaacacaatcaccttctttttcttcttcctttccgatgcagtcaccagaaaccaccgatgcagtcaccagaaaccaccgccggcagctgaacaagtgtggaggtttccgacagaagctgttgcaagagagagaacgaaggattttgaaagaagttgttgcaagagaatgaaagagccagagaatgaaggagccacagaatga

SEQ ID NO: 79882 - DNA, 1551 bp, Glycine max
  Peptide Sequence Number=SeqID_196660
caattagtagagaaaaggaaggaaaagcgtgctgctgagttggtaaaacaggatgatgaagtaattgtaaaacttgaagattcagctattgaacactcaaaatctgttgattcggcagttctaggtaaatacaacatttggaggaaagaaaatgagaatgaaaatgctgattctacagtacggttgatgcgagaccaaatcattatggctaaggtttacttgagtatagcaaagatgaagaacaagcttcaactgtaccaagaactggaatctcagcttaaagaaagtcaacgtgctttaggtgaggcaacttctgatgctgacatgcgtcacagtgatcatgaaaaaatcaaaactatgggccaagttctttccaaggcaaaagagcaattgtatgactgcaagttggttactgggaaattgagggcaatgctacaaacagctgatgagcaggttaggggattgaggaaacaaagcacattccttagtcagttggctgccaagaccataccggatggaattcactgcttatctatgcgccttaccatagattactacctccttcctcttgaaaagagaaaattccccagaagtgagaatttggagaatcctagtctctatcattatgccctgttctcggacaatgtcttggctgcatctgttgttgtcaactcaactattgtgaatgcaaaggatccttcgaagcatgtgtttcaccttgttactgataaactaaattttggagccatgaacatgtggtttttgttgaatcctcctggaaaagctacaatcaatgttgaaaatgttgatgaatttaagtggttgaactcatcctactgcccagtcttgaggcagcttgaatctgcaacaatgaaagagtattatttcaaggcaggccatccaactactactggtgcttcaaatctcaagtacagaaatccaaaatatctgtcaatgctcaaccacctgagattctatcttccacaagtttatccaaagttggataagattctttttcttgatgatgacattgttgtccagaaggatttgactggattatgggctgtgaatcttaatggaaaagtaaatggtgctgttttaacatgcggagagagttttcaccgatttgacaagtaccttaacttttcaaatccgcatattgcaaaaaattttgatccaaatgcttgtggttgggcatacgggatgaacatgtttgatttgaaggtgtggaaaaagaaggacatcactggcatatatcacaagtggcagaatttgaatgaagacagggtgctgtggaagctggggacattgcctccagggctgatgacattctatggattaacacatccacttaataaatcatggcacgtactcggtctgggttacaatccaagtgtagatcgctcggagattgataatgcagcagtcgtacactacaatggtaatatgaagccgtggttagagatagccatgacaaagtatcggtcttactggaccaaatatgtcaaatttaatcatccctatcttcagaattgtaagctacgtgaatga

SEQ ID NO: 79883 - DNA, 249 bp, Glycine max
  Peptide Sequence Number=SeqID_196661
atgacgctaccaaatctgacacatctgaaggggcatttttggctggtgccacagctgtccaacatggcaaaaatcatcaagatagtgccacgggacaatgattctgatattggagtgtttgagcgcttgatggatatctatggagcaaccgcccgagtaggcaaagacattggtaatcccaccaccatggcgttggagagcttgaatgagcatgtcagcaccattttcgggcttgctggtgtgaactga

SEQ ID NO: 79884 - DNA, 1737 bp, Glycine max
  Peptide Sequence Number=SeqID_196662
atgccaggtctcgtatcggacgcccaacccctcggaatctccgtcccggacacacccaggcaatcccagagaaccccttctccactccccaaaaaaccacccagcccatctccttctcgctcctccaaaaagaaaactcctgaaacccctccgcttctctctgatgcctctctcgacaacccggatctcggcccattcctccttaagttggcccgcgacaccattgcctcgggcgatgggccctccaaggccctcgacttcgccatccgggcctccaagtccttcgagcgctgcgccgtcgagggcgagcccagcctcgacctcgccatgagcctccacgtcctcgccgccatctactgcagcctcggacgcttcgacgaagccgtccccgtcctcgaacgcgctatccaagtccccgacgtcgaacgcggcgccgatcacgccctcgccgccttctccggctacatgcagctcggcgacaccttctccatgctcggccaggtcgacagatccatctcctgctacgaccaaggcctccagatccagatccaagccctcggcgactccgatccccgcgtcggtgaaacttgccgatacttagcggaggcaaatgtgcaagcaatgcagtttgataaagcagaggatctgtgtaagaagacgttggagattcatcgcgcacatagtgaaccagcttcgcttgaggaagctgcagataggaggctgatggcactgatttgtgaggcaaagggagattatgaatcggcgttggagcatcttgtgcttgctagcatggccatgattgcaaatggtcaagataatgaggttgcatcaattgatgttagcattgggaacatttacatgtcgctttgtcgttttgacgaggcgattttctcataccagaaggcgcttacggtgtttaagtctgccaagggtgagaaccacccttctgttgcctctgtttttgtgaggcttgctgatttgtaccacaggactggtaagcttcgcgagtcaaagtcttactgtgagaatgctcttaggatttactcaaagcctgttccggggaccaccgcagaggagattgccggtggcttgacagagatttcagcagtttttgaatctgtcgatgagccggaggaggcgctgaagctgttgaacagggcaatgaagttgttggaggataagccagggcagcagagcactattgcggggattgaggcacgaatgggagtgatgtattacatgattgggaggtatgaggactcaaggaactcgtttgagagtgctgtggcgaaactcagggctagtggggagagaaagagtgccttctttggagttgttttgaaccagatggggttggcatgtgttcaactgttcaagattgatgaggctgctgagttgtttgaagaagctaggggaattcttgaacaggagtgtggcccatgtcatcaggatactcttggggtgtacagcaaccttgcagctacatatgatgctatgggaagagtgggagatgcgattgaaatcttagaatatgttctcaagctgagggaggaaaagcttgggatagcaaatcctgattttgaagatgagaagcgtcgtctggcagagcttctgaaagaagcaggcaagacacgggacagaaaagcaaaatctctggaaaaccttattgatcctggctcaaagcggacgaagaaggagggggcaaagaggtggcctggtttggggtttagaatttaa

SEQ ID NO: 79885 - DNA, 2613 bp, Glycine max
  Peptide Sequence Number=SeqID_196663
atggccatggaggttactcaaatccttttaaatgcccaagcagtggatggaacattaaggaaacaagccgaggaaagcctgaaacaatttcaggaacagaatcttccaagtttcttattttctcttgctggggaactggcaaatgacgagaagcctgcagagagtcggaagctagcaggtttaattctcaagaatgctctggatgctaaagagcagcacagaaaaatagaatttgtccaaagatggctgtcattggacccaaccttgaaagctcagattaaggcattcttgttgaggacactttcttccccttctcttgatgcccgatcaactgcatcacaggttattgctaaagttgctggcattgagttgcctcataaacagtggcctgaattgataggatccctgttgtctaatgctcatcagcttcctgcccctacaagacaggcaacacttgagacccttggatacatctgcgaagaagtttccccagatgtagtagaccaggatcatgtaaataagatactcactgctgttgttcaagggatgaattcaacagaagaaaacaacgatgtcaggcttgctgccataaaagcattgtacaatgcattgggttttgcccaggcaaatttttcgaatgacatggagcgggattatatcatgagaattgtgtgtgagacaacacaatctcctgaactgaagattcgacgagcagcatttgagtgcttggtagctatttcttcgacatactatgaaaagttagctccttatatccaagatatcttcaacatcactgccaaggctgtgagggaagatgaggagccagttgcacttcaggcaattgagttttggagttcaatatgtgacgaagaaattgatatactagaagaatatggaggtgatttcagtggggattcagaggttccctgcttttattttattaaacaggcactttcatttcttgtccccatgttattggagacactgctgaagcaagaagaagatcaagaccaggatgaaggagcatggaacattgctatggctggaggtacctgcttgggattagttgcacggacagttggtgatgacattgtacctttggttatgccgtttattgaagagaatataaccaaaccagattggaggcaaagggaagctgcaacttatgcctttggctctattttagaaggtccatctcctgataaacttgtgccattggtgaatatggctttgaatttcatgctcactgcattgatgaaagatccgaataatcatgtgaaggacacaactgcatggactcttgggcgaatgttcgaatttttgcatggatcagctctggatactcccattatcactccagcaaactgccaacagattattactgtgctgcttcagagcatgaaagatgttccaaatgttgctgagaaggcttgtggtgctctttattttcttgcccaaggctatgaggatgctggatctgcatcctctccgttgacccccttcttccaagaaattgttcatgctctcctcactgtaactcacagagaggatgctggagaatcccgccttagaacagcagcctatgaagcgttaaatgaagtagtgaggtgttctaatgatgaaacagctcctatggtggtacaacttgttcctctcatcatgatggaactccatcagactcttgagaatcagaaggtttcatccgacgagaggcagaatgagttacaaggccttctatgtggttgcttgcaggttatcatacagaagttaggatcatctgaaccaacaaaatatcatttcatgcagtatgctgaccaaattatgggtttgtttttgagagtgtttgcttctcgaagtgcaacagctcatgaggaggctatgcttgccattggggctttggcctatgcaaccggtgctgattttgcgaaatacatgacagaattttacaagtatttggagatgggtctccaaaatttcgaggactaccaggtttgtgctatcacagtgggtgtggttggtgatgtatgcagagccttggaggagaaaatactgccttattgtgatgggataatgacccaacttcttaaggatttgtctagcaatcagttgcataggtccgttaagcctcctattttttcatgttttggagacattgccttggcaattggagaaaactttgagaaatacctgttatatgcaatgcctatgcttcagagtgccgcagagctctctgctcatacatctggtgctgatgacgatatgacagaatacactaattctttgagaaatggaattctagaggcatactcagggatcttccaagggtttaaaggttccccaaagacccagcttctgatgccatatgctcctcatgtgctgcaattcttggatagtttgtataatgagaaggacatggatgatgttgtgactaagacagcaattggcgtgcttggagatttagctgatactttgggtagtaacgctggcccgttgattcagcaatctgtgtccagcaaagacttccttaaagagtgtttatcatctgatgatcatttgattaaggaatctgcggaatgggccaagttggcaatcagtcgagcaatttctttttga

SEQ ID NO: 79886 - DNA, 1662 bp, Glycine max
  Peptide Sequence Number=SeqID_196664
atggccatcctgtcccaatccaccgccagcttctccttcgtctccactcggaccgattccactcacctaactcgcttcccctgccgcgtcaccttccgagcccgctctccccctctccgccccgccctcgtctcttcgcgcctcaactcctccaggtcccccgacgccggcggctccctctcgccggacaacggcggcggcgacgtcgcctaccagctccaccacgacttctctccgcagcgccgtcgccgcggctcgccggtcttcgtcacgctgccggtgaattccatcggtcgggatggccgtgtcgcgaggcccaaggcgatgatgttctcgcttaaggcgcttgccacggccggcgtggaaggcgtggttattgaaatttggtggggattggttgagaagaagaaacctagggtttacgattggagagggtatgaggaactcgtcgcgatggcgtgcaagtgtggccttaaggttcgggcggttctcgcctttcatcagcatggcacgggacctgatgatcccaattggatgccacttcctctatgggtgcttgatgagatacagaaagatacagagttagcgtattgtgacaggtttggacaaagaaatattgaatacatttcccttggatgtgatattctgcctgtgttatgtgggcgttctcctattcaagcatatgcagattttatgaggaattttagggacacttttgagtctttgcttggcgttgtcatcacaggtgtacagattggcatgggtcctggtggtgaactaagatatccttcattctcttcacaggagccaaatttggcttggtctcatgaacttggagagtttcagtgctatgataagtatatgcttgcttctctgaatgcctctgcaagaaatattggaaagcgtgaatggggaaatggtggtccatttggtagtgaaagtttgatgcaaaatcctgagcatactgattttttcagaaatgacggtggctcttgggacacaccatatggtaaattttttcttgaatggtactcagatatgctgctgctgcatggggagaggatttgtagggaagctgaaactatatttaggggtacagaagtccatatatcagcaaaattggctgccattcactggcattatgccatgcaatcccacccatcagagttaacagctggctattataatacttctaacagggacggatacttacccattgctcgtatgtttagcaagtatggattctcaatgtgctgctcttgttttgaaatgcaagatgctgtaacgcagaagatcaatccagatggtagtcctgaaggttttcttagacagcttttgctggttgctaggctctgtgatatatcactcgaaggtcaaaatttttcaactaatttggatgatggtgcattcacccaggtgcttaagatgtcaaaattttactcagatgggattgagaagcgacctttctcattcaactttgtaagaatggacaaaagattgtttgaatcccgaaattgggatcggtttactcgttttgtgagacaattgtctaatggaaacatttttcgagccagattaaattctgttcgtgaagtacggttgaagaccacaccagtggtagcagcagtgggactgttgtaccacctatatcagcactcttga

SEQ ID NO: 79887 - DNA, 735 bp, Glycine max
  Peptide Sequence Number=SeqID_196665
atggcaccgaacaacaacagaaccaagggatcccatttccctcttctcgctttcctctttctctgcctcctcgcgccccttctcttcttcttcttcgcatcgccccttcacggtctcattctctcattctcaaatctcacttgttttcaattattagttttgtttctagtgttggcacatccacgtagagtgtcaaacaataaatcagatttacaggaattctatattacatgcttggattctccatttttgtttcttagggactttctaattgtcggaaatgagatcgaagtgataattcagctgtttcgattgaaaaggatcttgtttggatacaattcttcattagcacttatagaaggagacaataaaaaggttcttgatgttattgtgtccaatacaaatgatgtggggcctttgagtcttgagagtttcagaaaaaataatctgtctgcttcatggagagttgctggattaaggacttcaaatgctatgaatcagctaaaccaaccagcagacaattttagacaagagaagcaaaatgggaaggaaggaagattttcaggtggtatcgtattgtcggttggtcgtgctcagtggactgacagtcctgttcagctatcaagaaggtttgccacaccttgtatcatggggggcacagagtttgtggctgttatggaaacaacctcactagtcactgctgatatatataatccttcccaaaccccaacctga

SEQ ID NO: 79888 - DNA, 177 bp, Glycine max
  Peptide Sequence Number=SeqID_196666
atgtcaaaactaaatgaaaagtatgaagctgttcaaaagacacaaaggcgtttgcatggggaagatcttggaccactgagcataaaagagttgcaaattcttgaggagcaacttgaaaaagctttatcacaagctaggcagaggaagctaattgatacgaacatggatattggatga

SEQ ID NO: 79889 - DNA, 375 bp, Glycine max
  Peptide Sequence Number=SeqID_196667
atgaaatcttcaactgtctcatataagcaaacattgcaaaaccaagggggagtagttgtcatcatcaaaaagggggagaatgtaaatcatgaagattttgatgatgtcaaaaagatcaagccttggataatggttgtcatcatcaaaaagggggagaatggggagaatgtgaatgtatgtatacatgattttgatgatgccaaagaagaatcaaacaaagttgcttcaaaggataagtgtggcttcaagattaatacaagattgcttcaacaaacaaagccttgcttcaagattaactcaagatcaagccttgtcttaaaacaaagtgctttcaagacattcaaggctctggtaattgattaccaggcagtgtaa

SEQ ID NO: 79890 - DNA, 240 bp, Glycine max
  Peptide Sequence Number=SeqID_196668
atgagtacacaaacatcgactgcgtccaatgtttttcatcattcatcttcatggttctcatgctgtcagggcccacctaatttcttgggatgcacaatcatataccaatttcaggcgacattccatgttgataggaatttcattgaggtaccttcattatatcataggcaatgggctcctgattacccacctcatgtgctgttggattacaatgggctccttatttgttgtgtgtgttga

SEQ ID NO: 79891 - DNA, 801 bp, Glycine max
  Peptide Sequence Number=SeqID_196669
atggcaatccatgacgaattaggagaagcaagcagggacatttttatgaaagtgataaatatgattttccataacccagaggcgaagataatggtaagagccatggatggcaagattaaggtaatgaccattaatgtcatgagttacctcattggtttggccgatcagacctcggagcataatggagctggaacatcttcactttctgtgcagattgatcgaataatgaagcgtttggagagaaaattggtggcagagagcaaacatttgggagaaagacggtactttttcatgatgaatagttggaggttggtagagctatgtgccgaaaagtcggggttagacgttgattgtttcaaaaaatacacagcaaaaattcaacaaaacctcaaactttatcaaagaagctcttggaatgtggtgctagacttgttgaagctagagaacgatgatcggtttgtggagcctaatgctaacgcagagtctatgaaagacaagctcaaattgttcaacaaccactttaaggatctatgtagcattcaatctagatgggctgcctttgatatgcagctgagggaacaaataataatgtcgctagaaaacattttgttgccagcatatggaaacttcattgggaggttccaaaatattcttggtaaacattcttatgagtatattaaatacggaatgtttgatattcaagaccaaatcaaccatttgtttctcgaaaccaagccaatgagtcagagacttctaaagtttgtatctcaggtttgtagttctaaaaacacttatgtataa

SEQ ID NO: 79892 - DNA, 309 bp, Glycine max
  Peptide Sequence Number=SeqID_196670
atggcagcggaatggagaaggaagagagagaggagatgccacttcaaggagaagatgagtctagaagaagctcaccaccataggaggccatggataagagcttggaggaagatggagatgaatgaagggagagggagagaagagcacgaaattttgtgctttaaaggagctctgaaatctgaagattgcatcaagactataccagtttttcctttggacacttctcctccaattactccagtatggcatataacagatgagaagaatgttcagatacaggacaatcaggatcagtcacaggaattttaa

SEQ ID NO: 79893 - DNA, 252 bp, Glycine max
  Peptide Sequence Number=SeqID_196671
atgtatagtgaaaactttgttaggagaggttcatctaaacatcggggaagagagagtcataaagggcctctggttgtttgctttggggagatgatgatcaatttggtccctacagtagcaagagtgtcccttgcagatgcaactgcctataagaaattcccttctggagccactgccaatgttgctgttggaatttgtagactaggaggctcagcagctttcattggcaaggtgaaattctcgagaatataa

SEQ ID NO: 79894 - DNA, 1374 bp, Glycine max
  Peptide Sequence Number=SeqID_196672
ataaagtaccacactcctgaggaggaaatagcatttggacctggttgctggttatgggactacttaagaagaagtggagcatctggttttctgcttcctctttctggtggagcagacagttcctccgtcgctgcaattgttgggtgcatgtgccagctggttgtgaaagctgaattagctggagaagtggacctgaatattcatagttcctttcttgaaaatcctgctaagttgcttgaatatagagcatggtggcctcttattacttcagagtgttcaacttgcaaagaagctaaactgtcaactgatgaaattgcaaatggggacgagcaagttaaagctgatgcaatacgaataggaaactataaggatggcctgtatcctacagacagcagagaatttgctaaacgaatattctatactgtgtttatgggatctgaaaacagttccgaaatgacaaggtcacgagccaaggtgctggctgatgaaattggttcatggcaccttgatgttagcattgacgtagttgtgtctgcttttttgtcattgttccaaacacttacaggaaagcgaccacggtataaggtagatggtggatctaatgttgaaaatttaagcttgcagaacattcaagctcgaatcagaatggtgctagctttcatgttagcatcactcttaccttgggttcacagcaagcctgggttttatcttgtcttggggagctccaatgtggatgaagggttacgtggttacttgaccaagtatgattgcagctcagcagatataaatccaattggtagtataagtaagcaagaccttcgggcattcttgcaatgggcagccatccatcttggttactcatctttggcagatattgaagcagctccacccacagctgaactggagcctatacgttctaattacagtcagcttgatgaagtcgatatgggaatgacttacgaggagctatcagtttatggaagactacgaaaaattttccgttgtggtccagtttccatgttccagaatctatgctacagatggggtgcaagattgacaccatcacaagtggctgaaaaagtaaaacacttcttcaagtattattctatcaatcgacacaaaatgactgtcttgacgccttcctaccatgctgagagttattcaccagaggataataggtttgatcttcgccagtttctctataatgcaagatggccatatcaatttaggaaaattgatgaacttgtaagtgaattggatgttaaagatgttaaagattcaggagaccatgaggcaatggcagctacatctgatggtgttggtgggatgggagttgccgcagctggttcaggcaatcctaatgttggattgtaa

SEQ ID NO: 79895 - DNA, 150 bp, Glycine max
  Peptide Sequence Number=SeqID_196673
atgggcttcattttaagtggtgtgatttataaatatttgataatgttggacaatggccaactgcagcctaaggtcacaagtgcacgtgttcataagctcgttatgttaatcttggagaacagtcggcatttcagatttgcattgagataa

SEQ ID NO: 79896 - DNA, 264 bp, Glycine max
  Peptide Sequence Number=SeqID_196674
atggagaacaacgacagcatcatatcgcgggagaagatcgaccaggcagcggtgtggctcggctccgccgtctcttccgctttcttttcctcattggaacgcttttcctgcgtcaacgtcgccacctctgaccccgacaacgacgatgacgacgacgattattactccaccaccaccgccactcccacctccgcatccaccaccaccaccaccgccctcgccaccactcctccctccgttcagggaaagatgtctaagggataa

SEQ ID NO: 79897 - DNA, 195 bp, Glycine max
  Peptide Sequence Number=SeqID_196675
atggtgagaggaaagactcagctgaggcgcatagagaacgccacaagcaggcaagtcaccttttcaaagcggcgtaatgggttgctgaagaaggcctttgaactttctgttctttgtgatgctgaggttgctctcatcattttctctccaagaggaaagctttatgaatttgcaagctcaagtgggtgggagtaa

SEQ ID NO: 79898 - DNA, 594 bp, Glycine max
  Peptide Sequence Number=SeqID_196676
atgcatgctttgttagggtcattcaacagtggaaactggtatgactctaaagtccttgatagtgcagggctgagttgtcatgctttcacgaggaatcggggtgcgataatcgtggttgagtttagtcttacaagaggaatctgcggacaaggcttgatcaggattaggctaaactatcatgaggaatcgggcttaccaaataacgcaagttcgccgagtgttcgatactcagttcttactgtttatactgcttgtgcgatccgatctcccacgggcaatttagttcctttggacatagaaattgaagctatgttgcgaaggaacagggctgagaggagaaggaaacttctgcaagatagaaaagttgcatccattcttgaggaggagactcatttctctgacttattatcacctgattcaccatcatcaagggaatttgccactcaattacctgaagccattaccatggcagaagagaatgaccagaggattacccttgaggattattcaagtagttcagtaccacaattttttaccggcattgcacgtcctgaagtgcaagctagcaacatcattatttcatggattacctaa

SEQ ID NO: 79899 - DNA, 1704 bp, Glycine max
  Peptide Sequence Number=SeqID_196677
atggatattataggagccaagtacttcaaggctgatggaaaccctgatccatcagacatactctctcctgtggatgctgatggccatggcactcacactgcatcaactgttgcaggcaatctggtcccaaatgcaaatctcttcgggttggccaacggaactgctcgtggcgccgtgccatcggctaggttggcaatttacaaagtttgctggtcatctagtggatgtgcagacatggacatacttgctgcatttgatgctgctatacatgatggtgtggatgtaatatctatttccataggtggagggaatcctagttatgttgaaggctctatatcaattggtgcattccatgccatgaggaaaggtataatcacagtggcctcagctggaaattctggtccaagcctgggaactgtaaccaatactgcaccatggattgtaactgtagcagctagtggcattgacaggacctttaggagcactgtacagttgggaaatggaaaaaatgtttctgaggtgcagggggtaggtgtgaattgtttcgatccaaaaggaaaacaataccctcttatcaatggggttgatgctgccaaagactcaaaagacaaggaggatgctggattctgctacgaaggcacattacagccaaataaagtgaagggaaagcttgtttattgcaaattaggaacatggggcactgaatcggttgtgaaaggaattgggggaattggtactttaatagaaagtgaccaatatcctgatgttgctcaaattttcatggcacctgctaccattgtgactagtggcacaggtgacactattaccaaatatatacaatccacaagatcaccatcagcagtgatatacaagagccgtgaaatgcaaatgcaagctccatttactgcttcattttcatctagaggcccaaatccaggatcccaaaatgttcttaagcctgatgttgcagctcctggccttgacatcttggcatcttatactctcaggaagtcactcactggtttgaaaggggacactcaattttcagaatttattctaatgtctgggacttccatggcatgtcctcatgttgctggagtagcatcttatgtgaagtcatttcacccacattggactccggctgcaattaggtctgctattatcaccacagcaaaaccaatgagcaagagagttaacaatgaggcagaatttgcctatggtgctggtcaattgaacccaagaagtgctgtgagccctggtctagtctatgacatggatgccttaggttatatccagttcttatgccatgagggttacaaaggttccagtttatcagctttagttggttcacctgtaaattgctcctctttgcttcctggtcttggccatgatgctatcaactaccccacaatgcaattgagtctggaaagcaacaaaggcacaagagtaggagttttcagaagaacagtgaccaatgtaggtcctgctccaaccatctataatgccaccgttagatcacctaagggagtggaaatcacagtgaagccaactagcctcactttttctaaaaccatgcagaaaaggagcttcaaagtagttgtgaaagccacatctattggaagtgagaaaattgtatcaggctcccttatatggagaagcccacgttacattgtaaggagccctatagttatcaacaatccataa

SEQ ID NO: 79900 - DNA, 447 bp, Glycine max
  Peptide Sequence Number=SeqID_196678
atgaacttttacattgtttttttgggagctcatacagagagcagaggcaatgcacttgacacttatttaaatgttctatctgctgtgaaggagagcttccttgaagcaaaagaatccatggtatatagttacacaaagaccttaaatgcatttgctgcaaaactgtcagaggatgaagcaaagaagttatctgccatggatgaagtgctcttggtgtttcaaaaccagtaccgccagctgcacacaacaagatcatggaacttcatcgggttacctacaactgctaagagaagattgaaatccgagagtgacataattgttgctcttttggatacagggttcacgcctgagtctaaaagcttcaaggatgatgggtttggtcctccaccagcaagatggaaaggatcttgtggccactatgcaaatttctcaggctgcaataagtaa

SEQ ID NO: 79901 - DNA, 222 bp, Glycine max
  Peptide Sequence Number=SeqID_196679
atgaataggtggatgactatgaagaacctcatgctagaggacacgggaacacaacgctctgataggattatgtatgtgaggggtagagggtgtcacatgaagcatcgatttcttggacattcaccaggcaggcaggcactatgcactatgtgttggtctctttctgcagaagcagagcttcgaggccaaatttctgctttgtcctttattttgggatcttga

SEQ ID NO: 79902 - DNA, 444 bp, Glycine max
  Peptide Sequence Number=SeqID_196680
atgataagggatgtatatgatctggccgaggggatcccacacggctcctctcttctccagaattcatacatcgatcccttatcagaacaattatctctcgaggacagatttgttctaccaaagaagggtgacttcacgaaagtagcagtggatatggcaatgaagttatgggtaagccttgaatccattacccttacctctgttgtctccagacatgacatatttcccacaattctcgaatactgcaagaaaatcaccgagatgaaattttcttgcggatacatctttgacgtaaagcattctgaagccatggctaagtgcaccccaaacttgaaggtattaagtattcgggtcatagtagcgaccatgacggctttgtgctgtgtgcttacttccttggaacatttggagggtgaatgtctgtcattgtttccttctgagtag

SEQ ID NO: 79903 - DNA, 174 bp, Glycine max
  Peptide Sequence Number=SeqID_196681
atgtcaaaagctgtttatgacacgggtagttttgacagatcggtgtctctgctttggatccgtctgagaagagaaccgcttgcagttttgatgtcggagaggttcctctttggtgacgaccatgacgttaagttctgcgagagagcggccaaggaaacaaaggaagaagggtaa

SEQ ID NO: 79904 - DNA, 1281 bp, Glycine max
  Peptide Sequence Number=SeqID_196682
atgatcatgagcatgcagatcataatgtcagaagcacctgcaagcattccatcgaatgcaatcgttgttgaagtactgaatagagagaattactcaaactggagcgcgcttgtgaggaactacttgataggcaacggtctctggtacgatattattcaggataaggatgatgaaaaagaagtgccttatattgaggacaatgatgaagacccaaaaaatcatattgaaggcaatgataaaggttcaaagcctcgttttcagggcaactttattgaagctctaaagcctccatttccaatgccttctccgcaggatgaagaagatccagaacagtcttatattgaaggcaatgatgaaaatcaaacatcgaaaaagaagaatgaaaacgattcaacaaaatcaacgtctgccaaagagtccaggagtcgaaaatgggaatacaaaaaccgcagggctttacacgccattcaactctcttgtgggaaggcagtggggcaaataaaagagtgcaaaacagccaaagaggcgtggaagcatttgaagacgtcgttcagcgaagacgtttacgcccactacgattcaaagcaatcacgcttttttagcgaacttatactccaaactaacgtgaggaaagggttcctggacgacgcgaaagagagcatcagcatctcccctgaagatattttcacaaaatccccggaggggaagaccgtgcttcatgttgcagtggaagcgggacacgtggaaattgtgaagatattggttgaaatggggaagaaaacgttggtgaaaatgcaagacaagaaggggtacacagcgctggctctagcagctaagttaacagacaataaggagatggtagagtgtatggtggagattggaggggatgagctgctatccatagcggccaaagaaggtccagtttatgagattccggtgcttctggcttcagctagaggccacaaaaaaatgactagatttcttttcaacaacaccccctggcccctcctacgccgaaaccgttggcaatgcgctcttgtgcttctttctcgatgcatctacaatgagatatttgatgttgccgcagcaataatccaacaccctgatgcacaacgaatgcctcttaatgatgaagcaaaaaacttacggcccatatatgcattagcccacatgccttcagcttttcgcagtgcagaaaccagacttcattggtgccagcttttaatttataatggtacgtccaacctttcacatacatggcttattaactattacacttaa

SEQ ID NO: 79905 - DNA, 1008 bp, Glycine max
  Peptide Sequence Number=SeqID_196683
atggagattttaaattgcttgtgcgaaagaataccaacgatggttgaagaagagttgcgtgaggcgtcagcatacgacgcaatgttacaggcagccaagaatggaattacggagttcatagagtcaatgaaaggtgcaaatcctgaccttttgttagccatggatgaaagtaaaagaggcatatttgcacatgcaattgtgaatcgtcaagaaggggtctttaacctcatacacgacatagagactaaagagatttttacatcttgtgaagatgcattaaaaaataacttgttgcacattgcagcagaattagcgccttcccgttaccttgaccgcatatccaatgcagctctgcaaatgcaaagagaacttcagtggtttcaggaggtaaagaaggttgtgcctcggtggtgccatgaagccaaagatggaaatgataagacggcatctgaagtatttaccgatgagcataaggagcttctgaaaagaggtcagcaatgggcgaaagagacggcaggtgctttcacactagtgggcactctcatcataaccattatgtttgctgcagccttcactgccccagggggtaacgatgataaacatggcacacccgtcttcttaggtgaaagcacatttacgttcttcatcgtatcagacgctatatccctcatcacatcttcatcatcggtgttgatgtttattggaattctcacatcgcgttatgctgagcaagatttcatcaagtggttgcccatgaagttactctttggtcttgttaccttatttttgtctgtggcatccatgatgtgtacattttgtgctgcacttgctttgatgctaaagggatactacaggattgtaatagcagccatgtggcttgcacttcttcctatccttgtgttcgtaccttctctgttacgtctcacctcagagatttcccgatctactgtgagatttgataagcttgctgcaaagaagaaaaagaatagggattcggggtcaatgtag

SEQ ID NO: 79906 - DNA, 3030 bp, Glycine max
  Peptide Sequence Number=SeqID_196684
atgtctgcaatccctgttaccaataccatctctgaaatcatggagaggatgtcttctttccatggttttggccaaaacatcactgaaaatatcaaacaccatctcactgccatccaaaacaaatgtttgggttcagcaaagcttgacctaagtgaccccaaaacgaaaaaatggttgggacaagtcaccgagttgttctacttagtcgatgatctctgcgccaaggctgctctgctttcaaagcagaggaagatgatgccattgttccctacgtgcaaccttaaaccactgctccaactcaggaaaatcgaaaagcagctggcacgggaagtggcaccaatgaagaatgtcaaaatgttgccaatccgggatgtagaggaggaaaaagaagcagaaaccgtggtgcgaggttatgtcaaggaaaaaattatgaaaagcatcttggacaggaagaaaggtgttgttcgagcggttgtgatttttgggattacagggttagagaagggaaaagttactgaatatgtttgcgaagatgagaatgtgaaaagtggctttgacgtggtggtgccaattgacggtctgcacctcgagcagcattttgctgattctgtggtggatcgtgtgaagcatgaattagaggcgaagaagaaaaaggactctggtgagggaaaaggattctttgtggttctggatgattttcacaatgagaaccatggggaatggcttcaattgatgacgaaactgaaggaggcagcacaagcacacacatcaactggaggtggtgtattacttgtaactacacggaatgaagccgtacttaaatctgtgattcatatatttttttcagttcacggttatcggtttgatagcttggatctttccgagtcacagcctttgtttgagaaaattgtaggaacaagggggacgacaattggatcaaagaccaaaggcgatttgctagagcacatgtgtggaggaatcctcggagcagtaaaatcaatggcaaggctagtgaggtcccagaatccaactactgaatcagatataaatgcattgaaggatgaatttgtacaggagatgctgttgaaatattacagtgagttcgacctcccctcttggcgtctaagacagtgctttgcttattctttatttagattctatccttcaactgattttgtgaaggagtttgtgaaggaggaggagctaattaggctttggatggcggagggatttctgggacactcttcttctcaacatgaaccagaagatttgggtcatgagtgtatacaagaattcctccgtaggtcaatattcagttctcaagaagatggatgcatcagcattaacaaaagtaaagccctaacaacaatcttggctggcaacgacagagtgtacttggaggacaacggcaccaccgatgacaatattcgccgactggtgaagggttccaacatggatgtttcaacaggcaacttcagatccctctttaaaaacaataaaagtgtgcgcacctttcttctagaagaaaagcaacaacgggttccagaccaggtgatgttaagctggcttgcgtgtgatgcaattttgtcagcattcacgaggctgcgcgtgctgactctgaaagatttaggcatgaaggtgttgccggcttcaattggggacttgaagagtttgagatatgtcgatttgtctcgcaacaacttcaacaaacttcccatttgcataggtgagctgcagcatttgcagaccttgctgttgttccactgtctcaagctgagagaactgccggatgaagtgcaccattttccgagtctgaggcatctggacgtggacaaatgcatgaatctgatgcacatgccgtccgcgttaaagaaactgacttggcttctgtcattgccccatttcgtgaccagcaagcgcaacggccttgaggaactccttcatctcaatcagctcaggggagatttggagatttcacacctggagcgtttcaaatgtaaaggatcaagttcaaataatggaaaggatcatgattatcctatctacttgaaagagaagcaacatcttgaaggcctcaccttgaggtggaatcatgatgatgagaaaaagaagcactcattggaggactaccaattacaaaatctggaaccacatccaaatttgaaaagattgttcattataggctatccaggtaatcaatttccaacttgcttgttatccctcaagaaccttgttgagattagtgtgtacaactgccccaaatggaaacatctccctataatgggccagccccttataaaaaaactcacactcgtgagtttggccgatctagagttcataacagatatggacaatagtttggaggagctgccactagaacgagtgagaatattggactgcccaaacctcacgagttgggggaatccggaaacatgcaatactactgcattcagtggtgccttatcagaattggtaatggaatactgtcccaagctggatagtatgcctctgtttcctaagattaaaaataagctagttttagatcactccagcatgaaaccgttgttgtacaccctaggatacaaatcagatacttctcctcccctatctgaattaaaacaattgaccgttaatggttgcgaagatttgaagtccaatatcaaaggttggaaacatctcagcaaacttgagactttgcatatttctaactgtacgcagatcaatttgccgagtgaggaatggaagggtttgaagggactgactgatctggtcatagaggatataccagatctaaagtcacttccagaagaaataaaacaccttgcctctgagggatctctgaatagtcttgagataaagagttgtcatgagttaacgacgatgctggattttggcgaatacctccactcctttgcatatatattaattgaagattgtcccaatttagattcattgcctgatagctacaaacacaactttttcacaccattgaaaatccaaaactgcccattgttgaaggattcatactaa

SEQ ID NO: 79907 - DNA, 168 bp, Glycine max
  Peptide Sequence Number=SeqID_196685
atggtccacatatcagatattaaactgataagaacagatactacacttgatcttagccaaaaggccgagaaaggttggtcccaaaaatatgacaaatgtggagttggtggcttggtgcaagttagtactcttctactcgagatgtggatgcttaggctatccttttaa

SEQ ID NO: 79908 - DNA, 405 bp, Glycine max
  Peptide Sequence Number=SeqID_196686
atggaacctccaacgtcaccgctgccaacttattggaccaacaactcttcctccgacgacgccttgcagatcatcgccgacaactcttcagggtttagcggccgtattccgtttgggaaaatagtcaaatgccctagctgtcggatagctgtaggtgttgcacagccacaacaaggatcacctcctgccgaacgcagcatggacatcaccgcatgggaaagggggttaagatacgtgaaattgatgaagcaaagcattcctgctgctgttcactctattgtggtgcagaccccttctggtctgactcgcactcatagatttgcaactgaaacagttgatctgccagcacaagaaggcgaaagggtaactgttgctgtggcagctctgtctaatgtatatagaaag

SEQ ID NO: 79909 - DNA, 312 bp, Glycine max
  Peptide Sequence Number=SeqID_196687
atggagatgcctcacagatcattcagctattacagtacaaatacggtccttttcaagttcttgaatcccaacatagaaatggattctcaagagcctccaatatatccaaggctaattagaacaacaatcatcattccatctcagaactggcccttagaacagaataggggatatcgtggaagtggagctggaggcaaccactctttgcttgggaaaaggatcaactacatgtttgatgactatgttacatcaagtaattttgtaggatcacacagcagatacttggtcgtggaaattgaatggggccaatga

SEQ ID NO: 79910 - DNA, 531 bp, Glycine max
  Peptide Sequence Number=SeqID_196688
atgtatgcatggagtccagatgtgaaggacataataattattgtttgggggtggggaaaaggatgggtcaatgtcatggatgacggtcctgcaaaattaaatatcatccctgatcattttcaagttccaacagcaagtatagaatctcctgagagcagaacatcatctattgccgaacctggaaccgatcaatcttcaagcggctgtcatggggttccagtactggaggtcaggaaaaggtctgatttgagcagcttttatgctgtgcatcttttgtcgttggtgaaggttgagctaacagctgcagaattagagtcacttcgatcggagcttgctgatatagcagagagggaagctcactcgaaagctcagttggaacatattgatgaagttttgcggtctgctcgtctatctggatatttatacattcgaactgtactgactgcccaccctacaccagtttatggtaatgcagttgtgttccttccgacaagttgtagttcacatttttttgctttaatattgatgtag

SEQ ID NO: 79911 - DNA, 393 bp, Glycine max
  Peptide Sequence Number=SeqID_196689
atgattcgtaccatatttgcttgcctcaatggaaaagcatcacataaaaaatctaaactagagccactggaagtcacaaaacctgtttatagagatgagttaaccaaaaaacaaaggctaaggaaggcagtgaagaaaactgtccgttttgcggaatcagaacctaccattttgggagaagatagtgagaagacaaggtgtgttagtggcaatgaagtgggaggaaaagaagggataagagtgaggatcaaattgacaaaagaagaagctgcacggttgctatcaaaatgcaacaatggaggaattctcgaattcgaggatgttgctcgtgagcttgtgttgatccctgttaaccgagttagcattgtgtccgatggcacaatcaatttgtag

SEQ ID NO: 79912 - DNA, 951 bp, Glycine max
  Peptide Sequence Number=SeqID_196690
atgcaaaactcaaacccatcatcatcttcccccccttcccctcctctgttggacaccgcaccgttcctcccccggagccgccgccgcgcgccgccgtctctgcgcacggcggcgaccttcttccggcgtgcaagcgggcggcgcatgatgctccgggagccgtcggtgcgtgtgcgggaggctgcggcggcggaggtggagggccggcagagcgagtgggcctactcgcggccggtggtggcgctcgacgtcgcgtggaacgccgcgttcctcgcgattggcgcgtcggttctcgcgctcagcgccgacgaggacccctgcgtgccactcagggcgtggattgtggggtacctgctgcagggcgcgttgcactctctctgcgtcgttgctgagttcacaagaagaagaagaacagcaacaattagtgggacccactccggttctaacgttgaatggagcttcagttctgagagtgatgaagagttttatccttcggaacagtttctcgagggtgacggaaacagcatcacaaaacacattgagtctgcaaataccatgctttcattcatatggtggattgttgggttctactgggtaactgctggtggccagagtttgacaagggattcacctcagctttactggctctgtatcacatttctttctttcgacgtcatgattgtactcatctgtgttgctgttgcatgtcttattggaatcgctgtttgctgttgtctgccgtgcatacttgccattctgtatgtggtggcagatcaggaaggggcaacgaaggaagagattgagcagttgccaaaatataagttcataataataaaggaatttaagaaagaaggtgatattgaagaatcttcaagaggaataatgaccgaatctgagagtgagacagccaccgaacatgttattgccttagaagatgcaatgaggacttaa

SEQ ID NO: 79913 - DNA, 429 bp, Glycine max
  Peptide Sequence Number=SeqID_196691
atgtcagccgaaaacctctgcatgaacgggaagccagtcaaaaacgaagcatacgtcgtcgttcacacgcagtcacgcaccaaattcttcacaacgaggacgcaaacgaaagaagaaggtgggagtaagagcaacaacaacaacccttcatggaacgggaagttcatgccaacgactgcatcacgatggaggaagggtcggagaaacggggttatcaatttctcggtaagggtgctgaaggaatctgcagagtctgaatctttggtggagattcaaaataatttgagagggtttgggatgcaactgtcgatgggtggggatgatgattctagcggaattgttactgggattccagttttctggaattaccctctcaatattccaagatgcatgagtatatgtaatttggaaaaagaaaatcttgactaa

SEQ ID NO: 79914 - DNA, 172 bp, Glycine max
  Peptide Sequence Number=SeqID_196692
atggaaaaagtccaaggtgagatgcagcagaaagggtacggacaccaagatcggaagaagtgcaagccacatgaaaaatccaagcaaccgtcgcttccccgtcctcgccaccgcgacgtgaagagcggtccttccgtcttctcgagactggagaagatatcacgagggcgac

SEQ ID NO: 79915 - DNA, 256 bp, Glycine max
  Peptide Sequence Number=SeqID_196693
gtttgacccaaaagatttcttcagggagctttatgaaacagacaatgttcaatttcgcatactcatagtaaaacaaggtttagggggtaatgtacgcattattttgtctggagcagcacctctatctagacatgtggaaggtttcctacgggtggtgacttgtgctcatatcctacaaggatatgaatttgaaggattagagatcctcctaatgaacaaaggaaaaataaaacaacaaaaagtcaatggagaataa

SEQ ID NO: 79916 - DNA, 639 bp, Glycine max
  Peptide Sequence Number=SeqID_196694
atgcatgctaaagctcatttaaatcttgcctggcagcagatgcttgttaatccccagactcatcagttaaaagtatgtgattttgggagtgcaaagatgttggtgcctggcgaacccaacatatcgtacatatgctcgcggtattatagagctccagaacttatatttggtgcaacagaatacacaactgctattgatatttggtctgctggttgtgtgttggctgagcttcttgtaggacatccaatgtttcccggagagagtggggttgatcaattggtagagatcattaagatcttgggaacaccaaccagagaagaaataaagtgcatgaatccaaattacaccgaatttaagtttcctcagataaaagcacacccatggcataaggtttttcacaagaagatgccttcagaagcagtggatctagtgtcaaggatgcttcagtattcaccgaatctacgatgcactgctttggaagcatgtgcacaccctttctttgatgatctgcgagaaccaaatgcatgcttgccaaatgggcgaccattgcctccattgttcaacttcactgctcaagaactggcggatgcacccgatgagttgcgtaggcgtctcattcctgagcatgcaagaagttga

SEQ ID NO: 79917 - DNA, 249 bp, Glycine max
  Peptide Sequence Number=SeqID_196695
atgtattctgcagtgcatacattcatttatgaagatagaggacatccaagggaagctgagatttattccaagattgatgaaattataagaagaattaaggaagctggttatgttccatatatgaatttttcattgcatgagatggatagagacggaaaggaggctggtcttgcttatcacagtgagaaactggctgttgcttttggattacttgcttctccaccagattcaaggagaattgatacatga

SEQ ID NO: 79918 - DNA, 966 bp, Glycine max
  Peptide Sequence Number=SeqID_196696
atggggttcataagatctgtgttgtctggctccattttgcttgttggttttgtatttgcaggaagctgtgaatccatagccatgaatgtgatgcgaaggttgaaaagcattgcttctgggaggacttccatttcatcagatcctgtaatgagggcacaagctttgtgtgagattgacatgattggaggggattgtaccacaaaaagagcaaagtttgatcaagacaccgaaggaaaggtcaatgaggaaacatatcctaatgagaggtgcggaaaagatcaggaacaccatgtagattccaatgttccttcagtgcctagaactgagaagtcaggttatgatcagcttccaaaagaattaaatgaaatgaagattggagatgacaaaggcaaaaacaacaatgagaaggatatggaagcaactattgtgagtggtaatggaacagaaaccggtgaaattattacaactgctattggaggtcgagacggacaaccaaagcggacaatctcatacatagcagaacgtgtggttggcactggttcttttggtgttgtttatcaggctaagtgccttgaaactggtgaagcagttgcaataaaaaaagtgttgcaagacaagagatataagaatagggaactgcaggttatgcgaatgcttgaccatactaatgttctcagactaaaacactgtttctattcaactgctgagaaagatgatttgtaccttaacctagttttggagtatgtacctgaaactgtctacagagtttcaaagcactatgtcagaatgcaccaacatatgcctatcattaatgtgcaactgtatacataccagatatgtcggggtttaaattatttgcatcatgtgattggagtctgccatcgggacatcaaaccccagaatctattggttaatccccagactcatcagttaaaagtatgtgattttgggagtgcaaagatgttg

SEQ ID NO: 79919 - DNA, 318 bp, Glycine max
  Peptide Sequence Number=SeqID_196697
atgggtgccaagtaccttgaagtggtcaaacgagggtcgcatcccaacaatggatggtccccggacgaaattaggacgcagaatgaacataatttgtctctgtgttttgttggaaatgatcgagcctgggcggcgagatacagaatgaccataatttgtctctacatgccactggacacgatcgcctctggatggcgaaaggtgcgcgaaatgaccataatttgcctctgcccacctctcgacttactgtttttgaatgacaaaggacgtagaatctgtatctacgcgtttatcacccacctcgctgcttccaaatga

SEQ ID NO: 79920 - DNA, 507 bp, Glycine max
  Peptide Sequence Number=SeqID_196698
atggacgaatatcaatggtcatatgacaatacgatgtctcaagaagttgatatggattatgaaaatgaacaagaatgtggtgtgaatgaaccacatgttgattgttcggatgcttttaatacttctcaagtctttagtacccgagatgatgttttgctgtgggctcgatcgattgcccaagaaaagggatttgttgcaatcattatgaggtctgacacacatactggtagtagaggaagaacttcatttgtgttaattggttgtgaaaggagtggtcagtataagtgtaggaagaaagaatttgttagaagagacactgagagtaggaaatgtggttgtcccttcaggcttcgtgggaaaccaatgcatggaggggaaggttggatggtgaagttgatctatgggattcacaatcatgaattggccaagtccttagttggacatccatacgttgggaaattgaccaaggatgaaaagaaaattattgttgatatgacaaagtctatg

SEQ ID NO: 79921 - DNA, 201 bp, Glycine max
  Peptide Sequence Number=SeqID_196699
atgcgggagtaccttatggttatccgcaccttttgtcaaccagaggcaagttttactgttgtcattcaagacattcaagcccgacgacacccaagattcttctctgctaggcagggacgatcgagttcgatagcatgtggaaacgtcgtggttatcccattttattgctttcaaggcattgaagttttgctgacgccctga

SEQ ID NO: 79922 - DNA, 153 bp, Glycine max
  Peptide Sequence Number=SeqID_196700
atgggaggagaggaagcgtttctcgcttacgaaagaacattcttccgtaagagaaaatgcctgaaaatgcttcgtacggaagaaggttcttccataagttgctatggaagaaccttcttccgtaagaacttatggaagaaggttcttccataa

SEQ ID NO: 79923 - DNA, 303 bp, Glycine max
  Peptide Sequence Number=SeqID_196701
atggttgaatcctccgaaagacaatcatggggtttgagtccacatgaaaggattcctttacctaagtttagaggtccatacaaagagaaagagggaattttgatggtgaggatgaacactagaggtggtagcacatcttcacgtccagatacgtatatccatgaagtctccaaggacatgagactgcctcctagccatttactccccacgtacactagatacaagatcatcacaggcacgagcgtcacatacaacaatgcaagggtgaccttctgggaagtttcccagaaaacgtgtgagtga

SEQ ID NO: 79924 - DNA, 279 bp, Glycine max
  Peptide Sequence Number=SeqID_196702
atggcttcttcacctgcctcccctcctcctcctcctcctccttctcctcctcctcctccttccgacgcatcggcttcaccgtctgccgtgaagcggacacggaaagccacacgtctacgatccttgaagaaattaagaacatatttgggaatagtggcacgcgataaggtggacgtcacgtacgagaactggaaggaggtccctactgctcagaagggctttatttgggaggatattcaggtggaatttgaaatcccagaggcttctgacagtaggtga

SEQ ID NO: 79925 - DNA, 327 bp, Glycine max
  Peptide Sequence Number=SeqID_196703
atgttgataactattaatcaatataagaagaatgtgaacctagctgctagtcatgggcagaggctggaggatgaacatgcgatggtatcaactttgcaaattgaaatggaagcaagagagagggtgatagaatcattgcacgtggatgctatgaaatggatggataggttcgctctcactctgaataggagtcaagagcttccaaggttgttagccagagccaaggcaatggccgacatgtactcggctctcgatgaagttcatgatcttttcgattactgccaacacatggttgaaataatgacccatataattaggaattgctga

SEQ ID NO: 79926 - DNA, 302 bp, Glycine max
  Peptide Sequence Number=SeqID_196704
tgctaacatggtgtgtctggtcatcagcataggtgccagggttgcatacatggagaaatggggttggaaccgagtcggaatgacccgacataactcgcaagcaaggaaatggttgaaaaatcctaggtgcagtagcacccaaaacggcacagggaagggggagtgcacctccatgaaggaggtgtgggccctaatgccaccgggcacagggcttggcggtgcgaggtcaccacagggagagctagtccaacgacagcaatggcgacacgacgacggcacaggcgaggcctcgacaaaaaatg

SEQ ID NO: 79927 - DNA, 510 bp, Glycine max
  Peptide Sequence Number=SeqID_196705
atgcgtctaccggggaaggagagtctgctgatgaaatctcccataaccataaatgagattttggatgttagcatttcgtttctaaatgaccatttggaggaaacactgggttcgacaaaaatagaagaaatccactcaaagtgtatcaatctcgcacaggtcaaggtttacggtgagtcaagattttggctcaaggctggtagaatggctagacatgatacatgtcagggtttggtttggctcaaggataaaaggggtgccccacattatttccatgacacaaatgcaaaaaatgatgatttggaaactttatgcaaaactggtcatgcatgcacctatgcggacactcaagtgtcaaatttttatggtcatgtgatgctagggctcaagattcatttcctctattttagtcaacccaacatttccaaaatatgttcttttatcaatttgtgcattcatccgagtccattttgggcgtctgggaaaatcttcacagcattcacccttcag

SEQ ID NO: 79928 - DNA, 309 bp, Glycine max
  Peptide Sequence Number=SeqID_196706
atgtacaaagataattggacccaaccttggcccatgggctcagaaatctaccctaaggttcatgagaaccctagggccttcttcagcagctctagcccaatcttcttggagcctcttgctcatggttctagtgattggtcccttcctagggaggattgcatcaggattcttagctgtggcgcgatacccggagtgggtggccaacattgtcccagtcccaaaaaaggacggcaaggttcgaatgtgtgtagactaccgggacttgaaccgggccagtccaaaagacaattttcccctgccacacattga

SEQ ID NO: 79929 - DNA, 279 bp, Glycine max
  Peptide Sequence Number=SeqID_196707
atgcccttggggggtaggattgcatcagaagttgtgtggttagcagggctagtgaaggagagtagcattgagcaaggtggatttcagttgcattgtgataatcaaagtgctatcgatttggcaaagaataaggttttgctcaagaatattcacactttagataatgtagccgatatgttaaccaaggcggtcacaactgacaagttcaagcattatgttggacttattgaatgttgcttagtgctagatgtgatgggactcaaacccaggacactatga

SEQ ID NO: 79930 - DNA, 717 bp, Glycine max
  Peptide Sequence Number=SeqID_196708
atggtgaacagtttatacgacgaactactgcaagaaatcttgcagaaactcccctcatcctcctcctcctctgtctccctcgtctgcaagcgctggctccgcctccaccgttcctccacaacctccctctctctccgcctcaccacccctcatttctctctcatcccttctctctcctcctttctctcccaccacccttttctctcttccctctctctctccctctccccacccctctctctctccccacacctcctctctctcatcactcccttttccaacctcctcgctctctctctctcgccagcacccgtttctctctcctccctcctctctctctccgcctcctgcccccgcctcaattccctcctcatcaccctccccaggcccctttttctcaactgggtcacgtccttcccctgcctcaaggaattgtcaattactttctcttccgacgaagaagaacgggtcaatagcgacgatgacgaagaaagtgatgattttgattctgattctggttttgaattggggttggagagtctttgtttggtggggattcgcggcgacgattggggggtgggttggttgtggagaagatgtaaaaatcttaggaagctaaggcttcagagttgccaggggattggagggtcttattcgtcttttgtcaagtgcttgcagggtcttgaggaaattgagctaagaacttgcaggagtgtg

SEQ ID NO: 79931 - DNA, 909 bp, Glycine max
  Peptide Sequence Number=SeqID_196709
atgaaggttcataccactaagttggttacttttgcacttatcgctagtgttggagatccttctacttttcaagaggctatgaacagcctggagaaagacagatggataggtttatggaaacctccaatatcagaaaaagaaggggaagagttcaaggctcgcctagtagcaaaggggacgatgctagtcttggtagctagtcatgacatgcacttggagcagatggatgtgaagacaacctttcttcacggtgatctagaggagcaaatttatgtggagcacaatctccaaggcaatggtacaagcggtttgtttcttatatgcttcaaattggctacaggtgatgtgagtatgaatgttgagtttaccaaagagtttgacatgaaggacttgggtcctaccaagaagattcttgggatggagattcacaaggatagaaaatcaagacaattgtggctttcacaacaaggttatgttgagagggtgctagacaagttcaacatgagcaatgcgaagcttataggtgctaaggtggagtacaagtcaaaggttccttatgccaatgtagttggttgcttgatgtatgttatggtgtgcactagaccagatttggcgcatgctataagccaaggttgcaatcaacatggtgatccttcagttgtgggatatgtggattctaactatgttggtgatctagatgatacgaggtctaaaacaagcaaggaagttaatgtagctccatgtggagcttgtaggtcttggatcttcttcatcaatgaagtcatttgcttcttgaagatcatggcagcggaatggagaaggaagaaagatgattggagattccacttcaaggagaagatgagtcaagaagaagctcaccaccataggaagccatggataagagcttga

SEQ ID NO: 79932 - DNA, 711 bp, Glycine max
  Peptide Sequence Number=SeqID_196710
atggtgtatgacaggaatcaggaaaaggcacaagaaatcaaaaatataatcactgcccctacttactgtctcgtggggaaaaggaagaaaagacaacagaaggcaatactaactgagaatacaccattgattgacgaccccccatctcccattgaaagacatgtgaagtggaagttggcccgcataaagcgatatcagcagatgacatctcaggcaacacaagaaatatctaataaaattgagttaaaggaggccatcaaaattgagttatcccaaaggcaatcgcagtactcaccctcaattaaggcaaatatacaagtattaggtgcacgtaagagcacaaaggggagcaatgctgaaactgctgtcaatccatcaggggaagaacatgttgctcatgtgatgctgactatggggtttgatgctcaagtctcgttgccaatgtcagaaattcagtatgtcaggccagcccttgacacattcatttcatggccgacacatgttgtgaatcttgtatcacatgagattagtccaaagaaactggttgaacctattcaaaggtcggatgatgttgctacagatgatcccttggatgacttgattaagagcctgtttatgaatgagtggagttcaagcgtgggtcatggtttggtgtatggattccttgagcctcagtccatacacaatgcaacagatagacgtgttgaatga

SEQ ID NO: 79933 - DNA, 231 bp, Glycine max
  Peptide Sequence Number=SeqID_196711
atgtcgatgttggtggtggagagaaaggtattaatgtggacgctggtgctgagagatgctagtgttggtgagcaaagagatgctggtgagcagaaagatgctggtgttggtgagcagaaagatgctggtgctgctttatatggtgtgaaagcttgccctgctgaacaattgcttgtaactaccatgctttggaagtgtcaaatgatatttgctagcagttctctggactaa

SEQ ID NO: 79934 - DNA, 102 bp, Glycine max
  Peptide Sequence Number=SeqID_196712
atgaagcaaaatcttgaaaatgaagtgaagcgccaaattgtagtcatattggaagaattgtcgacctctgaatcacctactaactcaagtgctcaggattga

SEQ ID NO: 79935 - DNA, 275 bp, Glycine max
  Peptide Sequence Number=SeqID_196713
atgaaatctgtgcattttcaggtgaaaaagaggctacgagaatttggcaaagcatcaacatcaaagccgcatgctaagcgcgagatcagtgcgctaagcgcagcaggtgccttcagccaggctaagctcaagattggcgctaaacccaatttcacttactcggtacagacttacacaatgcccagggcacagaatcacacagcagccacagtgcctattcagggaaaagagccctggaagcagcaaagaggaacaacttgtgcattgaagcctag

SEQ ID NO: 79936 - DNA, 405 bp, Glycine max
  Peptide Sequence Number=SeqID_196714
atggttatgggggatttcatcagcagactctccttccccgaaaacaccgagactttttcaagtctcacaagttatccagaactacgtaggtctgagttcctcattggaggatacgtaggagcaagagcctcgcttttgtcgaccacaccgccttttgttgccatgactcaagagctggtagcccgtggagacaccatacggttatccgcacctcgtcattcagtgaccccaagtgtgattgacgagcagaggccaatgtggtcatctgcgccctttccggagatgtcagcattttccgatggagacttttcaagtctcacaagttatcaagaactacgtaggtctgaattcctcattggaggatacgtaggagcaagagccttgcttttgtcggccgccccataa

SEQ ID NO: 79937 - DNA, 378 bp, Glycine max
  Peptide Sequence Number=SeqID_196715
atggaagaacttgttttgaacaagaggtcagagttagaagaaatatgtaaattgactcatattgaaccatatacaagtattgcagctagtgctataatagattctgagaatgagttaacatgggcacctgttttttttttcagatacattgaaattatgaagggagaaggattgaagatatctcaaccagcacctgacccaaattcgacaaagatacatcatagaattatagttagagctaggactaagaaagttcataggagagtctatgaacttagaggcaatactcaagctccattaaaacttttgtcaatactcaatagcctttttgatggatgggacccaatgagattagtttcgacacgtaatgcttggtga

SEQ ID NO: 79938 - DNA, 120 bp, Glycine max
  Peptide Sequence Number=SeqID_196716
atggatcttatcctagatgttggcaaattagttgttcgccagcaagctaaagatgttgttcttgctgctgaactagagggagctgttttggctatttctatagctcattccaaaggttga

SEQ ID NO: 79939 - DNA, 1248 bp, Glycine max
  Peptide Sequence Number=SeqID_196717
atggaacgcgtgcaacgtcatgaagccgaccggctcggcatccgcgtcactgacgcccaggtcgatcaggccatcaccacgatcgcgggtcgcaacaagatcagcgtggcgcaactgcgcgctgagatcgagaaatccggcgtctcctgggacagctaccgcaagtcgttgatggacgagatccggtcggaccgcctgcgtcagcgcgcggtggattccaccatcgtcatctccgatgccgaggtcgacgccttcctgaaggaccagcgccgcaatccggccttcgcggccgcgccgcagcaggcccagccgcagccgcaaccggaagccgcgcccgagcaggccgccgcgccggccggcccgatgctctatgccgtggcccagatcctggtgcgggtgccggaaggctcgtcgccggagcaactggccgcgctgcgcaagaaggccgaagacctgctggcgcgcgtcaagcgcggcgacgacttcgccagcctggccgccgccagttcggacggtcccgaagcgctgcagggcggcgtcatgggcgtgcgtccgctggatggttggcccgacctgttcgccaaggccatcgccaatctgcagaagggccaggtcagcggcctgctccagagcggcaacggcttccatatcctcaaggtgatggatcgtggcacggcccagccggcgcccagccgcaccggccgcgccccggttcccacgccggcgccgcagccccgtccgcagccgcaggcccaggcgccgcaaggcccggtggaagtgatgcagacgcatgcgcgccacatcctgatcaagacctcgacggtcatgagcgacgagcaggcgcgccaacgcctggagcaagtgcgccagcgcctggtggccggcgatgccaagttcgacgacatggcgcgccagtattcgcaggacgcgaccgcgccgcagggcggcgacctgggctggctcaaccccggcgagaccgtgccgcccttcgaggccgccatgaacgcgctcaagcccggcgagatcagccagcccatccagacgccgtttggctggcacctgatccaggtcgaagagcgccgccagcacgacgccaccgacgacctggcccgcatgaaggcgcgccagaccttgttcgagcgccgcgcccaacccgctttcgaagactggctggatcagttgcgcgcccaggcgtacatcgacaaccggcttgaaaagcaggaccgtatcaaccagaacaaccgctga

SEQ ID NO: 79940 - DNA, 1342 bp, Glycine max
  Peptide Sequence Number=SeqID_196718
tgggacgtggccaaggtctcggacaacgattacttccgcgatatttcgcagctgggtttgaaccaggcgtccaccacctatctgccgcagcgcgcgcgggtgggctggtcctcgacgtactggagcgcctatgcgcaggtctacaagtaccagaccctgcaggatccggatgcgctgttgacgccgccctatgacaagcagcccgagctgtacctgcgcggcgcccgctacgattggggcggtttcgacgtggactggacctcgaccgcggtgcgtttcagcaagccgctgttcctgggcaatcgcaacggtcccaacggcgaccggctgcagacctacccgacggtatcgtatccgatcgtccgtccgggctggttcgtgattcccaaggccggggtcaattacacccagtaccagaccgattggtatcacggcgactggctcggcttgaactcgggcacggccaatgccggcacctcgttcggctacccgcgctcgcagtcgcgtaccgtgcccatcatgtcgctggatgccggcctgattttcgagcgcgacaccacgctgttcggcaaggattcgatccagaccctggagccgcggttgtactacctgcgtgtgccgtaccgcgaccaatccaagattccggtctacgacacgtcgctgtccgatttcagcttttcgcaggccttcgacgagaacatctactcgggcggctgggaccgcatttccaacgccaatcagctcactgccgccttgaccacgcgctggctcgatgcgtcgaccggtttcgagcgcgcctcggtggccgtggcgcagcgcctgtacttcgccgaccagaaggtcaccttgccgggagaaacgccgcgcgagaatgtccggtcggacttcctcgtgggcgccagcgcggcgctgaccgataccctcaccaccgacgtggccgcgcagtacaacccctatgacaaccaatggtcgcgcgggctgcttagcgcccgctggtcgccgcagcgcttgacgacggtggcgctggcctatcgttatcagcacgatccgcagcccggcgtgctctaccagccgcaggggcagaaccagatcagactggcggtgcaatggccgttcaccatgcgctggtacggtgtgggccgggtcgactattccttgcgcgacggcccgtccaacacggccaatggcaccaccgattcgccccgtgtcacgcaggccatcgccggcctcgaatacaatggcgactgctgctgggtgggccgcatggtcttccagcgctacgccgtgtcagccaccgacgccaatacggcactgttcttccagctcgatttgaccggcctgg

SEQ ID NO: 79941 - DNA, 255 bp, Glycine max
  Peptide Sequence Number=SeqID_196719
atggccacctacgatgacttagatgatgagaagagtaatagttcaaatgaagaacaacctaacatctgcctgatgacagacacaaacaaaaaatttgagttaaaaacttggtttaaatccgatgtgtcatctagttcttcattagatggtgaagaagtgatggtgcaaaaacaccgagttaaagaaatcaaaggcaacttatcgaggtcgtacccaaatcaaataaacattaaaaatgcagtatctaggaagtga

SEQ ID NO: 79942 - DNA, 297 bp, Glycine max
  Peptide Sequence Number=SeqID_196720
atgaccggccctctcgacgagtcaatctcttgctttctcataagggtggacccttgggtactagtaccctcaccttcagagggctacacgccctcacctttagaggacttcacgtcctcaccttcagagggttgcacgccttcaccttcagaggactacacgtccttgccttcagagggttgcacgccttcaccttcagaggactacacctcctcgccatcagaggactacacatccttgccttcagaggacttcacttcctccccttcagagggctacttgccctcgccttggtag

SEQ ID NO: 79943 - DNA, 354 bp, Glycine max
  Peptide Sequence Number=SeqID_196721
atgaagccttgcttctacagttgctacttagcatcattttgcccaacgaccacaatgtcgatctccccctgtggaagggtcgcgcccgcaagacaccctgtggacctggagaagtccaagagggtcttggagttgccagctctgattatgggcctctgtcggttctacggggtgcctgttgcctccagcaaggtcatcaggatccctactaatcgagctttcatcaagaagtactgcgcccccaggcaggcacagggcgaaacaccccagcagcctggggatggcctgcagtgggcaacagacccaccgtcaccacctctagagttcacctcagctcatccacaaaaaggttag

SEQ ID NO: 79944 - DNA, 582 bp, Glycine max
  Peptide Sequence Number=SeqID_196722
atgaccgacagactgcttgcctggtcattgacatttgattgttgcattatgcattataatattgttagaattctgatgcctcgttcttctaatctcgctcaagcctctgaggaggacttgattctgatgtgggctttcttaaccggtcgtccaatcgactgggcccatttgatttgttactgcatgcataaggcattgtggtctggtgcacctctcccttaccctcagcttgtgactttatttcttcgacattttgaaattcctttggatttggagccttttctgctagttaaacgctcctttgctattggtgccggtgcagtaacctcctttggctaccgtaaggacatggatgggcaatggttgaagaaggacgcgcaacctccgcaagacgaatgtactccctctcctccgcctcaacgagatgattcctcagccctcatgaatgaagttctttcggaattacgaggccttcacacctatgttggtgaacgttttgattccttggatggtcgaatagatctattaatgctcgctttgaaggaatggatacctgcatcactcagcttgaagaggatgtga

SEQ ID NO: 79945 - DNA, 384 bp, Glycine max
  Peptide Sequence Number=SeqID_196723
atgggtcaaatgcaacaggacggatctgctagaggtgaccccggggctacagattgtggtggactttttcagaacaaatttgctgcctatcttgcttgttttacagccaacttgggagttagaaactctctctatgaagaaatcatgggtgctattttagctattgagctggtagaacataagggttggaggtatttatggcccgagtgcgattctctgttaactattcaagcctctcagaattatcatttggttacacacacatatgtagaagacaattcttgtgcaaacaaacttgcctcttgtgctagagattcttctgagttctgctggtgggattccccccttattttgttggagcagaattcaataggaatgggatag

SEQ ID NO: 79946 - DNA, 1582 bp, Glycine max
  Peptide Sequence Number=SeqID_196724
gccttgcaatgcttgcttcatcctcttagtcttggaccttgttgtaggacctccaattccatgtaaaggatgggctgattgcacctctattaggttaggtcttgcaagtcgtgccaaaactgtgtcaacaatgttgagaatcattgccaacaaaagattctcgcatatggtgccaaatgagcactttgttgttagcattctaagtggcctacctcttgatgttgctgctcctttccttggtgcaggcatcacggtgtatggtcctttgagatattttgggcttgataaacctaacatgcatctgggtgtggttggccttggtggattaggccatctagctgtcaagtttgcaaaagcccttgatttgaaggtcagtgtcatcatcagtacttctccaaataagaagaaaaaagccatacaacatcttggagctgattcctttgtggctgcagtgtgcaccttggacggtataattgatactatctcagcaatgcatcctctcacgcccttgattgatctgttgaagtctcatgggaaacttgtaatggttggggcacctgagaagcctttggaattgctactccctcaagagacacaagaaattattgatttcgccactgaacacaatgttagacctcaaattgaggtaattcctatggattatgtgaacatagcaatggagcgtctcctgaatgctgacgataagtgcattaacagtggttacgaatttgtccctgaacaccgtcgctctgctagggttcgtcgccttaccgtaacctttccgagccaactgccaaagccctgcattaaaggctgcgcagtctcgattaggatctccgatgatgagtatcaaaagggcttgttaagttgccagaacaaccttcatggaaggctgattctgccaaaaggcactacaccagcgaaggagcatttcggcgcttggcacttgcgtcttcaccagtggagtcctgatttcaaccccaatcgaatgaggcaaacccacgctcagatcccagtggcaattggcacctcgatagttctcaacgaatcaaccagacaaagggcttttgcccattatgctcgtcttcttatagactttgatttagcaggaactttcccaagtgaggacaaggcccctgttgacgataacacagtccccatcccgtcaaaggaccctaatacctcatcagctcccattgcggaccttgcaagtccaattgttatgactgaagtggctatggagcccccttcagatgttgctcatgttgctcaatttcaacctccttacccttgcatatgcaaagagactgtttccggattcgaacccatgaccaacaagtcaccaaggcacaactttaccgctgcaccagggctcgccctcttttttgaacataagagcctcaaaattaatgttgaaaaacttaaacctcaagctctttgcggtcaattctacaccacaagcagccccaaatttgtgggaaaagacaccaaggtccttggttcctcattggggacttcaattgcattcttggcaatcatgagaaacacagtaggtgcttgccataatgctcttcttgcgtag

SEQ ID NO: 79947 - DNA, 393 bp, Glycine max
  Peptide Sequence Number=SeqID_196725
atggccattggtgaattaaaatttccaaattcaaattcaaaatcaggggaaaaaggaagaggtgcacatagcttggaggaaatagtgaaaagccatgggtctttcgaaagagataacgactatgatttgggtcaaaggaatagggaatcattggaaaaaggtgtaatcctagctgaggatggtgaagcacttttcaagaatgaaagatatgggaaaaatgtgttactgatgaggttatcgagtctggtggatggcagtagtgtgggccttttagtcaagcccagaccctcaaggaattgttcccttgaggatgctgagtttgaacttggtgtaaatgagggctgtcaagagttgaggaaattagaggcagtgggggagaaagccaacgaataa

SEQ ID NO: 79948 - DNA, 390 bp, Glycine max
  Peptide Sequence Number=SeqID_196726
atggctgagaagacaaagaaacaactagaggaagctgctcagtctggaagcactgagggtgtcattaacccttcatcccatcagacgacacgtgaaactgctgccattgggcgaccagaacaccctggccatgtccgtgctgctggagctggtggacttgcactgcctccgaagcctaaggttggtccctcaggtgctcgtgtcagcacaaaggagagttgtgttgatccctcagggaacgatccacagacaggtgactcagacaagtgcgggctatacattgaagaaaatccttcccgcctggttgccctaggaagactttatgagggatccacaacggttcacaacatccctttgttgcatggccaagtgaaggttggtgttaaggag

SEQ ID NO: 79949 - DNA, 237 bp, Glycine max
  Peptide Sequence Number=SeqID_196727
atggagcttgaagaggaactgatattgtacaagaaggaggctgtggggaagcatgaaaaagggtttcaaaaggtcgtcaggcaggtcgggttctttgccaaggatcttgacttgagtctttctgatcctttcaaggatgtgaaggatggtattttgcttgacgaaaacgaacttgctgcaaaggaggaggctgctgatgaggaacaagaagctgaggagtatggcgatgatgcctaa

SEQ ID NO: 79950 - DNA, 573 bp, Glycine max
  Peptide Sequence Number=SeqID_196728
atgaccacccttacacagatatggatgacgttgctacttagcaacattctgcccaatgaccacaactctgacctccccctgccgaagtgtcagttggtttatgccattctgacacagatgagtgtgcacgtggctcagctaatttctgacgccatttatcagtttgcaggtgttgcacccatgagacaccctgtggacccagagaagtccaatcgggccctggggtttcccgctctgatcatgggcctctgccagttctacggaatgcccttcacccccaggaaggtcatccggccgcctattaccagagccttcatcaagaaccagcaggcagccaaccacaggggtcaggtgtggctaaatgagagtttttatcagtacactctacaccagcagggccaggattctagcccttacacatggcctacgctagagcagtttgaggctacagtagcatggcctgaagattggcccaattttcagacaaaggcgaggcccgccgggacctttggaggtggggatgatgcccaggaggaagaggacatggccgacctgatagacttcctcctgtga

SEQ ID NO: 79951 - DNA, 216 bp, Glycine max
  Peptide Sequence Number=SeqID_196729
atggctaaattcgatccagagatagtcatggagttctatgctaatgtctggcctactgaggagggggtccatgatatgcactcctgggtgaggggccaatggattccttttgacacaaatgccctcagtcagttcctggggcacccactgatcttggcagagggccaacagtctttacaagacacttttacacgatctgaccgttgggatctttga

SEQ ID NO: 79952 - DNA, 207 bp, Glycine max
  Peptide Sequence Number=SeqID_196730
atggaatcttcgttagcaatggaatgttcatctcggtttgatgtttgcgtttgtggtatttgtgaaggtggcgtaaagggggatgaaggatggttgttgtatgaagatactggattattgaggtctatgttgttgtacggtaactgttgtggaggcggtagttgtagttgtggacatgagggttgtggagacgatggttgtggttga

SEQ ID NO: 79953 - DNA, 339 bp, Glycine max
  Peptide Sequence Number=SeqID_196731
atggtgtggccttatcccattgtattgaatcttaaatggaaaactaaggttcacttgcaatgtgataaagtttatcctgagagtattttcaaggaagactcttatgtccagtctgcagttacagttaatggtagtcctgaaagactgtggaaatcaaagttgtctgtttcagattttgacaagtctgagtcttctaccaaattgcccaagggagtaaaggaaaacacattgatggcaaaactccttgaagcaagattagaggcacaaaaatcttgctctagaacttgcaaaagcacttttggatcaactagagaagcttataatgagaatatcaaatag

SEQ ID NO: 79954 - DNA, 522 bp, Glycine max
  Peptide Sequence Number=SeqID_196732
atggctcaactcagttgtcacccaagtccttttcatatcaaacgagggaaaattatctgtctttctagtccacctggagtaggcaaaacaagtattggtcgttcaattacacgtgccttgaaccgtaagttctttcgattctctgtgggaggattagctgatgtggctgaaatcaagggtcatcaccgaacctatattggtgttatgccaaggaagatggttcaatgccttaagaatgtgggcacaaccaaccctcttgttttgattgatgagattgacaaagttctttttgtttgcactacaaattttgtggaaatgatacctaatcccctgttggatagaatggaggatgttgctattgctaggtatattactgatgagaaaatgcacattgctagagattatctggagaagacaactcgtgaagcttgtggaatagagcctaaacaagtatttatctttgctacctgttttgcaatcacttctcctgcaaagaatgggatgttcaaagtcttaacatag

SEQ ID NO: 79955 - DNA, 1887 bp, Glycine max
  Peptide Sequence Number=SeqID_196733
atgcgcaactgccccacgtgcagggtatcacggtacaaagtgaaggatgatgaatctagtgatgatgcaaccacatgtaatggtcgtccaacaaaagatccaataaatccaaggcttggtcttgctttagacggaatgaatccttttggaaacttaagcaccaaccacagtcatggcctgtttgttgatgatttacaaccttcctccttagttgtgcatgaagcgaaaatacattatgatgtgtatgatgatagcaagtataagactaaggaaatgatatttgatgtgtatcttactccattgatcaaagacataagaaaactatgggtagatggggttgatgtgtatgacgcaaatctccaggagacgttcaggtatgtcattgaagaagctattgagttttgttcaaagtacatggaaacaaccaagcctgttggccttcctcaaagtcatcatgagtccagacatggaggtaggggtacacaaggatacaatcttgtgacaatgggttggcaagaggctgatttggaacactttactagtgcatcagataaaaactcgattcgagcatccatggcttactttggcgtcattaaagaactctgggaacttgattacaatgaatttagagtttgtatgttcaagtgtcaatgggttaatggaattactagtatgcatcaagacgaattaggatttactcttgtaaaccttcgtaaggtggctaacaaggacaaccctttcatcatggcaaaacaagcaagacatgtcttttacatccaagattcgtgtgactcaacatggtcagtagttctacaaggaaaaagtaatagtatcagtcaccaaaatgatactttgacccttcatattggtgaaagtcctagtttctccccacaaatgccttcagtaaatgaagaacatgaggtggatgatgtacatgcaattcatgatgatcatgatgaaggtttatgggagaacattttgacggtgatggcaacacccccaaggtcaccttcgcatttagatgatcctttagagactacgtctaggaggagtaagcaatccacccagctgagaagcttgactagaaaatttgatatctcagaagcttcaaatgccaagaagaaggttatattgacggtcgccactagatggaggcaatttaagtcttcactcaccactaaatacatttattgtgacaataagggtgaagataaacaacatccttttgctaaatatggtcttgatccaaagacttgggaggaatttgcaaaaagtcgccttacccctaatttgcaggattcaacaatgatcctcgaccctccatcccccattgcaagacattttaagtggaagatggcttgcacaaagcgatatggacagatgacatctaagggaagctttgttccccatggacgtcacgacatattgaatactgtcattggaagactggagcatccaggtcgtgtttgtgtggcagggactggtgtgacaatcaatcaatactttggacatgcatcacgtgcctccaacaatccttgtacatcaatcagccaacaacaattccttgaaatgattggaaacatgaaggatgagttaaggaaagaagtagacggggaacacaagaagagtctagagaaaatcaaacaagaggttaaggaggccatcacacttgagttatcccaaaagtcatcgcaatactcacgctcgattgaggcctatatacaactattagctgcacgtgccattgacacattcattggatggttgatacatattgtaaaaactgtatcctatgaggattcagacattcatgagccgaaaccgattggagttgtcaaaggttccaataaagtggctggtgttgatccgatgggtgaattgatgtga

SEQ ID NO: 79956 - DNA, 210 bp, Glycine max
  Peptide Sequence Number=SeqID_196734
atgtatcagtcgcatattcgaggcgccaatgttgttatctcattgctagtagatattcgaggcctcaatcgcagaaagaagtatagcaaaggaatggcgaacatagatatcgaagggatcttaaagcagcaacctgatgatggactaatgaagtcaacagtattagccagtttgttggaacttgtgtttgttgaaacttgtgatagatga

SEQ ID NO: 79957 - DNA, 102 bp, Glycine max
  Peptide Sequence Number=SeqID_196735
atggtggattttacagacccaagaagaagaggctaccctggagaagggtttccttctagtgacagagacgaggcgcgagtgagagagatgaggtgcgagtga

SEQ ID NO: 79958 - DNA, 321 bp, Glycine max
  Peptide Sequence Number=SeqID_196736
atgataacctatatgacagtgtgcccaaacgatgaagggagatgggtaatgaaatccaaggcattgtctaacaagttgtttggtgtctttgtacaacccaggccaaaagaaaaaagcaacaaggtgagccacataagccttgatgccaaagtgtccaattgtaggagtggaatggaactcatggatgagatcatggcgcaccaaggaagagactatgaacaaaagggcaaccaattcagggatgtgagaaaaagcatcattaacttggttatgtttatcagagcaatagcttatgggggtactggtaagggtggatattaa

SEQ ID NO: 79959 - DNA, 267 bp, Glycine max
  Peptide Sequence Number=SeqID_196737
gataccgcggtcaatgctgtaaacagacctagcatcatgccatcagagctcaattcaagcagaatcggagaaaggcttcaagtcagtccccgcgagctaagaaagttttttagtaaggctgggatattctcctttaagtttaagtcagtacccagaagcaaggaattagaagtaagcagaagaggaaggctcgaacttgcagagtacttgactagcctgcttgactcgcatctctacttctctttcagagcctgcgccaatgagtaa

SEQ ID NO: 79960 - DNA, 426 bp, Glycine max
  Peptide Sequence Number=SeqID_196738
atgaccactcttacacatatatggatgacgttgctacttagcaacattctgcccaacgaccgcaatgccgatctccccctgcggaagtatcagttgggatcgcgcccacaagacacccagtggacccggagaagtccaacagagccctggggtttcctgcacgggttacgggcctctgtcagtcctacagggtgctcgtcccccccagcaaggtcataccatcgtgacataggtaaggatcgctcccgcaagacacccagtggacccggagaagtccaacagggtcttggggtttctagctctgatcacgggcctttgcaggcgcagggcaagacaccacagcagcctggggatggccggcagcgggcaacaaacgcaccgccaccacctctagagttcacctcagctcatccacaaaagggttag

SEQ ID NO: 79961 - DNA, 415 bp, Glycine max
  Peptide Sequence Number=SeqID_196739
cctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacgaatggggaacgggcccttcggggcctcttccccgggcgtcgaacagtcaactcagaactggtacggacaaggggaatccgactgtttaattaaaacaaagcattgcgatggtccctgcggatgttga

SEQ ID NO: 79962 - DNA, 355 bp, Glycine max
  Peptide Sequence Number=SeqID_196740
aacgcattcgacaagaaggtacgtccgcgcaagttcaacgagggggacctcgtgctgaaaaagacgtcccacgctattaaggatagtcgaggcaagtgggcctcgaattatgaaggacctttcgtggtgaaaagagctctttctgggggtgctctgatactcaccaacatggatggcgaggagctgccctcgccccaaggagcagaatcgtctcaggccacggttagaagtcaagacaagtcaatggcagaaatcaaccaagggacggatgcaagcggggatggggtcacgaccgaccgatcgttgccccttcccgacgctaaacaagcagagaacgtcgctgcaaggcagccca

SEQ ID NO: 79963 - DNA, 273 bp, Glycine max
  Peptide Sequence Number=SeqID_196741
atggaggatcaaaagatctcttttgacctctttgaagcaatgaaacactcagatatgggtgatgcctgtttcgaagaagaagaggtggagcaggaaatagcattattagcctcaaccatggtactacagtctcttttggaaaaagaacctggctataggagagatttcttagctcgtgatgaagagcttgatgattcaaaagacagttgtgttgaacaggtggtttttgtagaattggaaaaactgagaccagcagaaaagcccaaagcataa

SEQ ID NO: 79964 - DNA, 1017 bp, Glycine max
  Peptide Sequence Number=SeqID_196742
atgcgggcgtgctcaccctgccctcttcttgagcgcatgaccgcatcccattctggatcgtctaacgcttacaccgctgccacggagacgaactacttttttgaagtgtctgccacttcggagtcgagcgatgggtcttcgagtggcaacagcaccccgacaaacgggacaacttctaccggacagacagagagctctaaatcgccgaatagtagtaaaccgtctcctttatatggcgctctcgatcgctttgcgcaatttttcgtggcaccgcttttcttagagtcaacgctggaccgcgagctgagggcggtagattctgaaaacaagaagaacttgcaaagcgatctgtggcgtttaatgcaattaaacaagtctctctcgaatcctgcacatccctatcaccatttctccaccggcaatttgcagacgttgaaagaagagccgcaaaaacgcgggctgaacgttcgcgatgagttcatcaaattctatgagaagcattactcatctaatcggatgaagctggtggttctggggcgtgaaacattggatgaaatggagcaatgggttggagatctctttgctggcgtaaagaataagaatctgccacaaaaccgctgggacgatgttcagccttggttagccgacgatatgtgtaaacaggtttttgccaagcctgtaatggatactcgttcgcttgacatctacttccctttcctagatgaggagcatatgtatgagtcccaaccaagccgatacattagtcacttgattggccatgagggtcccggcagtattctggcctatgtgaaggcaaaaggttgggccaatggcttgtctgctggtgttatgcctatttgccctggatctgcatttttcactgtttcgatacggttgacaaaggagggtttacggcaataccgtgaagtcgcgaaggcagtatttgaatatattgcgttgatcaaggaacgggagcccgagcagtggatcttcgacgaaatgaagaatctagcagag

SEQ ID NO: 79965 - DNA, 1116 bp, Glycine max
  Peptide Sequence Number=SeqID_196743
atggaggcgatttccaagcgcgtcgccggtgaaggttatcctttcgcccgtgtaacgccgcgcggcgaccgcgacatgtccggcaacaccattggcgtgacctacatcgttgatcagggcgagcgcgcttacgtcgagcgtatcgaaatccgtggcaacacccgcacgcgtgactatgtcattcgtcgcgaattcgatatttctgaaggcgatgcgttcaaccagacggttatcaccgctgccaagcgtcgtctggaagcgctgggttacttctcgaaggtcaatatctcgaccgccggcggcagcgcgcctgaccgcgtcgtgatcgtggttgacgttgaagatcagtcgaccggttcgttcggtatcggcgccggttattcgcagaacgacggtgttctgctcgaagcctccatcgaagaaaagaacttcctcggccgcggtcagtatatccgtctcgctgccggtgcgggtgaagacgatgcgcgtagctacacgctgtcctttaccgagccttatttcctcggctaccgccttgctgcgggtttcgacctgttcaagagccagagccgcagcgaagattattacgactacgacgagcagggcttctcgctgcgcgtgaccgcgcctatcaccgaggatctctcgacgacgttcaagtatacctacaagcagctcaactatgatggtgagggtgactgggagaccggtagcaaccttgctgcaccttataaggacctgatccgcggtggcgattggacgcagtccatcatctccaacacgctgaactacaatacgctcgacgaccgcaacatgccgcgtgaaggctggcaggctgctttgacgaacgaatttgccggtctgggtggcgattccgaatattacaagatctatgccaaggcgcgtttctactacaccctgtcggatgagtacgatgtcatcggctcgctcaccggtcaggccggtcacgtgatgccgacgggcgacaatctgctggtattcgatcagttcaagttcggcggacgtcaggtgcgcggcttcaagaacgatggtatcggtccgcgcatcggttccgactccatcggcggcacgacctatttcgccgcctctgctgaa

SEQ ID NO: 79966 - DNA, 234 bp, Glycine max
  Peptide Sequence Number=SeqID_196744
atgaaacagaggcaaatgatgcacaagctgttcattaaagaaattgccacttggcggagagagggtgacatctttggatcagacacactggggatgacactcggggaaatagaagatttgatggaaagtgactcgacgtcgcattacaaacactcggcaatcttcaatggggatgatgccactaggacataccaaaatagtgacggggtaaagcccggcacatgcagcaactga

SEQ ID NO: 79967 - DNA, 250 bp, Glycine max
  Peptide Sequence Number=SeqID_196745
atggttgatgacatgcatggggccaaattggaggcttgtgcggccatggcacttagattggtgcctcacacggtcgtggggcccaaattagaggctcgtgcggcgaagctggcgttcttcccttcgtccctgatgtcgtgcaaggtggtgaagcaggaggcgacgacacttctattgatggagtcattcccgcactgcaagaatctggatcatgttgaggttctccagttcctgaaccgttgcagcacat

SEQ ID NO: 79968 - DNA, 270 bp, Glycine max
  Peptide Sequence Number=SeqID_196746
atggcaaaggggtgcggaatgaccaaattttgtctccgcatgtcatcgggcccgccgcctctggatgacaaagggtgcagaatgaccaaattttgtctctgcgcgccatcggacacgactgtgtctgaatggcaaaggggtgcggataaccgtaaggtgtctccgcgggttaccagctcttgggtcatgacagcaaaaggtggtgtggtcgaccaaagcaaggctcttgctcctacgtatcctcaaatgaggaactcagacctacggtag

SEQ ID NO: 79969 - DNA, 835 bp, Glycine max
  Peptide Sequence Number=SeqID_196747
atgtttcaacggctaaggaaatatcaactacggctgaatcccaacaaatgtactttcggtgttagatttggaaaactcttgggtttcattgttagccagaaaggtattgaggtagaccccgacaaggtcagagctatcagggaaatgcctgttccacaaacagagaaacatgtgagaggttttcttggacggttgaattacatctcccgtttcatttcgcacatgacaaccacgtgcagacccgtattcaagctgcttcgaaaagatcagggtgttgtttggactgaagattgtcaaaaggcttttgatcgcatcaagaattatctgctagaacctccaattcttatccctccagttgagggaaagcctctgattatgtacttgattgtgttagaagattctatgggttatgtgcttggacaacaagacgagaccggaaggaaagagcatgccatttactacttgagcaagaagtttacagattgtgagtccaggtactccctacttgagaagacttgttgtgcactagcatgggctgccaagcgtcttcgccactacatgattaaccacaccacctggttaatatccaagatggacccgatcaagtatatctttgagaaaccagctttgacaggaagaattgctcgttggcagatgttgttgtccgagtatgacatcgagtaccgcactcagaaagccatcaagggtagtattcttgctgatcatttggctcaccaaccaattgaggactaccaacccatcaagtttgactttcctgatgaagaggttatgtatttgaagatgaaggattgtgatgaaccattgcctggagaag

SEQ ID NO: 79970 - DNA, 533 bp, Glycine max
  Peptide Sequence Number=SeqID_196748
atgacggatgaaggctgggcatgcccggtcttttcagacagaaagtgtaaatcgcggcaaggccccctcaccggacaagccatgccgcccggaaccatttgcccgagtcgtggccgtggcgacgggcgccaaccaggtggtggcctcctccgtttcaggctcgatcacccatttccggcgtggaaccctcgacgtcaagctcggcagcgttctgctcgtcggcggcctcctgggggcgacggtcggcgtgtggatattctccttcctgcgcagcatcggccagctcgatctcatcatttcgctgctctacgtcatcctgctcggcaccgtaggcgggttgatgctgaaggaaagcatttcggcacttcgccgcgccgcccgcaacgaaacggtgacgctgcgccggccgggacaccacaactgggtacaccgcctgccgctgaaaatgcggttcaagaaatcgaagatctatctcagcatcattccagtcgtcacgctcggtttcggcatcggcatactcacctccatcatgg

SEQ ID NO: 79971 - DNA, 315 bp, Glycine max
  misc_feature (119)..(119): n is a, c, g, or t
  Peptide Sequence Number=SeqID_196749
atgttatccgaagagcaagagaggatcactgagcctgtggcacatggtccagcatcagagcgtcgatttccgccacaacaatttcacatgctttcgtccagtgtggaaactcgaggttntgacagacgaagggagattgttcaagcagaagattttttccaacaaatggagcagcgtggccatggaatgtactacacgctaccaacattttctcagtatccttcgcagatgtatcagtatcctttcgtatggtggtgttgcggaaacacatcctcatttttcatggccgaccatgaccccttcgcagcaacatga

SEQ ID NO: 79972 - DNA, 156 bp, Glycine max
  Peptide Sequence Number=SeqID_196750
atggctactccacctgtctcgcctcctcctccttctgcttctcctcttcctcccgcagtagcagcagtgtctccgtccacccagaaacggacacgcaaagtggaatttaaaatccatgaagcttctgatagtaggacaaagatgaaagttctttag

SEQ ID NO: 79973 - DNA, 624 bp, Glycine max
  Peptide Sequence Number=SeqID_196751
atgcatgaacgacaatcaattcatggggctccgaacaaaagtggagaatggagaattacactaggtaatcactacgcatggttccaaactcacgggtggaggatgcacgaacgacaatcaattcatggggctccgaataaaaggcgagaatggagaattgcactaggcaatcacaacgcatggctccagactcacgggtggaggatgcatgaacgacaatcaattaatggggctccgaaaaaaagtggagaatggagaattgcactaggcaatcactacgcatggctccaaactcacgggtggaggatgcatgaacgacaatcaattcatggggctccgaacaaaagtggagaatggagaatagcactaggcaatcacaacacatggctccaaactcgttggtggaggacgcatgaacgacaatcaattcaagggactccgaataaaaggggagaatggggaattgcactaggcaatcactacgcatggttccaaactcgtgggtggaggatgcatgaacgacaatcaattcatggggctccgaataaaaggcgagaatggagaattgcactaggaaatcactacgcatggttccaaactcgtgggtggaggatgcatgaatga

SEQ ID NO: 79974 - DNA, 201 bp, Glycine max
  Peptide Sequence Number=SeqID_196752
atgacaagcaacgacaactcatggcaaccactagtggtcattggtggtggagaaggaggtgttaaggtttgggtggcgtttggagaggatgagagagtgaaaatcatgtttttcatgctgaagaacatatttataatctgcagatctcgcttagcgagctcgtctcacttagcagaagtccacttttcatacttagcatga

SEQ ID NO: 79975 - DNA, 351 bp, Glycine max
  Peptide Sequence Number=SeqID_196753
atggctattgtggaagaggacgtaaaagcgctcggcgtcacccgcttcttcaaagagcagttcttcacgccggtggcagaggcggcaaccagcgggatccagttcaccagactgcaaccggcgcagaccttctttggccgcgtgggcaccacgctgctggaggcgctggagagcaataaagtaccggtggctgcagcctgtcgtgctggcgtgtgtgggtgctgtaaaacgaaagtggtgtccggtgattataccgtcaccagcaccatgacgctgacggacgcagagatcgcggaaggttacgtgctggcgtgttcgtgccatccgcagggcgatctggtcctcgcataa

SEQ ID NO: 79976 - DNA, 417 bp, Glycine max
  Peptide Sequence Number=SeqID_196754
atggctgtaaatgaaaagctcgcgtgtgacgatctcggtaaactcttgttacgacttgccgtcggcgggctgatgctgtttcacggtttacacaagttgtttggcggcgtcgggtttatcagcggcatgctggtggaaaaaggattgccgggatttatcgcttacggtgtgctgattggcgaagtggtggcaccgatcctgattatcgtcgggctcttcacgcgcccggcggcgctggtgctggcgttcaccatgatcgtggcatggctgatggtgggcacgggcaaaacctttgcgctggatgccgtgggggcctgggcgattgagagcctgatgtacttctttatcggctcgctggcggtggcgtttttaggagccgggcgttacgcgctggggaaagcgcccccgtggcggtag

SEQ ID NO: 79977 - DNA, 438 bp, Glycine max
  Peptide Sequence Number=SeqID_196755
atgtttccgaaagaactactccttccggaaaatttttggaagaggtgttccgggagctttccggaagacctgttcttccggaatacgttttattacttccggaatatcccctcttccggaaatcttccggaagaccttcttccggaagttccggaagaacccctaacgggtcttccggaaggcgccaccgtcaccaagctttcgccattttttttcggcgtcctctaccctaagtgcataacaaaaccaaagctaagaggaaggccacctaccttgaatgcaaatgggtccaagggctggcggagaagcctcgcgaagaagaagaccaccaaggaagcttccgcggaagagagaagaggaaggaagctttcgcggaagagagaaaatgaagaagacagaatgcttccgaaagaaggaaaaagctttttatgtttttaa

SEQ ID NO: 79978 - DNA, 198 bp, Glycine max
  Peptide Sequence Number=SeqID_196756
atggtatcaagtgggggaattgtggcagtgctaagggaagtctcccttgaaaggagaagatatctattttatccatttaaatttcagttcaaaactcaaagtattcaagccatggtggagttaagaagacaatattccaaaactgacaacaaccagaatttcaacctagaaatcaagagtagtgtttatgttgcttaa

SEQ ID NO: 79979 - DNA, 678 bp, Glycine max
  Peptide Sequence Number=SeqID_196757
atgacaacagaactgacaaaaagacaaaaaatgaaaaaccgtgagatatttaacaaatggcaagctcaaagatggtgggcagagaactatgacaaggtgatggaactttacaatgtgcaaaggcttaatcgtcaagctttccctcttccaactccgcctagatctgaagacgagagttcaaagcgtgaatcaatagaagatttcccagtgacacctccactgagcagggaaaggccaccatgtaacttattccgtgcaggaggaggagggatgggaatggggtactcatcctcagattcatttgatcatcactcaatgcaatcatcccggcattactatgaccccaatgacgttaactcaaccccaaaagcttcttccaccattagtgctgctgccaagacagatatctcatcatcaatggatgttgatgcttccataagaagtagctcttctagagaagctgatcgctctggggacctgtcaatcagcaatgccagtgaccttgacactgaatgggttgagcaggatgagcctggggtttacatcaccatcagagctctcccaggtggcaaaaaggagctcagacgagtcaggttcagtcgagaaaagtttggtgagatgcatgctagactgtggtgggaagagaaccgtgccagaatacatgaacaatacttgtga

SEQ ID NO: 79980 - DNA, 516 bp, Glycine max
  Peptide Sequence Number=SeqID_196758
atggcaaaagatcttgttagaacaaggcatcaggttgagaaattttataagctaaaatctcagctccaaggtgtatcactcagaattcagactttgaaatcaacacaagcaatgggtgaggctatgaaaggcgtgacaaaggccatggggcaaatgaataggcagatgaacttgccatcattgcagaaaatcatgcaagaatttgagagacagaatgagaagatggaattgacatctgagatgatgggagatgcaatagatgatgctttggaaggagaagaagatgaagaggaaactgaagacctagttaaccaagttcttgatgagattggcattgacattaaccaagagcttgtaaatgcaccatcatcagctgttgctgccccggctgcaaagacaaaggtaccacaagttgaaacgactgggaatgatgatggagggatagatagtgatttacaggcaagggactctagttttactgggaaaattgatgctcatttgtaccatatagcataa

SEQ ID NO: 79981 - DNA, 567 bp, Glycine max
  Peptide Sequence Number=SeqID_196759
atgggcgatgttctaagccccttcacaatctcatcccctcctccaccctcctccccatcaaccaagaacaacagcatgcccatgttgtactacggtctcgtggtggtcggaaccgcggccatagtgctagccatatacaacctcgtcctcctaagacggagccaaacgcgccacgcgcggccggcgcaaagtatcacgcataatagagatattgtacaagttgtttccgaaagaacaaggagcttcgaggacagccaacaacgaaacttgttgtcgagcttcaagtacaagaaagaagtagtggcaaaagaagaagaagaagaagaagaagaagagcaagatgatgagtttgagtgctccgtttgcttatcggtttacgaagaaggcgaagaggtgagaaagcttccacagtgcaagcactatttccacgttctttgcatagacatgtggctttactcccacttggattgcccaatttgtagaactcccgttgatgttttgtgtccgggggagaattctcctgatgggatgatggaatccggtgctggaatggcagcatctctctag

SEQ ID NO: 79982 - DNA, 591 bp, Glycine max
  Peptide Sequence Number=SeqID_196760
atgtttgttcaccggaacaatgcaaacacagctacattggctgaagttgcggagacattacagtatatagtgtcaccacatgggaggaacacatggacagttgataatctcgtgccttatgtggagaagataacgattttatccaaagagcaagtgagaatcattgagcccgtgtcacatggtccagcatcagagcgtcaatttccagcacaagagtttcacattcttcagtcaaatgttgaaactcagggtataggcagacgaagggaggctgttgaagcagaagaatattcgcaacaaatggtggaccgtggccatggaatgtattacacgccaccaacattttctcagtatccttcacagatgtatcaatatcctttcgaaggtcatcacattgatacttttgcaagcgaacattcgttcggtggtgttgcggaaacacatcctcatttttcatggccgactatgaccccttcacagcaacatgatgtcccaattgtaacacctaacgccagaagaaatcctgatcgtcaagtacgaagattatgggatcaaccatgtgtgccgtcaacttgtatgattggcttataa

SEQ ID NO: 79983 - DNA, 270 bp, Glycine max
  Peptide Sequence Number=SeqID_196761
atggcgaaagaaggagaagaaatggcatttttccaaagctacttggactacaaggctcaaaatgcacaagtgactaatgctctcggaaacatcatggacaagtgttctatgaagctccagaccaaatttcgagaagatccaatggttaaagaaggctgggcagcatttttaccgagacagcttcatgtagcttccttgagaagcttcattaagaggcttcctcatggcttctttgaaaagttttctcgagagacttctttgacaagctag

SEQ ID NO: 79984 - DNA, 807 bp, Glycine max
  Peptide Sequence Number=SeqID_196762
atggacaagctgctctatggaaaggcttgcccagacgaaggtgacacgaaggctctcaacaccttcttgaggacaacaaacctgacctacatgtgtaggatgatccacaacatgttgttcaacatagtcatgcgcagggttggcttcagagatcgtttctacatctataagattatggtaggtgaaaaggtgaatcttcctgagatcatctttttagattggatgcaagtgtttaaggataggtttaaccccaaggtgaagaagaaccatattccttttggaatattcttcacccggatcctgaggcttgctggggtggaggtttcctttatggagccatcggttagtgccactcaactgaagggggcaacctttgtgaagatagcaattgctgaaaaatttcctaagtatatgcaaaggcacataaagaagaaagtgaaaaaggagaccttgacaagggaaaaggagctacgacagacaactaccagtgatcaactacctaatgaagtggtacttgaagctgtcaaacctaggtttgaagaaaagttgtggaaggcagagtttgatgtcaaagtacaatcagccttggaaacaagtgctaaaatattttctatagcatctactgcaagagacacagagctccaaccaactatgtctgtcattgaagtatcattccaagggtttgatattggtgtcatttcaaactctattgaaacaaaccctagagttgcaccactgcactcccatccagtaataatcgatgatgaagctattcttgatgctttgcttgctaaaccaatgtcataa

SEQ ID NO: 79985 - DNA, 441 bp, Glycine max
  Peptide Sequence Number=SeqID_196763
atgtctaagggtactgactatgttggacccaaaaagatatgggtaccaaaatctcaaatagtgcatgttatagatatccttggtaggaaaagtccagggtttaagatggtacctggacaatggatgctcacgacacatgataggggaaagtatatgttcctaaacctaaatccacatgaaggaggatcagttgcctttggaggcataggtaagggaaaaatctctagtatagacaaagttcttattccctctctagcctccatagacaaagtcttagatcaggctgaaggagtcaagaccagatcatcattcaaggatcttgctttatgtgctcttgtgtttgaaataaagcccaataccatagaagaagctctaacagataatgattggatcactgctatggaagaagagcttcaccagtttaccagaaacaatatctag

SEQ ID NO: 79986 - DNA, 309 bp, Glycine max
  Peptide Sequence Number=SeqID_196764
atgatgaagagtcttggccaacccaccaccgaagaagagattaagaggatgattcaagaggttgacgtggagggtgatggccacattaacttaggtgagttcttggagttgaacaccaagggcgcggaccccgacgagattttggagaatctgaaggacgttttttccatcttcaacatcgacggtaatgggtcgattatcgccgaagaacttaacatggtcatggcgagccttggagacgcgtgttccatcgacgagtgccagaagatgatcgtcggcgtcgactgtaataaattttataattcttaa

SEQ ID NO: 79987 - DNA, 1086 bp, Glycine max
  Peptide Sequence Number=SeqID_196765
atgattgttgtgattctaaacaaggaaactatattggctgagtttgagatcattgggaatccgaagccatatatggattctgataaaccgactgtgagagcttcagctgattgcacttggagaatttgcccaggactagtaatagttctgctgcccaaaatgcaaagtcataataacacacagaatttcaggccaacaattcaaccaccataccaaccgcctccactttacaaaggctgtgggccagtggtgaaaaatgaggtgccagcacgcatcgttcctaaagctgctttaaatccttatcaatgtcggtgggctatcaaagcaagggtaactgctaaagtggatctgcgtcgctataataatgctcgtggtgatgggaacatcttcttatttgatctgcttgattctgatggaggtgaaatacgagttctgatggaagtgaaatacgatgacatctgtgaatccttcagttcctatcttgaggaagaatggaatggaaacccaaagaagaattttgagtctgaaggacagttctggcaggaggttgaacttacactgtggggcgaattctgcaacagggaaggacaacagctgcaagagatggtggatactggatctttcctaattttagcagtcaaagctgggaaggtgaatgattttagtggaaagtcaataggttctatttctaccacgcagcttttcataaatcctgattttcctgaggctcatagcctaagagaatggtttgatcgggtaggaaaagattctgcctccctatcaatttctaaggacattattcctggagcagtgaagaataaggtacgcaaaactgtgtctcaaatgaaggatgaaggtctagggcggtcagacaagccagactggatcattgtaagggctgctatattattcatcaaaacagatacattttgttgcacagcttgccctctgatgattggagatcgccggtgcaataagaaagtgactaggtcaggaaacactaggtggcaatgtgatagatgcaaccaagagtttgaggaggggaagagattatggagtactcagcaaaggatctgtactttttga

SEQ ID NO: 79988 - DNA, 918 bp, Glycine max
  Peptide Sequence Number=SeqID_196766
atggtgtacggtggtgcaggtcccgtaggtggttcgggttcggcatcaacaataaagcaagtgtttacttggtatggtgcaaccattgaaatggatggtgctactgaaactgattatactgctgatgtgactccaatggttagttatgtaaatctgcatgttgtgctagatggaagaagaagtcgtgcgaaagcctcaccaccagatgattctggttcttctcaggaaattgcagacaattccagctcatgtgttgcagctgaaatcgcagtttcagacatatttttaaaaccttgtgacattttgtggtatgtgaattttgtgaatttggttggtcagggccctagggtcattgttgtaggacctactgattctggaaagagtaccttgtcgaggatgcttcttagtagggcagttaaacaaggttggaagcctacctttgttgatctggatattggccaagggtctataacaattcctaaatgcattgccgccactccaattgaaatgtcaatcgatcttgtggaaggcattccacttgaaatgcctcttgtttactattatgggcacacgactcctaggcaatttactggaaatgctgaatctagagctttaggcatggtgataaatactatgggatggatagagggtgtagttgctcttgcatgcaattcgtacattcaaggccaatgttgtcttggttttgggtcagaatcaggaaaatcatcaaatgggccagaaaaggattactctttaataggtgacacaacaaatcgcttatttggaatctttaatgccattcccatcattgccaacacttatggtagcggaatagttccagaaattcaggcaacgttagcaccctcggtagaaggggaaatgctcaaatttaaggactatgcgtttgttatgttgtag

SEQ ID NO: 79989 - DNA, 270 bp, Glycine max
  Peptide Sequence Number=SeqID_196767
atgtcgctgaatctcacagcaaacacgattccggtgataatcggcggcaacgtgaatgcgaaactgcttgttcaggttctggacatggcgctaatctccaacagcaaaaactcgcaacaacagagataccgtcttcttggttataaaaggggattaatacccactaacgtgaaaaaaggtctcattcctaacaaaaaagtgttctctctcactcatagtcatcacgaatggagaaaggcagaaagaaaggtcgaaggaagtgaaatctaa

SEQ ID NO: 79990 - DNA, 228 bp, Glycine max
  Peptide Sequence Number=SeqID_196768
atggcaccgaagaagctttctgcgaagagatctaggagggacgccgcgactaaagggaccagtgtcacccccgagtttgatagccaccattttaggagtgccaagcaccagcagcatttcgaggccatcaaaggatggtcattccacacagagagacgtgtccagctcagggacgatgagtacacatattttcaggaagagatagctcgccgacattggacgtcgctg

SEQ ID NO: 79991 - DNA, 264 bp, Glycine max
  Peptide Sequence Number=SeqID_196769
atgggaaaaggaaaaagaaggcagcacaatcaaaagagtgataagccaaatgaggaatcctcgcaaaagctatggacgcctttgacaagattcaagaggttcacttcaataactcacaacgaggcccaagttaaggtgcaaagaaggttgctagaagcattagtaaggagagtagattgtatggtttttagttgtatgagaagtagagagagaccaaaattaatgatccatgctggactcaaacttatgagtgggatcctctag

SEQ ID NO: 79992 - DNA, 378 bp, Glycine max
  Peptide Sequence Number=SeqID_196770
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagatgaatgtggctatataaatcttgtgatagatttttgttatgctgaaacgtccgccttagctaaagcatcatacaaggcgtggactgagatcggttga

SEQ ID NO: 79993 - DNA, 591 bp, Glycine max
  Peptide Sequence Number=SeqID_196771
atgtcgtttgagtcggggatggtcatggaggaacacgactcggagaaggtggagatcgtcctcaaaaccattggtcctgcacgcccctctcgccttctcgtttcttcttccatcaaggtgcgtgatttgaggagattaattgctgggaatgataatttgcaaattgacaacttgagtcttattttacgcggaagtgcactgtatgacatgaaaaatggagatgatgtatacatacaacttaatgatggagattgcttgattgttgctgtcaaaccaaagccaccagtgaaagatggatatgacaatgatgacgaggatgaagatctgaagtttcggcttcctcagtcatcaagttggtggaagaagaggttgtacacttttctacacgataacttgaagcttccagatatccttttgatggtaattttcactctgagtctgaaggcatggcttctcataattttgtggtttatcctggctcctgttgcccatagatgggatctcggacctttgtatgataaggttgtgtacaataaccctcccccataccttcgcatagcgaggaacctccggggcactgtgctatgctag

SEQ ID NO: 79994 - DNA, 696 bp, Glycine max
  Peptide Sequence Number=SeqID_196772
atggtggttaccttcttccctcgaatgacaacaccggattcaccttggatgaccatatatttggtgccaccgagatacaatcctattggagcaagagatccaggcttgttaaagtcatccatgatggcagttatctcctcagagcaggaatctgaacaacatcagcatggaccctctgaagctcctaagtcaagtgctgcgctttggaaacaagttcatccctcgacacaacaaggttctgtgcctccccacgcgcctactgcaactctatcttcacgctctccgagccctgcgcctcactttccattttcacgatcttctccagctgcgcacgaatctgctgctcccgctccctcttcagcgccaccatgtgcccgtgaagcatctgcatctcatgttgcgccaccgccagctcctgccgcagcacactgtgcgtcgcggccaggcgctggttctctgtcgccagacattgcatctccgcatgctgtggcgccagcttctccttcatcacctgaggcggagggagcaaatcaaacggcaccacgatcgggagcagcattgcggcggggtcctgcgggtgcggccgccgcagatcccgttcttgaacttgccactaatctccgcgaaatcgtttcggatacactgttgatgcggcacaacagaagctctcagcgtcgaggttgtcacgttgcttag

SEQ ID NO: 79995 - DNA, 189 bp, Glycine max
  Peptide Sequence Number=SeqID_196773
atggtacgcgacgaagggcaacatcgatgggcgtgtcgatttgggttcaattgggagatgcaatcgaaagccattttgagaaagtttgaacccatgaaccccctcactttcccacctccctccatcatcgttctgctaagctgcgatgtggaaggtaagaaccccttacccctctatcgaaggcgttag

SEQ ID NO: 79996 - DNA, 249 bp, Glycine max
  Peptide Sequence Number=SeqID_196774
atggctgttcacttgtttgaatgtgttgcacacattgtgacacatctagaagaggatgaagtcatagcctttgaacttgttgaagaccttgttgctgacgaccttgcagtccttaatgtcatgctaccagaatgtgctaatcctcgttggccaccttgtagacactactacaaatatgctattctacgacgtgccttcaacgacggtggtaccaaaaacaacattgttttagacgcggtggcattttag

SEQ ID NO: 79997 - DNA, 267 bp, Glycine max
  Peptide Sequence Number=SeqID_196775
atggagtggggcccactggggttcctttacctccggttcatgagacccaccaagatttttgagatcaatgagcacgtcggtcgacacggaggccgaaaagtggcgccactagtcctcttcttcctcacaatctctgtggtggcagtgcaagccaaggtgatcctacaatgcacccatctataccctcatgaaccggtaggtttgagaaccaaatcaagagtcatcattagaccatcatcgatcccaaatttcggtagtggcaagtag

SEQ ID NO: 79998 - DNA, 138 bp, Glycine max
  Peptide Sequence Number=SeqID_196776
atgactaaaattcaaagaaagaccaatgaagttccagaggatgttttgtctgtatgggtcttagcaatggatgttgtacttgagatcgatgaattgaagtctgtggaatcgaatgatagtctagatagacaatactaa

SEQ ID NO: 79999 - DNA, 204 bp, Glycine max
  Peptide Sequence Number=SeqID_196777
atggagtcaggtggcatgcgggggcactgtatggttttccgcacctttgttcaaccaggggcaaacgaccccgttgacgggcagagattaacttctttttccgcacctttggtcatcttgacccagggagttaggggacatgcgggggtcccgtatggtttttactttattcgtccagagacatgcaagccggatgacgcataa

SEQ ID NO: 80000 - DNA, 426 bp, Glycine max
  Peptide Sequence Number=SeqID_196778
atgcttaaggcattacgggccaatgcacctctcccttaccctcagttgataaccttgtttctgcgtcattttcaaattccgcttgatgatgaaccatttgttcaagtcaagcattcctttgcaattggtgctggtgcagtgacttcctttggttaccgtaaggatcagaatagtcaatggctgaagaaagacgcactccctcctcaagatgagcgtactccttcacctcctccccagcgagctgactcagcactcatgaatgaagtcctttccgaattacggggtcttcgttcttattttgatgaacgttttgactcattggatacacgttttgccggcatggatattcgcctcacacagcttgaagaggatgtgggttacattcgtcagagtttcgatcttccaccaccacctccaccttcttag

SEQ ID NO: 80001 - DNA, 1101 bp, Glycine max
  Peptide Sequence Number=SeqID_196779
atgtcggaatcgtcgaatttcgtcaacgggaaaccgatcattccggttctcaacgaacggactctgccgaagttcatggaatccgcgagggaggcgaagaccgtcagcagaaacagtaaccggttgaaattgttctctggcagggccaatcccactctctctcaggaaattgctcggtacatgggcctggaactcggaaagatttccatcaagcgatttgctgatggtgaaatatatgtccagttacaagagagtgttagaggttgcaatgtttaccttatacagccaacctgccctcccgcaaatgagaatctcatggagcttaaaataatgattgatgcttgtcggagagcatcggccaaaaatatcactgctgtgattccatacttcggatatgccagagctgatagaaaggcaagtattttggatgcaactacaagatcccgctactcattgactcaagggcgtgaatcaattgcggctaaacttgttgcgaaccttattacaaaagctggggcagaccgtgttcttgcttgtgaccttcattcagggcagtccatgggttactttgatattcctgtggatcatgtacactgtcaacccgtgatccttgattaccttgccagtaagatgataagttcaagtgacttggtggtggtttccccagatgttggtggtgttgcaagagcacgtgcttttgcaaagaaattatctgatgcacctttagctattgtagacaagaggcgccatggacacaatgttgctgaggtgatgaacctgattggtgatgtaaaaggaaaagttgctgtaatggtagatgatatgatcgacactgctgggaccattgctgagggtgcagcactcttgcatgaagagggggctagggaagtgtatgcatgctgcactcatgctgttttcagtcctccagcaattgagaggttgtccagtggcttgtttcacgaggtgattatcacaaacaccattccagttgcggagaagaactattttccccagttaacgattattactgtagcaaaccttttgggtgaaactatttggcgtgttcatgatgatagttctgttagtagtatttttcagtga

SEQ ID NO: 80002 - DNA, 963 bp, Glycine max
  Peptide Sequence Number=SeqID_196780
atggcatcaaatggagaggatctatatgtcatggatgaaaatgaatctcccaccaatggcaacaggaagattctccacaccgaagggttcaagtttctggatagagcagcgattatatcttccagagatctagaagaccaaaagagtggcgtttataacccctggcgtctctgccctataactcaagttgaagaagtgaagtgcatactaagacttcttcctatttggctttgcacgataatatactcagtggttttcacacaaatggcttctctttttgtggagcaaggggctgccatgaaaactacaatttcccatttcagaataccacctgcaagcatgtctagctttgacatcctcagcgtagctgtcttcattttcttctaccgtcgagtgattgatccacttgtcggaagacttaaaaagaaaagttccaagggacttactgagcttcagagaatgggaatagggcttgttatagctgtaatggcaatggtttcagctggaatagttgaatgctacagacttaagtatgcagacccagtatgcccccactgcagtggcacaagctctttaaccatcttttggcaaattcctcagtacacacttattggagcttcagaggttttcatgtatgtaggccagttagagttcttcaatgctcagacgccagatggcttaaagagcttcggaagtgccctttgcatgacgtccatatctcttgggaactacgtaagtagcttacttgttagtatagttatgaagatctccactgaggatcacatgccagggtggatccctggaaacttaaacagaggtcacctagataggttttacttcctcttagctatcttgacatctatagatttggtcctttatattgcatgtgcaaagtggttcaagagtatacagctggaagggaaatatgaagagaatgatatgcctggtagctttaaagtctaa

SEQ ID NO: 80003 - DNA, 235 bp, Glycine max
  Peptide Sequence Number=SeqID_196781
gccgtgttgggcgtcatcaccctccatgtggttgcctcgtatccccaggcccgtgcccagtggcgtcaggggcgtggctcctccgtggaggtgtctctcctttgttgcattatcaagaccgtgttgcgcaccatcgccctccatgtggttgtctcgcatcgccagaccctgcgcccaatggtgtaaggggcgtgcctcctatgtggaggtgtctcccctttgttgcactatcaag

SEQ ID NO: 80004 - DNA, 210 bp, Glycine max
  Peptide Sequence Number=SeqID_196782
atgaacatgctcttgactcgacatcgtttgttctgttccactagaacttattgttttggggacgggaaagcagttgatgatccgcaggaattaaccttctatttgtatgattctttcatagaaagaaaaaatggtatgttgctgccatttttgaaaagattgaagattcccgaagtaatgcctaaacccaatgattcaaagaaaagctaa

SEQ ID NO: 80005 - DNA, 351 bp, Glycine max
  Peptide Sequence Number=SeqID_196783
atgcatggtagtagtaatggggtggaagaagctaaccacatgctaataggtgtttgtatgttaaacgtagttgtaaaacctggacactggacctggtctggtggccggaaaaaagaaaaggcatatagttatatggataacaaatcaccgagcaaggagtccaaggaggtgacacgagagtcgcttattgctatttctaactctttacctgataagactctggaatcaacttctgccttagagagcaagaaatcagacggggttatgataccaaaccgtgatcaagatgacaagtttaggtctgaactgatttcaatttcttatgctgaatcccctgatgacaaaatctga

SEQ ID NO: 80006 - DNA, 2214 bp, Glycine max
  Peptide Sequence Number=SeqID_196784
atgggttgcttacactcaaaaaccgcacatcttcactcccctgaagaccctcctactgccttgccagactccaaaaaacccgatccagggaatggtggtgatgatgttgatcaagagtgtcaggttcaagcattcaaagagtatggtctgattgagcttagaagggccacaaatgagttcagcacagattacattgtttctgagagtggtgagaaagctcccaatgtggtctacagagggaagcttgagaacaatcggttagttgctgtgaaacgcttctccaaactgtcttggcctgatgctcaacagttcatggcagaggcagctggagttgggaaagtgaggcacaagagaatggtgaatctaattggttgttgtgctgaaggagatgaaaggctcttggttgctgagtacatgccaaatgatactttgtccaaacatctctttcactgggacaagcaaccattaccatgggaaatgcgtgtcagagttgcataccatgttgcccaggcactagatcattgtagcttggaaaaccataaaatatatcatgatctgaatgcatataggattctttttgatgaggatggtgatccccgcttatctagttttgggcttatgaaaaatagtcgagatgggaaaagctacagtactaatttagcttatactccacctgaatttttgcgaacaggcaggataatcccagagagtgtgatctacagttatggaactgttcttctggatcttttaagtggcaagcacattcctccaagccatgctttggacctaatcagagggaaaaatgttttgttgttgatggactcttctctagaagggcaatatgcaaacgacgatgctacaaagttggttgagcttgcttcaaaatgtcttcagtttgaggccagagaacgacctgaaattaagttccttcttactgccgttgcgcctcttcaaaggcagaaagaggtagcatctcttgtgttaatgggcctaactaaaaacaccgcagtggcagtgctaccaaccatgctttctcctcttggaaaggcttgtgctaggatggatcttactgctgtgcatgatatattgttaaaaacaggttataaagatgaagaaggtgcagaaaatgagctttcattccaagaatggacacaacaagtacaagatatcttgaacacaaaaaagtttggggatattgcattcagagacaaggatttcaaaaatgcaatcgagtattattctaagttggtggttatgatgtctgttccttctgctactgtgtttgcaaggagagccttctcctacttgatgaatgatcaagcagaacttgcattaagagatgccatgcaagcacaggtatgcataccggattggccaactgcattctacttgcaggctcttgccctctcaaagctgggaatggaaactgatgcacatgacatgcttaatgatggagctgcctttgaagcaaagagacaagatggatggcgttggatcgtaggactgaggatcctctctatcgaaattcctggcagtgggtctagtctatcatgtggtagagactcacatttgaggaggagattgatggagtacaagtatgaggttaaagtgtggaagtgtggtgtcaagttcacttatgtggttattcatggctcattggtatggcgcttaactcttggggccaaattcgaagtgggaaaatttgatggagcttggaatttcggaatgtggcaaaggcgagttaaggatttgttggcacaacaagacgaggtcctctatcacgtgatggagttaaagtctctgggggagggttcatatctccaacagcacatgaatgtcttcaatcaaattatcagtgatctcacaaggtttgatgtaaaggttgaggacaaggataagacatgtattttgttgtgttctttgccttcttcttacgaacatttggtgacaaccttaatgtacgggaaaaattcaattagtctggaggcaatacaggttgcacttatgtctcactctcaatggagacaaaatgcaatggggagtttgcaagacgatggtatgtacgtgaagggaaaacaagaacgtggaaggacacaagacaagggttctagtggtaggaagaagtccaagtccagagaacacaagaaaacaatggaggctaccatgtggatgagactcacacttaagggagagattgttagagtacaagtgtaa

SEQ ID NO: 80007 - DNA, 447 bp, Glycine max
  Peptide Sequence Number=SeqID_196785
atgactcatcctccacatgctgaggtacctgggctgtgggaccttcatcttccctgtgaagaaaaggctaccatctcagtgaactactccactgaaggaatagatcctcgaggtgccaccacctgggctgctgaagtggatgctggagtaggagttgcagaagtagaaggaagctcagctggccttgccctcgcccttctagcccctcagatagaaactgttagatcctcggggttccaacaattcttcctgatagcagggaacctaagtctagaagtgttagaatgggctatagagatcatctggcctgagatcatcgcccctatgttcatatccaagcgagaaactaggccaaagatcagcctagctctatccactgtcaagccagaagtgtgtgatgtgggggccaagttggagtatgagaggacactccgtgggatcctctag

SEQ ID NO: 80008 - DNA, 267 bp, Glycine max
  Peptide Sequence Number=SeqID_196786
atggataaagttgatatctttgtccctcatcctctcacaaacgcatgtttgcttattcaactttcaccggaatgtgggtgtaagccattggtctatttgctcaagcaacctgcgctcctgagtgttgacttccaagaccgttcaatcagagattactcatcttgcacgttggaatcctctacaacaagagacccacggtctcttaatcccttttcagaaataagaagaagagaagaagaggtctctcataaaagaggtagattgtaa

SEQ ID NO: 80009 - DNA, 174 bp, Glycine max
  Peptide Sequence Number=SeqID_196787
atgggctttccctttgctggcgattttagcattcgttattcgctctcccttgttgagatcctgctgtcttttttcttcgaggaaaggatgaggattctcttcacaggccaaggttcaaagtggcttaaggttgtatctcaacatggtcttttcatcgtgcgtgcccgactttga

SEQ ID NO: 80010 - DNA, 198 bp, Glycine max
  Peptide Sequence Number=SeqID_196788
atgtcccacgctgttaaggatagtcgagggaagtgggccccgaactatgaagggccctttgttgtgaaaaaggctttttccggaggagccctgggacgggcgcaaatggaggctagggtcacgatcgacaggttgtcaccccttcccaactcaggacaagcgaaaaacgccgctgcaaggcagcctaatatcctttaa

SEQ ID NO: 80011 - DNA, 729 bp, Glycine max
  Peptide Sequence Number=SeqID_196789
atggccactacccttgataaccctccaatttcagtttctaaaatagccatcataggagctggagtgagcggcatagctgccagcaaacaactatctcatcacaaccctcttgtttttgaggcctctgattccattggtggggtgtggaggcattgctcctacaattccaccaagcttcagtcgcataggcgtgactatgagttcagcgatttcccttggcctcagagagagagttcggaattccccacccacttggagattttggactatttgcattcctatgctgagcactttgatgtgctcaagaacatcaggttcaactccaaggtggtggaaatcaggtatgttggggaccaggaagatctttcttctagttttggaggcctacctagtgaccatagaaccccactccctggtcatcctgtatgggaaatcggtgtgcaaaaaaacaatcaatcagacagcattcagtggtacgcctttgagtttgtagtggtttgcatcggaaaatatggtgacatacccaagattccagaatttgcatgcaacaaaggccctgatgtgttcaagggtagggtcatgcacacccttgattactgtaaacttgaccaagaggctgctactaagcttctcgaggggaagaaggttgtggtggttggtttcaaaaagtcaggtattgacttagccatggagtgtgccaaggcaaaccaaggtaactattcaatctaa

SEQ ID NO: 80012 - DNA, 723 bp, Glycine max
  Peptide Sequence Number=SeqID_196790
atggcttttaattgttacgtccttcaacagagaagtggaatttcaaagtttattgagtcctacctacttcggaaactcccattggaaaagtatgagctaaaaccagagcacccctttgaggaggattatgcatcctgtcaaatggctatcgtgcccgaaaattttttctctgaggctgataaggggaaaattgtcttcaaaagagcatcaaattggtccttttggagtgggggaatagaatttgaagacaactctaaacttgaggctgatgttgtggtctttgcaacaggttttgatgggaagaagaagctcaaaagcatcttaccacgtcctttttgcagcttgttagattatccatctggtcttatgcctttatataggggaactattcatccgttgattccaaatatggcctttgtgggttatattgagagtgtttcaaatctagccacttcagaaatacgatccatgtggctctcaggactattagataagaaatttgagctccctagtgtcgagaagatgctttcacagacacttcatgagatggatgtcatgaaaagatcaactaggttctataaaaggcattgcaattctactcatagcatcaaccataatgatgaaatgtgtgaagatatgggttggagttcatggaggaagaagaactggattacagagggattcagcccttacagtagcgaagactataggaaaaaagattga

SEQ ID NO: 80013 - DNA, 936 bp, Glycine max
  Peptide Sequence Number=SeqID_196791
atgtgtaatccaagggaggaaggtgttgcaagtgatgatgctagtgttagtgtttttattcataatgatgatgacaaagctaacaaccaacatagtgatgcacattttaggccggtggacaaggctggtgggggtgagaaggctgttggtggaggtaagaaggttgctggtaggggtaaaaaagctgaacacaactatgtgaatgttaatggcagtttatttgtgacacccactttgcttgaagatgatattgaagatgggtatgttagtgaacaattgtctagtgattattcagatgaagagggacttgcactgccttcggagcctctgattggtccctcaggaaacgatcctaagacgggtgactcagataggtatagcttgtacatcgaagcaaatcctgcctgcctagttaccctggggagagtttatgagggatccactgttgttcataacactcctttgtttcctggccaagtaaaggtgggtgtggaagaggttaaagatccagatgctccagttcctgtgcccactgatgagcctgttgtgtctccgacaaaaccacctcaaaagtcggatccagagcttacatgggatgccactgtgttcggggtctttaatccagacttcccgctctacataaagcacgaagacctctctgaaatcgcacacggtggtcaatgtctcagcatattagtgttacagttgtggatttttatgcgagcggggaattctgatatctatggattcctcgagccacagtccactcagaggtctgggcaatcgcagtttgagactgaaagttatgtaaagagttggatgcagagttcaaaacgcgatgtctaccttagagcctacctgaatggtgctttaaaaggtcttgatgatgctcctcaatctaaatcaaaggctccagctaggtggattgttgtcaag

SEQ ID NO: 80014 - DNA, 297 bp, Glycine max
  Peptide Sequence Number=SeqID_196792
atgcgtgatcatggatcaataggactttccttgggaatgggttcttttggtgggcaaggattgacattctcaccctgggtcaaggtttatggtaagttgggattctggctcaaggcttgtagaacggctggtcatgatatatgtcagggtttggccagcggttcggggatgaaggggatgtcccacatttattcccatgatacacatgcaacaatgatgattaggaaattttatgccaaactggtcatgcatgcacccatgtggacactcaaacgtcaagtttttatggtcatgtga

SEQ ID NO: 80015 - DNA, 195 bp, Glycine max
  Peptide Sequence Number=SeqID_196793
atggatcattttaaggtcaacgccttaaatgaccaccttccaagtaaaaaagaatcacttgattctccccttttgaaagaactacgtaggtctgatttcctcttcgatggaggacgcacccgtgagcctcacctcgctcgcccgcaaaagggtaggttgcgacagttggcgactccactggggattgttttgtga

SEQ ID NO: 80016 - DNA, 1143 bp, Glycine max
  Peptide Sequence Number=SeqID_196794
atgtcttccatcgtcgatacacctttttccaacctgccacagcctaaatcgggctggcagctcttcaaaaatctggctttcggtacgctcacgccagggctggcgtggcagaaccccgcctatcgacgtaaattcatgttacgttcgctggcgacacccattagcaccgcgcgcctgttaacgagccttgctaagcaaccgcgtctgatgcagatgctgcaggtccagccaggactgccgtgtcggctgcatcgcccctggctgacggtgaaaatggatcgtcagcatgcgctggaatcgcttaactggcactatcagaccctgagccgccagcttcctgcgacgctgcttgcgggttacctttctaagccaggttacaccctgctgaccttaaccggcaaagaggaacagcagttcaccgttcgtctgtgcgctgatgcgttcctggataaagaaggggaagccaccctcgccttctgcgacaggcacaacacggtgctggcggaaatgacctttacgctctgccagtttgcaggaaaaacgacgctgttcatcggcggtctacagggcgcaaaagcgcacgttccccatgagctgatccagggggcgacgaaagcctgtcatggtctgttcccgaaacgtctgctgctggaagccgcgatgacgcttggcaccgctttcccggttgagcagatcgttgccgtcagtaacgccacacacatctatcgcagctggcgttaccgcaagaaaaaagaggggaaactgctggctgattacgacagtttttggatctcgatcggcggtgaaaaacaggataacggtcacttcctgctgccgcttgccatgccgcgtaaaccgatggaagagatcgcgagcaaaaagcgcgccgagtcaaacaggcaacccaacgctaatccgctttcccgcgcgccagccacagcacgcgggaaaacatcttacgcagcagagtcggtaccgcctccacgccccgccttcccgcttctgtcgccacttcaatggctaaatccggttttgacgaacgatgaatggctttggcgatcacgcgccgcatgttcatcgggacatcgacaggcaccatggcaattcggtggaatacgtcgtcgaacccctgacgatacataa

SEQ ID NO: 80017 - DNA, 201 bp, Glycine max
  Peptide Sequence Number=SeqID_196795
atgcttggaagtgcgcttagtgcacctgttgcgctaagcctgaactactctctacccctgtggttctatttggaaatcgcgatgaacgcgctaagcgcgcctgctgcacttagcctattcatcacaactgttaaaattttggatttccagatgaacgcgctaagcggaccaggtcgtgctaagcgcattcatccctgctga

SEQ ID NO: 80018 - DNA, 426 bp, Glycine max
  Peptide Sequence Number=SeqID_196796
atgaaagtagatccgtctgtcccctacaaggtcatcacatgtgtgccgagaaagggaaaacaaattgggaagaactcttggcaggatcggacgcaagggataacttggctcccgaagctaaagatttcaagtggggaagaagctgaagtccttgaggagagcgaagaagtgcaagccttgaaagcgaaacttgaaaggacgcgagtggtcaaggaaaagttcaagatgacgaccatcagggtcaggaaagagtgtgacgagctgagggacgtcaacatgaccatgatcgaagcattggagcgagaaatgaagagggttcgaaaagaagaatgggccaaaacaagttccgaggggctttatggggcagcaacaacgaactcaagcttcgaaggaccgaaagagacaagtcgagggtggaaagtatga

SEQ ID NO: 80019 - DNA, 426 bp, Glycine max
  Peptide Sequence Number=SeqID_196797
atgagtagggattgcttagtgcaattctacattctcaatctttttcggagccccatgaattgcgttttcgttcatgtgtcctccacccacgagtttggagccatgcgtagtgattgcttagtgcaattctccattctcaatcttttttggagccccaggaattgcgttttcgttcatgtgtcctccaccttcaagtttggagccatgcgtagtgattgcttagtgaaattcttcattgtcaatctttttcgaaaccccatgaattgcgttttcgttcatgtgtcctccaccttcgagtttggagccatgcgtagttatttcttagtgcaattctccattgtcaatcattttcggagccccatgaattgcatttttgttcatgtgttctccacccacgcgtttgcagccatgcgtattgattgctga

SEQ ID NO: 80020 - DNA, 399 bp, Glycine max
  Peptide Sequence Number=SeqID_196798
atgtgcaaaaaagagcatgaatccttcaaggaatatgcccagaggtggagggatctggcagctcaagtagcgcccccaataacagagaaagagattatcacaatgatagtagacacattaccagtgttttaccatgaaaagatggtgggctacacaccttcaagctttgcggatttggtcttcaccggtaaaaggatcgaaatgggtctgaaaagaggcaaatttaataatcctgctttgatgaatgagaaaactggggcaaatgaggagtgtgagaatgaaggagaaacccatgctgcgactgtcgttcctacatggccaagtttcccaccaatccaacaatgtcattactcagccaataacaaccattctccttatccaccacccatttatccataa

SEQ ID NO: 80021 - DNA, 381 bp, Glycine max
  Peptide Sequence Number=SeqID_196799
atggcagaagaagatgcactttctcttgacaacattgaaggtggtgtatgtgctgagtacaccaatgtcggtgtttatggaagacgaaactctggatcaaacaaggaagcgctcgaaatgggagaacgacgattacatttgtcatggacacattctgaacggaattatgggactctcttgaatccaagtatatggcagaagatgcctcaatttactcaacatgatttgaaaatggatgaatccattgcagtttcatctataattaataaactgtcttcttcttggaaagacttcaagcataccttgaaacataagaaggaagagttgactctggttcaactcggtagtcatttcatgattgaggagtcgctgagggcttag

SEQ ID NO: 80022 - DNA, 216 bp, Glycine max
  Peptide Sequence Number=SeqID_196800
atgttgattcaatcttttattggcaatgatggactatacggtcctccattgactaaaaatccagatcataaagagcaagaggtgctgccacaacaagaatgtggaaggccacggagttatttttggtccactcttaatttggaagcaatggaggctatggtattggcaacttgtgcacaaaattctttgtcagatcttccctcaggtgtatcttga

SEQ ID NO: 80023 - DNA, 304 bp, Glycine max
  Peptide Sequence Number=SeqID_196801
cccatgagcccgaaatctaccttaaggctcacgagaaccctagggccttctcttgcatctctggcccaatcttcttggagtcttctatccaatgcccttggggggaggggggtaggattgcattagtatggaaccccttaggggttcccatggaccctaagagaataaaggtcattcctgattggcccactccaccaacaccactcattgagttggtgaggaaccatgttccctcatgggaagatgccccagaaaggggtgtcgagggaaggagcccaaagtatcaagaacctcgggatttgag

SEQ ID NO: 80024 - DNA, 342 bp, Glycine max
  Peptide Sequence Number=SeqID_196802
atggatgaacctaatggagaacagacgaatgaaagtgaggctatccaaactattgttaaaaacgttaagcgtttgttagacaagacagagatgagtgttgctgaatatccagtcggcgtagaaccacgagtccaggaaatgattgaactattagaccaaaaacaatcaaatgatgttctactactcgggatgtgggggatgggaggcattggtaaaacgaccattgcaaaagccatttacaacaagattggccgcaattttgagggaaaaagcttcctcgaacaaattaggaaagtttggggggaagatgctggtcaaggagtagaatatgttggaaaataa

SEQ ID NO: 80025 - DNA, 228 bp, Glycine max
  Peptide Sequence Number=SeqID_196803
atgaggggcatcgtgcatgagcctcagggtgaacccttgggtactagtaccctcacctccagaggactacacgtccttgccttgagagggctacccgccctcgccttgggtactagttaccctcaccttcagaggactacatgtcctcactttcagagggctacacgccctcgccatcagaggactgcatgtcctcaccttcgtagggcttcacgccctcacctttag

SEQ ID NO: 80026 - DNA, 999 bp, Glycine max
  Peptide Sequence Number=SeqID_196804
atggggtttgcacttgatgctcaagtggtgaaagaaattttgggcatggtgggaaaggacattgtggtggaggtaaggaaggtgttgcattttgggtcattgaataacatgatgaagaacatgtttgtgaagagttatgtgtttggcgagggtgtgaggaagaggtgcatgagtttggtggataaagtgaatgtttttgtggggaaaatcattttggataatggagtgaagagggttgttgaaggtgaggataaggtcagggttactgagggctctaatgactttgttgatgtgttgttggatttggagaaagaaaacaagcttcaacactctgatatgggtacatcctttgtggtacaagtagagggtacatctactggggttgttgtaactgagaacaagagagggcacatctcttgtggatcaattttagtggagggtacatccacttggttgttcaaagagaacaagggaggatacatcccttgtggatctttgcttgtaatgacttttacaaggttgaaaagaaatctcaaggaccgcaggtcgcttggggactggataccacttgatccaacagttggtattgagtgcagtgcgagtgatgatgaccttcccaaccttccttatgtgcataccatagtgaaagaaaccctaaggatgcatatcaggacctctttatttcatgggccaattggcaccactactatggtcaacatctgggctattagtcatgaccaagatgtttgggttgagctagaacagttcaagccagagcattttttgaagtacgaggatttgccaattatggggtctgatcttaggttgacaccatttagctctggaataaaggtgtgccctagaaaagccacgggcttggccactgttgaactttggcttgctatgttcttacaaaacttcaaatggatgccttatgattccggtgtggacttgtctgagtgcttgaagctctttgtggaaataaacactctctcataa

SEQ ID NO: 80027 - DNA, 321 bp, Glycine max
  Peptide Sequence Number=SeqID_196805
atggaggactctgagcatactttgactacttctctctttctagaaccctcacctttggtggagcgcatctttccacttgggaccaaaccccatgtcttgaccttaatgggggttagcgcccaagtggtaacactgctgatagtcgaccaaggaggcagggaggaagacccggagatagacgaggaggacttgccaaaggagaagaaggccatattttgcgataagacaacaaccagtgaagaggtgcctcaggaaggagctagatggctgatagaggagagtagtgagaaagatcctgatatgcaagatgtctcttcatag

SEQ ID NO: 80028 - DNA, 150 bp, Glycine max
  Peptide Sequence Number=SeqID_196806
atgtctaaccgatgggtcactgtacagtcagtagttatattctctactccatcgaattactttccatatatgcctattgagtttctcttttcttatggtataagatgcaaaaagggttttggccctgatgtattagccttcaagatgtaa

SEQ ID NO: 80029 - DNA, 483 bp, Glycine max
  Peptide Sequence Number=SeqID_196807
atggatgaagctcgacacctcaaacggaaggctagctactacgtcatccatgatggtaagctattcaaaagagggttgacaacaaccctactcaaatgcctaaataatcaacaaatagactacatcatgagagaacttcacgaagggatctgcggtctttataccagaggacgctccttagacaccaaagcggtgcgagtaggctactattggccaacactcaaggcagaggccctagacttcatcagaagatacagacgatgccaagagtttgcatacgtgccacacactcctcctaacaaccttcatagtctgagctcccattggcccttggccatgtggggaatggacatcttgggaccattgccaaaagtcttaggagcagtcaaatacctattagtcgccatcgactactttaccaagtggatagaagcaagaccactgcgggaaattatggccaacgaggtggagaaattcacctag

SEQ ID NO: 80030 - DNA, 837 bp, Glycine max
  Peptide Sequence Number=SeqID_196808
atgggagaagaaagacgtaaagccattaaagaagaagttgacaatctcctccgtgcaaacttcatccgagaggtactgagcttcctggacgcctactccggatacaaccagatcaaaatgcatcctctagacgtggaaaaaatggcattcatcactgaagatgacaatttttgctacaaggtcatgtcattcggcctcgaaaacataggtttgacataccaacgactaatggaacgagtcttcaaacaacatatcgaaagaaacgtcgaggtgtataaggatgacatggttgtaaagtctcaaaccataccccaacatgtggcggacctggaagaagtcttcggggaacttcgcaaatacagcatgcgcctcaaccctgaaaaatgcattttaggggtaggcggaggcaagttcctcggcttcatgatcacatatcaggggattgaagccaacctcgacaaatgcactgccatactagagatgctaggagcacccctactcatgtatctcttagtagccaacgaagttgtcagctcaaccctcgtacaagagaaagggaagcaccagctccatatctacttcaccagtcgccatgatgccaaaaagtttcacattcagtacgaaccgcacagccccatgaagagacaattcatggctgactctctggtagaatttgctggaaacgacacaaccaccctagactggtggaccctttacgttgatggtgtgtccaacgtaaaaggaagcgaggcagggatcatccttgaaggccctgacactatcactctagagcaagccctcgagcttaacttcagagcctcaaacaatgaggcatag

SEQ ID NO: 80031 - DNA, 276 bp, Glycine max
  Peptide Sequence Number=SeqID_196809
atggaaagaactctacagcatactctgggtgtaccattgtacaccccagaaaacaaccaacgaaacttcttaacgactcacaatggcacaaacgccatgatccccgttgaagttggggaaccgtcgacaaagagactattgtaccaacaacaacaaaatgaagacaatataagggtggaacttgaaaccaccgatgaagtccgagaaataacgaggattaaagaagttgtcaaactacgagcaacaaggagatacaatacaaaggttcaaccatga

SEQ ID NO: 80032 - DNA, 1188 bp, Glycine max
  Peptide Sequence Number=SeqID_196810
atggctccaagcttgttaagtgtcttcttgttgattaaggcaaaagagcttgccttgaccgaaagtggtcatcaagtccacgtagtctctggtctcgactttctcgcctgcaaagctgaggagtggaccgacgtgaggttggacagtgttggtagaattgtcctggtcgatgaggatcttggacactatgaaattcgctatgatgatggagacaaccatggggttgtcttggttgacggagttgatgcccttgaagtccctatccgtaaagggtgcatcgacaagattaatgtcgatgtcctagatggcatgcaggttcctgttctagtggaagttgtcgctcgtgccactatgactgttgtctttgtctgccttggtctttcgctcttcttctgtctgcttcctagttcctatgttgctcctcttgatgtcctccaggtcttggtcctgcttggtgattgtctgtatttagttgcatctgaccctggcccgagaggtttcatatggggtagccgaatgggtacctctaggttgaatgcttcctcgagaatcgtgttggccttggtgtttgcttcacgcttctgtctagcttggtggacattgtctacgaacttgctagggcgtaaggcgaagagcatggaatgcaacactacctcgaagattgagattttggatttggacggctatgcacccaaatttgtccatgaactttctgagggactcgtcgcctgtttgtcgcagactggccaaggcgatcgaggtcatgcgatgagacctgctggtagtgcactgtggactgaatcattcgacaagggtgtcgaagctgtatatgaacctaggttcgcctgtgttaggaaggcgtccatgtgctcgtctagatttgttgtcccatcgtaccactcaaggttaagtggtttccaccccaagggtcatcagaagtattgcctgtgcgtcgggggtgtgattccccttgagtgcgttcaggcaaggtgtaggcgaattgcttattgccttggggacgtctggcacgtgcctctagctggatgtgagtctgcgtgggggactatcgcatctaaggccagaccaagtgctaaccatggatggatggtcccgaacttcacacattggcttggagaggttcctttgacaggaggagggacatgcaaaacaaaagactctgacgctcaa

SEQ ID NO: 80033 - DNA, 285 bp, Glycine max
  Peptide Sequence Number=SeqID_196811
atggcgagtgacacacatgcaagagtgtatcaccacagtgactccagtacttgccacccacgcatacttctttgcctccagtacgtgccacccacgacatgtgcgcacgagcgtcctgttaaacctctaggtgtgccacccacgtatatgtcacccatgacgagtgacatatatgcaaaagcatactatcaagcctctagtaagacatgcgcacatgagcatactaccatgactcagtatatgccacctatgatgagtggcatatatgcaagagcagactactga

SEQ ID NO: 80034 - DNA, 447 bp, Glycine max
  Peptide Sequence Number=SeqID_196812
atggaagaatacgaggcacttggcggcgaggtagcggaatcggaggtcggtgaggacgattttggaggcgttgaggaggtggaaggcgcggcggtagtggcggccgaggaagagggcctgggcctgcatgtagatgtcggcggggtcggcggtgaaggcggccaccttgtcggcgaagaagatggcggaggagtagaggtgcttgctcacgcagtcccgcaccactcctcgaagcttctccatctcttcctccctcattttcgaaactttactctttcactcactgcttgcaagggtttcgcagggtctttttcttcactctgcgtggttcagaggccaagttgtgacggcggcctggtggtgttcctgcaacagcagtgctacctcactggttcgacggcaacgacagctgaggctgatgcgtttagggtttcagtggttcactga

SEQ ID NO: 80035 - DNA, 687 bp, Glycine max
  Peptide Sequence Number=SeqID_196813
atggcgcctcctctcacctcttctcctttatcttccgttgcaactccatggtcaccacttcagctcccgccaattaccgaagagtctgtctcctctttaaatggaatggacgttttgaattcgggtcactgttcattgtcttcttgcttccttactttctcttgtgctttttggcttttggtttccttttcttcttcctccatcttccaaaggggctcgattgagcaacccatcatggatcgggaggtcatctcgataggcggttcctcgtttaaggatactcgccaaggtgcctttgatagcgagtcctcctctttggagagggtaaaggtctcacatcaaactggtgggggtgcttctcgccttcgcgaaagggcgcgaccttctgctactggtgtgaggagaggtgatgatgatggagatgtgagggcgtctcctcgtgtgcaatgtagcataagtgttgggtcgatgtcatccaccccaactgttgctagctatgagtgggtgaagcttgtaaacactaaggactcttgtaagctgggcgttcaggcttgcgggagtgatgacttcctattcttgagggcggtgtcattttacccttgcttttcagtgtgctttgttggagcacttgaatgtgaccccttcccagcttcacccgaacagttagacgatggtgcaagcctttga

SEQ ID NO: 80036 - DNA, 354 bp, Glycine max
  Peptide Sequence Number=SeqID_196814
atgatgcatgcacctgacctcaactctcagatgcaatgcggtacgtaccgtatccaataccaaggaaatagccctaagcgtgtctacacgacacctcacttaggaaaccatgaagtatttgtcgaggccacccagtcgtccactgtaactccccccctaggtgatcaacctgggcccacaaggagttccctaccaggtgacacaccccctagtacaaagtacatactgccacagtgtatactatttcccatgtcatatgagggacgttcgacaaggtcaatgcaccccctcatggacatacataacatacgacatatgaacgtgggcaccatcaagtacaatgaccatggatga

SEQ ID NO: 80037 - DNA, 1062 bp, Glycine max
  Peptide Sequence Number=SeqID_196815
atgggtctccccttgaatagtgtgtccaagaagttgtttgagtttgattcaaatatctttcatcattttaaggaccattttttcaaggtcctggctactggtgtcgtggctgatgatatgtcattgatgttcaacagggatggggagccttgtttcctattctactggcagtctgatcccaccaggttcaagttgtataatgaggatctgctgacccgtgtggaaagggtcggcaaagcgatggagcagctaccggcctcgctgggcatgcgagccattttgtctcttctgtcggtgaacgatccttttgttgtcgtggatggtaaagtgcctgaccttaccctcgtttggtgtcgacgaatgactaacatgtgtttgtgttattgtcttgcttgttttgcaagtattatgggtgacttcgcctgtaggccactcatgatgcaagtcggacctgtacgtgagactgtgtcaccatctgctgctactccgtctgctggagaagggggtcaacctgctggtgaggttggcccagttgttgctgttgttgaggtcactctagtgcttcttcctctgtcttggcaaagaagaagagggatgattgtgttaggccatctggctacgagaagtcgaaggccccttgagtctttgtgccctgaggtaggttgcagggttgatgcccattgcgggtcacctttcaactgcgtaagatgtcccttcggctccatcggctatcgaggctcctactgttgctgttgtgactcttgctactcttgcttctttaccttcacctgttgttattgttgttcaagagccactcaggttgattctattgtggtgtcgttgttcaccgtcgcggcacctttattaagtgatggtgtaatagccaccaatgctcccacggtgttgcctccttcctctacgactttgatggtttctccctctactgttttagtggcggtggtgtcgccttcttcgtcctctcaccctcgcatcttgcttgatcacctatacacctttagtgatgttgactcactgtggggtgcaacttataagccggagtag

SEQ ID NO: 80038 - DNA, 495 bp, Glycine max
  Peptide Sequence Number=SeqID_196816
atggagcagcatgaaaaaggctttcaaaaggttgtcagacaggccaaattctttatgaaggaccttgacttgggtctcttcgatcccttcaaggatgtgaatgatggtgttttgcttgatcaagaggagattgctacggaggaggaggaagctgctgatgaaggacagggtgttgtggagcaagaccatggtggtcttgtaaagagtagaatggcgcagagttatctcaagtttgatttcaacctgattaaaggtcttgtcacccatctggcagggcttctttctattttgtggagtttctccccttatgtttctcctctgatggttgtgaggaatgagtttgagctgcacctgaataaaggcttgtcatgctatcgggtggtgggtcatcttgacttgcagaaatactcctctgatgttgaacttagacccttgatggtggtcgtcatagttgctgcatatgagcgacccaaggggattccttgggttttgtag

SEQ ID NO: 80039 - DNA, 483 bp, Glycine max
  Peptide Sequence Number=SeqID_196817
atgcagtatgacaaagaaaatgttgtagaagccaagttcagagatcttgagaatgaaagctgtaaaagtgaccaatcagattcttctttcttgcgcacactgaaatctaacactgatctattggcctgcaaagctgaatactactatcagtgtggtgaatatcagaaatgttttgagttaactaatgatttgcttgagaaggatcttttccatctaaagactacgttagtacatctggcagctgctgtggagcttgggcattcaaatgaactctatctgatgtcatgcaatttggtgaaggattatcctcagatggctttatcatggtttgctgttggttgctactactacagtatcaagaagtatgatcaatcccgccgttattttagggcgagccctggtgcagcggtaaagttgtgccttggtgacttgttggtcatgggttcgaatccggaaacagcctctttgcatatgcaagggtaa

SEQ ID NO: 80040 - DNA, 489 bp, Glycine max
  Peptide Sequence Number=SeqID_196818
atgccagggccctacatgggacgtggacgatgtgacaatcttcgacgatgggcgacagtggttgaaggtaagcaccaacaaaaaagcactaagaagtctgccaaacaagtgcaaagcagacgcgtggtattattcattgcgaagagggactgcgcgaaaaaggaaaacgaaggagaaccatcaaatcagcatggaatgaccccaagctttagggatcgactgtgggcactcctgatggtgggttcgtcagccagagaggttgccatagctctagtggtggctgacaacattgaccggaaatgttgccaaaaaattcaaaaacaaattgtcaaaggagaaaaggtccctaaagcactagaatgcggagacaattcgcaggaaaacggacgaagcagaaaggtccaccagggacagcaggtccacccgggaaacccaagacctactgtccccagtggagcacgattttcattattcctttgtcaagaataa

SEQ ID NO: 80041 - DNA, 291 bp, Glycine max
  Peptide Sequence Number=SeqID_196819
atgaaattaaatctcgcaacgaaagctttattttgcatggggctgacatgtgctgcgctgcctgcattcgcgctcgaagcatggagcggtcaggaaggtggcagtacttatgaagttattttcgatggcggtgtgtataagaatgcgtggtgggtaggcgcctcagattgcccgggcaatgctgctaacgatcaggcaaataacccctggcgttttgaacgcaacgcgaccgccgctgaaatggataaatacggtaatcctgttacctgtgaaaccagtggtggtacgtag

SEQ ID NO: 80042 - DNA, 249 bp, Glycine max
  Peptide Sequence Number=SeqID_196820
atggtgcatgatgatacatttattgtaccagatccccctcaggagcccatccacccagcagctatgccaaaaccacctgcacctatagctactgatgttgacatgcctcgacatgcagtggacacttgccaaaagacagcagaaagtttggaatgcatgattggtatgaggatggccactgctagaactgaagcatacactctgaccgaacactatctaagattagctaggggtgtcactgagcaatga

SEQ ID NO: 80043 - DNA, 456 bp, Glycine max
  Peptide Sequence Number=SeqID_196821
atgaagcaccacatgctctctacaaacctcagaaccccaccaaaacaaagaaacttcaagggtagcacgttctccgagatcgccatgaaggaaactgaacaaaacgaagaagaagaaatatcaaaaaatatgaacgaaggagccacaaacaagcacagtaaagaaagagagagagagagagagagagagagagagagagagaagcgcgtaaacgaagagtctttgccatatataaggaggtcccgaccaagctggacatggttgcagaggaggagagagaaagtgagaggggagagagagagtgtttcgacaaagagaatcggaaccgttcgatcttccgtacaattgaatcctggccgttggttccaacctgatatgacagcatgcatgtgccaccatccttcagtggtcgttgtcagagtacggagtatagagaaggaaaatatattgccataa

SEQ ID NO: 80044 - DNA, 222 bp, Glycine max
  Peptide Sequence Number=SeqID_196822
atgaccgttgttgccgctgccaccgacagtaacaatcatgttggtggcaatgacgacgatcatagtaatagtggtgacgatgataacggtgacaacaatcatatagataggttggtagtgatggtgacaattgacgatcatgatggtgattgtagtagcggctatgataattatggtgaaaacaatcatgacgaaagtttaagatatcttaggatatcataa

SEQ ID NO: 80045 - DNA, 2940 bp, Glycine max
  Peptide Sequence Number=SeqID_196823
atggaagggctttccgaagatgacattttgtctttgtccgattctgattcctgttttgaagaattaatcgaggaaagaaagaccgttttgcgacaagagttggcgaagatcacttgtaatgcatcggaagaggatgatgagagtgcaagctttttagacattgtattctcttggagtcttaaggatgctctgaatgaagatctttacaaacataaggtacaaaggataccggagacgtttatgtcaacttctgattacttgaactccttcatccctccgttgatagaggaaacacgttctgatctgtgttcaagcttgaagggtgtgtctcgtgctcctatttgtgaaatctggactgttataagggacaggttctttaaactccccaatagcttattctatctcataaaactgaagactcgaaccgatgaagttgaagatgaagtgaaagaagatattggatcatatgaacctgagccaggagatatatttgccttcacagatattagacccaaaaacattggtgacttgatcaataggcccaaattaagctacgttattgcttatgtgtgtggccgaaaagatgcaaacactaatgaaatcccaatacgggcatctaagtgcttggagatggatattgaatttgaatttagtaggttgaataaaaacgaaacaacccagctgaggagctatatagaagaaaccaatcagcccagaaacacgaaacaaaaactatatgcaacctatcttttgaacctgacgaccaatattcgtatttggaaggctttgaagtacaagggggaggaagcaaacatgaacatcattaaagatgttcttcaaccagatttaagtgtagttatgaagagaggagttgactgtcaaaattgcaaatgtagaaaaagcgttatacctgtctgtaaatggtacccacttcggtctcagaatctgaatgaatcccaagaagttgctatttcaagctgtcttactatgtgtgaccatatggttactaaacttatatggggccctccagggactggaaaaacaaaaacacttgcttgcttgttacgttgcctgcttagggttaggcacagaacattggcatgtgctcctactaacactgcagttttggaagtggcagctcggttgcgaaatctagttaatggttcacttggatttgatacatatgggttgggtgacatagttttgttcggcaataaatccagaatgaaagtagattcttataccggcctccgagatgtgtttcttgatcatcgcgtacaaaatctgtcgaagtgctttgatccactgagtggttggaagcattacttggaatcaatgatccagttacttgaagaccctaaggaacaatattcctcgtatgagaaagagaagggtattgtttcatttaaagattttgtcatgcaaaattaccctagttttggacttcaattccatgcaagcaaggaaggctgggagttacagtcgactgattccattattacggagtatgtgatgcagaaaaggaaggacattgtggagcaatttctattggatcaacaaaagaaaaagaaaaatatgatgaccatggagcaatttctattgcatcaacaagaaaaaaagaaaaatatgatgacaatggagcaatttatagtagaaagatttggggagtttgcagcgaagctcatgtttttcatgcaaatattgtatacacacttaccaaaatctttcctttcattagaagtcgtgatgaaaatgttttcagttaaggatattctaacttctcttgaatcaaaattgaagctaattctttgtggctgtaaagaagaaaaaaacattattgattgctttcaatcgtcaagcggaaaatgccttagcatgttgagatcagtatcgtcggcaattcccaatactgattttctggctaaaggcggaatagaaaagttttgcttgcagaatgcatctattattttatgtacagcttcaggttctataaaattgtatgcagaagatatgactccaataaagtatgtgataattgatgaagcagcccagctcaaagaatgtgaatcagtcattccgttaaagcttccaggattaaagcatattatcctagtaggtgatgagaaacaacttcctgcattggtcaaaagcaagattgctgaaaaggctgattttggaagaagtttgtttgagaggctggtgcttttaggagacagcaagcatatgctaaatgttcagtatagaatgcatccatccatcagcttatttccattcagtgagttctatgatgagaaaatttctgatggacccaatgtcttggaaagaagttataatgagcggttccttgagggggaaatgtatggttcatattcttttattaacgtttctaagggcaaagagcaatttggtcgtggaggatatagttccaagaacatggttgaggctgctgttatttctgagattattcgaagcctcaaaaaagagtatttgaggtcaaggaaaaaagttagcataggaatcatatctccatacaatgctcaagtgtatgaaatcaaggaaaaagttgagaagtacaattccgtttcttttcctgatttctcttttagtgttcgttctgtggatggttttcaagggggcgaagaagatattataataatctcaactgtgaggtctaatggcagtggaaaagttggttttctttccaatagacaaagggcaaatgttgctctgactagggcgagatattgtctttggataataggaaatgcaacaaccttagtcaatagtgactctgtatggagaaaggtagttcttgatgctaagataagagattgtttctacaatgctgaagatgacaagaaactggctcttgctattgagcttgaactgcttgaagaatctgagtcacggtttaagaaactcagcctatgggataagtaa

SEQ ID NO: 80046 - DNA, 192 bp, Glycine max
  Peptide Sequence Number=SeqID_196824
atgctgccaatgcaagaaaacaataggaatgaacttgaaaggcttgataaagagaggcaggctgacttcttaaacatgctgaaaggatttgtagttaatcagagaagtaatgtgttagttttagacgatgctatgcttgcaatgagagggaagcatgatgaaagagaaagattagaaagtaagagcaaatag

SEQ ID NO: 80047 - DNA, 345 bp, Glycine max
  Peptide Sequence Number=SeqID_196825
atgaagaacactacactacactacagtacacttcactatgctaccctagttttacaacagacattaagcattcaaagaactgcaaagtcaccacgagtttcccaatccttgcaacagaaacaaacaaaggtccttgggttaaccacgagttccccaaatagacctaggtattcaatagaacaacagagcttagaagaaatgtacctaggtaaggtggcgatggagaagaaaaagagacttgtcacgatcttcaacgcaatggagaaaaagaagcttagacgcagaacaagagaggttagacggagaagaagagagcgcgagcaaaataggtcgcgtctgatataa

SEQ ID NO: 80048 - DNA, 302 bp, Glycine max
  Peptide Sequence Number=SeqID_196826
atataacacatacaagaggtggtgaccgcaccaaacctactacatctgtatgtaggcatgaaagatgtgtagttgtagatgaggagcaagagatttacgaagctcccgaacatgttgcaactgatgatgttgcacctcaagatgttgtgtttggtggtgtgcttgaggacaaattagtccttattgaatatgctgatcacgtggcttgtaaattgtgggatgacttggaccatgaagagttcaagctagtagctcatggaaggaagttgagggatttgggccccctcataaggagatcatga

SEQ ID NO: 80049 - DNA, 222 bp, Glycine max
  Peptide Sequence Number=SeqID_196827
atgcttactcggaatgaacaagtgaagaagacaatgtttcaggcatggagaaacgaggaaatcaagctatggacaagtgagaaagacaaggttactatgcccattttgaaaaattgggaggtgcaagaaacaaactgggagtcgtataatgatagtgggctggtggccagcccaatacctaaagtcctgttatatatgcataattaccttccatcctattga

SEQ ID NO: 80050 - DNA, 1669 bp, Glycine max
  Peptide Sequence Number=SeqID_196828
atggacgaattctatgtaactgaatcgttctcgaagggctgcaatgcctctttcctagctttaatacctaaggtggctgatccacaagctctggatgaatatagacccatatcactcattggttgtatgtacaagatagtggctaaggtggttgaggaggctaaaagaagcaagaagccatgcattgtcttcaaagtggattatgagaaggtgtatgattcagtttgctggaaatttcttctctacatgcttagcaggctgggattctgctccaaatggatccagtggatcaaggggtgtttaatattcgcatctgtctcagtactgataaatggcagtcccttgcctaagtttatcccacaaagagggcttaggcaaggggacctactagcaccacttcttttcaatattgttgttgaggcattaactgggctggcatcaatggagaatatcaagacaatcaaagcaattctgaggacctttgagcttgcatcaagccttaaaattaactttgctaaaagtagttttggtgcaattggaatgccggataggtggaagcgcgaggcagttggggcaaaccctagacggtatcagatgtgggatcctattctcagaaagtgtgagagaaagctagctaggattcccaagaaggcattggacaagctagtaagcattcaacgcaaattcctatgggggggcctaggcatcaaggacataaatttcttcaatctcgctttgcttgacaaatggaagtgggatttatttcagcatgaaggcaagctatgggctagggttctggaatccaaatatggtgggtggaggagtttggacataccatctcgtgacaaggtcaagttttgggaagatacatggatagatggagaagtatcactagcagcaaagtaccccagactatactcaatttcttgccaacaaaaccagattattcagcagttaggaggatataatggtctagagtgggagtggaatttatcatggaggaggtcactatttgatgagataccaatggctgatagttttctaaaagatattgatagcaagcctattcagatgcacaaaagtgatgacttggtgtggttggcagatcctagtgggttgtactcggcacaaagtgcctacatcttgttgaggggagaagcaacactggggattcaggacaaggcatttgaggaattgtggaagctaaaggtttcatccaacattctagtttttgcatggagattgttcagagatatattgccgactaaaagcaatttgcacaagagacaggtggagatcatcgataggagctgcccactatgcaatggtgtcgaggaggatgtgggacatctattttttcagtgtagtaaaacaatcccgatttggtgggaatctttgtcttggttgaacattgcagcacctctgccgcagaatccaagacattatttcctccaaattggatcgatttcggtggatgggatgagggctactaggtggaaatgttggtggttggccatgacttggactatttggcaacataggaacaagttaatcttctccaatgaccgtttcaacggaaataaattgatggacgatgcaacgttcttattgtggacatggccgagaaacttcgagaaggacttctccattcattttaaccattggtcta

SEQ ID NO: 80051 - DNA, 846 bp, Glycine max
  Peptide Sequence Number=SeqID_196829
atgggaggcattggtaaaacgactattgcaaaagccatttacaataagattggccgcaattttgagggaaaaagcttcctcgcacatattagggaagtttgggagcaagatgctgggagtagaataatcatcacaactagagatatgcatatacttagagggagaagagttgacaaagtgttcagaatgaaaggaatggatgaagacgaatctattgagctttttagttggcatgcatttaagcaagcaagtccaagagaagattttattgaactttctagaaatgtagttgcttattctgcgggattgccactagctcttgaagtccttgggtcctatttgtttgatatggaggtaacagagtggaagaatgtattggagaaactcaagaaaattcctaatgatgaagtacaagagaaattaaaaataagctatgatggtttaactgatgatacagagaaaggaatattccttgatatagcttacatgggaagagaaatcattcgttcaaaaacaccaatggagcttgaggagcgtagtaggttatggtttcatgaagatgcgcttgatggaacaaaagctattgagggactggctttgaagttaccaataaataatacaaaatgtttgagcactaaagcttttaaggagatgaaaaaactcaggttgcttcaacttgctggtgtacaactggttggagatttcaagtatctttccaaagatcttagatggctttgttggcatggatttcctttagcttgcataccaacaaacctttatcaaggaagtctagtttccattgagctagaaaacaacaatgttaatcttttgtggaaagaagcccag

SEQ ID NO: 80052 - DNA, 312 bp, Glycine max
  Peptide Sequence Number=SeqID_196830
atgggtggcggagatggtggtgatggcaaaagaggcagaattatggtggaacgagggggtgggggtgcggatgtggaggcagacgaaggtccatcatttgctgctcctggagcttcgcaaggccggcggcctgggttttgcaggaacaaaagtggtgtggtgagaaaccggtgtgggtttgggcatggtggaggaaggcataggagcatggcggaagaaacactggtccaggttgaggttcgtagagtgcatgacattgtcaagatgagcaagggcctcgtcgaggttgcggaaggccatgaggacaaatga

SEQ ID NO: 80053 - DNA, 879 bp, Glycine max
  Peptide Sequence Number=SeqID_196831
atggacaaccacaaagctactatcaagctaactggagagggcagaatgatatacaatcattttatttcacccgcttccctgaggatgcgacagagaaagcactatggctccatttcaaataatatggtgacatacgggaagtgttcttgtccagacacaggaacaagattgatgtatgttaacatcccaagatatgggagggctaaggacgcacaaatactgccagaaggaacaaacgacactcagccccaaggggcagcccagacatccataacacatcaaggtcatcggcttgaggatgatttcctttgggatattggagctgacatatcgctaaaatacatgggagatgatatggtactcctgctatgcctctctgatgacagagccaaacggattatggaagaagaaaccgaaggaggactctccctgttccactcactagaaaagtggaacccgaagttatgtcctggatgccagctgacttgggtgaactgctggggtatcccattagtggcctggaacacagaacacatcaggaagatagtgtctggtattggagatttagtggacgttgacgacgacgtagaggtgcttcagaggctggacagggcaagaatcttgatcaaaactccatggaagctgattatacaacacactgttaacgtacacatccgagaagaggtgtacggtgtgcatatagtggaggagggtgggagctgcccagagacacaccattgccggtgcaggagagtgtatgggtcatcggaagaaatagctacagatgttagcgatgtcgggacgccgctcatggaagccagtcgaacactggtggaggatggtggcttcaacgcaacctcgataaggagacatgtctag

SEQ ID NO: 80054 - DNA, 585 bp, Glycine max
  Peptide Sequence Number=SeqID_196832
atgtgtttcacttgtgacgaacgataccctaaagggcattacggcgtttctaaagcttcccttctggttgctgaagatgaagattccaattgccttaatacggacccagttgacccgacctcagacccaaaacccacacctgaccctagcccaaaactcaaacctgacccggacccaaaacccacacccaacccgcacccgatccattcggcccaaattagtttgaccttcttctcgggtgatttagcatcgagaaatttgcgccccgccgaccttctctccggtaatcgagtggtcctccttactgatgggagaagtacccacaccttcttccaacctccactatcgatctttctgagcttaccttgtcggacggctccaacaccattacgcgtgatgttctttcctcacgggcactttgtggaattgcaggttcgtcaaaataaaccatgggatcctgggagtgatagggaagcatatagcagcagacaaagtgcaggaggtgcaagcagaaacaatgacagggaaacatatagcagcaagaaacaaagtgcaggaggtgcaaacagaaacaaacaagaataa

SEQ ID NO: 80055 - DNA, 771 bp, Glycine max
  Peptide Sequence Number=SeqID_196833
atggctactagtgatggtggtggttgtttgctcgccggtgatagctatccatattggttaaccttcaacagcgaaggttcatccatgacttttgaaatccctcaagtgaaagggcgtaacttgaagaaaatgatgtgccatgtccattattcttccccggaaaatataacttcagatggtttgaaaaatttgttggtgataaatcacacaaaggccatcattcaactttataagagaaatgcattagtctcctttgaagatgaggagtggcagggggtactatcaaaaatagagcctggaaacaaagtgcaaattgttgttgtcttctggagcaaattaactgtttacaagacaacaatttatctcatatatgaaccaatgaatgaaaaaatagagcattcccgtgcactaaataagaatgtaatggattctagtggtgatgaaaatgaatgtgttgttgggaccatctctcttcaagtagaatccatatataagccaacaaatgacataatggagcattgccatgcatcaaataagaatgcaattgtttccagcagtgatgaaaatgcatgtgttgtcaggccgtcctctcctcaagtggaatccatagatgacttaaggtggatcaactgcgtttttagagaagtcatcaaacaagttgataaccttggcagtctaagtatgtacctatgtggatcattaatttcctgcggcatgagatgcatgactcctattatggtaattacgttaaccgctttgctagttaattaa

SEQ ID NO: 80056 - DNA, 239 bp, Glycine max
  Peptide Sequence Number=SeqID_196834
atggctgtgagggtgtcaagagaatatggtttgcatcaaatgtggggctttaagcaacccagacttcacagcaagggtcttagaattgatttgggtactgtggaagagaagaaccctctgggttttctcatagaaggaattgcagcagacaaggacaatgctggtaacaatttggcttcagcttgcctctttattctatattgctacgatcctcttattgaagaagtgataacattcag

SEQ ID NO: 80057 - DNA, 708 bp, Glycine max
  Peptide Sequence Number=SeqID_196835
atggctcgtgaaggggagactgttgttacctctggatcgcatccaacagagaagagacacattgatgataggttgatgaagaggggggcaaggagggaccaagggtctattacaaacaatcaaaaaaggaaatggtgggcgctgctgaccagccccgccaagaatcttgaggaccttaagctggaactgccattggcttgggaacctatgtgcagtgagagctcttcgtttgaagcattttggcttgatgatgtggaggaaggtgaggagctaggggcgaatttagatgagtgtgggtcacaaaggtttggaaatttgtctcaaaaaatcaaaaggcttcgaaagaaactgtataagattcaacgcagcccctgggtcagtttcttaacaaacacaaaagttgagattgaaggtgagttggaggagcttttaaggcttgaggaggtcctttggaagcagaggttgaaggtggagtggttgatgtatgtggataggaacacaactttctttcatagaaaaacatcccaccgaaagcaagtcaataccataaagaagattcaggatggtgatggaaatgtgtataggaatgtagaggacattagtgaggtattaacaaagtatttctctgatctttttacctcatctccgcctcatgacatgacagaaattgcaagccttgtggaggggagaaattatggagagatgtga

SEQ ID NO: 80058 - DNA, 501 bp, Glycine max
  Peptide Sequence Number=SeqID_196836
atgaaaaagaaccatagtaaaacaacgaaagttgaggttacagtcttactcattcaattgtcgaagttctaccttcaattgtacattctgtttgtggtaacagaaacaacagttgaagttgtagttgcagtctcaatggaacttcaaatcacctcagaaagtcaaagaaatcaaaatacaaatacaggtttctcatcgaaagttccaaatggtaaaagctccacagatgaagaaggaatatccttaacgtgccttgccttagtgtatgtcccacattgcttagtctattcaggtgaaggaggtgctcatcccatattagggataaagtcccacgaattctgtaacatgtatagaggacctattttgaaaagaggaatgccagtatcaaatttgtgtgggtctcattttcaagaagccaacaatgctgaaaaaaacccacagataaaccacccaagtttctcattaaggtttagctgtgagttgcatatcttgttaaggtga

SEQ ID NO: 80059 - DNA, 387 bp, Glycine max
  Peptide Sequence Number=SeqID_196837
atggcggcgaagatttcattggcaattggtttgagaactctcttcactgttttgggacttcttatgcttgctatcgttctttacactgtcttcaccgatggtcttccgtttcgcaaagaacttctcacaccgtggatggcagcaactttgattgatttttatatcaacgttgtagctttggcggtctggattgcttacaaggaatcaaacttaatcagctcaattctgtggattgttttgcttgtctgccttggaagcatcactacatctgcctatattgttgtgcaatttctgaagctgtcatctcaagaatcttcacaggatcctatgtattatgttctattgcggaatccaaataagtatgtctacagaagcactactatatag

SEQ ID NO: 80060 - DNA, 591 bp, Glycine max
  Peptide Sequence Number=SeqID_196838
atgtatgatgatgggaatgaagaggacaatgaatatgattcattggatattaaggtggaagaaaggaaacttggtcaatatgattcccctacttttatcttgtccaagagagcaacaacagggaatgaagggccacaagcctccaatgacaaggttaagggtcaaggcactatttttgaaggtcctttggatgttgtcaagaaggcttggagacctagaaagggaatgaaaaagaaggataagttagcttctagtgctactttgaaaaacaaagtagataaggtggtggtcaaagggattgaaaacataactatggtttctagaaaggagcgagtggaatttcatactacagttataccagagcagaatcgggggataggtttcatagataatagggaaggttttcattattcttctaggccaccagatcaaccaatagttaagtcatctagtcataagccacctgattcacagaatatccatatggattgtgtgaatgaagggaattctaaaattgaggtggtgatggagacaactctttctcaaggagttgctagaaaggattccaaattcgatgtttttgatcaataa

SEQ ID NO: 80061 - DNA, 227 bp, Glycine max
  Peptide Sequence Number=SeqID_196839
atggtgagggaaggagaggcatgtatgtggaagaaggcactggcggcatttgtctggattaatcgtcgaagttgtggtggggaaatggcttccaagtctttggtgcacatgcaaatcagtggtgaaggaatagccttgtgtcgcaacctacccttcggcgggagggcgacacgagggctcacgggtgcgtcttccatgggaggaagatgcgcggagtcgccaccaac

SEQ ID NO: 80062 - DNA, 2313 bp, Glycine max
  Peptide Sequence Number=SeqID_196840
atggcccatatgcttcattccggcatcatcaaactaagcacgagccccttcttggccttgaacgccctcacaatcaaggatcgtttcccaatccccacaattgatgaacttttggacgaattgggtggcgccacttggttttccaaacttgatctcatgcaaggctaccaccagaccctcatggcggagtctgacatcgccaagacagcctttcggatgcaccacggccactacgagtttctcgtcatgctgtttggcctctataacgccccatccacctttcaggtagaatatttgggtcacatggtgtcttgccggggagtggagcccgtaccagctaagattacggcagtccagaattggccagttccccaatccactcgtgcattacgaggcttcctcggcttgtcgggattttacaggaggttcataaaaggctatgcatccctcgcagctcccctcactactctcttagctaaagattcctttcactggaacgctgatgccgatcaagagttctgcaatctgaaacaagccctgtgcaattctcctaacaaccacccaatagctttctttagtaaaccattctgccccaaacttcttcgtgcatccacatatgtcagggagctcgccgccatcaccaccgccgttaaaaaatggaggcaatacttgttgggtaattccttcatcattctcacagaccaccacactctaaaggagcttatgagtcaagtcattcagaccccggaacaacaacgttatttggcacgcttgttgggatatgactactctatccattatcacactggacgctcaaacgcgacggcagatgccctgtcatgccaaatggaagccaactcgccccaattttttcttctaacagttcccaattccctctttttgcaggaacttaaacaggagctccttcgcaattctgccttcatcgattttcgaaatcaaattcaggccaacccctcccaataccctgagcactccatacgacacgacttcatccttcacaaaggtcgtatatggctccctaaggatctccaggccatccctactatcctcgttgagtttcacaacacccatactggcggccacatgggcattgcgaaaactttggggcacattagtgagaattttgtctggccttccatgaagcaagatgtcaagctattcatttcttcctgcctaatctgtcaacagaccaggaacgatcaccgcaaaagcccagggttactttgtccactgcctattccaaagaagccatgggaggacctctccctggacttcatcgttggtctgtcgcctttccaagggcataccacgatactcgttgtggtggaccatttctccaaaggattacacattggcttgcttccagcacactacaccatgaccaccgtagccaggatatttatggagattgttggcaaaatccacgggatgccacgcagcctcgtctccgacagagatcccctattcatgagtcgtttttggctagaactattcaagctaagtggaaccaaactcaagatgagcacggcctaccacccccagacagacggtcagatagagtggtcatacaacacatccatacactccgctaccggaaaatcaccgtatgaaataacctttggcaagaagccccctaatcttccacaatacgtggccggcgactccaatgtgacagcagtaaatgattggttgactgagcgtgataacatgatttctaaattgacaaagcatctatcaaaggcccaacagaaaatgaaggagagtgcggacaaacatcgaagggaccttcaatttgaggaaggcgcgatagggcctatggcccacaagcttgacctcccggagtcatcacgcatccatccagtatttcactgctccctactcaagccttacaccccatcaaccactccgccggaggttcctcttagccttccagcctcgtcagaagaccaccagccactcatttttcccctagcaatcctggacactaagtggactcagtcagaggaggagagtgaattacttgtacttgttcaatgggctggtctactgccggaggacacctcatgggaaccttggactcaattgaaaactgattataaccttgagaacaagaccaagctacctcaaggacttcgtaagcaggtagtggtgcagaatgtgtcctgctctggcaacattgctcctgatggtagtggcacgcctgaagacgtgttgttgcttgaattcgttaggactgttaagaccatgtttcgcttttatcattttgcaacttttctgttcctccaaggctaa

SEQ ID NO: 80063 - DNA, 713 bp, Glycine max
  Peptide Sequence Number=SeqID_196841
tatttggcaactcccttgggaatgagtggcttcccttcaatgacatgatgtacattcaatgctgtgattgccctgctggcctaggccattgtttcatcggtggagtgcttgaaacttcgagatcttgcaagcaactcataggacctgaagggtccgataaggaatttgaaggctatattgatagcaacctacgtgttgtggagaccttcttgcgtttgttccccattggtctttgtgtcacagctcttgtaattatgctcaagaactctcaggaaaataagtatggctctgttagctacaccgaccttggtgctttcaggtatttggtgcatgccaatggcatttgtgcaggatattcattattttcagccatttttgttgctttgcctcgtctgtcgagcatgcatatagcttggactttctttgtgcttgaccaggttttaacgtacataatcctgtctgctggagctgcatcagcagaggtgttatacctggccgaaaagggaaacatggcaacagcatggagctcagcttgtaggtcttttggtccattttgtcataaggttactgcatcaacaactatcacatttgttgttgttgttttctatgtcttgctttccctcatttcatcctacaagttgttcagcaagtatgatgcaccaactgtgagcaacccctctatgggtgctgacattgttgctttccatggctag

SEQ ID NO: 80064 - DNA, 754 bp, Glycine max
  Peptide Sequence Number=SeqID_196842
atgggggaggattttcttaggaggtctggcattccatttaccataatcaggttgacagatggaccatacacatcttatgatctcaatactttactcaaagcaacagctggacaacgacgagcagtccttataggtcaaggagataaactagtgggagagaccagcagaattgtggttgctgaagcatgcgtgcaggcactagatcttgaagtcactgaaaaccaagtatatgaagttaactctgttgaggtgtgctgcggtggtcggcgacggcaaacgaggtacgctgaaggtggtgcgtttgtcgcgaacgtacggatcacttacggatcagcatgtggtgcgaatgaaccacatgttgattgttcagatgcgttcaacacttctcaggtttttgagtgtcaagaggatgttttgtggtgggctcgatctgtggctcatgaaaacggatttgtggtggtgattttaaggtcggacagaaacacagacactaggactaggaaatgtgggtgtcccttcaagcttcgttgcaagccagtggttggaggagaaggctggatggtgaagttgatttgtggagtgcatagtcatgaattggccaagtcattagttggacatccatatgcggtgcgattgactaaaactgaaaaaacacttattgttgtgtcgcaacatgccctttcgcgggcgagcgaatgcgaggctcatgggtgcgctttccaaaggaggaaagatgcgcggagtcgccaccaac

SEQ ID NO: 80065 - DNA, 333 bp, Glycine max
  Peptide Sequence Number=SeqID_196843
ctcattgatgttactgatcgagctaagaaagatgaaatagttaaggttgttatggctttgaaacatgcaaaaattgatgaaggttacacaattgatgttgttgcaactcgtcagggagaaggattaaagatatttcaactggcccttgacccaaatgcgatagagatgcatcatagaattacagttagaggtagactaagaaagaaattctatgaactcaaaggcaatactcaatctccaccaaaacttatgtcaatactcaatagcctttttgatggatgggacccaatgagatcagtttcagcacctgctcgagcccttgttcaatggtga

SEQ ID NO: 80066 - DNA, 144 bp, Glycine max
  Peptide Sequence Number=SeqID_196844
atggagctacgggttcaaaaattgagagtgcaaaagaaaatggggaaagcctttccaaagatcttagcggcaccagcaatcctcagtgctgttgaagatggtttggaaaattaccttgacacctttcatatgcatagcagctaa

SEQ ID NO: 80067 - DNA, 177 bp, Glycine max
  Peptide Sequence Number=SeqID_196845
atggatgggtctggaagtcatggtggaactttgcagctattgatttttgtcatgtctactatcctgcaagtaaatgtaactgataagaggaagatgaagaataaacgtgacagatactcctctaaaaataattttcttactaaattgaagaacatttccaatgtcatgaaggagtaa

SEQ ID NO: 80068 - DNA, 813 bp, Glycine max
  Peptide Sequence Number=SeqID_196846
atggaaaacaacagcagcacaaatgccacatcaaaactaccccgcagagcaaaaagaaaaaagaagggtctgggagtaaatgttgctcaagtagcagacaacacatcagaattctcatttgctatagccaaaactgctgttgctcaaatctgccaatcagttggatacaaaatctccaaacaccatgctcttgaagccttaactaatgtttccacaagatatatggaagccattgtgaggtcagcttcctcttttgccaatgcctccaatcgtaccgactccaacctctttgacctcatcaatggcattcatgatctgtgttctgttctaggatttcctggtggttcaatgatacacaaaagtaacctgctggggtcttcagctctaaaagagattatgaattttgtcaacctctctaacaaaattccatttgctaaaccaattccattcagaaatgtttctgaagtaaccattgattctggtacatcaatgtgcttatctaagcaagcgaaaactcacataccaagatggctcccagattttcccaaggaaaactgtaatcgggttttggttaaggagaggaaatgtgatgaaaaattgtgggaacatttacttgctgcggaggaaaacagtggcttattacgtagcaatgacattaatggaaaagaaggtaaaaacgcaaggatggaattgccaaagggaagagaaagaatgaagtttaaaattagaggggagaagaagaagcatggtggattgggtgtgaatatgatgaatggggattgtaaaggaaaaacgagtgtcttggaattatga

SEQ ID NO: 80069 - DNA, 276 bp, Glycine max
  Peptide Sequence Number=SeqID_196847
atggtgaagagaatgaagatcttgcttatcacttatctgaaaatttcaacaaaaacaaagacttttatgagaaaaaatgtaggtgtcaagatgaggttgatgtggctagaagatcctaagcctataattatgagcataaagacttacgtaagcataagccacactaaagatcccattattcccatcattgaatcatcaccacatttatacttagctctaagccacttgtgcccaagccttatcatcgttcttgcacagatcccacgaagcttttga

SEQ ID NO: 80070 - DNA, 585 bp, Glycine max
  Peptide Sequence Number=SeqID_196848
atgtcgttgcgcaggcgaaccttgctcaaggtcattgttctcggcgacagcggttctgtgtggaccttagctaactgtgtagatacgtgcacaagaagtttagtcagcaatataaggctaccattggagctgattttgtcaccaaagagcttcagattgacgacagacttgtcactctacaagtgggtttcgtttcctgtttcaacgatatgggacactgctgggcaagagcgattccagagtctcggggttgcattttatagaggcgcggattgctgtgttcttgtgtatgatgtgaatgtgatgaagtcgttcgatacccttgagaactggcatgaggagtttctcaaacaggcaaaccctcctgatcccagggcatttccatttattttacttggaaacaagatcgatattgatggtgggaatagtcgagtggtttctgagaagaaagcaaaggactggtgtgccgcaaaagggaatattccctactttgaaacatccgcaaaagaggattacaatgttgatgctgcattcctgtgtattgccaaagctgctttagccaatgagcatgaacaagacatgtaa

SEQ ID NO: 80071 - DNA, 792 bp, Glycine max
  Peptide Sequence Number=SeqID_196849
atgacgacgcaacttagcgatacggaactcatagccaccttgcaagccagggccaaggaattagaagctgagaatgcaaagctattatcccaacttgctgattgccgctgtcatgagatggagaaaaaattgcatatccctgatgagaaaggcagggaatcaaaaaaaggcaacaggaaatctgaagagaagatagagaaaatgccaggctataacacaaggtttatgagtcatcatagcaagagatatgtagctttaaaagtcacgtactttggaaaaaggttttatggttttgcttcagaggcacaaatggaaccaactgttgagtctgaactttttaaagcttttgagaaaacaaggctattggttggtgataagaaggagtcacagtattcaagatgtggtagaacagacaaaggggtttcctctgttggacaaatacccccaataacaatcattgtgcttctaaagagtaaagacctatatggcaaatgctatggaagaaaagatgaggtgatagctcttttcctaagatcaaacctcaagatatctgcaacaaataatggaaattctggagttgttttggatgagcaacatggggaaatagattatgttggggtgctaaatcgagtccttccaaatgacattaggattatgggctggtgtcctgctcctgttgatttccatgcaaggtttagaataatgattgcaataagcaatgctagacaagggaactactttccagtatcctgcataatgggatggaagcaattgtggcaacactggacatag

SEQ ID NO: 80072 - DNA, 384 bp, Glycine max
  Peptide Sequence Number=SeqID_196850
cacttggaggagaaagcgaatgctttggcggatcaaggtgaatgggctttgttcattgatgtcttggcgctattggtatttggagccgtcgtctttccaactgtggatgggctagtggatctagcgacgattgacaccttccatacttatcaccatagcaaggaaagtttggtcatggctgttttggccaatgcctacgacacatttaaccggagatgcgagaagagcggcgcaaggattgtctgttgcacacccactctttatgtatggatggtctctcacctctttcatcatgaaagtagacctgtctatcccctacaaggtcaccacatttgccccgagaaagggaaggcgaattgggagcacctcttgccaatatggtag

SEQ ID NO: 80073 - DNA, 2031 bp, Glycine max
  Peptide Sequence Number=SeqID_196851
atgtcacattccaggaaacccgtgtcgtccgagttagggttcaccgagcggttccgcgactcactgagttgctccgacgacaacaccaacaagcccgatttccgagaactcgatttgggttcaccggtttccacattgcggccacgtcactaccacagtgcacccactacaacgagtagcactagtacgagcactagcagcgggtcgaccgggtcgggttcgggtcgaagcggaaacaataacgcggtttccaagagatcccattccggcgagttgtctgggtcgagcgagaccaatagtccgacccgtgtttccaaaccgggtcaccggagatccaattcgggtcagagccagagatctccgtcgtcttcctcctcctccgccgcggtgaattcaccgcctctgagcgttctcccggccgggaacatctgcccgtccgggagggttctcaaggcggcgaccgcagcggtggcgcccagccggagctcccggtcggatgttctgggatccggcacggggaattacggccacgggagcataatgcgaggtggaaaaggtggtggtggtggggatgtgaggatcgccggagattcagcgaagcgcgtggatccggaggaggtgaagaggatgggaaatgcggagtataagagagggcactttgctgaggcgttgtgtttgtatgatcgggcaattgcgatgtcgccgggcaatgccgcttaccggagcaaccgtgcggcggcgttgaccgggttgggacggctgccggaggcggtgagggcgtgtgaggaggctgtggtgttggatcctaattatgggagggcgcatcagcgcttggcaatgctgtttctcaggttaggacaggttgaggattctaggaagcgcctttgttatcctgggctgcagccagatcctgctgagttgcagaagttgcaaattgtggaaaagcatattaacaaatgtggtgatgtgcggaggatacgagattggaaaagcgtactgagggaggttgatgctgctgttgctgctggagcagactcttgtgttcagctctttatgtgtagagcagaagcccttctcaagcaacaccagatggatgatgctgaatcatgtttatcacagattcccaaaagcgagccacgacctggttccttatcacaggcaagattttttgggatgttttccgaggcttattgcttcttcgttagagctcagattgagatggcttttggaaggtttgagaatgcagttacagctgctgagaaagctagtcagattgacccccgaaatgttgaagttgctgttttgctcaacaatgtgaggatggttgctagagctcgactgcgtggtaatgatctttttaagtcagaaaggttcactgaggcctgctcggcatacggggaaggtttgaggctcgacccttcaaactctgtcctctattgcaatagagcagcatgttggtttaagcttgggcaatgggaaagatcaattgaagactgcaatcaagctttatgcatcctaccaaattatacaaaagccattcttcgaagggctgcctcaaatagcaagctagaacggtgggaagaagcagtaacagattatgaacttttgcggagagaactaccagacgacaatgaagttgctgaaaatctgtttcatgcacaagtagcattaaagaaatctcgtggggaagaagtacataatttaaaatttggtggtgaagtggaggacatatcaggtcttgagcagtttagagctgcaatatctttaccaggtgtttctgttgtcctttttgaaactgcatcaaacatgcaatgtaagcagatatcgccattcatgaatacactatgtagtcgtcatccatctattaacttccttaaggtggatattcaaacaagccccgcagtcgccgctgctgagaatgttagggttgtaccaaccttcaagatctacaaaaatggcagtcgagtgaaggaaattatatgtcctagtcatgatatgttggaacactccattaggcattacagcttgtag

SEQ ID NO: 80074 - DNA, 414 bp, Glycine max
  Peptide Sequence Number=SeqID_196852
atgaagtccttggtatggagacttgctcatgaatgccttcctacaagagctaatcttagatcaagaggagttgattgctttttggtatgccctctttgcgagaatgatgtggagactacattcaacatcttctttgactgtcagagagaactattgatggtgctgactcttgtaatgagtagtcatgaaaaagttaaactaagtcatccctcatcaacaacagagggtagttgtgttgcattggaacacgtggagaaggcagaacgatatgctttgggagctcaaagagagactggtggtagcaagaacaatgttgaagaagccatgtatgaaagtggacgaaggagtgatgtggggtttggtagttgtgctggaattcgcataattcattggccttcatcacattgtgtttga

SEQ ID NO: 80075 - DNA, 192 bp, Glycine max
  Peptide Sequence Number=SeqID_196853
atgccaaagtctggaaaagcacttgaagccaatggtacttggacccttactatgttgccaaaaggaaagaaaccgattggatgtaagtgtgtctataaaagaaagtataactttgatggaatcattgagcgatacaaagctcgacttgttgctaaagggtacaatcaagttgaagggatggatattacatag

SEQ ID NO: 80076 - DNA, 447 bp, Glycine max
  Peptide Sequence Number=SeqID_196854
atgccaccatcactcggtttggaacattggatcgtggacactctcattgaccaagctaaccattgctggaattcaaatttgattaagcaagtctataatactcaagatgtgcaacatattctctctcttgttttgatggatatcaatgatattttagctgaaagtgataaggaactcctagcattgatccaagagtgggaaaagccttcttctaattttcttaagcttaacattgatgcagctttattcatagaccagcagtgctttggtctcgggttgtgcattagggatcattctagtggatttgtaagagcaaaatcttttctccttcaagactccaaaattgtggtggatgagttcaacaaacatctattatatcaagatgtaaatctgttttgttcagagacaagccaaccaagttgttcattctcttgcaagagaatctag

SEQ ID NO: 80077 - DNA, 360 bp, Glycine max
  Peptide Sequence Number=SeqID_196855
atggccttggttgcaattccatggttgttttggtttctcatctttttatatagatgttgctttaaacccaatgatggcaaatttgataatcgtggtaaagttgcagcaactccaaattgtgcactaacagctgttgtgaccaacccttgtggtgaaaagtctccggatcattccgttgaagatagagggcaccatgttcattttggcgcagttgttgagatggggaacgaaattcaagaacaccattatgaagaaggtggtgataaattacaacgtgagtccaaggaagaaacaacaataccatctttggtaatgattgagtctagagaaagtgaaaaaattcctttaaaatctcagtag

SEQ ID NO: 80078 - DNA, 672 bp, Glycine max
  Peptide Sequence Number=SeqID_196856
atgaggatgttgcggtggatgtgtggtaagactcgacaggataaaattagaaacgaagctattagagagagggttggagtagcgcctattgtagagaagatggtggaaaatagacttaggtggtttgggcatgtagagagaagatcggtagactctgtagtgaggagagtagaccagatggagagaagacaaacaattcgaggcagaggaagacccaaaaagactataagagaggttataaaaaaggatctcgaaattaatggtttggatagaagtatggtgattgatatgctactggacacttctagaatcctaaggaaaccccaatacactatggcttcagaggttccattggttcttcagtcctgtgaatttgacaacattaagtttatgtgttcatcagatgcgggagaagcgctgcgtgtacacttggtgaatgaatgccaaatttaccagcttcaagctgcaatctttcatgaagctcttctaaattgcgtgcctctatcaaatggtcctgcaaatgcgtttgcaaattacttcccaattactttgcttttatttatagtgatctattatgctgatagcccttccttttccagatcaaagcttgctgccttttcaaggatccaagaagaaagtttcccatgtccctcttatgtcacgaccaactga

SEQ ID NO: 80079 - DNA, 291 bp, Glycine max
  Peptide Sequence Number=SeqID_196857
atggaagctgcgatgggactgatgcggaggattcctccgaaacacacagaaacagctctgtcagcgcttctgagccttatgcctgacaactcctccgatctcctctctcaagtcgatcagcccctccaggttctgtgcgatgtggaatgcggcaaggagttcattttgtgcgaatacaatagagatgccgactcttacagaggtaaagatacagcaagttggttgtgtctgggagaaaaatcagagagagagagagggaaaatggaagaaatgattttccacgatgattaa

SEQ ID NO: 80080 - DNA, 312 bp, Glycine max
  Peptide Sequence Number=SeqID_196858
atggtgatgttagcagcattgatgataatagagacaccaatagtgattgcgatggcaatggtgatggtggtgattggtgaaggtgacattggtggtagtaaaaatgacgatgatgtggtagtaatgtcagtggtatcggtggccacagtaattggtggtaacaatactaatggtaatggtggtggtgataacaatgtttgttgtgatggtgatgtcgatggcatcgacaacgacaatggttgtgccatagtggtgacaaatagttatgacaatcacaataatgatagtggtgtgatgatggtaaagacataa

SEQ ID NO: 80081 - DNA, 1565 bp, Glycine max
  Peptide Sequence Number=SeqID_196859
gtgttgtatatgaatctgttggctttcctacggaaggcaataacaatcaaagtagcactgtggaagatgttgctacaagtagcttgtcctctgctctctgggcctttgttgagtcaatacctactactcctgcatcagctgctgaaagtgcattggtgaaccgagctttgaatcgaatgtctagcttcagcaggttgaagatcaagcacaccaacattgctgcatcaggcaatataaggtgtagggtaattctaatgaaccttaattcaagagaaggcgctgtaaaggaatttgcaggtgtcgctgctggagaagatcgaatcgaaacgcgaataagtttctttctctctcgttggacgaataatggttctgaggaggaagaagatggagcagcgcttcaccttcttctgctgttgatttcatggccacctcccagtcccagcatcgctgcgttttcgggttattatgacgattgttgtgtttctgatgtagttgggaatataccgtatgatgccacagaggaacagcttatcgaaatctgccaagaggttggcccagtagtctcattcagactagttattgacagagaaactgggaaaccaaaaggttatggattctgtgagtacaaggatgaagagacggctttgagtgctcgacgaaatcttcagggttatgaaattaatgggcggcaattacgcgttgattttgccgaaaatgataaagggaatgatagaaatcgagaacagggtcgtggcggtcctggaatgacaacaaatgttgaccatcagaaacaagttggtgtcccagctgtccatggggaagctgttcagcatcagcctattggtcttcatattgccataacagctgcagctgtcatgacagcagctctaggtggtgctcagtttggcatccagtcaaatcaaaacagtttgcagagtcagtcagcattggcacatgatcctttaactctgcatctggccaaaatgtccaggagtcagctgacagagattatctctgagctgaagggaatggctacacaaaacaaagaactggctcgccagctgttgctttcaaggccgcagttgcccaaggctctttttcagttacaaatgccaaaccttaggctggtttctgatcaaacctcacagtcttcaatgaatgaaggccagctgggtcaggcatcattggttcaaactctgtcaggccttcctcatgggcaggacaagttgcagcctggtttgacaccttatgctcaagaaggccaagtcaacaccatacctcataatcctttggttcctagtcaattaactgcgcatccaaagcctccagtgcagcctcggattccccttcagcaaaatccaaacaatcttgtactgccaggaacattgtctgggcagtctaatttaatgcttccttctgcacgttctccaggtttgggaagtttgtctgttaggcctccaattcaactggcaacttcaactgctctaaaccagcaaatgcatgcctctttgctacagcattctgtacatgttggaaactcaactgtaggacataatgttcaaaag

SEQ ID NO: 80082 - DNA, 210 bp, Glycine max
  Peptide Sequence Number=SeqID_196860
atgcttccgaatcacatcggtgatcgattcctacaccgttcatcgttcattcttcgttcttcatccggacgtacccttgccccaaacgagaggccttttcgtgcccccgtcggagggcagggaccagtcactagagccatgagcaagaggctccaagaggattgggctagagctgctgaagaaggccctagagttctcataaacctcagg

SEQ ID NO: 80083 - DNA, 186 bp, Glycine max
  Peptide Sequence Number=SeqID_196861
atggcaacgcaatcttatcttctgaatctaaacacttttcgtgttcatgcgggaatcagtggacggcaatgcaagccttcaatattcaaaccaagcaattttggctttagggtctgggtaagcgttactatctgcaaatttctcgtgggagtgcttctattagctaagtttggtatacccatttga

SEQ ID NO: 80084 - DNA, 300 bp, Glycine max
  Peptide Sequence Number=SeqID_196862
atgccacaactctgtagactatttctcatttttcttcctcttttgcattctcatctctctgttccccaaatcgacgacgtggacaacaaattgccgaggaagcatgaggacaccgatgacaacgacatccgagacttcgagtctgacttcgaggatactcacgatacgaacgaggagattgacgatttgtacaacggcaggaatgtggagatgaagaggatggtgaaggccgggtacttcaacatggatgataaaaagggagcgttgaaatttcctgtttcagtaattaatatggactag

SEQ ID NO: 80085 - DNA, 483 bp, Glycine max
  Peptide Sequence Number=SeqID_196863
atgttgcctgccctagctcacgaacaatccaaaaacggtttcgtgcgcctaagaaaacatcttcaggatgcttctcttaataacgttatgaccactgttttcggaagacggtacaaccatgatgaaagcaatagtagctatgaggttgaagaggtgcgtgagatggtgatggaagggtttgagattttgggagcattcaactggtctgattatgttccttggatcagcttcttttacgatcctttgcgtattcgagaacggtgctcggttcttgcgcccagagttaagaaatttgtgaagcgggttttggaggagcaccgaataatgccttcgttcaaggaactttctgatgactcggactttgtggacgtgctgctctccctagaaggggatgacaagctccaggatgatgatattattgccgttttatggatttacgtggagatacaaatattgactctagaagcaaccatgctatattga

SEQ ID NO: 80086 - DNA, 1698 bp, Glycine max
  Peptide Sequence Number=SeqID_196864
atgtcgtttggcaagaaactgttcctccaaattctgtggtggttttccttgatcggtcttagttcccaaagacggagtcattacagttttgttgtgagagaggccaattatacaagactcggttcaacaaaaagcatattgacagtgaatgggaattttccaggaccaactatcaaagtccacagaggagaaacaatctttgttaatgtttataacaagggcaactacaatatcactttgcactggcatggagtgaagcagccaaggaatccatggacagatggtcctgcatacatcactcagtgccccatacaacctggaaggagattcagacagaagttgattttttctacagaggaagggaccatatggtggcatgctcatagtgactggtcaagagccactattcatggggctatctttgtctatccaaccaagaatacaccctacccttttcccaaacctcatgcagagattcccatcatatttggagaatggtggaagagtgatatcaatgaggtgttcacacaatttattgaatctggaggaggcccaaatatatctgatgctctcacgataaatggtcaacctggggatttgtacccttgctcaatggcagaaacgttcgagtttcatgtagagcaaggcaggacttatcttctccgtgttgtcaatgcggcaatgaatctcattctcttcttctctgtttcaaaacacaacctcactgttgttggtgctgatggtatgttaaccaagccattggcaagggaatacatttgcatatcaccgggacaaacaatggatgtgttattgcatgccaaccaagaacctaatcattactatcttgctgcaagagcatattcaagtggtgttggtgttgcctttgataacaccacaaccactgctagagtaaagtacagtggaaactacactccacgttcatctccttcattgcctaaccttcccaactttaacgacacgcgtgctgcgttggacttcattacaagcttgagaggcttatctgagagataccctcgccaggtcccaacaaacatcacaactcaaatagtgaccactatttcagttaacactttgccatgccctaataatggcagaacctgccagggaccaaatggaaccattttcgctgctagcatgaacaacataagttttgacacccccaacgttgacatactaaaagcctattactaccatatcaacggggtttacaaaccgggatttccaagatttccaccctttatatttaacttcactggggattttttgcctgtaacattgaatataccaaagcaagggactagggttaatgtgttgaattatggtgcaacggttgaaattgttttccaagggacaaacgttgttgcagggatagaccatcctatgcatctccatgggttcagtttccatgttgtaggatatggtttaggcaattttaaccaaagcaaggaccccttgaatttcaatcttgttgatcctccttatttgaacacagtgattgtccctgtaaatggttgggctgctattaggtttgtggctaccaaccctggagtatggttcatgcactgtcatctagagcgccaccaagcttggggcatggagacggtgtttattgtgaagaatggaaaggcttcaaatgaaacattaccaccaccaccgccagatatgccctcttgttga

SEQ ID NO: 80087 - DNA, 1695 bp, Glycine max
  Peptide Sequence Number=SeqID_196865
atggcgcgtggcaagaatctgttcctccaaattctgtggtgtttttccttgatcggtcttagttcccaagcacagaattacacttttgttgtgagagaggccaagtatacaagactctgctccacaaaaagcatattgactgtgaatggagaatttcccggaccaactattagagccaacagaggagacacaatttttatagatgtttacaacaagggcaacttcaatattactttacactggcatggggtgaagcagccaaggaatccatggacagatggcccttcatacatcactcagtgcccaatccaacctggaaggaaattcacacagaggttgatttttactttcgaggaagggaccatatggtggcatgctcatagtgaatggttaagagccactgtctatggtgctatccacatatatccaaataagaataatccctacccttttccccaacccgatgcagagattcccatcatatttggagaatggtggacgagtgacgtcaacgaggtcttcagacaatctatggaaactggaggagccccaaacgtatctgatgctctcactataaatggtcaacctggggatctgttcccttgctcaagtccagaaacgttcaagctaaatgtagagcaaggcaagacttatcatctccgggttatcaacgcggcactgaatctcattctcttcttctctgtttcccaacacaacctcactgttgttggtgctgatgctgtgtacacaaggccactgacaagggaatacatttgcatatcaccgggacaagcaatggatgtgttgttgcatgccaaccaagatcctggtcactattatctggctgcagcggcatattcaagtggcgttggtgttgcctttgataacaccacaaccactgctagagttgagtacagtggcaattacactccaccttcatctccttcattgcctaaccttcccaacttcaacgacacgcgtgcggcgttgaacttcattacaaacttgagaggcttacctgagagagcccccagccatgtcccaacaaacatcacaactcaaatagtaaccactatttcagttaacactttgccatgccctaatggcagaaacgactgccaggggctaaatggaaccattttctctgctagcatgaacaacataagctttcgaatccccaccattgacatactaaaagcctattactaccatatcaacggggtatacgaacctggatttccaacatttccaccgtttatatttaacttcactggggattttttgcctataacactgaatacaccaaagcaagggactagggttaatgtgctgaactatggtgcaacagttgaaattgttttccaagggacaaaccttgttggcgggatagaccatcccatccatctccatggctacagtttccatgttgttggatatgggctaggcaattttaaccaaagcgtggatcccatgaatttcaatctcgttgatcctccttatttgaatacagtgatagtgcctataaatggctgggctgccattaggttcgaggctgtaaaccctggagtatggtttatgcactgccatctagaacgccaccaatcttggggtatggagacagtttttattgtgaaggatggagagtctgaaaatctaagattgccaccaccaccgccagacatgcccccatgttga

SEQ ID NO: 80088 - DNA, 248 bp, Glycine max
  Peptide Sequence Number=SeqID_196866
gtgaatggtggaagaaagatgtcgttgaggtttacaatgaacttcgtagaagtaggagacatgcggctatttacgtacaattaacgagcaacctggtgatcttcatccatgctcaaagaatggttagagttgattatgggacaacgtatctgcttagaatggcgaatgcggcagttcaggacattctgttctttgccattgcgaaacataaactgacagtggtgggaattatgatggtagctatgtaa

SEQ ID NO: 80089 - DNA, 294 bp, Glycine max
  Peptide Sequence Number=SeqID_196867
atggcgattttgaagacatcccttgaaggtgttgacaaggtggaaaagggtgataatggttgtgaaccaaatgaagcattatgggagaatatggaagatgttcgtgttgtagagaaggtcctttgtcctctaaccactacatttgattttgtggtttgtgcaattgaagagtcaaaggacatcaaatcagtgattgtgaacaattattgggttcatttcaatcatatgaagaaaggttcaaaagaagaaatgatgagcctttggagcaagttcttaaagccaaaacttctttga

SEQ ID NO: 80090 - DNA, 342 bp, Glycine max
  Peptide Sequence Number=SeqID_196868
atgaaggcccaagtggagaaggatgaaggcccagaggcagagacactatcaagactattaattgttgctgaaggcccaaagtttctctctaggttcctggttgaaccaattatcagacttatcaaggtaatccttgtggcgttctacccagacttatcttccttaaccggaagtggcgtctacccagacttatcttccttcactggaagtggcgtctaccctgacttatcttccctctttggaagtggcgtcatccaaatctctgtaacctgtatcaaacgatccgctcctagtcaggttcacatcacaacgtttgtcaaaaaattgcgcaatgttggctga

SEQ ID NO: 80091 - DNA, 795 bp, Glycine max
  Peptide Sequence Number=SeqID_196869
atggttcatgcacttcttggttcattccttgcaatggccacaaaagcaaaccataagctgccatcgggaccatcccgtgttcccatcataagtaacctccttgaattgggtgaaaagcctcaaaattcattggcaaagcttgctaagatacatggcccaataatgagcctaaagttaggacaaataaccattgttgttatgtctttagcacaaatggccaaagaggtgcttttaaccaatgaccaattcttgtcaaaccaaaccattccccaatctgtgtcagttctaaaccatgaacaatacaaccttgctttcatgcccatttcacctctttggagggaactcataaaaatatgcaacactcaattatttgcccacaagtctcttgatgctaaccaagacgttaggcaaaagttgaaggacttggtgaccaatatcacaaagctggttggaacaccaaacttggcaaatttttttccagtgttgaagatggttgatccacagagcatcaaaagacgacagagtaagaactcgaagaaggtgttggacatgtttaaccacttggttagccaaaggttgaagcagagggaggatgggaaagtccacaatgacatgttagatgccatgctcaacatttcaaatgataacaagtacatggacaagaataagattgaacatctctcacatgatatatttgttgctggaacagatacaatagcatccacccttgaatgggcaatgactgaattagtccgcaacccagatgtaatgtcaaaagcaaagcaagagctttag

SEQ ID NO: 80092 - DNA, 537 bp, Glycine max
  Peptide Sequence Number=SeqID_196870
atgcagatggctctattgaacgccaaaattactacagttcgacttttgctggcactcgctgcttcgaataagtggtttattagacagcttgatgtcaataatgcgctccttcatgttgatcttaatgaagaggtgtatatcattctacctccagttgctcgtggaacctctggtattaacatttgtcaaagaaagtatgcttttgatcttctcatcgatacttatatgttaaattccaagcctgtttctactccttttgattattgtactagactacatcaatcctctgagtcattgctttctgattcacaaatttcttcatatagacgcttaattggcagcgagcttcaactcaaagcctttagcgattatgattgggctggatgtattgatactaggaaattcgttactggtttttctgtttatcttggttcatcacttatatcatggaaatctaagaatcaagccacagtctcaagaagttcttttgaagccgaatatcatgcccttgctactgtaacttgtgaaattcaatga

SEQ ID NO: 80093 - DNA, 948 bp, Glycine max
  Peptide Sequence Number=SeqID_196871
atgtcaaatatacacataatagttagcaaaaaggaatcagttagagttttgagaagttgtatctcctctcttgagagtgggttgggagctatatacaaggtgcagaaggataaaggtcaactaaggagcttacggatattcatcataaggcctggagcttttgatcagttatcagaattagccattaaaaatggaacatcagctaagcttcacagcatagtcacaaaaaggtttggttccagtgataatgaattgagcttcagcaaagaagagctgagaaaagttaaagagcaactgagacttgtgtttgttgagttctatcagaaactcctccatctcaaagattacagttttatgaacctctcagcattttccatgatcatgaagaagtacgaaaaggttaactttctattggagaaagtggagtctaccttcatcagaaactttacacactcaaatcacaaaaaggggaggaagctattaaggcaaaaaacaaaaacagaaaggcacagcacaacatttttcacgggggcaagtggtaacgagaatgaacaactcaccagtgacgacgacgttggggtgatactccggcgaaaggcggcgagggagctgaggctacgattccacggcggcagcgggggaggaaaccaagtacctcagaagattgtcatatgtcagagcgaccctcaaaatgggagatttggcccaagatctttgacaaaattgtatctctttttcttagcttttcaaggactactcatatgctccatttggagttctgtagcatcttataggtcctgtacaaggcagataggtcaaggcaaaactaaaagaaagactaagaaggatcaaactaaagtaaaaccacaaattaaaagaaaggtgagggtggatatgagaatgatatttaggctaaaactaagagaaaagaggggcaatggggagtaa

SEQ ID NO: 80094 - DNA, 288 bp, Glycine max
  Peptide Sequence Number=SeqID_196872
cgcctcgggtcggtagccgggctccgggacattactaccacggctactatcgacccgagcccaaagaaggaaaagaacggactaaagcgaggagttcattggccatacatagtgaagggggatgggggtcaacctctttcatgacccatggccccattgagacacgtttttcggatatggattttttcgagatggttaaccacttttttaaccgtgagagggaggtcattcagaacccgctggctccagtccagaaccggtggaagttccccacgccgatcccccaac

SEQ ID NO: 80095 - DNA, 548 bp, Glycine max
  Peptide Sequence Number=SeqID_196873
gcctcgagaagcgtgatgaggcctacgatagtgctctggatgtaggagtggggattctgcatggtgtagcgaaccccagcttgcatcgtgaggtgcatctgtgcgtgaaagaggcggagaggaaacatggtgttgaacggaagagctcctcctctaacaaggctgtaggtggtgtcggggtaaaggatgcagaggagggagaggtcgaagctggggaactaaaaggagaggagtttggcggtgacgatggagcagaagagggaggcgagggtttagaggaagtgagggcctacaagctccaatggagcttgcatcagctagggacattagaaataacagaagacgctgttagagcctatgatcaagctacgattctaatgagtgggataaatgccaacaccaatttcccaataacccaaacaccagaaggtgatccaaagagcactaccaacgaggacactccctcgaccaccaccacggtggatcctacatgttcatgtgttcatgtggggcttacaagacctttgtgtctatatctgtcgtattga

SEQ ID NO: 80096 - DNA, 341 bp, Glycine max
  Peptide Sequence Number=SeqID_196874
atgctgagattcacccgtcgcgcgctgctgtgcgccacgctggccgcgttccccgccgccgccgaaacgccgaagttcggcccggagctgcagggttttcactacccttacccgttgcagcagttcagcctcacctcgcagggacagccgttaaaaatgggctatatggacgtgccgccggaaggtgccgccaacggccacaccgcgctgttgctgcacggtaaaaacttctgcgccgccacctggcaggacaccatcaaggcgctgagcaaggccggttaccgcgtcatcgcgccggatcaaatcggcttttgctcctccaccaagccggcgcattacca

SEQ ID NO: 80097 - DNA, 1842 bp, Glycine max
  Peptide Sequence Number=SeqID_196875
atgctcaattcctctttcctcaccgtttctgaacacaccttttcccacactccccatcatttcccaacaagggcttcttctcaaagccccaaccttcagccacagtttcaatctttagcctttgcaaaccatgtagtgagtgaattcccatctgggtcttgctccaatgcccccagaagaaaaggggtgttggctgtgcggtcaaagtcaacgctgggagtagaagaagtggtggcagagggaggaggagtgaagggtaagggtgaagaagagtttgatgcaattgttatagggtctgggattggagggttggttgcagggacacagttagcagtgaagggtgcaagagttttggttttggagaagtatgtgattcctggtggaagctctggtttttaccagagagatgggtatacttttgatgtggggtcctctgtcatgtttggtttcagtgataagggtaatctcaatttgataacacaagcgttggaagcagttggttgtcggatgcaagtggtgcctgatccaacaaccgtttacttccatctaccaaataacctttctgttcgagtgcacaaagaatatgataaatttactgaagaattgaccagttactttccccatgaaaaggagggtattctcaaattctacggtgaatgctggaagatttttgatgccctgaattcgttggaattgaagtcactagaagagccactctacctttttggacagttttttcagaagccacttgaatgcttgacactagcctattatttgcctcaaaatgctggagccatagctcggaagtacattcaagatccacagttgttgtctttcatagatgcagaggtagatagatgtaactatttgtttgattcagttagaagtttcaagaaattattaaggaaaatgtgtcctgatgaggaatcaattctagtggatctcatgtatgaggttctatgtgacagacactttggtgggattaactaccctcttgggggtgttggtgggattgcaaagtccttagcaaaaggtctcgttgatcagggtagtgagatagcttacaaagcaaatgtcaccagtattataattgagcagggcaaagctgttggtgtgaggctttcaaatggcagagagttctttgccaaaaccataatatcaaatgctaccagatgggatacatttggaaagttactgaaggacattccacttccgaaagaagaagagaacttccagaaagtttatgttaaagctccatcttttctttcaattcacatgggggttaaagcagaggttttaccaccagatacagactgtcaccatttcgtgcttgagagcaactggtccaaattggaggagccatatggaagtatctttctaagtataccaactgttcttgattcatcattggctcctgaaggccgtcatatccttcatatattcacaacttcttctgtggaggactgggagggtctttcaagagcagactacgaggcaaagaagcagcttgtagcagatgaaatcacaagcagattagagaataaattgtttccaggtcttagatcatccattgattttatggaggtagggaccccaaagacacaccggcgatacctggctcgtgacgagggaacttatggtccgatgccgcgcagaatcccaaaagggttattgggaatgccattcaataccacaggcatagatggtctttactgtgttggtgatagctgcttccctggacaaggtgttattgctgtagctttctcaggagttatgtgtgctcatcgagtagctgctgatattggtaagatagagcattccttcaaatgtgcaacacattaa

SEQ ID NO: 80098 - DNA, 1679 bp, Glycine max
  Peptide Sequence Number=SeqID_196876
tgatcaagggcatgacaacaactgaggagaaggatatcttgaatgggatcactggttctgtaaatccaggggaagttttggcattgatgggcccctcgggaagtggaaagacaactcttttaaaccttcttgggggaaggttaagccatcctataagtggtggttctatcacttacaatgaccaaccatattccaagttccttaagagcaggataggattcgtgacacaagatgatgttctgtttcctcacctaactgtgaaagagacattgacatatgcagccaggctaagactaccaaaggcatacacaaaggagcaaaaggaaaaacgagctttagatgtaatctatgagcttggcttggaaaggtgccaagacactatgattggtggttcctttgttcgcggagtatctggtggtgagaggaagagagtttgtattggcaatgagatcataatcaacccttctcttctttttcttgatgaaccaacttctggtttggattctacaacagccttgaggattgttcagatgctacaagacatagcagaagcagggaaaacagtggtgacaacaatccaccaaccatcaagcagactcttccacaaatttgacaagttgatccttcttggaaaagggagccttctttactttggaaaagcctcagaaacaatgacttacttccagtccataggatgttcaccacttatttccatgaacccggcagagtttttgctagaccttgctaatggaaacataaatgatgtttccctaccttcagagttggaagataaagtgcagatgggaaatgcagaagctgaaacacaaaatgggaagccatcaccagctgttgtacatgaggcatatgaaactcgagtagcagaaacagaaaagaaaagactaatggttcctatacctcttgatgaagcactgaagactaaagtgtgttctcataagagacaatggggagcaagttgggatgagcaattttccatactattttggagaggaatcaaagaacggaggcatgactattttagctggttgagaatcacccaagttttatccactgctgtcatcttaggattactttggtggcaatcagatactaagaacccaaaagatctgcaagatcaggcaggattactattctttattgctgttttctggggattttttcctgttttcactgcaatattcacatttcctcaagagagagccatgctgagtaaggagagagcagcagacatgtacagattgagtgcatacttcctggctagaaccacaagtgaccttccactagacctcattttaccagtgctttttctacttgttgtttatttcatggccggcctcagactcagtgttgcaccatttttcctcacggttctcactgttttcctctgcattgtggctgctcagggacttggacttgctattggggccacacttatggacttgaaaagagcaacaactttggcttcagtaactgtgatgaccttcatgctggctggaggattttttgtgcaggtgcaatatgaacacatctcaccagtcatcaatgggatcagaattgatagtggtgcaacagaggtagctgctctaatagccatggtttttggttaccgtttcttggcatatctttctctaaggagaatgaaacttcaatctggagcttaa

SEQ ID NO: 80099 - DNA, 360 bp, Glycine max
  Peptide Sequence Number=SeqID_196877
atgccaaacaagcttcaatcaaattttgatccacccatcaagattttagatgaaacccatttcttgaaattcaaagttcaagctccaaggaagaggaaaaactttgaaggaggaaagtatgaaggaaatgagagaaaaaggatgggatttcaacatataagagaattgaagaaagtctttgaggaaaaccggcataatattacaatattcaaatacagtctcgcgaaaatcgtatttgaattagggcaatttaagttattcggtcgtgccatgatatcaccccgctcattcacacaacctcccgccgttctctcgatgtttgattactccgttgaagtcgttgtgctctgtgatcattga

SEQ ID NO: 80100 - DNA, 237 bp, Glycine max
  Peptide Sequence Number=SeqID_196878
atgactgaatatcaggctaagcatttccaaaattccaagtttcaaaatttagaaatggagtgtaaaacagaaatgaaggaattcatttggagtggagttgatctaaagactaaaggatttatttgtgaaaatgctgcagcggtacaaacacttcgtcagaggcatgatttctctatttctggctttatacaagtgaggattcagagaccgatacttaagcttcgaatcaagacataa

SEQ ID NO: 80101 - DNA, 2199 bp, Glycine max
  Peptide Sequence Number=SeqID_196879
atggcattgagacgggtgaccaagcctatgtggggcgataatgggctaactacatgtgatggtttagggaaaatgcaatcgcaacgatgtcgtgttgtggactctgtgaaaatcgcaattgcgagcgccttacgtatcgtgaaatttcattgcatcgcagctgttgcgtcgtcagtttacagaaagctcacatcgcaaatcttgtgtctccattcagaaattgcagagcggcaaagtttctcagccgtgatagagcagagtcaagatagtttcaaatttggggttcccatgaaggagatgactgaaatgtggtcgagcttaaccggggaggacatgaatgagttgaagtatgactttgtccttgagaggtatctagtttggaatctccgtgtggctcatgttgaccccatgggacctacccaggcactttctttcctttctttttggatggcccacatcaactccagacctgctgcgtctttcactattgttcagtcaacctcgtgcgatatgatgaccaagagagccaactacaggcccttggctgcacttgtcctacctgtggatgtgactatttctgcctcggactataccgattctctccggtttcgagcagccaagcaatctgcctcgcctattactgtcatggctcagtctagtaatcttgtagcttttgtatcccaatcctccactcttggcagttggatacttgattctagtgcctctgatcatatgactggtaaccagtccttattctctcaattgtctttttcggattcattaccttctgttacccttacaaatggctctaaaacaaaagtttgtggcattggtcaaactcgttcactccctaacctttctttaaattccgtcttatttgttcctgatggctctcaatctaaagtttgtggatctcaccttgtctatcgccttcaacattccctctacggcctgaagcagtctcctcgtgcctggtttggccgttttagttctgaattacttcaattttgtatgactcgttatgaggctgaccattctgtgttttcactccattctccatctggcttgtgcatttatctagttgtctatcttgacgacattgtcattactggtgatgactttgacggttgctcaatcctcttctggatttctatttcccagcgtaagtatgttttggatatacttattgagaccagcatgcttgattttcgccatagtgacactccaatggatcccaatatcaagcttcttccgggtcaaggagagccattggaaaaccctcaatttctgaatgctccttgtgattgccattggaatgctgtcatgcgcattcttcgatacatcaaggatgcaataggccatggattactaaatgcagacaaaggtaatgccaagattgtttgctactccaatgctgattgggaaggctcaccatcaaacagcaggtctacgtctgtgctgaagctgtactgtgccatgacagcagctgcaattgaaattacatggccaaggcaacttctccaacaactccgatttggagatactcaagcaactaagcttatttgccataatcaagctactctccacattgcatctactccggtcttccatgaacagactacacatagagaaaaaccaattcctgatacaaagaaagaacggacatctctgagccaggataattggagagggattcctactagactaaataacattccgcattctcgagaaatcaggaaatatttctatgatgatgtgctacaagctacacagagggctatcaatgatggaaaaactagggtgaaggatgtttatcgaataggtaccttgatggaacttgttcgaactcttgccctttcttttgctgatgatggaaaacgggttaaggtttgtgtacaagggtcaatgggagaaggtgctcttgctggaatgccgttgcagcttgctggaactcgtaagattttagagttcatggattggggtgattatggagcaaaaggaaccttcatcaatattggttctataggtgctgcagaggttgaggaggaagatgacatgtttatcttggtggctcctcaaaatgctgtagggaattgtattattgatgatctaagagccatgaccaatgctgctgaacacagaccagttatactaatcaatgctaggcttaaggttcagttcctagctccttttgtatga

SEQ ID NO: 80102 - DNA, 654 bp, Glycine max
  Peptide Sequence Number=SeqID_196880
atgaaggatggtgaactacttgatgaagaagaagtggttgctacggaggaggatgtcgatcttggcggaataggaagcgagaccttgatgggtttgtatggaatagagaacgaatccatgacggatttgtatgaaatagagaatttgatgacaatcaatcatcttgggtttgatttcaccctggttgaaggtcttgctaaccaatctggtggtgtgctttgggttcctgcaaagataaaacttggtaacagagagactcaacaagggcagaccttgggtttctacaaagataaaactcaacaacagaaaggctcaccaaaccttgggtttgacgagcctttggagattagaccagggatggacatgtccatcttggattttggtgaggctcatcaagggcataccttaggtttgacgagcttttggagaatcgaccagggatatgtcggtcttggattttggatggaccttgggtttgacaagcctttggagattccaccagggacgtgtttgtcttgggttttggagagactcaccaagggcggaccttggacccttggacttatcgagtcttgtgcacagggctttaaggatgacctcattggttgtctcttcctgtctggggatgttcgacagaagtcacaaagtgcttga

SEQ ID NO: 80103 - DNA, 222 bp, Glycine max
  Peptide Sequence Number=SeqID_196881
atggaacctttggggttgatggcaaatgggtgtggcagcggaggttgcttaggcgaagaggttgtgagtggaaggagaagtggcgggggtgtagacatgaatgatgatgggtgcaagaagaagaagaaggaagaggagtggagagaagaggagagggaagtcgagttcgttgagtggttcacgaacactcacagaaaccaagtaacaaatgcgtcgatttag

SEQ ID NO: 80104 - DNA, 324 bp, Glycine max
  Peptide Sequence Number=SeqID_196882
atggttgttgagggaggattgaagctctctaaaggtttcttgcatttgaggccaaaccgtgtgctaaccattggtgtaaagaggttgcggggaaagttttactgcgaccccacggtgggcgccaaatgtacttaccaaaatttggagttgattgatgttagggtcaacatagacaagatgggctccacgatctcacacgtcggactacatgtacctttcattgggagaacaaaagggggacctgcaaaacaaaggactctgacgctcaacccaatagtccggatgctgagggagctgcgtttgcacctctggtgtcagggttga

SEQ ID NO: 80105 - DNA, 426 bp, Glycine max
  Peptide Sequence Number=SeqID_196883
atggctcttgcaatttcattctccttcgatcgtcttcctcacttcaaggtacatccttcttccatcatgtcttttgtttttgattctgctatgggtatgggcggaagtgatttcgggggttctaatcagcaaccccttatggatcatgaagttgttctaatcaatgacttctcctcaaaagagacacgtcgtgaagtttctgatggcaagtcctcttcctctgagaggttggtggacccacgatgtgtcggtggggttaactctcgccctcacaggagggcttggttaagggaattagatcttattgtgtccaacctccagtctaggttgaaggagtttgagctcgaggtggcgaaggagaaggaaaccaacatggagttagagaaggagctcttgatgttcaagaaggaggaggccatggagtag

SEQ ID NO: 80106 - DNA, 1983 bp, Glycine max
  Peptide Sequence Number=SeqID_196884
atggaatcttgtgcgcaattcgggttctgggtggtcttcatcttgttcttggcatttcaaattcctcccaattacgggttctaccttccaggtagttacccccacaactatggtgtctcagatgagttgtgggtgaaggtgaattccctcacttccattgacacagaaattccctttagctactacagcttgcccttttgcaagcccgagggtggcatcaaggacagtgctgagaaccttggggagctcctcatgggggataggatagagaactctccttataggtttaggatgtactccaatgagtctgagatttacttgtgccggatcgaggcattgtctggggaccagttcaagatcttgaaggagaggattgatgagatgtatcaggtcaatttgattcttgataatttgcctgctattaggttcacacagaaagaagggtactttatgagatggactgggtaccctgttggtattaagattgaggatgcctattatgtgtttaaccatctcaagttcaatgttcttgtccacaagtacgaggagaccaatgtggctcgtgtgatggggactggtgaaggtgcagaactgatcccggttgtcaagcaggggtcttctgagaagcccggatacatggttgttgggtttgaggtgattccttgtagtattatgcataatgctgattctgcgaaaaccttgaagatgtatgagaagtatccatcgtctatcagatgcgatccagccactgtggcaatgcctatcaaggagggtcagcctgttgttttcacttatgaggtcacctttgaggagagtgacatcaagtggccatctagatgggatgcttacttgaagatggagggagctaaagtgcattggttttctatccttaattcgcttatggtgatcacttttcttgctggcattgttcttgtgatcttcctaaggactgttaggagggatctgacccgttatgaggagcttgataaggaggctcaagcacagatgaatgaagaattatctggttggaagcttgtagtgggagatgttttccgtgctccatcgaatcctgctttgttgtgtgtgatggttggggatggggttcagattcttgggatgtctgttgtgacgatattgtttgctgcacttggattcatgtcaccggcatctcgcggaacactaatcacaggtatcctgtttttctatatgatactcggtattgctgctggttatgtctcagttcgtatgtggaggacgatcggctttggcgaacagaagggctgggtgtcaatcgcatggaaagctgcgtgtttcttcccaggcatttcctttttgatcctcacaaccttgaacttcctattgtggggaagccacagcaccggagccattccatttgcactcttcataatactaatcttgctttggttctgcatatcgttaccccttacacttgttggtggctactttggagcaaaggcaccccacatcgagtatccggtccgaaccaaccaaattcctcgcgaaattccccagcagaagtacccatcatggctgttagttcttggtgctggcacccttccatttggcaccttgttcattgagctcttctttatcatgtccagcatttggatgggccgcgtttactacgtctttgggtttctcttcgttgttttgatccttcttgtggtggtttgtgccgaggtatctctagttctgacttacatgcacctgtgtgtggaggattggaaatggtggtggaaatcgttctttgcctctggttctgtcgccatatacatctttttgtactctgttaactatcttgtgtttgatctcaagagtttgagtggtcccgtgtctgcaactctttacttaggatactcactcttcatggttctagcaatcatgctttctacaggtacaattgggttcctctcttcattctggttcgtgcattacttgttctcttctgtcaagttggattga

SEQ ID NO: 80107 - DNA, 336 bp, Glycine max
  Peptide Sequence Number=SeqID_196885
atggcgtcatggttggcggagcgggggtggccgggaagtgaaagtaaggcatgctggctgccaaacaggcctaaaaatgggcacgagtactgttcactcgagctccggcaacggacggtggcggctgccgtgaaatgcattggtaaaggagaaaaatacccagaaagaagggcagcgagcataagggctcaccggaatgcggaaataggtcgctggaaggacgacaaacagaaagatccactgggacaatgggtcgccgaagaagtgacggttggtggtggttggaaaagttgctggaaaggagaaaatggtcaccagaataagtgcaacgactag

SEQ ID NO: 80108 - DNA, 651 bp, Glycine max
  Peptide Sequence Number=SeqID_196886
atgatatcaggtgcacctgcctcgggcaaaggcacgcaatgtgaattgattgtccaaaagtttggattggtgcacatatcaacaggggatttgctaagagcagaggtaggggctggaactgaaattggaaacaaagcaaaggagttcatgaacgcaggtcaattggttcctgacgaaattgtgacagctatggtggcagcacgattgactcgcgaagatgcaaagcaaactgggtggcttcttgatgggtaccctcggagttatggccaagcccagagtttggagaaaatgcagatacgacccaatgtgtatatcgtactagatgttcctgatgaaattctgatcgacagatgcgttggtagaaggctagacccagtgacagggaagatatatcatcttaagttttttccaccggatactgaagaaattaaagcaaggctgataactcgacctgatgacactgaagagaaggtcaaatctcgcctaaacatatacaagcaaaatgcagaagcagcatcttccgtttactcaagcataacacataagattgatggaagccaatcaaaagaagcagttttcaaagaaattgaatctttattatctcaattgcaacaggataaagtgaaaataatgaaatcagaagttgcataa

SEQ ID NO: 80109 - DNA, 195 bp, Glycine max
  Peptide Sequence Number=SeqID_196887
atgcattctattctatcgcaagtctcgtcatggacatggagtgcaattagtgctagtgcccccactttgagactttgggtcacatggtatagtaatagtacctcctccttgacacgaaaagatcacgatcgaaatcatttatccctagaaagcagtggccaaattagaaagaaaggctttataagactcccttaa

SEQ ID NO: 80110 - DNA, 1821 bp, Glycine max
  Peptide Sequence Number=SeqID_196888
atggagagaaagttcatggctttaggtttcatttggtgggtggtgttggttcatccactatgcctgatttctgctaacatggaagtgtactgctccaacctatatggagatgctttgcatagtctgaggacaaacttacaggatcccaacaatgttttgcaaagttgggatcctacacttgttaatccatgtacatggtttcatgtaacatgcaacaatgataatagtgtcataagagttgatctggggaatgctgcactgtctggtcaacttgttccgcagcttggtcagctcaagaatttgcagtatttggaactctacagcaataacattactggccctattccaagtgacctggggaatcttactaacttggatagtcggcttaacaataacagcttgtcaggtcctatccccatgtcactgactaatattacagctctccaagttctggatttgtctaataatcatctatcaggagtggttcctgataatggctccttctcattattcactcctatcagttttgcaaacaacttggatctatgtggacctgtcactgggcacccttgtccaggctctcctccattttctcctcctcccccttttgtccctccacctccaatttctgccccaggaggtaatggtgccaccggagcaatagctggaggagttgctgctggtgctgctctattatttgctgcacctgcaattgcatttgcctggtggcgtcgaaggaaaccacaagaatttttctttgatgtgcctgctgaagaggatcctgaagtccatctgggacagcttaagaggttctcactacgagaactgcaagttgcaacagatagtttcagtaataagaacattcttgggaggggaggatttggtaaggtgtacaaaggacgtttggcagatggttcattggtggctgtgaaaagattgaaagaggaacgcacaccaggtggggagcttcagtttcagactgaagtagagatgattagcatggctgtgcatagaaatctccttcgactacgtgggttctgtatgacaccaacagaaaggctacttgtttatccctacatggctaatggaagtgttgcttcatgcttaagagagcgtcctccacatcaagaacccctggattggccaactagaaaaagaatagctttgggatcagcaaggggtctttcatatttgcatgatcattgtgacccgaagattattcatcgtgatgtgaaagctgcaaacatattgctggatgaagagtttgaggctgttgttggggactttggattggccaaacttatggattacaaggacacgcatgtgacaactgctgtacggggaactattgggcatatagctcctgagtacctctccaccggtaaatcttcagagaaaactgacgtttttggttatggtatcatgcttctggagctgataactggacagagagcttttgaccttgctcgactcgctaatgacgatgatgttatgctgcttgattgggtaaaaggacttctgaaagagaaaaagcttgaaatgttggttgatcctgatctacaaaacaactatatagaagctgaggtagaacagttaatccaggttgcactgctctgcacacaaggttccccgatggaccgaccaaagatgtcagaagtggtgagaatgcttgaaggtgatggcttggcagaaagatgggatgagtggcaaaaggtggaagttctccggcaggaggtggagctggcccctcatcctaattctgattggatcgtcgactcaaccgaaaatctgcatgcagtagagttatctggtccaaggtga

SEQ ID NO: 80111 - DNA, 375 bp, Glycine max
  Peptide Sequence Number=SeqID_196889
atgaatccattgatgaagaagatcctaggcctacaagctcaaatggagcttacatcaagactagagggtaggagagaaatagaagggattgcagagagtatccttgcagggtttttgaaaaacacacaatacatgtctagcaatacaaaacaaaaaaccaaaaacatcgacaaccttaccttcacgaatagttgcaagtggcgacaccactcaaaagggcacgacttcggctacgtggcggtggtgggaacaacacgaggttcggaggtcggaaaatgcgacaatgtagggttccttttgtggaggtcagggaaagggcacaatgtcagggtggagcaagggacacagtcgacgggagctgagatttttcgttag

SEQ ID NO: 80112 - DNA, 168 bp, Glycine max
  Peptide Sequence Number=SeqID_196890
atgaaacgagatataagccttgcgttacttacatcggtttttcagcctcacattatttacattggcttcaccctcaccatttacacatcggctttagcatcaacatcgggagaaaaagaaaatggtcttcaatggttgaattatcatgttgatcttaaaaacacttga

SEQ ID NO: 80113 - DNA, 129 bp, Glycine max
  Peptide Sequence Number=SeqID_196891
atgtatgttgcagctgaggatattgaagctggacctaggacgaagtttcaaacggaaccaactctaccaatatatctaaaggcaaggatgaagcttactttagcaatcattgcaaccaatagaacatga

SEQ ID NO: 80114 - DNA, 417 bp, Glycine max
  Peptide Sequence Number=SeqID_196892
atgtataccactaacaaacactccgacgaagcctggtttctttggaagtggaggaaactctttggcatccaacacaacaatctctcatcttctgatcaatcagctgttagtgacttcgctaaaaaggttttaagaattgatttcttgctcactgcattcttttcaggtggtagtgatacaaaaattgagactgaggagggtaaagaatccacacaacaacaaacttccatccggggaaaaaacgggggaaggatgttgatagtgagcggcaatcaaaagttgctaaggccaagggagatgatgatctcaaaaagcacggtacaacaacagagttgcgtgaaatgctggaagccaatggtgaagattcatcaggatcagaaattgatttacgtgaccgctggtaatttaatctcatag

SEQ ID NO: 80115 - DNA, 1476 bp, Glycine max
  Peptide Sequence Number=SeqID_196893
atgcaaggcctcaactccctcttaaattcttcatcccaaatctcccttcaagaccttcacaatcacaccactaaccagatccaaaattcacacatgaaccaccaacaccaccaccaacaacaacaacaacaccaacaacaacaacaccaacttgctcactttgattcaacttctcacgacgactttctcgaacaaatgctctcttcctgctcttggacagatctcaaccataacaagccattattatgggaccctaacacccccaacgacatcaagccccccgacgaaacgacgccgtccaacaacaacgacgacgctactgctaatgtcgtttttccctccttcgacgagcactccaccttagcctccaagttccgcaaccaccagatcagccccaacaacgccccaaaaaacgccgcggcggcggctttcatgctccaacaccaactccttagagactctggtcttctcaacatgccactttccttgcctggaaacgacgtcgttgacgcttcttccttcaaatcccccaatcccgtaccacactcttacactataaccggtggtgaggcttcagtccaagctctctacaacgggttcgccggatctctgcatggcgcaggccaatcctcgaaccagactcagcattttcaaaaccctcagggaagttcgaatccaatgcaaggccaaaattttggggcggcaccagctggtggcggtggcgcaacgaaccaagctccggggagtggcgctgccgcgggcggcgcgccggctcagccaaggcaaagggttcgagctaggagaggacaagccacggacccacacagcatcgctgaaaggttacgaagggagagaatcgcagagagaatgaaggccctacaggaactggttcccaatgccaacaagacagacaaggcatccatgctagatgagatcatcgattacgtgaagttcctgcagctccaagtcaaggttctgagcatgagcagactgggcggtgcagctgctgtcgctccccttgttgctgatatgtactctgagggaggcggtgactgcatccaagccaacggcaacagtaacggcggtggggcccacgctccaaactccaacaccaaccaaacgtcagcgacaacaccctcaaacgacagcctaacgatgacggagcaccaggtagcgaaactaatggaagaagacatgggttccgccatgcagtaccttcaagggaagggtctttgcctcatgccaatctccctcgccactgcaatctccactgccacgtgtcacaccaggaacgttaccgttaacgttaaccccttgatcaatgccgccgccgccgcccagattccgacagccgccaaccccgctggtgacgggccgtcgtctccgagcatgtccgtgctgacggtgcagtccgccgtcgcggtcaacgacggctccgccgccgtgaaggacgctgcctccgtttcgaagccgtga

SEQ ID NO: 80116 - DNA, 213 bp, Glycine max
  Peptide Sequence Number=SeqID_196894
atgcattctcagtccactaggctaatccgagagagaggtgaatttggaagtcagaaatcactcactcccacagtcatcaacgcaacaactgaaagagtgacacataggtttggatacctaaacttacgtcctggccaaaaagtagcagacttcaatttctcgaggatgaaaaaagactcaaaattttgcagggatgaatttcaaactttttga

SEQ ID NO: 80117 - DNA, 168 bp, Glycine max
  Peptide Sequence Number=SeqID_196895
atgacaagcttggggaggagtatcaaaaacgcggattccccactcatggagctagcctttgatggcattgagaataggtgcatagtgatgacttctcatatggggactcttcacaagcttcaccacaacagcagaattcgattccagcaaaagcctcctcacacctga

SEQ ID NO: 80118 - DNA, 384 bp, Glycine max
  Peptide Sequence Number=SeqID_196896
atgaaagaatatgaaaccggagttcaaacgagggtacacacttactttttatatttaaggccggtgggccttttccacaagattataaaggtggggatagatggatgtccgaaccgcataagaataagagggccagggcctttcactaatttggctgaaaatggattctgcctccttccagagagaaaaggcattccagatcatatccatccacatgttgaggctatcctcattaagaacaccctccgcataggcaaaaggatttccatccaatcccaaacgactcctcgcccgtgcctgggtggattcattcgacgaggcctcttctatatagatatctacatgtccatctattatcgaacctacgatagaaacaagaactaa

SEQ ID NO: 80119 - DNA, 351 bp, Glycine max
  Peptide Sequence Number=SeqID_196897
atgagggttattatggagatggacgggagtggtatcgatggtgcctcaaatattgggaagcgaaatgagttccttgaaggtttgtgtggcttcgaggaggtggcgactgccgatggggaacttgatgaattcagggtagagcttggtgttcaggaggtgcatgattatgttggttatcttggagacgagataagggtcgagggagtagtgggaggtgagggttttggcagagaggggcttcgctggaacagatgtgttctactgaaagggcgtggaaggcggagacagagtagtgagagtgagaaagagggtttggaggaattgagggatggagagggagcaacaaaatga

SEQ ID NO: 80120 - DNA, 873 bp, Glycine max
  Peptide Sequence Number=SeqID_196898
atgattgcacagcatataggaacaaagtccaaagatcagtgcaagaaatttttcatcatgggtcacaaatcccataggttggatctcatccaccacagacttgaaaatattggatctctactaaatgaagtaaatctcagcagcagtactaacactaactatgcccatgttggggaggcagattcagtcattgacaatgataagtcaggcacaaaaacaaataatgaccagccttcatcagtcgtgaactcgagccgtgataaatccaaacctatggaagccatgaatctttcagcttactttaaggaatcagttattggcaatgataagtcaggcaccaaaacaaatgatgagcagccttcatctaccatgaactcgagccatgataaatccaaacctgtagaagccaggaatcggtcacctgacttaaatgaatcaaatgaaattaatagagaatttgatcatcaagataaaaatatgatttctaacacatataatggtgagtgtaaaatggtgggcactgatggttgtggaattgtctcgtaccattctgataagttgagttcagtcaaggacaagagagctacaatgatgtcggatatcatagaagtcagaaaagataaagtgggagatgcagttacagaattggtgtcgtcagcttctgagataattgaaccatgtcactctcattctgttgctgaggataaactatctgtgatgttgatgtcatttcgtacacgactcgatgataaagatggtaaacatggaggtgatattgatgatgatgtggttgaattgaaaagccaaagccatgattcaaacacaaaagcaaatacttggctatcatctgtggtaaacatggactgtctttga

SEQ ID NO: 80121 - DNA, 538 bp, Glycine max
  Peptide Sequence Number=SeqID_196899
gaaatccaatgaaagtgagagggttgcagttgatgcattgattgatatgtgtgattctcttacacctgagtctacaatgctgccatgccaacaacatgctgtatcatctttcggggatgattttaggatgattgcacagcatataggaacaaagtccaaagatcagtgcaagaaatttttcatcatgggtcacaaatcccataggttggatctcatccaccacagacttgaaaatattggatctctactaaatgaagtaaatctcagcagcagtactaacactaactatgcccatgttggggaggcagattcagtcattgacaatgataagtcaggcacaaaaacaaatgatgaccagccttcatctatcgtgaactcgagccgtgataaatccaaacctatgagcttctttgttccaacaactgttattcagagcagaggttcaagatccttggatactgaaattgagatggcttcctcgaatggaaattttccagcatctatgcctattctcaaaggcaagaactatgatgattag

SEQ ID NO: 80122 - DNA, 213 bp, Glycine max
  Peptide Sequence Number=SeqID_196900
atggagcttagccataccataggggccgctctgagacctcttgtcgagtggccttttgctcctacccctgttgggacggaccaagggcttttcaaccaccaaatacgagcaaatgtgtgtgagattgattggcggggtgctaattcaagagtgcgggcaactactttactataccttccccgtagggccacgggtgatcgcactttcgagtga

SEQ ID NO: 80123 - DNA, 819 bp, Glycine max
  Peptide Sequence Number=SeqID_196901
atgccacaagaagaacctatggaaatatgtgttgacaataaatcagcactcgctttggcaaagaatccagtcttttatgaaagaagtaagcacatcgacacccgttaccacttcataagagaatgcattgagaagaaggaggtaaaggtcttatttccaacactcatccaccacggacttgaaaatattggatctctactaaatgaagtaaatctcagcagcagtactaacgctaactatgcctatgttggggaggcagattcagtcattgacaatgataagtcaggcacaaaaacaaataatgaccagccttcatcagtcgtgaactcgagccgtgataaatccaaacctatggaagccatgaatctttcagcttactttaaggaatcagttattggcaatgataagtcaggcaccaaaacaaatgatgagcagccttcatctaccatgaactcgagccatgataaatccaaacctgtggaagccaggaatcggtcacctgacttaaatgaatcaaaggaaattaatagagaatttgatcatcgagataaaaacatgatttgtaacacatataatggtgagtgtaaaatggtgggcactgatggttgtggggttgtctcgtaccattctgataagttgagttcagtcaaggacaagagagctacaatgatgtcggatatcatagaagtcagaaaagataaagtgggagatgcagttacagaattggtgtcgtcagcttctgagataattgaaccatgtcactctcattctgttgctgaggataaactatctgtgatgttgatgtcatttcctacatga

SEQ ID NO: 80124 - DNA, 2096 bp, Glycine max
  Peptide Sequence Number=SeqID_196902
atgagatactttggaccatttaaggtgctggccaagattggtgatgttgcttataagttggagttgccttctgctgcacgaattcatcctgtttttcatgtgtcccagctgaagccattcaatgggactgctcaagatccttacctgccattgcctttgacagtcacagaaatgggaccagttatgcagcctgtgaaaatactagcaagtcgaattatcatcagagggcacaatcagattgagcagatactagtgcagtgggagaatggcttgcaagatgaagctacttgggaggatattgaagatatcaaggcaagctatcctaccttcaaccttgaggacaaggttgtttttaaaggggaaggcaatgtaacgaatggaatgtcacgtggggagaaggttaacaatactgctgagtcatcaagtgagagaggattgcataacaaacttgctgattttgaggaattgggacgtgggaagagagagaagaaaccaactatggtcgcagaagcttggattgtaaagatgggtaaccaggtagcaaatgtgatgtcaaaaactgtgcacctccacaggtcactgtcagagtctgagatctcaaagctgaggaatgagatcttggactcagagggtgttaggaatttggtgtcctctgatgaggattatctccttgagctggctctggcagagaagcttgaggagttgaatagggttgctagtgttgtctctaggttggggaagaagtgctctgagcctgccttgcaagggtttgagcatgtgtatggggacattgttggtggggttatagatgtcaaggaattggggttccttgttaagcatatggagggaatggtgaggaaaatggataggtatgttactgttactaggaacttgtacagtgagatggtggtgttgaatgagttggagcaagcagtgaagaagtttcagcataatcagcatgaggagagtaggagggcttttgagcagaagctcatatggcagaagcaagatgtgaggcatcttaaggatgtttccctttggaatcagaactttgataaggttgttgagttgttggctaggacagtttgtaccatttatgccaggatttctgtgatctttggagaatctgctttgaggaataatgcccttggacctggtgttggtggaggctcgccaggtacgcaaaatgaatcggggtttgtgtcgggccatgttaatgctcacacaagttcggagaggttgaagcgcaatcagagcaagggaaatggattccatccgggttcggttggaagaatggctgtggcggagagaaggggagctactagtaggcctcagattgatttgaggagaggcgagttggtgcctattcgacttgaagattttggttttccatgtggaacaagtgcgggaagacttttcatggaatgcctaagtttgagtagctcagtttcaaaatttgatgatgctgatgatgtcaatagggaggaccatcatagtagctgttgcagtgttgggatagggaataatagcatgaagatggagcacgcgtgccattctggtattctaagtcatagccgaagtggcgttcctttcaccggagatcttagacaagccaaatctggtgtacaaagttgctcaacattaggtcccaaaagtaggttagctgtttatgctcctccttccacacttggaggctgtgctctagcattgcactatgccaatgtcataattgtcattgagaagctgcttcgctacccgcatttagttggcgaggaagcgagggatgatctatatcagatgctaccgatgagcttaaggttatctctcaaggccaaactgaagtcctatgtcaagagtttggccatatatgatgctcctcttgcccatgactggaaggagaatcttgatgggatactcaagtggctcgccccacttgggcataacatgatcagatggcaaagtgagcgtaattttgagcaacaccaaattgttagccggacaaatgttctgctacttcagactttatactttgctgacagggaaaagaccgaggaatcaatctgtgaacttcttgttgggttgaattacatatgccg

SEQ ID NO: 80125 - DNA, 396 bp, Glycine max
  Peptide Sequence Number=SeqID_196903
atggaacgggtcgtgatgagcagccccgtatttgattcatactgtgagaaggttattatggagatggacgggagtggtatcgatggtgcctcacatattgggaagcgaaatgagttccttgaaggtttgtgtggcttcgaggaggtggcgactgccgatggggaacttgatgaattcagggtagagcttggtgttcaggaggtgcgtgaccatgttggtgatctaggagacgagataagggtcgagggagtagtgggaggtgagggttttggcggagaggggcttcgctggaacagatgtgttctactgagagggcgtggaaggcggagacagagtagtgagagtgagaaagagactttggaggaattgagggatggagagggatcaacaaaatga

SEQ ID NO: 80126 - DNA, 99 bp, Glycine max
  Peptide Sequence Number=SeqID_196904
atggacattggattcaatgcaagagagcccactaatgaacaatgcacgtgcatttcaaagcaatactcattccaaaatccagatccagcattgccctga

SEQ ID NO: 80127 - DNA, 682 bp, Glycine max
  Peptide Sequence Number=SeqID_196905
gatgatttggatttcagggcaatgctggatctggattttggaatgagtattgctttgaaatgcacggtgacaagttttggaaaattggaggatttcgagttcaaacaagagagtgaagccttggtgcaatgcaattgtaaggttgcttccttgtgccttgtaggacatgggtttaaatgctggaaacaaccttttcgtatgttgggtgcccagaggctcttcgctatgcgaaagtatgagagagggatattgtacgcagccttacccttgcatatgcaaagaggctgtttccggattcgaacccatgaccaacaaagtgtcagaggatgcagtgagaatgatatcatctacataaagaaggatgtaggccgtgtcattgccattgtgcaacaacaacagtgggctgttccaccttgggctgcaccgtggcaaccatgggccacgccaccatgtccgtacccaactacgccaaattggcaacatcagtccactcctcgccagcaaggaattcttggaccaaagcctccacaagctcatatggcagccacatcagcaaataatgctcaaccatcatatgcatcaaccgacattcaagctgcgatgcatactctttctatggctcctcccgatgatcagtggtacatggataccggggccacctctcacatgactgcaaatggag

SEQ ID NO: 80128 - DNA, 168 bp, Glycine max
  Peptide Sequence Number=SeqID_196906
atggttgacaatgcactggataaggtggaaaaagtgttttacatgccaatcatattaggaagaggaagtaagtatagaaggaacttcaaagattggcaacagttccttgctcgagctctatcagatttgccgaacaggagtctggtggatgtagaatgggatgaataa

SEQ ID NO: 80129 - DNA, 615 bp, Glycine max
  Peptide Sequence Number=SeqID_196907
atggtgtgcggtgctgcagttaaccaaagaacgcgttcaggaagactccacctttggaggaaatccgatgaaaaatggacaaatgaggagaaggcagcctttcttcaggctgtatcgtctttcggcgatgattttacgatgatagcacagcatataggaacaaagtccaaagatcagtgcaagaaatttttcatcaagggtcacaaatcccataggttggatctcatccaccacagacttgaaaatattggatctctactaaatgaagtaaatctcagcagcagtactaacactaactatgcccatgtatgggaggcagattcagtcattgacaatgatgagtcaggcacaaaaaaaaatgatgaccagccttcatcggtcgtgaactcgagccgtgataaatccaaacctatggaagccatgaatctttcagcttactttaaggaatcagttattggcaatgataagtcaggcaccaaaacaaatgatgagcagccttcatctaccatgaactcgagccatgataaatccaaacctgtggaagccaggaatcggtcacctgacttaaatgaatcaaatgaaattattagagaatttgatcatcacagaacatag

SEQ ID NO: 80130 - DNA, 843 bp, Glycine max
  Peptide Sequence Number=SeqID_196908
atgctgccaagacatgttcaaactattggtagtctccttgagagagttatgcaagttcatgttgcgcagctcagaggaataaatacacatttctgtctttggtactcttctgtgtcgacttgtaatgagctgccaagaaagctcaacaagtatgagaggaaaccaccggtgacaagttttaatgaacttaagcgtcaagccagactggagagaaaggagaggcaaaaggtgcatgagaataaattacaacctcccgaaaatggcttattggtggagcatttaattcctattgctcatgaagtttatgctgccagatgtcacaccataactctagtattcttcattgtggttgttcaagcttttagcatgttgcctgtagatattctattcaactatgatatctgcttatgtggagaagttcatgttggtcatccaccacatcaaattagaacatgcgatgttagaggaagcccatcaagcaaagaacatagttgggtcaaaggtggtgttgaacatgttctgccacttgtagagtcatttcatctgtatgatagaatagggagggctgtttcacataatgaaatgcttgaagtagaccgaattccagcaattgttgaattgtgtattcaggcaggttttgacatacctgagtaccctaccaggagaaggtccttccctgtttactgtgttgctggtaggattattgattttgagaaaagatttcctaaagaaatttctcttggtgaagatatagaagcacatgggttttggtttaagaaaaaaagagtggatgtaaacacaaattctatggcaatgcaatctgatgatatccaaggtttatga

SEQ ID NO: 80131 - DNA, 411 bp, Glycine max
  Peptide Sequence Number=SeqID_196909
atgggtgaagccgtgaagttaacaggtgatatacatgaggaggttgagagtcataaccagttgcttgatcgggtgggtaacaaaatggacggatcaaggggtgtgatgatgggaaccatggatcgatttaaaaaggtttttgagaagaaatcagcaaggaaaacatgctcacttgtggggtatttcacacttgccttcatattcatatactatcttattaggttcataaacaaggtaatgtttaagaaaatcaaactatcaaaggcagtttttcttgtgcttatccttaagcacaagtgctgctgtgtttcatgtaaggagtctatgtgtttgaaccattccattccattttggctaaagcagatggcttcagactcacctgttgatagcaaaaacttattgcatacatga

SEQ ID NO: 80132 - DNA, 615 bp, Glycine max
  Peptide Sequence Number=SeqID_196910
atggtgtgcggtgctgcagttaaccaaagaacgcgttcaggaagactccacctttggaggaaatccgatgaaaaatggacaaatgaggagaaggcagcctttcttcaggctgtatcgtctttcggcgatgattttacgatgattgcacagcatataggaacaaagtccaaagatcagtgcaagaaatttttcatcaagggtcacaaatcccataggttggatctcatccaccacagacttgaaaatactggatctctactaaatgaagtaaatctcagcagcagtactaacactaactatgcccatgttggggaggcagattcagtcattgacaatgatgagtcaggcacaaaaacaaatgatgaccagccttcatctgtcgtgaactcgagccgtgataaatccaaacctatggaagccatgaatctttcagcttactttaaggaatcagttattggcaatgataagtcaggcaccaaaacaaatgatgagcagccttcatctaccatgaactcgagccatgataaatccaaacctgtggaagccaggaatcggtcacctgacttaaatgaatcaaatgaaattaatagagaatttgatcatcacagaacatag

SEQ ID NO: 80133 - DNA, 351 bp, Glycine max
  Peptide Sequence Number=SeqID_196911
atgagggttattatggagatggacgggagtggtatcgatggtgcctcacatattgggaagcgaaatgagttcctcgaagttttgtgtggcttcgaggaggtggcgactgccaatggggatcttgatgaattcagggtagagcttggtgttcaggaggtgcgtgaccatgttggtgatcttggagacgagataagggtcgagggagtagtgggaggtgagggttttggcggagaggggcttcgctggaacagatgtgttctactgaaagggcgtggaaggcggagacagagtagtgagagtgagaaagagggtttggaggaattgagggatggagagggagcaacaaaatga

SEQ ID NO: 80134 - DNA, 270 bp, Glycine max
  Peptide Sequence Number=SeqID_196912
atggcccttgcaaaagaacttattggtttttcctcatttgtttctgcttcctacaaagtgtttctgcaccacaagcatggcaccttctgggtcaatactatcttgcttcctttggataacacaagagttgtgaggttgaggaagggaggaaagtttccgaaggcagctattagtgaggatttgataaagaccacactgacagtgcatgcagagaaaccagtacaattcaaagtcagagcggtggtgacagtgaggaataaaatcaaataa

SEQ ID NO: 80135 - DNA, 402 bp, Glycine max
  Peptide Sequence Number=SeqID_196913
atgagggttattatggagatggacgggagtggtatcgatggcgcctcatatattgggaagcgaaatgagttcctcaaaggtttgtgtggcttcgaggaggtggcgactgccaatgaggatcttgatgaattcagggtagagcttggtgttcaggaggtgcgtgaccatgttggtgatcttggagacgagataagggtcgagggagtagtgggaggtgagggttttggcggagaggggcttcgctggaacaaatgtgttctactgagagggattgtaaggcggagacagagtagtgagagtgagaaagagggtttggaggaattgagggatggagagggagcaacaattgaatgcgcctataaaaaaccgtcttgggtcaaaagcaaaaaagtgccaatgtga

SEQ ID NO: 80136 - DNA, 2024 bp, Glycine max
  Peptide Sequence Number=SeqID_196914
atggttgaatggcacacccccacctccactacgagtcttcgcggcttcctgggactaaccgggttctaccgaaagtttatcaaaggctacgccgccattgcggctccccttactcacctcctccgcaaagaccaatttcactggtcccccgaagccaccaccgcttttcaacaactcaaatcctgcatgaccagtgcccctgttctatcaacacctgacttctctcttccttttattttagaaacagatgcttctgcgattgcgattggcgccgtcttaattcagcaagcccatcctatcgcttacttcagcaaggtgttgtgtccacgtttacagagggtctccgcctacgtcagggaacttcacgccatcacttccgccgtccgcaagtggcgccactacttacttggcagttctttcaccatactcaccgaccataagagtcttaaggaccttatgtcccaagtcatccaaacgccggaacagcagacttacttggtcaagctgttaggatatgattatgacattcgctacaaaccaggtgtttcgaacgtggttgctgatgcgttgtctcgacttccccagggtgaactcctctctttcacgatgccccactgtgacttcatggctactttgcgcgcttctttggcaaacaacagtcagtatcaagacctaatggcggcaattcaagctcacccacaggaccatccccttctgtcaacccacaatggtctcatcttcaagggccgccgtatttggttaccttttccaacactgctaacctccaccttgatcgatgaatttcattcctcacctctcggcggtcacaccggtgtcgcgaagaccttacaccgtcttcagcagagcttcgattggccaaccatcagacccgatgtgcgccaattcgtctcccactgtttggacttatccctcgattttatcaccggccttccggtgtcacatggccacactgtgatcttggttgtagtggaccgttactccaagggagcccatttcggtgctctcccgacccgacacaccgcccaccaggtcgctgttcgtttcgtcgacatggtctgcaaacaccatggttttcctcgaagcctcgtatccgacagggacgctctcttcctcagccatttttggaaggaactcttccgcctcagcgggactcagttgcggatgagcaccgcataccaccctcaatcggacggtcaaacagaagtggtcaaccggaccctcgagcagtatctccgggattatactcaccacaagcctagtcaatggtaccgctatctccacctggcagaatggtgctacaataccacagttcattccggcaccggtttcgctccattcgaggtcatttacggtcgccctccctcaactttagtggattacatacagggctcctctcccatggacgccgtcgactccatgttgactgaccgcactgagctccacgctctgctgctacgccgcctcctcaaagcccaaacctccatgaagtcagctgcagataagcacaggcgcgatacccacttcgctgtcggagactgggtctatctccgtcttcacccataccgccagacgtactcgaacgtattggctctgtggcttacagactggccctgcccaatgagactggccctgcccaatgattcgcgcatccacaacgttttccacgtttctcttttgaaacctcacaacgggcctttgcctcccattgacactccccttcctccccttgctgttgatcatcatcccgtcgtcactcccttgaccattctggattggaaattggacgcatctgtcacacccccgcagcggatggtgctggtccaatggacaggtctttctcctgaggatgcttcgtgtgaaccttgggaagctttgcgcgaaacttataacctcgaggacgaggttgtcttcgaaggggagggtgttgatagcattatgcagaacagggcaacacataacagcaatagtatcaacaggcccaaaagggtgacccgtaaacccac

SEQ ID NO: 80137 - DNA, 630 bp, Glycine max
  Peptide Sequence Number=SeqID_196915
atgtgtgagcagtgtagagagaactgtatccaggtgtgtgatgtgggagggaagatcatggctatagacgagaatatcgtcgaagaacaccgctacaaatttgcgcagataaggtcgcagagtctcgttcatggtggattagaaggtggacggggcgttgcagagcccgaagggcatgacgcggaactcataatgtccctgatgcgtgcgaaatgccgttttggagatgtcggaatccgccattcggatttgatggaacccttggcgcaggtcgagcttcgagaaccacgaagctttgcccaggtcatcaagtcgagcttcgagaaccacgaagctttgcccaggtcatcaagtaactcatccaccatgggcatggggaatttgtccttcacggtgatggtgttaagagcacggggaagagaagggactttggcttggtctgataaggccggcgtgagggtaacggtaggggcggatgttaacgggtggagaattgggaaggaggggaatgtggtgttgaattgtgcggggtgggggaagttgttgaggtccggcaaatatggtggagtagcgggtgaggatggtggatatggacggagggatggtggtggggagtggggacgatggtga

SEQ ID NO: 80138 - DNA, 234 bp, Glycine max
  Peptide Sequence Number=SeqID_196916
atgggagatcaaaaggatgaagaagaacaactcggtgtcagtagtggtggcgaccgagggaaggtcattgacgtggtggtggtgagagttgccaacaaggttaaggcggaaaaagaaagtgtcgaggagtcacaatggtgcatatgtgaaaaaacaaaaacaataaaaaggaagatcgagcaactcaaaagtggtgctaggaggttaggtgccatggtggtggatttgcaatga

SEQ ID NO: 80139 - DNA, 207 bp, Glycine max
  Peptide Sequence Number=SeqID_196917
atgttggatgtgacaggatccccaacccaagacataacgaagcggacttgttgtttatcttccatgaggctaaatattcatcaaggtggagattgttgtgcatggctcatatttgatgggcacgacaaagttgaagtggagtgtaaggatcacttgttgttgggttacggagcagggtgcgagacaaagcctctgtggaatgtgtaa

SEQ ID NO: 80140 - DNA, 711 bp, Glycine max
  Peptide Sequence Number=SeqID_196918
atggaacttaagctaatccattcctgctcaatgaagcactggaaaattgattccactttgtattttattacatatggtcatgctggtctttttaattgtgaaaagctaacgggatatctgttctatggttatcccatggacaaatctttcaatttacagggaggtataatcagagagaagttatgggatctattggttagtgaacctggtgttataatggaggaaggtttccctaatgcaactgggcgagaacaatcaataaaagggatgcaaacatcagagttttgcctgcatccagctggggatacacccacttcatgccgactttttgatgcaattcaaagtctttgtatacctgtcattgtcagcgacaacattgagcttccatttgaaggtatggtggattatgcagaattttctgtcttcgcagcagttagtgatgccctgaaaccaagctggctagtcagtcatcttcaaagcttttcaaaagagcagaaagacagattccgccaaaatatggctcgggtacagcccatctttgtctatgataatggccatccaggtggtattggaccaatacctgcggatggtgcagtgaatcatatatggaagaaagttcaccaaaaactgccaatgataaaagaagccataattcgagagagaagaaaaccacctggtgtttcagttccacggcgttgtcattgtacttga

SEQ ID NO: 80141 - DNA, 324 bp, Glycine max
  Peptide Sequence Number=SeqID_196919
atgtggcatgtcaaggacgagattgcccctgctgttctgcttgttgtggattttggcggttggtaccggcttgactcccgaggtggttcaaactgtagcgagagtgatgtgattccgcacacgcaagtttctgtgattaaagatgtgattgtgccgtacacacatctgctgcccaggttggacttgtcggataacaaggagcggcaccagcttctgtattttaaaggagctaaacataggcaccggttgttgcggttacattttttatgctgtgaagaattgcacacagatgcagttgatgttgtgagtgatcaagtttgttaa

SEQ ID NO: 80142 - DNA, 552 bp, Glycine max
  Peptide Sequence Number=SeqID_196920
atgggtgtttttaacggcgtccatgacctgcctctgccgcttgtaatcgtcgttgtcgtgcttctttctgaaggcgcctttgttggcgccgagctgcatttcggcgctgagcgtggcgaagaaggggacgaaaacgacgtcggcgagaagcgggtcgaggacgcgcttcgcgaaggaggtggcgcggtgttggggaggggtcatgaggtcgcccgtgatccagtactcggcgctgtactgtttgatgagtgggttctcggggtaagggggaatcttagccgtctgatggagggaggaagggggagtggtgtgatcggcatcggtggggagacgggaatcggagaaagaggaccagtaggtgtggaggagggcgtagttgagggatcgagggaggtcggcgacgtagacgttgattgtggaagaggagaatggagagagagaagggtggagggtggttgttgttgtggcggtggggaagatgaggaagaggaagagggcgagggagagaatggagaagagggtgcagaggaggaagagcttggggacgtataa

SEQ ID NO: 80143 - DNA, 438 bp, Glycine max
  Peptide Sequence Number=SeqID_196921
ataggtaacttgactgtgtcccgcttgtgcaatgaggaagtgattacaacagtcaatggaagcctgcctggaccaacgatttacgttgaagagggtgacactcttgtggtccatgcaaacaacaattcaccctacaatattacccttcattggcatggaatttttcaaattttgactgcatgggcagatggtcctgaatctgtaactcaatgtccaatacgtcctggtggaaagtatacctatagatttaacataacaggacaagagggtaccctatggtggcattcccactcttcttttctacgtgcaaccgtctatggagctcttatcattcgccctagaagaggaaactcacacccattcccttcagtttaccaagaagtccccatattgcttggtattacttttttgctttcccttttagcttgtttcctttaa

SEQ ID NO: 80144 - DNA, 462 bp, Glycine max
  Peptide Sequence Number=SeqID_196922
atgttactagggtgtacactagagattttccagatcagcctccagctgtgttttgactataccattgactataccaacccaaacataacaacgtcgccagatacacctcgtgaattcctaatcgcacctaaatcaacgaagccatacgtcattgccgcagagaatcaccctattcacattcatggcttcaatttccatgttttggctcaaggatttgggaattacaatgccactagagatgagcccaagttcaattttgtgaatcctcaaatacgtaacacaatttctgtgccggttggaggatggtacgtcattagattccaagcaaataatccaggtgtttggcttgtgcattgccatttggaaacacatttgccgtggggactagccatggctttcgaggttgagaatggcccttcaaccagggtgcctccgccaccagctgatcttcctaagttttga

SEQ ID NO: 80145 - DNA, 1266 bp, Glycine max
  Peptide Sequence Number=SeqID_196923
atgctctcttcatggtccacccaacaagattgttgtggatggagaggagtcaagtgtgacaacatcacaactagagttactcaacttagtctcccatgttctacgattcctccaacttacattgacgaagaagataaatcacactgcctcacaggttccatttacctatccttgttgttgttggagtttgaatttttaaattacttggatttgagcaataatgacttcttagctatcaagtttgattctatgcatagtcagaattgtcataacctatctgtagctactcctcctcgccagtgtgtaaactcttcagctcttcgatatcttgacctatcacttaacgagaatcttgccatgaatagtcttcagtggctttgtttcatttcctccttggaatatctcaacctcaatggcattaatcttcacaaggaaactaattggcttcaacttgtaactatgcttccatcactttcagagctccgcatggatggttgtcaacttaaagacttgagtccgtctcttcaatatgctaattttactgcactccgagttcttgatctttctaaaaataaattttactccgagttgcctaaatggttattcaaccttagttgtggcatctctgatatttacctttactcaagttctttaagaggacaactaccaaaggcattgttaaatcttcaactcttggaagccttgatattggaatccaataacttaagtggaccaattccaaattggttaggcgaacttgaacatttacaatatcttaatcttgtaagaaacatgttttttggatccattcccataaatttgggaaacctttcatccttaattgtcttggctgttggccgaaatcaattgacaggagttgtgtctgagagaaatttcgtcaaactgtcaaaattaaagatattggatatatactcatcacctccattaatatttgattttgagtcccactgggttccaccttttcaacttgaaatactagtttttgggtttgcaggtccctatcttcctgagtggttatatgcacaaagatctattgaacttctgtgtatttgcgaatcatcatttaaggcccaaggcaaattttggaattttgtatcaagagtgactgaacttcagttacgagaaaatttgatagatggggacttgtcaaacgtgttgttgaactctacattcttagatgtatcatcaaatgatctgaaaggttacctgcctcaattatcatccaacgtggtctttaatttgtga

SEQ ID NO: 80146 - DNA, 450 bp, Glycine max
  Peptide Sequence Number=SeqID_196924
atggccaccaatacaacaacagcttcatcctctgttgtattttctcccgagaaactgaatttctggctggacaacccttctccaatttccttgacttgggatcaggtgaagcactgcagggaagccctcacctcgttgaaggacaagtttgaccacactcctgagagtatcacccacgagttcaaactcttagaggctaacagggcagtaacagaaagtgagaccgataaaatatgcgccgtagctcttgatcgtgacaattttagcaaaaatcgacacgacgtttatccactggacaagaacaggataattctgaagtcaacacatggttatatcaacgcaagccctatgtcggatggaactagagatgttggtaaaaatatctctattatcgggaaaggggtgaaaactactttgacttcaccgctggtattgacccatctcccatag

SEQ ID NO: 80147 - DNA, 840 bp, Glycine max
  Peptide Sequence Number=SeqID_196925
atgactcgccactgtatctggtccggaagatggatcttgatttttccttttaggatagtgtactgcttgggtgctagcagtgctaattatgatggcatatgctgctctgcattttgtggttcaggatatttgatgatttgcaatgtcaacaagcaagtacacttgaatcccatagcagtaatcatcttcaaggtcctgcaagacgactttggactttgcactttgaactttactactgctaaaagtttgataagtgtgacagcaattgattgctgggaagtttttgcgccatttctggctaatgtgatatgttgcccccaattggaagccactctcacaattcttattggtcaatccaataaacattccaatgtacttgccttaaacgagaacgatgctaaacattgcctggcagatgtggaacaaattttgatctgccgagacatgatttgcggcattataattgaacatgaaatggaacttcaacgtctcaaccaaaatgaagagaccgacaaaaggaaaagaagcatagcacttaaagcctcctcctcaatgcaagaagaagaagaagaagaatctgatgatgaagaggacttctcactctttgtgaagaagtttcataaattcgtcaaaaatagaagaatggagagacgtcataacttcgacaatgggaagagatctcaagaagaaaagaatgagaagaaaagccatgaagaaagaagatccaagaaggcgtatattgcttgggatgacaatgactcatccgatggttcggagaaggagatcaaccttctatccaaggactacgagagtgatgagaacatctctcaagaagattaa

SEQ ID NO: 80148 - DNA, 942 bp, Glycine max
  Peptide Sequence Number=SeqID_196926
atggccatggatgatgaatataatgctcttattaaaaataagacgtgggaattggtgccccgtccacctgatgttaatgttattctgtctatgtggatttttagacaaaaaaaatcttacggttcttttgagaggcataaagcccgtcttataggtgatggtgtaggtcaaaaagttggcatgaattatggagaaaattttagcccgatagtccaactgctgaccgttcacacaatgcttagtcttgttctttctaaggcatggcccattcatcagttggatgttaaaaatgcattcttgcacaatgaactaaaagaaacagtgtacatgcatcaacccttaggtatcaaggattcagatcttcctaatcatgtctgtcttctgcgaaaatcgttatatgggctcaagcaagctcctagagcctggctctttgacgttttagattctgaaggctcacttagcactgtttgctcgctaagcgcgcatgcagattggggtgtatgcccagacattaggagatccgcttctggtcattatgtgtttcttggagataatttgctctcatggtcttccaaacatcaagccacactttctcgctctagtgctgaagcagaataccgaggtgttgctaatgtggtttctgagtcatgttggttacacaatcttcttctggagttacattgtcctatccataaggttgcactagtttactgtgataatgttagtgcaatatacctttctggaaatctagttcaacatcaatgcactaaacacatcaagatggatattcactttgttcgcgagaaagttgctcgtggacaagtatgtgtcctacatgtcccctcgcgctatcagattgcagatattttcacaaaaaggacttcctttggtgttatttcagggacagtctcagcgtacaaaaacctccagcatcgactgtag

SEQ ID NO: 80149 - DNA, 288 bp, Glycine max
  Peptide Sequence Number=SeqID_196927
atggcaatgctgactataagtaaatcacatgcatatttgatatttttctgtggcaaactcggtttgagtgctggtattggtagaactggagcatactgcaccattcacaacacaattcagacaatacttgctggtgatatgtctgctgtaaatattgctgacgcagtggctaccttcagaacccagcgtcttagaatggtccagactcagggagcagccgtcgttgctcatcacgcggcagaggtgctcgctggcgtgaagggcttgggccatgccttgcgccgttga

SEQ ID NO: 80150 - DNA, 198 bp, Glycine max
  Peptide Sequence Number=SeqID_196928
atggcaattcaacatgtttaccaagagaacaagaatgacaaacatgtggacatccctcaagtgtttgttgtcttggaaaatagcagcaattcttttccaacactactcggtcgagtcatctatccaaccattgagggcggcgaacagggaggaagggagtggaagaaagtaaagagaggtggtgagaatggtggctag

SEQ ID NO: 80151 - DNA, 2463 bp, Glycine max
  Peptide Sequence Number=SeqID_196929
atgaagctccaaacacatcaactgctactctcctttgtgttgttctccgctgtcatcatctccacaatttcaggaaccaccatcaccatctctccgggcacaaccctatacgcttccaacacaacccaatcatggtcctctccgaacgacactttctctctccacttcctccccctccaccctccaactttccctccttccttcaccgccgccgttgtccactccggcggtgctcccgccgtctggtcggctggaaacggcgctgccgtcgactccgccgcatccttccagttcctccccgccggcaacctcgtcctcgttaacgggtcgggttccaccgtgtgggactccggaacttccaacatgggtgtctcctctgccacccttcacgacaacggaaacttggttctctccaatgccaccagttccgtgtggtcgagcttcgacaaccccactgacaccattgtttcgtttcagaactttactgttggtatggttttgcgttctgggtcgttctcattttctgttcttagttctgggaacctcactctcaagtggagtgatagtgtcccttactgggatcaaggcttgaacttttccatgagtgtgatgaatttgagttcacctgttttgggggtggaaccaaagggggttttgcagcttttttatcccaatttgagtgcccctgtggtggttgcttatagcagtgactatggtgaagggagtgatgtgttgagggttttgaagttggatggtgatgggaatttgagggtttatagctctaagaggggtagtgggaccgtgagttcaacatgggttgctgttgaggatcaatgtgaggtttttggttactgtggtcataatggtgtttgtagttacaatgattctagttctagccccatttgtggatgtccatctcagaattttgagatggttaatcctagtgatagtaggaaagggtgtaggaggaaggtgaggcttgaggattgtgtagggaaggtggcaatgttgcaacttgaccatgctcaattcttgacttatcctcctcagtttttgatcaatcctgaggtgtttttcattggtatttcagcttgcagtggaaattgtcttgcttctaattcttgttttgcttccacttccttgtctgatggaagtggactttgttacataaagacgtcaaattttattagtggttaccagaatcctgctctacctagcacttcatatatcaaggtttgtggaccagtggctcctaatttggcaccttcgttagagaatgcgcattggaggttacatggttgggtagctcttgttgttttgagtacccttttatgtttccttgtttttcagggtggtttatggttgtggtgttgtagaaacaggcaacgatttggaggttttgcagctcagtatactcttcttgagtatgcttctggcgcaccggttcatttctcttataaggagcttcaaaggtccacaaaagggttcaaggagaaactaggtgatggggggtttggtgctgtttataaaggaactctctttaatcaaactgttgttgcggttaagcaacttgagggcattgaacagggagagaaacagtttaggatggaagtttctaccataagtagtacccatcatttaaatttagtgaggctgattggtttttgctctgaagggcaacacaggcttctagtgtacgagtttatgaaaaatggatctcttgataattttctttttgttgatgaagaacaacagtcagggaaattgttgaactgggggtatagattcaacattgctctaggtgctgctaagggcttgacataccttcacgaggagtgtagaaattgcattgtccattgcgatgtaaaacctgaaaacattcttttagatgagaattacaatgcaaaagtctcagatttcggccttgcaaagctcctacgtccagtggattgcaggcaccggaccttgacaagtgtgagaggaaccagagggtatctagctcccgaatggctagcaaatcttcccataacttccaaatctgatgtttacagttatggcatggtattgttggagatagtgagtggtagaaggaactttgaagtctcagaagaaacaagaagaagaaagttttcagtctgggcttatgaagagtttgagaaaggcaacatcatgggagttattgacagaagattggttaaccaagaaatcaacttggagcaagtgaaaagagtgcttatggcatgtttttggtgcatacaggaacaaccatctcataggccaacaatgagcaaagtggtgcaaatgctagaaggtgtgatagatattgagaggccaccagccccaaaaatcaatagcaatgccgctcctatctccactattgcaacttcatcagctccaaattactcctcatcttcatctttgtttacttttgaggcttctcccttggctcttgcaatatcctag

SEQ ID NO: 80152 - DNA, 585 bp, Glycine max
  Peptide Sequence Number=SeqID_196930
atgtgcacattaccaaagaaaaatcacaccaacaatagccttatctcactaggtaaggtcaattatatggattacatgatgtcattggacttggttaaaaaccaaactctaggagacagcttagcaattttaagagctgaattgaagagtcaaaagaagcatgtaagaaatttgaagaaaaaatcactatggtccaagattttggaagaggtgatggaaaagctagtagatataatccattttctatacttggagatacatcaagcatttggtagttctgatactgataagccagcgaaagattctcaaggcaaccataagaagttggggtctgctggtcttgctttgcattatgcgaacattatcactcaaattgatactcttacacaaatggtcacaactgcactgttattgaatctaaaaaatgatagaaagacagttgggaaggtgtctcgatcaagttctgtgcctcctaatacaagggatgccttatatcaggggcttccacctaatgtaaaatcagcattgcgctcaaggttacagtcatttcaggttaaagaagaggttgcactttcttccaagtaa

SEQ ID NO: 80153 - DNA, 366 bp, Glycine max
  Peptide Sequence Number=SeqID_196931
atgggtggtatttgctcgaggtcatggaaagcgactgtagatggtgtagctgtagataatgcacttagtcgaagctcggggcatgctaatggtcatgctaataacgaacctggaatggcttatcagtctattggacttcgcagaagtgcagatagcaatgcaaatgtgcttcctgatgatgatgatgatggtgacttggataagcctcaacgggaatcattttcttttaccggaagggaaaatgtttcgtatggatcgagtgtggatgatatcaatgatgggattcctcgcctgtccagggctttatcacataaatctaggtccaagcaagctgttgttaagttgagttacctttctcccgtttga

SEQ ID NO: 80154 - DNA, 813 bp, Glycine max
  Peptide Sequence Number=SeqID_196932
atggacctttccatcaacgaaagaagccttgttagagaaagacaagaggaagaagaagaagaagaagatgaaagagacaacggtgatgaacccaaagagggtgcagttgaggctggaacacgcaggccaagagggagaccccctggttccaaaaacaagcccaaaccccccatcttcgtcaccagggacagcccaaactccctcagaagccatgtcatggaggttgccggcggggccgacgtggcggaaagcgtggcccagtttgcacggaggcgccagcgtggggtgtgtgtcctcagtgggagcggttccgtggccaacgttactctccggcaaccttcggcaccgggagcggttgtggcacttcatggaaggtttgaaattctgtccctaaccggagcgtttctgcctggtcctgccccgccaggagctacaggacttactgtgtatctcgctggagggcagggccaggtagtgggagggagcgtcgtgggctcccttgtggcagctggaccagtcatggtgattgctgccacttttgctaatgctacctatgagaggttgccccttgaggaggaggaagacgacggtggtggtagcgtgcaaggagggagtaccctaggaggatctcctcatggaattggtagtagcggcggcggtggcggtagtggtggtggccacttaccaggtgggattcctggtccttcttctttgcctttgtataatctcccaccaaatcttcttcccaatggaggccaagtggggcatgaggcttttgcttgggctcatggccatggaaggccaccttactga

SEQ ID NO: 80155 - DNA, 1795 bp, Glycine max
  Peptide Sequence Number=SeqID_196933
atgggcaacaactgtgtgggacccaacgtcggcaacggcttcctccagtccgtcaccgcggcggtgtggaaaacgcgcccgccggagaaccgccttcctccgcccaacgccgaggccaaagcccccggcggatccgcgccttccaccgcaaccacaaccaccaacaccgccgattcctcgaaatcaccggagcctcctcccggcatgccggtccagagcacaccgccagagccggtcaaaatgcctgccgccgccgccgacgctgcgaaaccgctcccgctgaagcccgagaagccggcctcgagccacgccatggagccggtccccggcggcggcgataacaaccaccagaccaagaagcccacccacttgaaaagggtatctagtgtgggacttcaagtggaatccgtgttaggtcgaaaaaccgaaaacatgaaagagttctttagtttggggcgcaagttagggcaagggcaattcgggacaacgtttttatgcgtccaaaagggcacaaacaaagacttcgcttgcaaatcaatcgcaaagcgcaaattgacaacgcaggaggatgtggaagatgtaaggagggagattcaaatcatgcaccacttggcgggtcaccccaatgtgatacaaattgttggggcttatgaggatgctgtggctgtgcatgttgtcatggagctttgtgctggaggagagttgtttgataggatcattcaaagggggcattacactgagagaaaggctgctgaacttgctaggctgattcttaatgttgtggaggcttgtcattctcttggggtcatgcatagggatttgaagcctgagaattttttgtttattaatcatgaggaggagtcacctcttaagaccattgattttggactctctgtgttctttagaccaggtgaaacattcactgatgtggttgggagcccatactatgtggcccctgaagttttgcggaagcaatatggtccagaatgtgatgtttggagtgctggggtgatcatctatattttactcagtggagttcccccattttgggatgaaacggaacagggaatatttgagcaagttttgaaaggagaacttgacttcatttctgaaccctggcctagcatatctgaaagtgcaaaggatcttgttcggaggatgcttataagggaccctaagaagcggatgacagcacatgaagttctttgccacccatgggttcaggttggaggtgttgcacctgataaaccacttgattctgctgtcttgactcgtttgaagcaattctctgcaatgaacaagctcaaaaaaatagccattagagtaattgctgaaaacctgtctgaggaagaaattgcaggactgaaagaaatgttcaagatgatagacacggataacagcggacagatcactcttgaggaactgaaaaatggtttggagagagtgggttctgttcttaaggattctgaaattacttggctaatggaagcagtaagtgcttccctggcagacgtggataacagtggtaccatagactatggtgaattcttagcagctatgcttcatctaaacaagatccagaaggaggatcatctatatgctgcattcacatactttgacaaagatgggagtggatacattacaaaagatgagctccaacaagcctgcgaacagttcggcctaaaggattatcatctagatgatataatatgtgaaattgacaaagataatgatggacgcattgattacagcgagtttgcagcaatgatgcaagacactgattttggcaaaatgg

SEQ ID NO: 80156 - DNA, 513 bp, Glycine max
  Peptide Sequence Number=SeqID_196934
atggagatggacgggagtggtatcgatggcgcctcacaaattgggaagcgaaatgagttcctcaaaggtttgtgtggcttcgaggaggtggcgactgccgatggggaacttgatgaattcagggtagagcatggtgttcaggaggtgcgtgaccatgctggtgatcttggagacgagataagggtcgagggagtagtgggaggtgagggttttggcagagaggggcttcgctggaacatatgtgttctactgagagggcgtggaaggcggagacagagtagtgagagtgagaaagagggtttggaggaattgagggatggagagggagcaacaaatgaatgcgcctacaaaaaaccgtcatgggtcaaaagcaaaaaagaacctagccatgactctggctctggctctagcataacctttcaatcaccaaaagaccacaagcgcaagttctggaaaaatgctaacaatgcctctctttgtttgtcctcaaagaggtccattgataatgtgtga

SEQ ID NO: 80157 - DNA, 150 bp, Glycine max
  Peptide Sequence Number=SeqID_196935
atggaatattacttggatactttgaaacatctaaggcctatagagtctacaactctagaacctcagttatggaagaagttatccatatctaaggctggacgatggcattggagcactaacataacagtctatagaaacagatacatctaa

SEQ ID NO: 80158 - DNA, 726 bp, Glycine max
  Peptide Sequence Number=SeqID_196936
atggactctactaaagtatttgctccagtagcaaggctggagacaatgatattggtgatagctttggctagtagcaatggttttgagatcaaagggaagcaaagaatggtgtacaagttgaataaggccttgaaaactgaaggaatacttcttatttgcctatatgttgatgatttgcatgtgagtggcagccatagtgaagaaatagagaaatttaaagctaagatgatgactaagtttgagatgaaatatgcaactgatgtattgaagagattcaacatgattgagtgcaacccagctaccacactagcagaagtggatttgaagctagatgttgcaagtgatgatgatgatgaggttgatccaaccttgtttaagaaattaattggctatctaaggtacttatgcaatagtagaccaaacatcgcattctctattgggttggttagcagatacatgcttgagccaaggaaaagtcatttgatggtagccaagagaattttgagtggggataggtcaaacaagaatagcactttaggctacatattcaagttcttagaggcaccaatttcatggtgttctaagaagcaacttgtggtggcactctcaacatgcgaagctgagtatatagcaaggtcttttgttgcttatcaagctatgtggcttgacttagtgttgaaggaattgaagattgacaaagaagccaatacaactgttagtggataa

SEQ ID NO: 80159 - DNA, 270 bp, Glycine max
  Peptide Sequence Number=SeqID_196937
atggcttcctgtggaagaagttcttccgcgttcttccgcgagatcacatggaagaaggaatccacggaagaaggttcttccgctgttgttattttcaactggggaagaaccttcttctgtggcttcctacaaaagaagttcttccacgagatggcatggaagaaggttcttccgcagttaatgttacaactgtggaagaaccttcttccatgcgatctcgcggaagaagttcttccgcaagaattcacggaagaaagttcttccgctgtt

SEQ ID NO: 80160 - DNA, 153 bp, Glycine max
  Peptide Sequence Number=SeqID_196938
atgtctcaaccacgagccacaccagagggggtaggtgcctttggtgttgttggaccttctggagatgcagcaaaggatggagttgataaggattatgttgctgatgtcactgctgctcaaggagcatgggagtcatggcctactcaggattga

SEQ ID NO: 80161 - DNA, 1320 bp, Glycine max
  Peptide Sequence Number=SeqID_196939
atggtgggcaatggtggattccctgggaatttgccaattcttgatggcaagaattgggagcgatggagtatgcagatgaaggtgttttttcggtttcaagatgtgaatgaatttaagcagaatggatgccaagaacttggtgataatcctatggatgcacaaagagctatacacaatgatgcagtaaaaagggatagcaaagccttgttcttgatccaccagagcatggatgcaagtatctttgacaagatctccaaagcatgtacaaccaaggaagtgtgggatatattggagaggtgcttcacttgtggagaaaagattcgaaagatcacagatcaaatgatcataggcaagatcatgcacaccctcactcagaattttaatcgcattgtggtggtgaatgaaaaatctaaagatgtagagatcatgaaaattgaggagctgcaaggatctttagaagcaaaaaaattgaagttgattcaaaggaacaagatcaaagaagcagatcaagctttgcaggcacaggtgaaaggtgtttcttcttcaaaagcttggtatctagatattggatgctctaaccatatgacatggcataaggaatggctcattgatcttgacacaagcagatccacaaaggttaagctagttgatagcaaaaccttgaatgttgagggagttggcaatatccgatcaaaagaaaggatgtctaaagacatggtggtaggtctccccaatgtgcatgtgcctgatagaatgtgtaaggttttgaggacagatggtggtggagagtatacctctagggagtttgaagatttttgtgagaaatgtggcatccaagatgaagtcacaacaccctatactccacaacacaatggtctatattggactggaagaaaaccattggtgagtcacctcaaagtgtttggttccctatgttgcaaacacattcctgatgcaaagagaaagaagttgcaagataagagtaagcctatgattctattgattcatggaattggcaagatggagctagcaacagtaaaaaattcatgtgtttcaattcaggtacaagatgttcacttcgaatgtgagcagaacagaagggaatcaaatgatgagattgaagcagcagctaatgtgaatcagactcaaaggccacaaaaggaaaggcacattccctctagactctcagattatgagatacttcatgatagtgaagaagatgtgtggaagaaagccatgcttaaagaattagaagcaattgagaggaatcacatctgggaattgactgagaaaagctacctcctcacgagaaagccatag

SEQ ID NO: 80162 - DNA, 270 bp, Glycine max
  Peptide Sequence Number=SeqID_196940
atggccgtggtggctattttttttcttaccccttcagttcatcaggaaaaagaaatcctaactaatctagagttcaacaatgaggcagctaacctaagaacgcatttaggaagactcctcctttggaggaaatccaaggaaagtgagagggttgcagttgatgcattcattgatatgtgtgattctctttcacctgaggctacaacgctgccatgccaacaacatgtgacacatgacattactcgtcgggatattgatgatggaacttaa

SEQ ID NO: 80163 - DNA, 1473 bp, Glycine max
  Peptide Sequence Number=SeqID_196941
atggcttcggaagtagtcccatcttccggggatttgttgaagtgttgcaactgtggatgtggttgctccttggtagctcattcttcggggacatggatgcggtccgttaaacggaagcttgatgagtttaaaatggacgaccaattacccattcctgcgtttgcgcggattgaaattgagaatgaatgtgtggccttacgcgagatggtcagcatgcagcagagaaccattcaggatttgaatgctgagttggacgaggagaggaattcttcgtccacagcggccaatgaggccatgtcgatgatattgaggctgcagagggagaaggcggaggttcaaatggaggcgcgccaattcaagcgttttgcagaggagaagatgacacatgatcaggaggagcttctgtctttggaagatttgctctataagagagaacagataattcagtcacttacctgtgaagttcaggcttacaaacacaggttgatgagctttggtcttaccgaggacgaggctgagggtgatcaatatgaacttccaacctatgaatatcctcctttgaagtgtaatgtgatgcatgatgctatggatgctgataatgatgacactgatatagagaaatatgtgtttgatgaaaccccaagtgaccgtttgaggaacttggaaaataggatttctaaaatggagaaaacctcaacttacagtcagatggatggggattttacagggaaaaatgttctagagaaagtgatcgttggacagtctccaagatggactaagcatcctaggagatcgtccagtgactcagcatctttgagcgggatgggaaaagaaataggtcctgagtctatgatggattctcccaagctcaatagtaactataggagagattatttctcacagtcagaggatccttccaatttcaagaaggtagataatgcatcggatgacgatgatacgagtgacagaatttatacaattgactctgttcattgtggggcaccatataatggtttcacagattccaaagctggtgcttttgaagattatgcaaccactcctagggagtcagggaatcatgctgctgattttgaggatccctacataaagaagcttcatatgaggcttcaggcacttgaggctgatagggaatcaatgaggcaggcaatcatttcaatgcgcacggataaagcacaggtggtgttactgaaggaaatagctcaacatttgtgcaaagagatgtcaccaaaaagaaaaatggcaaggaaaccgtattttgctggcaactctaactctatgctcttttcaattgttaagtggatctcatcaattgttttctggagaaagagagctcaccaaagcaagtatatgttcgggctaccgcttgagagtgtcggcttgctgatgctcctggacaagggaacgcgtgcaaggccatggagatgcatttcaagtacgcaagtgtgggattaa

SEQ ID NO: 80164 - DNA, 504 bp, Glycine max
  Peptide Sequence Number=SeqID_196942
atgaactcgagccatgataaatccaaacctgtggaagccaggaatcggtcacctgacttaaatgaatcaaaggaaattaatagagaatttgatcatcgagataaaaacatgatttctaacacatataatggtgagtgtaaaatggcgggcactgatggttgtggggttgtctcgtaccattctgataagttgagttcagtcaaggacaagagagctacaatgatgtcggatatcatagaagtcagaaaagagaaagtgggagatgcagttacagaattggtgttgtcagcttctgagataattgaaccatgtcactctcattttgttgctgaggataaactatttgtgatgttgatgtcatttcctacacgactcgatgataaagatggtaaacatggaggtgatattgatgatgatgtggttgaattgaaaagccaaagccatgattcaaacacaaaagcaaatacatggctatcatctatggtaaacatggactgtctttga

SEQ ID NO: 80165 - DNA, 282 bp, Glycine max
  Peptide Sequence Number=SeqID_196943
atggtggtttcgtggggatgtagaggaggtagaacctcatttggcagtggtagaggtaatggaggcagaaatggaaaaatatgcacacaccgtggcattacaggtcatacggtagaagagtgctataaaaagcatagctatcccctatggcatcaattacataagccttctcaaggtgcaaatataaataactcagtggtagaaaatgaaaccagtgataatcaaaattcagataatcaatcaagtggctctggaatgatgattatagctcaacaatactag

SEQ ID NO: 80166 - DNA, 900 bp, Glycine max
  Peptide Sequence Number=SeqID_196944
atgttagaaggtcccattccagatggatttgggaaagtaatgaactctcttgaagttcttgacctctccggtaacaaactgcaaggcgagattccatctttctttggtaacatgtgtgcattgcagagtttatacctctcaaataacaagttgaaaggggaaatttctagcttcttccaaaattcttcatggtgcaacagatacatatttaagagcttgtatttatcttataaccggttgactggcatgttacctaaaagcattggattgctatcagagttggaggatctttacttggctgggaattctttggaggaactcgttgtctctgaaattggtcccaagcgacccatcaagcccaacagaagcgaacccgacgccgttttccaataccccgtcgcagccgcttctgtcaacaatatacctgagcttcacaagtttcaatcccttcaatctccctctcatgctataatttcatcggcggggtttgtggatgcacaggatgagtttgtggagacgcagtactataaagaattggcatccattgacaaacaacatcacacgacagtgagtgggttcataaaggcagcgagagaaggaggggaaggtgaatatgagattcagttgcccaataatcatgttaatgctgctgaaacccaacccaggtcctataaaagcaaccctgccactaacgattgggttcctaactctgatgaacatcaggcacaagagctgaaaggcactgtcccgacaggggtaggagcaaaaggccactcgacaagaggtctcagagcggcccctatgagaagcactaaactcacacaaagaacaaacaaagaaaaagtgcttgctgcgggtgaggatgaagacattgttggaaataaggctttttatgtttag

SEQ ID NO: 80167 - DNA, 348 bp, Glycine max
  Peptide Sequence Number=SeqID_196945
atggttgcatataacgctatgaaatgttgggctaaggatgtgaatgaatcaatagatcatagggggaagcgcttgtaccacgttagcattggtcccttgagggaggtggggaaatccttgcacaaaacggcatcatcattggaatacaagtttacccaagtgaggtatgtccatgatgccatcaacgaatgggtgcaactgaatggcatcattgtggatgttcagggaccgaagtttggagtggattggggtttcctcctgattactgtaagaggagagaagagtatggttttcctagtttcgtgttttggcatgggtggatacttgaaaggatggggagtgtggtag

SEQ ID NO: 80168 - DNA, 348 bp, Glycine max
  Peptide Sequence Number=SeqID_196946
atggagagatacatgactattttcgtcaaaattagagatcttgacctcggtgtcacactgcattccatgatcacaacactaaagcttgggatgttcatcgacaacctctgtaggaaacaacccaaagatttggacgaactccgagcaaaagtgacaagatcatccagatggaggaattatctactttccacaaccaaatacgttttggagagcagaaaaagaggaactcaccaaagacaaaatatagaggttggggcaagggctgaggaaaggaggcaccaagttagcccgaaaaagacacttgtgaaccatcaaaagcataaaccatatcaatgtcacacgtgctaa

SEQ ID NO: 80169 - DNA, 351 bp, Glycine max
  Peptide Sequence Number=SeqID_196947
atgagggttattatggagatggacgggagtggtatcgatggtgcctcacatattgggaagcaaaatgagttcctcgaaggtttgtgtggcttcgaggaggtggcgactgccaatggggatattgatgaattcagggtagagcttggtgttcaggaggtgcgtgaccatgttggtgatcttggagacgagataagggtcgagggagtagtgggaggtgagggttttggcggagaggggcttcgctggaacagatgtgttctactgagagggcgtggaaggcggagacagagtagtgagagtgagaaagagggtttggaggaattgagggatggagagggagcaacaaaatga

SEQ ID NO: 80170 - DNA, 471 bp, Glycine max
  Peptide Sequence Number=SeqID_196948
atgtcttataaattcattatggttattcccaactcgcatttccttgatcatgttctaagtagctctacaactcctgtggaagagcaagttgaaggcaaccataccaatgtggggatcctctacgtaagtcaaacaaagggggagaagaaaggtttggaagatgaggcgaagaagaggaagagtaatggagataaagaaccaactgagaagttggagaacgaaaagatagagagaaagaagcagagaaaaaaaaagagaaagaggtggaaatcactcagaagctggccaaaattgaaaaagagaagaggacagactcataagtcgactttgcttatgtccaaggataatccaagctctagaacagagacagtgtcaaaagcttacgagaagagtaaagtgatgtttgtacaaatgaaagccataaaggttgaggtcagaaaaactaaacaacttggagcaatggttgtttga

SEQ ID NO: 80171 - DNA, 969 bp, Glycine max
  Peptide Sequence Number=SeqID_196949
atgtctagccaacttcatagtcgaactccccctaccgaggacaacgatgaagaacaaaataaccgagtagatgccttaactcgtcttacaagtactaagaggccaggtcaacactggacatttattcaagagaccctcacttcccacaccaccgaggatcacacaatgtatgtcttggacatggtacataggggaaattatggaatgcacactagagggcgcaacatggcaacaagatttatacgagctggttactcttgcaacgttcactacacaccacttgaagagcttcacaatatcacatttccttggtcttttgccatgtggggaatggatattctaaggccatttcccataaccaaaacccaaatcaagttcctcctcatcactatggactacaccaagtggattgaagcagaacccttggaaaacatcacaactcaaaaggtgcaaaagatcacatggaagaatattatctatagatatgacttacctgaacccatcatgacagacaatagaaagaaattcatggaaaaaggctatgaagattttcttaagcaacttgacattagacatctgacatccttggcaaagcatccccaaaccaatgggcaagtagaggccgcaaacaaagtcatcctcactgagttacgaaaaacattgtcaaagatccctaaagggttatgggttgatgagctcccaagcatgttttggggaataatgttcaatacgtctaataactcagaatcactagcagtagagttggacttggccgaggaagtccgaggtgaagcaagattccatgaagaagcatgtaaaacaagagtgtctaaaaaatataactccaagctcaagaaacgaagcttcaaagctaacaatatgaatgacgcttataggcttgaagacatggcagaaagggccatccctaggactcagaatgcaacttatataaggccttactacagttaa

SEQ ID NO: 80172 - DNA, 657 bp, Glycine max
  Peptide Sequence Number=SeqID_196950
atgaagttcgctatgatgatggagacaaccatagggtcatcttggttgacggggttgatgcccttgaagtccttgtccataaaggtgccatttttgggattgattggactatcctccataggaaaagccgccagtgatggtcttgattacacctctgatgtgctgggcagtcttcttctcttcttttgtctgcttcctagtttctgtgctgctcctcttgatgtcctctgggtcttggtcttacttggtggttgtctggggtgtgtaatgctcgtacctgggccctttggagagaagttgatgcttgtctggcctgtgcctcttgtccaacttgtgcaagtcgatcttggtgtttacttctcgctggtcgcacttctatccggcttggcggacttcattctggaatctgaacatttcttccatctggatgtagcccttggctcgttcgcacagttcgtgcgtgaacttgcccggactggccaaggcggccaaggtcatgcggtgagacctactagtggcgtattgcgcactgaatcgtttgacaagggtgtcaaagttgtctatggatctaggtggaagtctgttgtaccaagtcaatgtttccccttgagggacatagggaagacacgacataaaattgtgtcatcgttggtgtag

SEQ ID NO: 80173 - DNA, 114 bp, Glycine max
  Peptide Sequence Number=SeqID_196951
atggagtcaaacccaacaaatgacatcctcagagttaagaccatggacgtctgtaagggcagtcatggagaggtggtggctgtcgacaagaaaaaaggccttgtccaagtgtaa

SEQ ID NO: 80174 - DNA, 858 bp, Glycine max
  Peptide Sequence Number=SeqID_196952
atggcctctgcaaacacccctactactgagactatcccaaccatggaaatcactaccatccccaaagataatgagccatccattcataggcatgttgagtttgtcaataagaagactgtagcatccaaggttttgggagtaaaggtagtgttgtcctacaacactattgctaaggcaacaagatgtctacgtgagggaagtacttataggagggctgggaggaaactaaagggcttaggtggtcaggatgacatctactatgcaaccttcatcaacaagctcttgtgggatcaaggagtatcccatgttttcaacaagatggacaaaaactataagcacaacctaatagccaaaggttcagttgttactaaacaacaaaattttagcaagactaacctgaaagctatgaagaaaagaaagaagaccaaaaaacaatctcaaaaggatgaagaagaaaaggaacttcttgccagggagcacaggactaaaagaagtcataagtctattgtgtctgttccaccggttatgacctcagtcccacaaaggttgaaagacctaagtgagactgatgaagatgatgaaggtctaattcaagtggcctggcgaaagaggaaagcaactgcactagtttcccttgcaccaaaaagagataagaaagttcgaccagtcttagaaccccaagtgtttctcatcccctttgctattctaagatgtatcaagatgagggcaaccaaggccaacccaaagattggtgacaaagaatgggcagtttcatttactggaaacaaggaggatctaacctcttcatcatcagataacgagtccacaaatggtactcctatctctcccctccactaa

SEQ ID NO: 80175 - DNA, 1167 bp, Glycine max
  Peptide Sequence Number=SeqID_196953
atgagtgaggaaagtaaagcaagtatatgttgtaatgagactcgtatgagtgaaaaagagaggggcacatgcttgttgccgtgtgctgagtgtgagagcaagttgtgtagaggggatagtagtcttgaagagcagagggtgacgggtttgtcaagcccccaaagtgtggacgagagttgtcctgtgtcaagtgtgacaaccttgacgaggagtgcattgaagacaaacgttacttctatcttctacaacaggcatatgcggcacacgctctgtactcttccgtatgtgtccctcatagagttggcacgtattggaatggtggcgattcctcatctgaggatactcactgaagtgcttccaacagcgagtcctcctcgtgtgagaggtgaaggcgcttcttgccctcgtggaggggtgcggccttccgctgatatcagggagcctgtctcggttactatgatcctccccctacaacgtaggaagcaagaccttgttgatgtagaggtcttgccaaatagtggggtagcagttcgccttgtggaacttggacccttaacgatggtcgtcgtagctgctgcatggatgggacttagtaatggaaagggcttcaccaagggtgaaccttgggtttgtcgagccttggaccagggacgatcggcaagcgcagagcttgggtttgacgagtcttgcatggcggaccttgggttttgtgagccctttggaggattgaccaaggaattgtccaacttaggttttgggcaccgtgctcttgcatacatgccacttttcatggtggaacgcactagagacgtgctgtgggtgtcatacactagagacttggtaggatgttcgtgcgcacatgtcgtgggggcacgtactggagacttagtggtatgctctagtgcacatgccatgggtggcacatactggagacttgtttttgtgctcttggatgatgctcgtacgcacatgccatgggtggcatgtactagaggcttagcagggtgcttgtgcgcacatgtcactcatctagggtggcattctccttgtcaatggttcctcggtttctacggggatcatggcatttgtgccatatgtgagtcgggccctgaggatgactccattaactgcctttgcctatccgttagtctgggatgttcgatagag

SEQ ID NO: 80176 - DNA, 213 bp, Glycine max
  Peptide Sequence Number=SeqID_196954
atggtggaaggtgcatgcgaatatggcatggatgctacctggtatgatgatgctaagacaagcttcaacatgcccgagttacaacgacagttaatgggtgttcatgcgatggcagtgggtgaaaggtgtattatgaagaaagagcacttgaaaactttgttgaagcttggatcaaacaaagaagaggctatcaagaaaaatgaagaaaaatag

SEQ ID NO: 80177 - DNA, 558 bp, Glycine max
  Peptide Sequence Number=SeqID_196955
atgcaagagcacggtgcccaaaacctaagttggacaattccttggtcaatcctccaaagggctcacaaaacccaaggtccgcccttggtgagtcccactaattcacatcatcatgcctccaatactagccactttgtaagaggcacgcatgcaagagctcaacacttacactacatgcaagactcgtcaaacccaagctctgcgcttgccgatccttatacgtctacaaaatccaaggcccatccttggtccgcccttggtacatacttctacaaagcccaaggcaccctcttggttcgctcacatgcagcagctacgacgaccatcgttaagggtccaagttccacaaggcgaactgctaccccactatttggcaagacctttaatcagaggagtacctttgcaggtcaagatgacccaccacccaattgcatgacaagacctttaatcgggtgcagttcacacttactcctcataaccatcaaaggagaaactaagcaagtcaagcgaccaatccccacattggttaggcaagaccttcaaccaggggcaagttaa

SEQ ID NO: 80178 - DNA, 282 bp, Glycine max
  Peptide Sequence Number=SeqID_196956
atggaaagtatagatcgaagaagaacaagaaaaaggtaccgcacgagcatcgaaatacagcatgctcattttgaaggccaagctgcgagtggccaaggacctagcggaataggagattccgacgatgccgagaacgaggccgctgcagcggcgcatgccgcggctggacagagccgagccaatcgaaggcaaagaggaggtgcgtgcggcggaagaggccgaggaagagcgccatggcagtgtccgcgatctcctcagcgtgcgaggtgtcgacgtggatga

SEQ ID NO: 80179 - DNA, 357 bp, Glycine max
  Peptide Sequence Number=SeqID_196957
atgggagggaaagaggaggaggaagcggaggggaagtggaggaaaccggagaagaagaggaggaagaaggtgaaggtgagcatgattgtgatggtgaaggtgtttatgggtttggaaggcactggcatcgttgaggggaagaagatgggggttctaaccctctcttcgagtcagagaggacatggacatggaaatggaatggactcggttgcaggatttgccgaagatggaagtgtagtgggaggaagtgattacattgatagtagaatgggcaaattagatcttggcgatgatgtagaaggtgttgagtatggagtgacatgtgcagaaacaaaggggtgcatagggaatgattga

SEQ ID NO: 80180 - DNA, 468 bp, Glycine max
  Peptide Sequence Number=SeqID_196958
atgttgaactcccttgtgctcgctgcgacgtcgttgggagtggaagttctggcgcgtggggttgggggcgtcaagaggctgtgggggattgttaacttcttgctcgctctttgtttggccatcaccgttttggttaccaagttggcccaacacaccctactccccaactcccaccaggaaccgctgcctcctcccgccgccgtcaaagccgccgcgttggctctcttctccgtcctcggaatcccactcgcgcataccctttgctctagcatcaatattctccagtacctcaggggcaggccaagcattcgtggtgggtgcggtggcggcagccgccagtggcattttatccataatcctgcagccatctccaccaccggatttggccaaagcagcaaccacagccggaggaggagtttgatgtggctgtacataaccctgctgaagcaggacccagccctgtcttaa

SEQ ID NO: 80181 - DNA, 255 bp, Glycine max
  Peptide Sequence Number=SeqID_196959
atggcttcaattttcatgttttggctcaagggtttgggaattagaatgccactagagatgagcccaagttcaattttgtcaaccctcaaatatttaacacgatttctgtgcccgtcggaggatggtgtttggcttgtgcattgccatttagaaactcatttgccatgggggctagccatggctttcgaggttgaaaatgggcccagtccttcattttcagggcctccgccaccatctgatcttcctaagtgctga

SEQ ID NO: 80182 - DNA, 1032 bp, Glycine max
  Peptide Sequence Number=SeqID_196960
atgaaagtggctttgaatattgccacaaggcttcttgtggtgcatcccagacccaatttgaatagtgtgagggatttttcatcatcacagacaccaacctttgttcttcctcttctccacactcaccgtcccgccaaaaccctcctacgaatcgcgacgccgtcgtttcgaagttgcggctgcgcaccaatgtccaagctccatattcgcgataaaatcgacctctccgacatcgagagaagaatcttcgacaggcttctcgccactcttcgccacttccacctccaaactcagctccgagtcgccggtggctgggtccgcgacaagcttctgggaaaagagtgctatgacattgatatcgctctcgacaatatgatgggaactgagtttgtggataaggttagggagtacttgttgtccattggcgaagatgcacagggagtttgtgttatcgagagcaatcctgaccagtccaaacatttggaaacagccaggatgcgtttgtttgatatatggattgattttgttaacctaaggagtgaagaatacactgagaatagccgcattccttctaagcaaagatttggcacagcagaagaggatgcatataggagggatttgacaattaacagcttgttctacaatatcaacactgactcagttgaagatttcactaagcgaggcatctcagatcttaagtctggaaagatagtgacacctttacctccaaaggccacatttcttgatgatccgttacgagttcttcgagccattagatttggtgctagatttgaatttactctagatgaagatctgaaagtagctgctgcatgtgatgatgtgaaagatgctctagctgctaaaattagcagagagcgcattggaaccgagattgatctgatgatatccggaaatcagcctatcaaagctatgacttatatttgtgatttgacactattttggattgtattcagtcttcctcctgaatttgaacccgccatttcagatgggtgtgaaaggtatagtttgtag

SEQ ID NO: 80183 - DNA, 573 bp, Glycine max
  Peptide Sequence Number=SeqID_196961
atgctcaccttcaccttcttcctcctcttcttctccggtttcctccacttcccctccgcttcctcctcctctttccctcccatcacccgccccacaaccacgccgcccacggcggaacccttctccgatctggtcgcggccttcaggaaatgggattcccaagtgggctgcgctcgcttcaaacaaaaaccaaatggggtgccccttaaccactcaaaggtcgcgtctttgcaggaagttagcgattgcgggggcttgaaactcaaccatgttagcgttttggtcaaagggtggacttggattcccgataacttggataacttgtactcctgctcatgtgggttgagctgcttgtggaccaaatcgcccgttctcgctgacaagcctgatgcgttgttctttgaatcttccacgcctccgcttcagtttttcacggctggatcaatagatagtgagaatttcctaagacttgatgttggagtagatctaggacatttgttttggtgtactaggagtggtagtcatgggaagctgatggcacctggcagttataaggataattatcctttttag

SEQ ID NO: 80184 - DNA, 618 bp, Glycine max
  Peptide Sequence Number=SeqID_196962
atgggtaatataccaaaatggataccgcacggtgcaaaggctctccatttaagatctaataaatttagcagtagcatcccaacacaaatgtgtcagatgtcttccctcattattttggatattgcaaataacacaatctcaggacatatacccacctgcttacataatatcacagccttagttttcaacaatgcttcgctcaacaagcttagttttgagtttcctacaatagatacccttggtattgtggataatccttactatgccttagtagatagtcttgagctggttacgaaaggtcaggtaaaataccatcaggggttcagtgcactcagctatgtaggcaatcgtgatctttgtgggcctccacttaccaaaatatgtttccagggtggtaaacctaacaacacagagccaatagatgaagatggagatgagtttgcatttttgtcgtggctttacattggaatagaatctggatttgccacgggctttttgggattttgttgtgtcattttcttaatcagaaaatggaggcatgcatacttcaagtttctttatgacttgaaagaccaactttatgtcatggtggccatcaaaatgaattcttttcgttga

SEQ ID NO: 80185 - DNA, 234 bp, Glycine max
  Peptide Sequence Number=SeqID_196963
atggtaatgccaatgaactatgttgtggtagaaagccttgagaaagtatgggacataaaacaattgatcaatggcaaagatgttatgaatgccctacaacttaaaggaggacctcttgttaaggagtcgctggataaagcaatggcttggcaacttgcccatccatctggaactgcagaggaatgcattgaatggttgagagaagccaattctaagcgtattaagttgcagtga

SEQ ID NO: 80186 - DNA, 201 bp, Glycine max
  Peptide Sequence Number=SeqID_196964
atgtcactgtttcatgtagaactttcagatacatccttttacccgataataaatgcatttgtactgatgcttattcagacattcagtaaaggaggtgatgaataccagagtgtacccaatcaagttcaaactgatcatgcaagcagttctgtttctgaagctgaaagcaaagagtataaaccaggtgacaagaaagactaa

SEQ ID NO: 80187 - DNA, 501 bp, Glycine max
  Peptide Sequence Number=SeqID_196965
cttactgaagcattgcttggacttggaatgtgtggagacatgtaccttgagttaagagatgacaaagatgggtatcccatggaacatgggggattgatggtaggaggacctaagagatggctgaacataaggtgtactggctatggagtggttacgggaaacagatgggctagtgatgatctcgcagaatgtaaggcagaggatgccatagatgctgtccgggcaatttgtattgctgaagatgaagctagagatgatctcgcagaaggtaaggcagaggatgccatagatgctgtccgggcaatttgtattgctgaagatgaagctagtgatgatcttgcagaagataagacagaggatgccatagatgctggggttgatgagagcaagggtgtggactctgaaggtggtggatcagttaagccggttctagcatcacgcttgcaaactggacaaaaggttctccatgaagtaagccacgaatccacacaggcagcatga

SEQ ID NO: 80188 - DNA, 813 bp, Glycine max
  Peptide Sequence Number=SeqID_196966
atggggacgcggctgtggctgcaaggcccaagaccaagccaaaggcttgagattatcttcagtgtgacaaaggttttcgttctccctaacaccgcgttgcaccttgcggttagagaaggtttgagagattgtgtgaggttgttacaagcgaacgaggcaaggactgatattctagattcaagagacggtgacacgtgtctacacgtggcggcgggtgtgggggacgagagcatggtgaagcttttgttgaataagggaactaataaggaagtgaggaattttaagggtgagactacatatgatgttgctgtgaagaaaggacacgcgcacgtgtttgacgcgctgaggctggaggatgggttgtgtgtggtggcgaggaaaagggaggtgaggagtatcaagaggctgattgagggaggcacgtcgatggacgggagggaccagcacgggtggacggcgttgcacatggcatggtttaaggggcgcgtggaggcggtgagggcgctgttgttagagaaagggtttgaggtggacaccagggatgaggaggggtatacagcgctgcattgcactgtggagacggggcatgctgatgtggcggaggtgccagtgaagaggcagggcatgtttgattgcgttgcagatctcttattttgttctttgttggtgcagttgggtattttgaatgtcattcaagctatggaacttgcccctgaggtgtttcatttgtggatgatcacatgtgtggctggatcaattaactcaagcgaagagcctattattaagagaggccaggagcttcaaaagatttaa

SEQ ID NO: 80189 - DNA, 438 bp, Glycine max
  Peptide Sequence Number=SeqID_196967
atgatttgtgcatggacttttgctcttgtgctagcttcttcgttggctcatgctgcggttgtggaacacactttcaatgtggaggacatttctgtgcaacgtttgtgtcgtcaacaaccgatcactgccgttaatggaaccctgcaaggaccaacaattaacgctcgagagggtgatactattgtcgtttacgtattcaacaagtcaccctataatcttactcttcattggcacggaattattcaatttttaacaccgtggtcagacggtcctgaatttgtaactcaatgcccaataccttctggtggcagttacacatataaatttaacctaacaggacaagaagggacactttggtggcatgcacactcgtcttttctgcgtgctacggcatgtatatcagaagaattctctgctaagtatgattgtttaatatag

SEQ ID NO: 80190 - DNA, 627 bp, Glycine max
  Peptide Sequence Number=SeqID_196968
atggattcttcttcatcagcaagtgtttgtcagcatgccaaggttgttccaaaacaatatgacatcttccatgcaggaaggtacccttcatctcgcaggactcattcctcttcctcctcttgttcatcactttcaccctcctcttcctcctttgaatcattctttttccctgaggatccacttcttagtcctgcatcccctcttagattctcaggtgttccattttcttgggaatacttgcctggaattcccaagaagcagaattccaaaaagaagctgcaggagtcctccttgaaactactaccattgcctcctccaactaccacgcactcttctagaaagcacactcatgaagaaacaaggattagaaagaagaattcaatacaaagtgttttccaaagggatcctttctttgctgcactggttgaatgctcaaaggatgatagtgaagaaacaagtagaaatttgtggaatggagctaaggtgccaaggagtgttagtgatcgttttgggtttattagcctctatgcttcttgcaagagaacttgtgctgtttctgaatctttagtctaccttccaagctcaagaagaagcacctgcgaacatgttagtcccaggtccctctaa

SEQ ID NO: 80191 - DNA, 275 bp, Glycine max
  Peptide Sequence Number=SeqID_196969
tacaaaagggacacaggcctgaaagaggcccaaacatagaagcaaagactcctaaagcttacgagtacactagggaggccaattcatgcacagggatggtgtcaccagactccccatccattggtcgtcgtatgggaatgcaagttttatgtggtcattcttttcttagaaaactcggttttaaaactggttcaacagtgtaccaattgcacaagtatagaagtatctcaaaaatattatcttccaaaggatttgtgcaatatcaaaccaattga

SEQ ID NO: 80192 - DNA, 210 bp, Glycine max
  Peptide Sequence Number=SeqID_196970
atggcgaaggaaatgatccacggtcgtaattctccagggaagctcgcccaggtaagccagttgcttaggcttgaaggtatcagctcgctcaggcgagctggttgcttaagaatgaagctttcccatggcccaggcgaggatgttgagtcctatggaaacataaagatgaggacgttgagtcctatagggcataaagataaagggcattga

SEQ ID NO: 80193 - DNA, 1579 bp, Glycine max
  Peptide Sequence Number=SeqID_196971
caaactcaccaaaccggttctccggcgaaccggtttcgtcacacaggacgatattctctaccctcacttgacggttcgcgagacgctcgtgttctgcgcgatgctgaggctcccgcgcgcgctcctgcgctcggagaaggtagcggcggcggaggcggcgatcgcggagctagggctggggaagtgcgagaacaccataatcggaaacagcttcatccgcggcgtctccggcggggagaggaagcgcgtgagcatcgcgcacgagatgctggtgaacccttccctcctcatactggacgagcctacctccggcttggactccacggcggcgcaccgcctcgtgctgacgctcggttcgctggcgaagaagggaaaaacggtaattacatcggtgcaccagccctcgagccgcgtctaccagatgttcgacaaagttgtggttctaacggagggacagtgtttgtactttggcaaaggaagcgacgccatgcgctactttcagtcggtcgggttcgcgccgtcttttccgatgaatccggctgattttctgctcgatctcgctaacggtgtttgccatgtcgatggtcaaagtgaaaaagataaaccaaacataaagcaaagcctaatccattcatacaacacagtactgggtcccaaggtaaaagctgcctgcatggacactgctaatgttcctacaaaaaacacacacccttggagaagcaactcctcaaaggaatttagacgtagcaacagggttggcttcttagattggttttaccaattcagcattctgctccagagaagcctcaaagaaagaaaacacgaatccttcaacactctgagagtctgtcaagttattgctgcagcactattagctggcttaatgtggtggcactcagactacaggaacatccaagataggctcggcctactcttcttcatttccatcttctggggagtcttcccgtctttcaactcggttttcgcattccctcaagaacgcaccatcttcatgaaagagcgagcttcgggtatgtacacactgtcctcctatttcatggctcgaattgttggagacctgcccatggagcttattcttcccacaattttcctcattgtgacatattggatgggtggattaaagcctgatttgtgggcttttctcttgactttgttggttgtgcttggatatgtgatggtgtcacagggtcttggccttgctttaggtgcagcaataatggatgccaaacaggcttccacagtggcagcagtgacaatgctagcatttgtgttgacaggtggatactatgtccataaggtgccatcttgcatggcttggatcaaatatatatccacaaccttctactgttataggctgctgactagaatccagtatgaggatggcaagaagatatcatatctattgggttgctatcatggtgataagggtggctgcaggtttgttgaagaggatgtggtggggcaaattggcaccctaggatgcattggggtgttgcttttcatgtttgtgttctacagattattggcctaccttgccttgagacgcatcaagagttga

SEQ ID NO: 80194 - DNA, 184 bp, Glycine max
  Peptide Sequence Number=SeqID_196972
atgaaggctgatatggaggccatgaaggaacagatgacgacaatgatggaagcaatgatgaacatgaggaagatgatggaggataacactgctatagttgttgatgcgagtacttctattgagatggacctgattcacccgactggttttaatcaagtgaatcatccagtctcagatgtagtag

SEQ ID NO: 80195 - DNA, 255 bp, Glycine max
  Peptide Sequence Number=SeqID_196973
atggcgaaagcaaataaaagaaaacacgttcgtctcctagggagaaaacgagtaaaaatccatttggtgcaagggaagctcgcccgggcgagccagttgcttaggcttcaaggtatcaactcgcccaggcgagctagttgcttaaggctgaagctttcccatggtccgggtgagccagatgccagcctgggtgcaagcaaagtcattgtcactacgatttggattttggatactcgtagatatgacggtgcatag

SEQ ID NO: 80196 - DNA, 225 bp, Glycine max
  Peptide Sequence Number=SeqID_196974
atgtccttgaagctattgccaccatcaaatattcgaagttgtgcacttctattatatatgcccctgaaggggcagctctacatgcatggagttaccataggcatagccaagctttcattttacaaagctcctctctactacaccacacaacaacgtgaacatgagtcatctatgccatcgatatcattggcaacttaccatgtccaatacatcatgaagaaataa

SEQ ID NO: 80197 - DNA, 792 bp, Glycine max
  Peptide Sequence Number=SeqID_196975
gcaaacttgatcagatctgctgccatgaattatctgctgcattctggcattcagtggggagcagcacctgcagttaaaggtgtccgtgatgcagcagtagagttgctgcacacattggtagctgtgcatgcagaggtttttgctggtgctaaacctctgttggataaaacgcttggcattcttgtggaaggcttgattgacacattcatcagcatttttcatgaaaatgaagctacagatcttagtgcaattgatacaaatggattctgtcagctcatgcttgagcttgagtactttgagaccatattaaatccatattttacttctgatgcaagagattccttgaagtctttgcaaggattacttttggaaaaagccacggaaagtgtgacagatgctgttgacaatccaggacacaatcgtcggccaactcgtggtagcgaagacgcacttgcagatgataagcaacaaggaacaactgtatcacctgatgagctcatttctcttgcacagcagtacagctccgagttccttcaatcagagcttgagaggacacgcattaacacagcatgctttgcagaatctattcctttggactctttgccagaaccagccaaatctgcctactctcccttcaggaactcaatggattctcctagcagaaaacacagagttgatgaaaatttgtattctttgcactgttatctgtttgtaaaggtggatgacaattaccacataatgagttttggaacatatgtaggcattcatgtatgccaatcgcaagtgcagtga

SEQ ID NO: 80198 - DNA, 1083 bp, Glycine max
  Peptide Sequence Number=SeqID_196976
atggccacttctccaaacgtgacaacatttaacaccaaactccactcttgcgcctacaaatcccgctccattcctcccacatcatgcatcaattccaccaccttgcattgctcaattcccatcatggaaggttgcaaaatgtctccacaaaagccatggaagaaagggccaacaaggggcaaaggtggccctcaaaactcttcatgtgagtatagaggtgttaggcagagaacatggggaaaatgggtggctgagataagagagccaaaaaagagaacaaggctttggcttggctcttttgccacagcagaagaagctgccttggcctatgatgaggctgcaaggagactctacggccctgatgcttaccttaacctccccaacgtgatgatgatgcaaaaaattcaaccaacagcaagcttcacaaattccaccatcaccaccacaaaatctcacaagtacttcaattggttcccttccaagaacttcatttcaatgtttccctcaagtggtggattgctcaacctcaatgctcaacctagtgtccatgtcatccaccagaggctgcaagagctcaagcaaaatggggtggttgcaacaagtcaaaatcaatcatcaccgcatgctagttcattatccactcatccaaaggttgtggtggaacttgaaaacttagacatccaaaaccatgcagaaactcttgttcctccactgcaagagggtaattctcaagtttcatcacagaaaactattattggtggtgattttgagaagccccagatagacctacttgagtttcttcagcagatgggaatactaaaggaggaaagagaggaagaaaaaactgatagctcaggaagttcaacaacagtgtctgaagcagtatcaagagatgatcagagtgaacaacaacctggagtgttttctgatgatatgagtagtgttaactgggaggaattgatggagatgcatgagcatgaccgtggagttgtagataattatcatgcattagaagaaatccagtttgaagcatatgacataaacgaggaccttactttctccacttccatttggaactattaa

SEQ ID NO: 80199 - DNA, 264 bp, Glycine max
  Peptide Sequence Number=SeqID_196977
atggaatccaacataagatttctggaagtatactccggtctaaacacgaaacagatctataacttgaagattgaatgctcacagcagcaaaatggtagtgttaaagctccagatcatactgggaatggttgtggggtagaggtatcaggtgattgtgattttgtgtatcaaggtgaaaagattaaccttgaaatgaaaaagcaggcagaacaagatctttgtttgaacaaaccccaagcaagcctagtgtttcccggtatataa

SEQ ID NO: 80200 - DNA, 669 bp, Glycine max
  Peptide Sequence Number=SeqID_196978
atgtcaagaccttttggagtcagatcatgtggatggactttcatgaagccttcacttttggctatgatggaagcaacaatgttgagcattgcaaagtcattcaagtgttacatcttgtcaagatgtaacactttgatgatgcttgtgtcttcttcaccaaggatgttgacaactaccccttcattcaatgatgaagaagaagctgctatttttgcaaatgatattgcttcctctatccaagttcaatcatctgccaaagctatggccaacaccattgtatgtggggtcaccattgatcctacgaacactagtgttatggaagaaaatcttgaggtgtccaatgtagctatggctaatgaaattcaacaccatgttcaagaccctgcgttcaagcaatctagaacttcaaataaggctacttctcgagataagggcgaacataatgttgttatagtttattctactagtcccgaccccgctcctctcaactatgcacaactagccactgtcacttgcgatcaagtagaagatatgattggccaagacatggagactttcgctgaacaccaacgacaagagaatgagcaattctggctctctattcaaccatctcttccatcttcaccaccaccttctcaacctccaccaccaccgcctgctcaggactga

SEQ ID NO: 80201 - DNA, 282 bp, Glycine max
  Peptide Sequence Number=SeqID_196979
atgggggcaccttctgaaactctatctttggaggttccacttcttgtgaaaggtcccttcaatgtttcactaatagatcccaagagatactgctttgagagctctttttatccttcaacttctgcatactacgacatgtttgagtggagcctaccctacgacaagagtgcgggtgaaaagccaaaggagcatcttccaaaaaggaaaatgtgtgggagtcaccaccaatgtttattcgaggaaaacgttagaaaaaccaaaaaagaggtctgcgaattttga

SEQ ID NO: 80202 - DNA, 303 bp, Glycine max
  Peptide Sequence Number=SeqID_196980
atgtcgttaacatatttagatgcagcttggaaggatggaaaggctccaattgattcatttactctgaaaacttcaagtttggttatcttattttgttttatgatcagaaaaattgatgaactaaaaaattcggtgaaaagatttgatgaaattgggatcaaagttcttggagatgctgttttaaatcaccactgtgctcattatcggaatcaaaatggtatttggaacatatttggaggccctcttaactgggatgatcgtgcagttgtagctgatgatccacattttcaggaaacagaataa

SEQ ID NO: 80203 - DNA, 2040 bp, Glycine max
  Peptide Sequence Number=SeqID_196981
atggttttcttcgcctccgtttcaaactctaatcaatgccgaaaacaaaccttgttgtttatatttaccatcttcactttgttccatacactctttaccactgtagtatccctttccttcaactcttcaaccttccaactaaactcaaataatctaatagactttaagggtgatgctttttcctcaaatggtgttcttcagctcacaaagaaccaaattgatgacaaaatcacattcagcgttggtcgagcctcgtataaccaaccagtgaggctttgggatggaagaaccaagaagctcactgatttcacaacccacttttcttttgtcatgaaagctattgacccatcacggtttggtgatgggttagccttcttccttgcaccatttgattctgtcctcccaaacaattcagctggtgggtaccttggcctattcagcaatgaatccgcattcaacactaagaaaaatcagttagttgcggttgagttcgacagcttcaaaaatgaatgggatccgagctctgatcatgtaggaatcaatgtcaactccattcaatctgttacaaatgtcacttggaagagcagcattaagaacggatcggtcgctaatgcctggatatggtacaactctacaaccaaaaatctctctgtgttccttacttatgctaataatccaacttttaatggcaattctagtctttggtatgtcattgacttgagggacgtgttgccagagtttgttagaataggcttttcagcggccacaggttcatggattgaaatacacaacattttgtcttggtcattcagttcaagcttggatgagggtagtaggaaaaaggtgaaggttggtttagtggttggtttaagtgttggtttgggttgtttagtttgtgttgtaggcctattatggtttacgttttggagaaggaaaaataaaggaaaggaggacaacttaggtgttgatgcttctatagatgatgagtttgagagaggaactggcccaaagaggttcacctatccagaactaagcaacgcaaccaacaactttgcagaagaaggaaagctaggagaaggaggatttggaggtgtttacaaaggcatagttgtacactccaaccttgaagtggcagtgaagagggtttcaaaagggtcaaaacaagggaaaaaggaatacgtgtcagaagtgagagtaatcagccggctgaggcatagaaacttggttcaactcatagggtggtgccatgaacaaggtgagctccttcttgtttatgaatacatgcctaatggaagccttgattctcatctgtttggaaatagagtcatgctttcatgggtggtgagacacaaggtggccttaggtttagcatctgctcttctttatcttcatgaagagtgggaacaatgtgtggtgcatagagacatcaagtcaagtaatgtcatgttggatgcaaatttcaatgccaaacttggtgactttggtcttgcaaggctagtagaccatgaacttggttctcaaaccactgttttggcaggcacaatggggtacctagcccctgagtgtgtcaccacaggaaaatccagcaaggagtctgatgtgtacagctttggtgttgttgcacttgaaatcacatgtggtagaaaaccagtggaagtgagagaagaacctagtaaagtaaggcttgtggagtgggtgtggagcctctatggaaaagggaaactacttgaagcagctgatcagaaactgaattgggaatttgaagaacagcaaatggaatgtttgatgattgttgggttgtggtgttgtcatcctgatcataccatgaggccctccattaggcaggtgattagtgtcctcaactttgaagcccctttgccaagtcttccatccaagttgcctgtgccaatgtattatgcacctccaatggatatgtgcaaattctcctacacttcatctggtgttactagcacaaccaaagcatcttccccatactcatcaatctcggaagggtccggaaaatctctattaaagcactaa

SEQ ID NO: 80204 - DNA, 240 bp, Glycine max
  Peptide Sequence Number=SeqID_196982
atgtggtggtccaacgacaagaaacaggagttatggtggccaccaatggtcatgggtggtggaaaagaaggtgttaggaattgcgctcagtgcacttgtcttgccaagcgagatgtccaaaagtattattttgcaaatcccaacagtcaaagcttgaagagttgggttacaaaactacagtctaaatttgaaggtgatccaacgtttaacaagttcgggatcacaggtttaccaaaatag

SEQ ID NO: 80205 - DNA, 198 bp, Glycine max
  Peptide Sequence Number=SeqID_196983
atgaagtattttcattgctctgctcaagtgaattttatcccaatgctaaatgggactaactttaagtcctcaaaggaactcataggaattattcttggtggtatggatttggacttgacatggatgacggaacgacccattttgactccagaaacctctaatgagggaaaacttgagaagtgggattggttcaactga

SEQ ID NO: 80206 - DNA, 692 bp, Glycine max
  Peptide Sequence Number=SeqID_196984
atggctttccctccccacgtagtagaggactgcatgggcctcctcaaactcctgagtgacggcaccgttttgcgctccaatatcaacttccaagaacaacctcaacctacccaacacgacaacctcgtacaattcaaagactttgtcttcctcaaaaaattcaacctccacctccgtttctacaaacccaaatttgaggacaatgatgatgacgacaacgaaaacaacaacaagaagttgttgcccgtggtgatgtttctccacggcggcggcttctgctttggctcgcgcgcgtggccacacatgcattcgtgctgtgtgcgtcttgccacgagcctccgtgccgccgtggtggccccggactaccgtctcgccccagaacaccgccttcctgccgcggtggacgacggggtggaggccgtgcggtggctccagcggcagaagggtcaccacggcggggacgagtgggtgacccggggtgttgactttgaccgtgttttcatccttggtgactcctctggcgggaacattgctcaccacttggcggttcagctcggacccggttcgagggagatggacccggttcgcgtacgaggttacgttctgctgggcccctttttcggtggggtggttcggactaggtcggaggtgggtccaccggaacaaatgctgacccttgagttgctcgacag

SEQ ID NO: 80207 - DNA, 387 bp, Glycine max
  Peptide Sequence Number=SeqID_196985
atgggcatgctcaagagagtttttttttatcctattcatgttgctgacacttcttctttaacattgaagaaagaaatttctagtgttctttctcgccattgtcttgatattcaaaatcttcgtggccaagggtatgatggagccagcaacatgcgtgagaagttagccatcatgttcaagaattttttttcaagtttatcattgattgtgaatgttgtgattgcttctcctaagcaacatgaccaattgccagctgcacatgcgacaataatagcaaatttgattgctagtgatgatattgcaatggttcttcaaaatgctattgaagatggtaattattccctccgtgatgatgctaatagtgcttatgatattctcacatcctaa

SEQ ID NO: 80208 - DNA, 195 bp, Glycine max
  Peptide Sequence Number=SeqID_196986
attgaggaatatgtcagaaaatctatctgcaacagttgtgaatgctgggagaatgccgaaaatgaagggacaagtttaaagaagcaagtccaggcaccgactctcaaaaattcaacacttgaagatagagtcacccatctagacaatgcacttaaggagtgtgttaggcagctaagacaaacaaggtgtttataa

SEQ ID NO: 80209 - DNA, 561 bp, Glycine max
  Peptide Sequence Number=SeqID_196987
atgggaatttcttcacagccttctcttgtttccttctctttgaaagatctgattcagggaactgaagaaaacaaaacttcttcatcatatgggtgtttgtggagcaaagtcttgacagcacaagccaagaaggtgaaaggcacaaagagaagtgttaggaggccaaggaggattttgatgatgaatagaaggagtggctctagaagaggatcctacaatgggattagaagacgtgtgagaacattgaagagccttgtgccaaatagtgactctttggggttggatggactcttcagacaaactgctgattacatattgtctctacaaacgagagtgagagtcatgcaggttatggttaagctacagaaacattggtttcagaatttcatgtttattattgtttcatgtcatctagatttagatcagttttatgatcatggtctcaaaggtgaatcaagtaaaaatgatgctacatgcacatcgatcctagatgctgttaatgtagcaagaacgaagaatcgcattagtgggcttgatgccatgtcccaatccaaaatctga

SEQ ID NO: 80210 - DNA, 1557 bp, Glycine max
  Peptide Sequence Number=SeqID_196988
atgcagaagcatggttttgcatcaaagcgcaacgtgttgccgtatcaaacggcgaggctaagggaccactacgttctggggaagaagctggggcaagggcaattcgggacgacgtacctgtgcacccacaaggtgacggggaagctctacgcgtgcaaatcgatcccgaagaggaagcttatgtgccaggaggattacgatgatgtgtggagggagattcagatcatgcaccatttgtcggagcatccaaacgttgtccagatacaaggcacgtacgaggattccgtgttcgtgcaccttgtcatggaactatgtgccggcggggagcttttcgacaggatcattcagaaggggcattacagcgagagagaggctgccaagttgataaagaccattgttggggtggtggaggcgtgccactctcttggggtcatgcatagggatctcaagcctgagaatttcttgtttgatacccctggcgaagatgcccagatgaaggccaccgattttggcctctctgtcttctacaagccaggacaagcctttcatgatgtagtaggaagtccctactatgttgccccagaggtgttgtgcaagcaatatggacctgaagtggacgtatggagtgctggtgttatcctatacatcttactgagtggggtgccacctttctgggctgaaaccgaagcaggaattttcagacagattttaaatggagatcttgattttgtttctgaaccgtggccaagtatctcagaaaatgctaaagaattggtaaaacagatgttggatagggaccctaagaaaagaatttctgctcatgaagttttatgtaacccttgggttgttgatgacattgcacctgacaaacctctggactctgctgttttgacacgcctaaagcatttctcagcaatgaataaacttaagaagatggcattacgggtcatagcagagaggctttcagaggaagaaataggtggattgaaagagttgtttaaaatgattgacacagacaatagtgggacaataacttttgaggaactgaaggaggggttgaaaagtgtgggctctaatctcatggaatctgaaattaaatcacttatggaagcggctgatatagacaacaatggatcaatagactatggtgaatttcttgctgctacactgcacttgaataagatggaaagagaggagaatttggttgctgctttcgcctattttgataaagatggtagtggttacatcaccattgacgagcttcaacaggcttgtaaggacttcagcctaggtgatgtgcatctggatgagatgatcaaagagattgatcaagataatctgataaaatttgggatgcttgaagtagaaaatggttatctgcctaaagaaatcccgtgctgtatcagaattgttttggctgtggatgggaggattgattatgcggagtttgcagcaatgatgaaaaagggtgatccaaatatgggtagaagcagaaccatgaaaggcaatttgaacttcaatattgcagatgcatttggaatgaaagactcttcttga

SEQ ID NO: 80211 - DNA, 798 bp, Glycine max
  Peptide Sequence Number=SeqID_196989
atggcggcgccgaggaatgtgacggcgacgagggacgaagagaagggcgaggacgatgattcgccctccgcgaagaagcccaaatcggagaggttcccgctgaacacgtgggaattcgccgtcgccgtcgccgtcttcttggtgttctccaccggcctcttctgcatttacctcaccatgccctcggccgcttacaccaacctcaaactcccccgcaccctctccgatcttcgcctcctcaaggaacatctttcgacgtatgcgagtaaccaccctgcgcagttcattcttgggtactgctccacctacatcttcatgcaaactttcatgattcctgggacaatcttcatgtccctcttggctggggcgctttttggagttgtacgaggaatcctattggttgttttcaacgccactgcgggtgcatcttcctgtttctttttgtctaagttaattgggaggcctttggtttcttggttgtggcctgaaaagctaaggttcttccaagctgagattgcgaagcgtagggataggctgctgaattacatgctttttctgaggataaccccgacattgccgaatctgttcatcaatttggcgtctcccatcgttgatgttcccttccatatattcttttcggcgacattgattgggctcgttccagcctcttatattactgtcagattgcctataggcttttgcaaggttgagaagatcatgattttgcacctaggattgcactattctactgtttctcttgcttctccatgctcaagccaatgcaggattgccacctga

SEQ ID NO: 80212 - DNA, 258 bp, Glycine max
  Peptide Sequence Number=SeqID_196990
atgacgggaggtcttagccaaattatcaaagtaaggataaaaaaactacgtaccccattgcccagaggttcttcgctatgcgaaggtatgggggagggatgttgtacgcagtgcaaagaggctgtttccggattcgaacccatcaccaacaagtcaccaagacacaactttaccgctgcaccagggctcgccctctatcaaagtaaggatatttcaaaaaaaaattctggcagaaatttacttcgaaggtccatctag

SEQ ID NO: 80213 - DNA, 885 bp, Glycine max
  Peptide Sequence Number=SeqID_196991
atggcccctgaggttttacgcaagcaaactggaccagaagtggatgtatggagtgccggtgttatcctatacatcttactgagagggcacccacctttctgggcaaaatccgaatcagcaattttccaagagattttacatggagagattgattttgtttctgatccgtggccaagtataacagaaagtgctaaggatttgataaaaaaaatgttggataaggaccctgagaaaagaatttctgctcatgaagtcttatgtcacccttggattgttgatgatagtgttgctcctgacaaacctctggaccctgctgttttgacacgcctaaagcatttctcaactatgaataaacttcagaagatggcattacgtatcatagcagaaagactttcagaggaagaaataggtggactaaaagagttatttaaaatgattgatgaagacaatagtgggacaatcacttttgaggaactcaaggatagtttgaaaagtgtgggctgtgatctcatagaatctgaaattaaattccttatggaagcggctgatatagacaacaatggaacaatagactatggtgaatttctcgctgctacactgcacttgaataagatggaaagagaagagaatttggttgctgcttttgcctattttgataaagatggtagtggttacatcaccattgaagagattcaacaggcttgtaaagactttggccttggtaatttgcacctggatgagataatcaatgagattgatcaagacaacgatgggagaataaattatgcagagtttgcagcaatgatgagaaagggtggtccggatgttggtaggagcagaaaagacaattacaatgcttcattattggatatgcttgtggagtga

SEQ ID NO: 80214 - DNA, 588 bp, Glycine max
  Peptide Sequence Number=SeqID_196992
atgaaaagatatcctccactctctccaaaagaagaaggatgggttgtgtgccgagcatttcgaaaacctagtccaagtcacaggcaaggttttgacccatggtgcagcactagtagtcaacaacaacactttttcagagatcaaattcaaagctatgcaagacccttatcaattgccgacattttgaatgaaacaaataatgtgcctcaccctgttgaaggtacaagttttagtcactccttcaactcggataatcagcaacacttgaataatattatatcaaaccaaactgctatcattatggacaaacaactccttgagcttccacagctagatagtcccactgcaagtttggcaatcaaagaatgtaaccaacaacaacacaatggcctaacaaatgaggagtattgcagtgatgaaagaagcaatagcagtgcacaaggcatcgattggaagagcttcgacaacttgtttgggtcacaattgagtgataatgcagcttatttttcacatccaaacttgcccttggtgatgccccataaccatgatcaagctagtcatatcctaggatgcttccctgattcataa

SEQ ID NO: 80215 - DNA, 789 bp, Glycine max
  Peptide Sequence Number=SeqID_196993
atggccactgccactgtttcaatttcaactttatgcgctactttcggaacccattgcgccatttcccacaacccaaaacctctattttctcaacctttcaatctcaatcactttccttctaactcttacaagctcgctttctcgcctcgctcacctctttcaccccttcccaaggcctctgaatccgcggtagccgaaaccgaacccggttcggccgagcccgaaccggcccaaatttccccggcccaacctccctcctgggaacccggtctcttcgctgtcgtaatgctttttccgatgttgggtgttggattcggtgacccaatgtggaaaagtttcaagctttggtctgaaattgttgacccagatgagttttttttagtgattgtacatgtacttgtagatgtggcactgtggcagttattgagtaaaatgattggcggacgccaatatattgttcacccggggcgacatcttactgttcagaggttaaaaggtgctaatgttaatgataagattgccttacacaaggttttactggttggcactgatacatcttgctacattgggaaaccaattgtaacaaatgctgtagtatacgcaacggtggaagagcagggtctagaccctaaagtaattgtcttcaaatataaaaagaagaaacattatcgcagaaacattggacacagacagccaaatacacgtatacggataaatagcattatgggctatgaaaactacccaaaagttactatggacgatatcaaatcagacgaacccgaatcatga

SEQ ID NO: 80216 - DNA, 282 bp, Glycine max
  Peptide Sequence Number=SeqID_196994
atggccattggctacgcgttgctcttcgtcaaagtcataataggttacaagcttatactagctagctctaaaaaaactctaggggatgagatatttagaagtaatgatgatgatgattgcactctcaacgcctgctggtggtggagaaagacctgccctgtcgtgatcacaattcacgaccaccaggcacacacatgtagccaccctgatacagataaatctccactcatcagcttaagccaattttcagaattttattccaaggataccatcgatcactag

SEQ ID NO: 80217 - DNA, 1488 bp, Glycine max
  Peptide Sequence Number=SeqID_196995
atgtcagtaaataaggtggatatagtgtattttcagtgcgacaatggctggtatggagtagattgcagcatgccatctgttatttcttctattaaagagtggcctagttggcttcgtcctgctcggattcatattgctgacgatactcatgccaatgaaaaaatgattaatctcaatgctgtggttgcaaagaaaaggcctcttgtatatgtttatgatttgcccccagagttcaacagcttgctgcttgagggacgccattataagttagagtgtgtaaatagaatttatgatgacaataatataacagtttggacagatcaattgtatggtgcccagatagcactttatgagagtttgttagctagtcctcatcgaacactaaatggtgaagaggcagattttttctttgttcctgttcttgattcatgtatcataactcgtgctgatgatgctcctcacttgagtatgcaggagcatatgggattgaggagctctctcactttggaatattataagaatacatatactcacattgttgagcaatatccttattggagtcactcatcaggaagggaccacatctggtctttttcatgggatgaaggtgcttgctatgctcctaaggagatatggaacagcatgatgctagttcactggggaaacacaaacacaaagcataaccattcaaccacagcctattgggcagacaactgggataaaatctcttccgacagaagaggaattcatccatgttttgaccctgacaaagatctcgtgcttcccgcttggaaagttcctgatgcttatgtgttgacttcaaaactttgggctcggtctcatgagaagcggaagacactgttctacttcaatgggaatttaggacctgcgtaccctcatggaagacctgaagatacgtatagcatgggtatcagacagaagctggcagaagagtttgggtcaagccctaacaaggatggaaaacttgggaaacagcatgccaaagacgtcattgtgacaccggagcgttctgaagactatcacatggatctagcaagctctgttttctgtggagtgtttcctggggatggatggagtggtcgcatggaggacagtatattgcaaggatgcattcctgtggtcattcaggatgggattttcctgccatatgagaatgtgctcaactatgacagctttgctgttcgaatacctgaagcggaaattccgaacttgataaagacccttcggggattcaatgacacagaaattgaattcaagctggcaaatgttcagaaaatatggcaaagattcttgtatcgtgattctgttttgcttgaagctgaaaggcagaaaactgctattggacatgttgatgattgggcagttgaattcttaaagctgacagaggatgatgcctttgccactttaatacagacacgcatactggatgcaagaaaaaaaatttgcattgattgcaaagaatgttga

SEQ ID NO: 80218 - DNA, 1362 bp, Glycine max
  Peptide Sequence Number=SeqID_196996
atggccccccgcactgataaacctgacaaatctgccgatgaggtcagtgcccagtttcgagaaatgcaattgtgtcttgaggcggtcaccaaacaacaaacagatttccaaaattttctcaccacacaattaccccttctcatacgtgaacaaatttcttcccaatctgcagcccattcatcctctccggttcgaaccgacccgccacaatcaaccatcaaattacccaaaataaccctatcttcctttgatgggaaagatcctcttgactggatcttcaaggctgaacactattttgacctaacggacacaccacccccccgccgcctcattctcattcccttcttccttcaaggtcctgctcttagttggttcaaatggctccattccaaccatttactcacaacttggtcggaatttctccacgcccttgaggtacgttttggtccctcttcctttgccaaccatgaagcttctttgtataagcttcaacaaaccggatctgtgcttgaataccaacaacaatttgaatccctctccaaccgagtcaccggtctctcacccacctcccttctcaactgttttctttcgggccttcgaaaggatatccaccatgaactcagcatactcaaaccatcctccctgacccaagcaatcgatttagctaaactgattgaaaccaaaaacctagccacaaaatacccagcctcacggccaaccaaaccaccattccctccaaacaacccacaaccctctctgttaggaccgcctccgaccgttccgattcgtcgcctcacgccggcggaacaaaacgagcgccgctctaaagggctctgtttcaactgtgatgagaagtttcatgttggacatcgttgtacaaagaaacaatttctgattatgctcatggacgacatcgatgaagtggtgggctctccgacaagtgatactgagcatcagatggtggaatcatgtcccttgctgtcaccagcacccatgtcaccgccgtcctctccggattcatcctctccggccgccgccgagcattttcaactgtctcaagcagcactggtgggacctccatcaccacgcactcttcgcgttcaaggacgtgtcggtgaacttgaagttacagtcctgattgattcgggcagctcgcacaacattatgcagcccagagtagcggaattcctcggtttgcctatggtagctatcaagccattctcagttgtggtgggtaacggcgattcgatcacttgtagcggattctgtgctgaggtgccagtgaacctcgctaagcaaatgtttcacatacctttcttcatcataccaattcatggcgcagatttggttttgggggtgtag

SEQ ID NO: 80219 - DNA, 474 bp, Glycine max
  Peptide Sequence Number=SeqID_196997
atgggatttgtcattgtgaggaatagtgattttatggttgctatttcaggttatgatgtcaaggcagcctggtgttcttggtctcttgcggcaacaattgcttctgttgtggcattggtttctgtagtccatttgttcttgttccctttgacacccactttcaattattttaagatagcccaggactcgtgcttcccaactaatgcatcggcagaatttccaagcaaccatgaccaggaaaggcctgcagttgattttaagcatcagtttccggctgacttacatggagcatttgtttatcatggtgtaccgtggaaggctgaaattggccagtggcttgctggttgtgattctgttattaaggatgtaaacatcactgaggtggcattaactgcaaaaatgactgcagtggccaggggatttgtaatcgacaattgggacaatgtcgatgttttcatggttattctggattaa

SEQ ID NO: 80220 - DNA, 357 bp, Glycine max
  Peptide Sequence Number=SeqID_196998
atgtgtttagtggaactcaagttaatggcaattacaattgcctctagagtaggattggtactagcagatacaaatgtctctcgggtagtagatacaagtggtaagtataccctcatgtatcacatacttagtaagaagcacgaaaagacattgggaaggctgtgtataaactacacatgctcctccaccaatgagctgttgggatctagccatccagaagtgggcactcccaacggcaggtttgtcagtctgaacggtagcaaacaagctagcagaggaacaatgaaggagccaaaggtcctccagaatgaaggagggcaagggaaaggtgccacaatgaaagcagctagggtttag

SEQ ID NO: 80221 - DNA, 531 bp, Glycine max
  Peptide Sequence Number=SeqID_196999
atgctaatttctgaggtgacaggggatggatgcactaaaaacttgcaattggaatgcaacttcctaggatcaccagatcaaccatttgggagatgggttgtctcaatttgcccagccaactgtgacaagacaagagcaatgtgcttctgtggagaaggcgcaaaatatccaaatcgaccattagcagagacatgtgggtttcaatttgatccaccttccgaacctgatggtcccagaatagtgaattggacaaaaattgaccaagatgtcttcacaaccaatcgtagcataccaggttggtgtaacgtggacccagctgaagcatatgctggcaaggcgaaagttaaagaagaatgtgactgcaaatatgatggtcttgcgggccgattttgtgaagttcctgtggaatctgtttgcattaatcaatgctctgggcatggccactgtcgtggtggattttgtcaggctagggtagagagaaaagataccttcgagcagtatcagctccagaaaataagagagaaaggataa

SEQ ID NO: 80222 - DNA, 807 bp, Glycine max
  Peptide Sequence Number=SeqID_197000
atgaactgcaccaaggcaactaatctttcgttgaaatggaataatccaatactagaaagcttctctcctcaaagaggcctaagtcaagatgatcctctctcatctccttatcttttcatactgtgtatggagaaattagcaattcttattcaagaaaatgtgaatgatggttctcgggagcctgtcaaaatctctaggaatggaccagcaatctgccatctagttttcgcgaacgactgtttattgtttgtgaaggcgacttgctctcaagtaagaattgtcaaagaagtgctgcaccaattctgccgtgtgtcagcttctaaaaatgtcactagaaggaaaattgagaagtacaactctattcttgagttccaacacactactaccattggaagatacctaggctttcccttgttggccgggagaggaaaaaaagaagattttgcatttgtggttgacaaaatcaatagcaagctggacggttggaaatcgaagttaattaatcaagcacggagtttttgcgttaccctagttgaggcagcaatcccaacatatactatcaaacctttttggcttacggaaggcatatgtgagacaattgatgcacgtgtgaggagttttatcaactatccttatacaaacaaggccttgacatggctgacgtggaccatttttgcatacatgtcggcatatggtgcattccaattcccgccccaaaataacacgaaggaaggtggccggaagaagaatgaaggtgactggaacaaccttttgttacctcattcgaagatctgtatcatgggctaa

SEQ ID NO: 80223 - DNA, 204 bp, Glycine max
  Peptide Sequence Number=SeqID_197001
atgagatcgattgaagtcaaaatctgtatagtagggaaccaaacctttgtggacaaccatttggggtctctttcattgaagctgagcaggggaatggataaccaatacattgttaggaaagcagccgcagaaaagaagctattggaaggtgaaatgggggatgatggaccctactatattacaatgcaattctcatcattttga

SEQ ID NO: 80224 - DNA, 273 bp, Glycine max
  Peptide Sequence Number=SeqID_197002
atgggcataaacctagtaaaactacccatcatatctcccaaacacccaatacccacgaaattatgtgagaaagaagtctacccaaacctgaaatttgaagtcccacaatgtagaggtgcgcttcacgactccgaaaatggcttcctttcgcgatttggagcagaaatggtgagcaaaggttggagctttgatggagcttcaatggtggaggagaaagggagaaaaaaccaacgtgagggagagggaaaagcttctgaacttttggctgagtga

SEQ ID NO: 80225 - DNA, 687 bp, Glycine max
  Peptide Sequence Number=SeqID_197003
atgacagccctatgcacatccggtggaggatttgtctttaatgccaatggagccccttggaagctgttgaggaaggatctggctacgctcgcgcagacatggagcgtgctctcttactttaaccttgcccctacttctcacacttcttatcttaatgttgacaaggcaagactgatatatggcctagtgatgaagatggacatggacctgggcagcttcatttcaggtcaaatcacacatatcgcccagtccagcacctctcggttgggcttctcggcattgatcatagcgctgtgtgatgctcaggggggcgtttctaacaccctgacctttgagtctttaagccatgtgattatccttgcctatataaagaagaattgttggaactccgccgacccgtccatcgccttcccgagaccccttcatgccagagccagagctgctgcaccagatgccccgtctctcgcacagccccccccccccacctgccgcatgccaccagcagccatccacctcggccccgacagatccacatacaagttgcttggccaggattccagccttctactgatggggaggggggttgagccctctgaggtcagagagactactgagatcggagttggggatgacatcatggtagacctggtagctgctgattggggcccatggccaaacttgggttga

SEQ ID NO: 80226 - DNA, 297 bp, Glycine max
  Peptide Sequence Number=SeqID_197004
atggatgctacatcctcaccatttgtttcctcaagaagaatgggtgtatatgatcctatccaccaaattagagcgtgggaagaaaatttgggcatacgtgcagcagttagagtcatgtcgtctgcaggttgtgcagttagagcaagaggtagatcatgcaaaacaacagggaatgtgatgcaatcctaccccccaagggcattggatagaagactccaagaagattgggccaaagatgcaagagaaggccttagggttctcatgagccttagggtagatttcgggcccatgggctaa

SEQ ID NO: 80227 - DNA, 444 bp, Glycine max
  Peptide Sequence Number=SeqID_197005
atgtgggatttgagatggcagtgtagggttaagtctgggttcagcatgagtcaacaacaatgtaggataaggagggttgaggtggggcagcaggttgtaaaggttcaggaattggggatgaagggtcaggtggtttggcacacagcttcgctttaccatttggttcacacagctgccttagttgcctccccaattacaaaacaccctaatgtttttggaggccttctaacaactggtatcttggctttctctgggacgtatagtgaaagtgttcccaccacatataaatctcaattgaataaaagatatttaagtttgctcaagcttaacaagatcaagttgagatacatctgttcaggagtcaggacattgcggaagtttatgtttaagccacaaaggtgtaaaaggctgagtcattgccacattgatgttgaagatgaatag

SEQ ID NO: 80228 - DNA, 401 bp, Glycine max
  Peptide Sequence Number=SeqID_197006
ggccctgttggacttctccgggtccactgggtgtcttgtgggcacgatccctgcaaatagtggatggcatcagaaatcagtttagccacatgcatacttacgtatgtcgaaacggcacagaccaactgggcagaatgttgctaagtagcaacgtcatctatatctgtgtaagagtggtcatgttggtgcgcatgaccaacacttgtctctttgcagtggcacgggtgaaatcctgccccggtatgcatagtagttgcgtgatagcctccctctctggttgtgcttgcacagttggtcgccctccaatatcaggggtggcccataaactgataaaaggaaactactggccccttaactgggagtgcaagtctcggttaggcattaagggtggaggaccttga

SEQ ID NO: 80229 - DNA, 858 bp, Glycine max
  Peptide Sequence Number=SeqID_197007
atggttcctgggcagccccctgatcctggaggagggccaactatgcaagtacaaccagaggaggaggctatcgcgctgctactgtgtataccggggcaagatttcacctgtgtcgctaccgggagacgggtgcggatcatgcgtaccagcatgactactctgacccagacatggatgacgttgctgcttagcaacatcttgcctagcgatcataatttcgacctccctcagccaaagtgtcagttggtgtatgccatcctaacacggatgagcgtccacgtggcccaggtgattgctgacgccatctatttgtttgcaggtatggcgcctaccaggcaccctctggacccagataagtccaacagggccctggggtttccggcgctgatcatgggcctctaccagtccttcggagttcccgtcgcccccagtaaagtaatccgaccacccatcacccgggccttcattgagaagtattgcacggctagacaggcaccgggtgatgcaccacaggccgcaggcgcgccgccaccacctcatcaggctgacccagctgggtcatttgacacggagcggtacttgcggcactcgattcgccagcacacggccaaccacagggggctggggcaggtccatgagtgtctctaccagctcagcctcagcatgcaaaaccagggtttcactccttttgctagccctactccagaccaattcaaggcagaggttgcatggcccggagattggcccgaggcccaggcaggggaggcgcccgcagaggctcccgacgatggagaagaggccagcatggatgagatgtcggatttgctcggcttcttgggagggagtggagccacatga

SEQ ID NO: 80230 - DNA, 720 bp, Glycine max
  Peptide Sequence Number=SeqID_197008
atggaagacgcacccatgagccctcgtgtcgccctcccgccgaagggtaggttgcgacagaatttgttcattagtgctagacataaaaatgtggtcattttgttggttttatgcacaaataaaagccaactgatgattgtctatgagcaagtatgcaacagttcacttgaacagtacctaacaaggggaagtttccagtcattgacttggaagcaaaggctgaaagtggcaatgggtactgccaaaggtttaaagtaccttcatgggaataacataattcttggaaatataaaaccaagtaacattcttctaacacatgacttcgaaccacggattggagattttgactttggaaaagtgaaacatggaccaaagaaatccagcaaagataaaagtgtacggaattctggatatgcagcacctgagtatgttgagaatggaaaagcatcaaataagacagatgtgtactcctttggagtggttcttttagagctgatatattattatgcaaatgaatgtaggatgagccttagtgcaatgatagggttgctaccagttgaccagaaagcaaggcctctactgggaggaaagaagtaccctaagttggtggatctgaaaatcagaaagaatcctaaggaaagaataacaatgaatatggtaagtctaagtgatgtagaatacgataagaaagtgcataaaacagaaaagaaagcatgctag

SEQ ID NO: 80231 - DNA, 240 bp, Glycine max
  Peptide Sequence Number=SeqID_197009
atgaagatcgtatcggggacagagtcatttggcagcgacgagagtggcgtagacggtgaggaggaaggggtggtggagatttgtttccctgaccgtggcggaaaacacaacgaaaagggagaagcagagggaggtgggaagctaccatgggaaggggaggcaacgtggtttctgctggtggtggtggctttgcaaaggaagaagatgggaaaagttggctcgttacctttggaagcagag

SEQ ID NO: 80232 - DNA, 930 bp, Glycine max
  Peptide Sequence Number=SeqID_197010
atggttccgtcaaataccgtaacggcattcaccgcaaagccgtctccgttattaactttcgtaatgctcatcgtcctcggcgtggtgggattctattccctgcatttccctccccgtcccaccacctcccccgacccctcgcgcttccgccacgtgttcgtatcgtcttcgtcgaactccactgtcgcgagctacctccgcgccctcaccgtgcaccctcacctctctggaacaaaacccgcctcgttaaccgcacgctatgtggtgaaccatttcaccaccctcggctttcaaacaaaaacagtacaacactctgcgctgctatcctacccggtgcgctcctcgctcgccgcgcattttagcgacggcacgagtttcgagtttcagttaaccgaaccggacactgagaaggaagtggtggcgccgtaccacgcatactcgccgtcaggtgcggcggaggcggccgcggtgtttgtgaactacgggcgggaggaggactaccgtcagctggtggctgcgggggtggaggtggcggggtgcgtggtggtggcgagaggcggcgcactgccgcgcggggcggtggtggaggcggcggagaggcacggtgcggcggcggcggcggtgttcgtggagagggacacgtggcgcgaggggtttgagagagggcacgtgatgagaggggggataggggacccactgagtcctgggtggagtggggtggaaggtggtgagagtttgggtttggaagatagtgaggttttgaaaaggtttccgaaaattccatctttgcccttgtctgctgaggctgcggagaggatcttggagtcgcttggtggtgctcctctgcccttggattggaggggtaccctaaagtcatccaaggttaagaatgttggcccgggccccaccatcctcaactttacttatcag

SEQ ID NO: 80233 - DNA, 951 bp, Glycine max
  Peptide Sequence Number=SeqID_197011
atggatgtgttctttgactcagtggatagtttatcagctcaagattttgttttagccaaagaagagtttggttctggaaggtgtggttatgacgaaatttgggtgaaggagcctggtttaggcttacttgattcttcttccaaggtttgttcacaagagaaaatgagcttagatgactcatccataagcttgggattggagaggatcagggagtgcagtggggcaatctcaaatgcttgcattttgcatactgatcaagtagtatctgagaagtggattctctctgggggcaaagcagcttctaaagaaaaaatctctttggatgaattcaaagggtgtccccaagatgaagcagaagcaaacattcaaggaaaagaccatgagttctcttctatagctcaggagcatagacccagagaagctgtttcacaagaagaatttcaggattttgatatgggtaaaagaaagaagaaaaactggtggaagcgctttgtcaacctcaggaaaagtggtgaaggaaatgtaaggtccaaattgaatgcagggacaaataaaactcgaagaataaaggtgaagcggaataaaaagaggtggctacatatgttgcaaagaggtgttgcaaaggttgtagttaaaaaggggaagacacaactctttaaggatggcaacccaatggtgtacaatggagttgttgatagaataattgggaggccacctcccaagaccggggatgttgttctggtagcagatgggactaagaaaccaattggatggggcatgtacaactcagtttctatgttctgtgttcggctcatgcagcttgaagatgaagctactagcttaagcccattaaacaaacaatgtaggacaaaccaagagtgtgcttcttggctaggtactcccttgataaacaaagcaagagtacttctcttgggcaaggtattcccttga

SEQ ID NO: 80234 - DNA, 126 bp, Glycine max
  Peptide Sequence Number=SeqID_197012
atgtaccactttccagttctcctcagggtttgtgaaagaattgatagaccttgttcatccctatttgacagtgactggaaaaagattgaagcatttgttgtatcaaagacagtcatccattgttga

SEQ ID NO: 80235 - DNA, 465 bp, Glycine max
  Peptide Sequence Number=SeqID_197013
atgactttttgtgattgtttgttcctagatagtgtttctttgatgattgcaagttttggagatgttcagggtgaattgaaggtggctaccattgaaaacgtttttgccattatcaagggacgggaagaacctgatcgatatgttctgcttgggaaccatagagatgcatggacatatggtgctgttgaccccaacagtgggacagctgctctacttgacattgctggcagattttctattctattgcgtttggggtggactccacggaggaccatcattctatgcagttgggatgcagaggaatttggaatgataggatccactgagtgggttgaacaaaaccttgtcaatcttcgttccaaagctgtagcatacctcaatgtagactgtgctgttcaagggcctggtttctttgctggctcaactcctcagctagatgatcttcttgtcgaggtcataaaacag

SEQ ID NO: 80236 - DNA, 318 bp, Glycine max
  Peptide Sequence Number=SeqID_197014
atggtggcagacaaattgagattagggtatgaggtgatctcatacatctatttcgtctggagaccatccattgatgggatgctcagcttgattgaccgtttccagtggatgtacaatgccacctggaaaataaatttgaaaattcaaaggctcagtggtgttgattctgatttcgctccatttgtgcaacatgcaggggttccatctgttgatgtatattatggaaaagattatcctgtctatcacactgctttcgattcctataactggatgacaaagtttggagatccattctttcagcgccatgaagctggttag

SEQ ID NO: 80237 - DNA, 435 bp, Glycine max
  Peptide Sequence Number=SeqID_197015
atggggtcccattctcctgtccagtgtggtgccttgtctgataaaaagtgtggtggtttgagctatgatgatgcttggaatgcatgtagtaatcaaaaccggaaccattttcatcatttggttacaaccactggaatatctcaacctctatcagcgtcagaagtaagattgaatccttatgccttcgtacaatctgttccttctagtgaaaaagctgccacacaatcccttaagttgtggaactcaacgattgcttttgcttatggatttcatggtcaaggacaagaagcaatcaaggttttcaatgagatggaacaagaaaatctgccagaaagtgaagtaatattcttaaggctaaccaaagaggaaacgggttttgatgacgtgtcttatggagggacatttgttgtatgtgaattttggaagtctgtatag

SEQ ID NO: 80238 - DNA, 603 bp, Glycine max
  Peptide Sequence Number=SeqID_197016
atgcaacctatctcagcacctcatgtcagaacttcaatcaaaattgttagcacattaaacgaaagctaccacaccaatcaaccacccttggcaggcaaaataaaacgccttgttctcacccaggaaggtagaacaaagctcaacatttacccagatagagagttctatgcatttccacgctttgtaaaacatgtagatgatggttttgtttctacactgaccaatctttacagagagaggttgagatctgacatggagattcttgacctcatgagctcctgggttagccatctaccaagtgatgtcaagtacaaaaaggtggtggggcatgggttgaatggacaagagctttcaaagaatccaaggttggatttttttgttgtgaaggatctcaacaaggatcaacagtttgaatttgagagttgcagttttgatgcagtgttatgcacagttagcgtgcagtatctccaacaaccagagaaggtatttgaagaggtgttccgggtactaaagccaggaggggcattcattgtgagttttagcaacagaatgttctatgagaaagccataagtgcatggagggaagggactgcttatagtagg

SEQ ID NO: 80239 - DNA, 318 bp, Glycine max
  Peptide Sequence Number=SeqID_197017
atgggtcatgggtcaggcagtaaatcaacacctggttttgatagcttgcaacctaaaaccataggagatgagataggcttggcttcactggctttcgatactatacagttacggtctttaaatccaaactcctgtaaggcatgctctcccactgataagaaatctacttctaggaattgtatttttattggtgatatcttgatctcatggaagagaaagaaacatgtggtaaaatcaagtgcagatgctgagcatagagcttcatccacttttgaacttacttggcttaaagaattgatatttggaaatatctcatag

SEQ ID NO: 80240 - DNA, 465 bp, Glycine max
  Peptide Sequence Number=SeqID_197018
atggctcgcaccgtgctttgcaaaccaatctacgcaacattgatgcatataaaaaatctatttgagagctctaatgaactatcattaaggcccgaaggctttcagaaagcatttagaaaactaggccgcttgactacaagaaagacttttggctttctcaacagcttcaacatagtaatagagtctccagagtgtagcatcatcctgcagaaaatcaacatgtttctattaaaaaaatctaagtttcacattgttaaagatgaggccaagatagagtataaaagtgaaaggcaatcctatgagctaccttttggacttgagttaagtacaaatctacattctaaaatgatacaagagcttatactaaatccatacaaaggattatccaccatgctatccatgacatcaaacccaaaatgtgttgggaatgagggagtgaaaaaactcaagtttcccattgactaa

SEQ ID NO: 80241 - DNA, 345 bp, Glycine max
  Peptide Sequence Number=SeqID_197019
atgtcgggattagtgcacgtaggacagatggggcaatccgacgagtctatcattgaagacaatgacgggaaagacagtcgaacacgccaccatgcgctaggaacaagggctgttgtttggccagtcaagaacacacgcatgagaatgcgtgattgtgaaaataattaccacaactttcaaaacgacgtcgtgttgaagggacagcacggggacaacatggaaaggaacagcagagaagccaatttcttagggatgcgtctggtgcagatgaaaagaccagggggaaagcacacctcgaggaggtattggccgaaaaaaactcgtcaaaaaaaggtcggtgaatag

SEQ ID NO: 80242 - DNA, 270 bp, Glycine max
  Peptide Sequence Number=SeqID_197020
atggagttcttaagtgatgggttagcaaaagtagatgcattgaatagtgaagtcgactactctgtcttctattgtcattcacctcaaggatgcatctatctcattgcctatgtggatgacaatacaacggtgatcaccatgcaatttgctatgattcgcagtgaagtcgactaccctgtcttctattgtcattcacctcaaggatggatctatctcattgtctatgtggatgacaatacaacggagatcaccgtggtattatcagcttga

SEQ ID NO: 80243 - DNA, 237 bp, Glycine max
  Peptide Sequence Number=SeqID_197021
atgtatgataagtggaatgaggatagatatcatggtacccatgtttatgggtacctggttgggatgggaattgtcaggattgacaatcgatatgcattgaataaggtggtggttgttgttattttattgtgggcagaattgggtaataagatgtggatctccaatccctgggtgagccagcctaatcagtatctgagtagccaactagccaagtatgtcccctatcagcataaatga

SEQ ID NO: 80244 - DNA, 153 bp, Glycine max
  Peptide Sequence Number=SeqID_197022
atggagcatcgatccgcggcaagagcaaaagggtggcttgtgaggaggaagccatgggcgtgtttgggtgtaattaaactatcatcagggtcgtctcccaaaagaataaagaaggtttcaacaaggttcgccaaagcgcaagtcaattcctaa

SEQ ID NO: 80245 - DNA, 597 bp, Glycine max
  Peptide Sequence Number=SeqID_197023
atggagactcaaatagggcaattgtccaaacaattgcaaacctcttcaattggcttttttgcaaccactgaggagaacccaaaggaccattacaaggttattatctccaccgtagagtgtgacatgggaggtgaagaagaagaagaggtagaagaaagcaccgcgatagaggaagagatgaaagcacaatccaacctttcattccaaggcgcgagttgcaaccttatgcctcattctttcttagagaagattggtcgccttaacctaaagcccactaacatgactctacaattcattgatggttctaaaatgaaagtattatggaaagtggtaaacgtgacaataaagaggaggacctacaagttccaatcatttaggaagatacttcataagaaccactcatgtaaccgatcagtgttcgtaaaggagtctatacacttagagagggcaagaaaaaaatgttctactacattcaaggcactgaggattttcccaacaaattggctctctaacaacaccatcatacatcaagctattgatgttgaaaaatcacctaccaggaagcagcctagcattttttgcattttaaattcttag

SEQ ID NO: 80246 - DNA, 237 bp, Glycine max
  Peptide Sequence Number=SeqID_197024
atgacgaaggaagtgatccatggtcacaactctgtagctcctcgtctccacttcttcttcttcttcttcttctatgtttttccctcagctttcaggttgctggggtcttttttcctcttcccctacatggctatttatagaaaaagccatttagtgcaggggaaactcgcccaggcgagctggttgcttagggtagaagggcaagctagagctcgcccaagtgagtggcttgcttag

SEQ ID NO: 80247 - DNA, 300 bp, Glycine max
  Peptide Sequence Number=SeqID_197025
atgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcggataaccgtaagaatgaccaaacttggtctctgcttgtcatcgggcccgccgcctctggatgacaaaagggtgcggataaccgtaaggtatctccgcgtatcatgggtgcagaatgaccaaacttggtctctgcttgtcatcgggcccgccgcctctggatga

SEQ ID NO: 80248 - DNA, 207 bp, Glycine max
  Peptide Sequence Number=SeqID_197026
atgcgtctaccggggaaggagagtctgccgatgggatcccccgtaaccataaatgagattttggatgttagcatttcgtttctaaatgaccatttagaggaaacaccgggttcgacaaaaatagaagaaaatcactcaaagtgtatcaatcttgcacagtgcggggcgagaaaaaaagtcgctagcgcacgggattttggttggtaa

SEQ ID NO: 80249 - DNA, 267 bp, Glycine max
  Peptide Sequence Number=SeqID_197027
atgacgtacactaccacacttgatcacaactttcggtcaacgatcaagacatcgctcaagccctctatgccagtgaacacctccaccctccaccgcatgatgagcagcaacggctacaccagcacacccaatcgacactccatgagctcagacacagtgtttctcaaagaagagaatcatcaacgtgagggaagagtcacgagttcaagcatgagatgtcagaaactttcgggtggaagaaaggatgaagttataaaagaaatataa

SEQ ID NO: 80250 - DNA, 1195 bp, Glycine max
  Peptide Sequence Number=SeqID_197028
atgatgaatgtaaactatacgcatgtctatttagacgaggatcaaaactttcttttcacttcttatgatcaacttggattcgtgggccctacacgtattagtcttgatatattggcttactcattattgtatttgccattgctgattaaacagactgaagaggaattacagaggcagaaggcaattaatgattggcttccaattacttcttcaaggaatgcaaaatggtggtactctgccttccacaatgtcactgccatggttggtgctggtgttcttagtctcccatatgccatgtctgagcttggatggggtcctggtgtaactgtactaatcctgtcatggatcatcaccctgtacactctatggcaaatggttgagatgcatgaaatggtacctggaaaacgttttgataggtatcatgaactggggcagtatgcctttggggagaagctaggactttatatagtggtgcctcaacaacttgtggtggaaattggggtgaacattgtctatatggttactgggggaaaatccttgcaaaagttccatgacactgtgtgtgacagctgcaaaaagatcaagttgaccttcttcattatgatctttgcctctgttcactttgtactgtctcacctgcccaacttcaactccatttctggtgtatctctggcagcagcagttatgtccttgagttactctacaattgcctgggcagcttctgctcataagggtgttcaagagaatgtagaatatggttacaaagctaagagtacatcaggaacagtctttaacttctttagtgcccttggggatgttgcttttgcctatgctggacacaatgtggtgttggaaatccaagcaacaattccatctacaccagagaaaccatccaagggtcctatgtggagaggagtggttgttgcttacatagttgtggctttatgctacttcccagttgcccttattggttactggatgttcggcaatacagttgaagataacattctcatcagtttagagaaaccaaaatggcttattgcaatggctaatatgtttgttgtgatccatgttattggaagttatcagatttatgcaatgccagtgtttgacatgattgaaactgtgatggtgaagaaattgaactttaaacctagtatgacacttcgttttattgtacgcaatctgtatgtgg

SEQ ID NO: 80251 - DNA, 471 bp, Glycine max
  Peptide Sequence Number=SeqID_197029
atggcttatgttactttggcttccaattggtatcaatatatgcagctatatgcaatgccggtttttgacatgatcgagaccgtgatggttaaacaattgcgcttcaagccaacttggcagctacgatttgttgtgcgcaatgtttatgttgcatttacaatgtttgtgggcattacgttccctttctttggtgccctcctcggattttttggaggatttgcatttgcgccaacaacatactttctcccctgtattatctggcttgctatttacaaacctaagaagttcagcttatcctggatcaccaactggttttacctattgggcttccctgtgttttcagatttgcattatatttggcctcctactcatgattctgtcaccaattggtggattaaggagtatcatactcaatgccaagaattatgggttttaccaatgagggagaatgtgttgaaagaaaggtgttaa

SEQ ID NO: 80252 - DNA, 457 bp, Glycine max
  Peptide Sequence Number=SeqID_197030
ggcaaggctacaagcagaggcaaaggctgctgaggatgctcggaagcgggcagacgcagaagctgctgcagaagccagacgcaagagggagcttgagagagaagctgcaagacaagtactgctgcagatggaaaaatctgtcgaaatcaatgagaactctcagtttcttgaagattttgaattgcttagtgccgtacctgctgagcaattaccgagttctgtagatgagaccagtcctgatatctctcaggatggcatgggtagtttcaagtttgggggtggtaatcccttggaacaactaggattgtacattaaagatgatgatgaagaggaggaaggagatccactgtgtgttccaaatcctcctgcaacgcaacagagttccagcgatgagaagggagaaggtgacgaaagggggagtgacggtcagggattggagttgcacggtggctattga

SEQ ID NO: 80253 - DNA, 428 bp, Glycine max
  Peptide Sequence Number=SeqID_197031
ctgttgatccaactcattatcgagcagaaaaggcaaggctacaagcagaagcaaaggcagctgaagatgctcgaaagcgggcagaagaagaagctgctgcagaagccagacgaaaaagggagcttgagagagaagctgcacggcaagcattgctccagatggaaaagactgttgaaatcaatgagaattctcggattctcgaagatttggaaatgcttagagctgtacctgctgagcaattgccaagttctgtagatgagacgagtcctgcacactctcaggatggtctgggtagtttcaagtttgggagtagtaaccccttggaacaactaggattatatatcaaagccgacgatgaagaggaggaaggagagccaccttgtattccaaatcctgtaaatgatgtagaagagggtgagattgattaa

SEQ ID NO: 80254 - DNA, 1620 bp, Glycine max
  Peptide Sequence Number=SeqID_197032
atggcgaaaagtaggctttctggagggtattatgaaaatgcagtagagacgggtggtggtgattcagaggggtctggtacatcggggcgaatagatgccggaaatactattttggaggattctagtgtccgcagaaggaagtgcattagtttgaattcaagtggcaatgatgcttttggtgttcccatgcaagttgttcccatgtccaatttggccccccttcagagaaaggagctcgtggataggttaacctccgaactcgaacagattcgagtgtttcggaagagaattgaactgcagaggatgaatgatgttatgttgtcatctaaaaatgatattattagtagccgtagaaatgaccataatgggcctcaagtggagagaaaaccatcaatgtccagttctgtaccagggaatgaatcgaaacctttaggtcagagtcagaagcctcgtgaatggaatcggggctcttctgggaagtttgaatctgctacgcggacttctttactgagtgctgcaaatgctttgttgatgaaagattgtgagttgttgttgaaacggttaatgagtcaccagtatggttgggttttcaaaaccccggtggatgtggtgaagttgaagcttccggattatttcagtattattaagcatccaatggatttgggaacagtaaagagcaagatagctgcaggagaatatgcaggcccaatagaatttgctgatgatgtgaggcttactttttctaatgcaatgatctataatccacgtgggaatgatgtccatgtcatggctgataccctcagtaaatattttgaattgagatggaaagcaattgagaagaaactgccaagaagagatgatgtgccatttccttctaagccagacacttgtgaagatgttaaaactactagaacattgcctccttcaaagccaaactcttgtcaagatgtaataaaaactacaagaccgatgcctccttcaaaaaagagaaaaatatccactctgccctgtcaacctgtagttatgccacctgctaagaaagttatgtcggatcaagagaagcacaatctaggtatagaattggagtctttgctgggagagatgcctatgcatatcattgatttcttaaaagaaaattgttcaaatggtgaagaatgtggagaggacgagttagagattgatattgatgatctaaaggatgatacactgtttgctttacgaaagcttttggatgactttttgctagagaagcaaatgaatgaaacgaaagttgaagtgcgtgaaatagaggtgttgaatgattctggaccaagcaattcctcattgctaccatttaaaggtaatgattcagatgacgaagaagtggacattggtggaaatgaaccccctgtctcgagttatcctcctgtggagattgaaaaggatacaacttgcaggatcaacacctgtttaagtccaggaagcagtgatacagactctagtgattcttcagatagtgaatctgatgatgttaaatcaaatccagcaaatgtagcaaaggaaccagaaaatatggaatctggagctcagatggtagaaaatagcagggcagatgatacttctgaaagaaatcgtgagtaa

SEQ ID NO: 80255 - DNA, 520 bp, Glycine max
  Peptide Sequence Number=SeqID_197033
atggcgttctactgtttttcccatccgaaatggaatccggatggaggtatctcgtatcccatcacaagttcaaattttaggtatctgtctgccttctccatcctagatggagatacagactctgatagttcttctgatagcgaagccgatgatgttaaagcaagtccagcaaatgtagcaaaggcaccagaaaatctgggttctgaagctcagttggatgaaatgaccatggctgctgctactcttgaaagaaatcaatctgttagtggcttagatcaacttgaggataactctcagcataagccaagttcttttgattctgattgccaacaagatggggacagtgctccaactgagagacaggtctcacccgataaactttatcgagctgctgtattgaagaaacgatttcttgataccatcttgaaagctcgagaaaagacactcacacagggtgaaaagggggatcctgagaaattgcgccaggaaagggagaaactggagatggagcaaaagaaag

SEQ ID NO: 80256 - DNA, 1434 bp, Glycine max
  Peptide Sequence Number=SeqID_197034
atggtgatatcgaagagtaggctgtctgggggttattttgggaatgcactagatactgctggtgaatctgagggttctggtagctcgggaagaatagataccgaaattacagtttcggaggattcgagtatccccacgaggaaatgtattagtttgaattcgagtcgccatgatgcgtttggtgctcccgtgcaagttgttcccttgtcgaatatgccactttctcagagaaaagatctggtgcaaaggttgaggtctgagcttgagcagattcggctgcttcagaagaaaatcgaacagcagaggacgaatggtgttgcattgtcgtcctccagtgatattctcagctgtagtaatgggaataatgggcatcgagtggaaagggataaaaagccatcaatgtccagttctgcaccggggaataaagtgaagccgtcgggtaataagaatcagaagtctcgtggatggaaccggggttcttctgggaagtttgagtctgcagtgcagtctgcttcaccgtccactgcgaatgctatgttgatgaaagattgtgagttgctgttgaaacggttgatgagtcaccagtatgcttgggttttcaagacccctgtggatgtggtgaagttgaatcttccggattatttcactattattaagcgtccaatggatttgggaacagtaaaaagcaagttagctgctggagaatatgctggtccactggaatttgctgatgatgttaagcttacattttcaaatgcaatgaactataatccgtctgggaatgatgtccatctcatggctgataccctcaataaatattttgagttgagatggaaagcaattgagaagaaactgccaaaaagtgatgttctgccaatacctgcaaagccagacaatagtgaaggtgtaaaaactaaaagacaagcgcctccttcaaaaaagaggaaaattgcctcattaccccctcaacctaaagttatgccacctacaaagaaggttatgtcggatcaagagaagcatgatctaggtcgagaattggagtctcttctgggagaaatgcctatgcatatcattgatttcttaaaagaacatagttcaaatggtagagaatgtggagatgacgagattgagatcgatattgatgatctcagtgatgataccctgttcacattacgaaagcttttggatgactttttgcaagagaagcaaaagaacaaagcaaaagttgaagcatgtgaagtagaggtgttgaatgattctggaccaagcaattcctcattgcaaccatttaaaggtaatgatccagcggatgaagaggtggacattggtggaaatgagccccctgtgtcaagctattctcatgtggagattgaaaaggatacaacttacagagtgaacaaaagcctaagcccaggcagctcaaatggtaagtaa

SEQ ID NO: 80257 - DNA, 924 bp, Glycine max
  Peptide Sequence Number=SeqID_197035
atgcaacaagatgattgtctgttgctattgctaatagctgttgtatattcactgcagaactctcccttgttgtcacccatcgtagcaaaaaaagatgatgctggctctactggcagtcagtccttaagagcacttgcattaattggagctggtttgtcaggtcttttcagtttttcaacaatggcagcagctgatgaagctgaacatggcctggcatgtccaagctatccatggcctcacaagggaattcttagttcatatgatcacgcttcgattcgtcgtggtcatcaagtttatacagaagtctgtgcttcctgccattctatgtctttgatatcgtatcgtgatttggttggtgttgcttatacagaagaagaggtaaaggctatggcagctgagattgaggtggttgatggccctaacgatgagggtgagatgtttacacgccctggtaaactcagtgatcgttttcctcagccatatgcaaatgaagcagctgctaggtttgctaatggaggagcttatcctccagatctaagtcttgttaccaaagcccgtcacaatggtcagaactatgtttttgcccttctgactggttatcgtgacccacctgctggtgtttcgataagagagggacttcattataatccttactttcctggtggagcaattgccatgcctaaaatgcttaatgatggtgctgtggaatatgaagatggtactcctgctacagaagctcagatggggaaggatgttgtgtcattcttaacttgggccgccgaacccgagatggaagagagaaaactgatgggatttaaatggatatttgtactgtcattggcactacttcaggctgcctattaccgccgcttgaggtggtcagttctaaagtctcgcaagctggttcttgatgttgtcaactag

SEQ ID NO: 80258 - DNA, 1644 bp, Glycine max
  Peptide Sequence Number=SeqID_197036
atggcgccggaggatataagcaagacagccttcagaacgcatcacgggcattatgaattcctcgtgatgccgttcggcttgtgtaacgccctagcttcctttcaagccactatgaatcagaccttgggcccgtatttgcggaaattcgtaatcgtcttctttgacgatattttgatttatagtcagacgttttccgaccaccttgaccacctgcgaaagatattgcaactcttagttgatcatagctttgtcttgaagttatcaaagtgctcattcgcaactcagcaagtggaatacctggggcacttggtatcggaaaaaggggttgaaccagttccggcaaaggtaaccgcggtgcaacaatggcccactcctcgaactacgcgcgctctacgaggattattgggtttgtcggggttctaccgacgttttattaagggatatgcgtccttagccgcccctctcactgccctactagccaaggatcaattccattggaatgaagaagctgacagagcattttcacaactcaagcttgctctgtgccaagctccggttttgggtcttcccgatttcaaatctcccttcgtcgttgaaacggacgtctctgggattgggatgggagccattctctcacagaatcatcaccctctcgcctttttcagcaagcccttttgctcgaaactgctcagtgcttcaacttatgttcgcgaactcgccgcgatcaccgccgcggttaaaaagtggaggcaataccttctggggcatcattttgtgattcttactgatcatcggagtttaaaagagctcatggctcaagctgtgcaaacccccgaacaacaaatttatttggcgcgtctaatgggctttgattatacgattcaatatcgagccggaaaagccaatctagccgccgatgctctctcacgacttccacccccctctcgaagtcaactttatgtgctaacaataccaaatttccttttcttgcaggaactccgcgcagcacttgctgttaatcaagacttcgtactccaacgacaacagctgcaggataaccctcatcctgattggggactgagagaagacctgattatgtatcaggggcgcatatggcttcctctgaaattttcattaattccggcaattctgaccgagcttcattccacccctaccggcggtcacatgggggttatgaaaacgcttgctagggtccgcgagaattttgtgtggacttctatgaagaaggatgtacaccactttgtgaccacttgcttcacctgtcagcaaattaaaaccgataatcgccgttcacctggtctcttgtgccctctacccattccggcgaagccttgggaggatctctccctcgactttattgttggtcttcccttgtaccgtggtcattcagtcatcttggttattgtagatcgtttctccaaaggcctccatctgggttctctaccacagcatcacacggcggccggagttgccaaactctttatggagatttccgaaaaacttcatgggatgcccaagagtcttgtatctgatcggaacccactatttttgagtcacttttggcaggaactatttaaattaagcggaactaagctctgcatgagctcagcttatcatccctag

SEQ ID NO: 80259 - DNA, 267 bp, Glycine max
  Peptide Sequence Number=SeqID_197037
atgactggttccttagaactcatagaattagtgttgatgacgtcggagaggatcttctttttaatgagtcacagtcaacttttaggtgatgatttagagaaaagagaagcattatggtatgacccgaggtcaaggctagaattcgaggttctagcacctcctagagaaaagaattatgtaattctaacagaatttggcatatgtgccttggaggaatttgcaaaaagatatgggtcatgctctcaagatgcgtttctaacggtctaa

SEQ ID NO: 80260 - DNA, 1269 bp, Glycine max
  Peptide Sequence Number=SeqID_197038
atggcatcgccaacaacgaggtttctccaccaccatagccattattcttctgcgtcaaaaatcttaatcttcttctgtctctctgcatttctcgccctcgccctcatcgccaacctcttccgcgcctccctctccactcactatctcgccatcgccaccaactgggtcgacaccaacgcaccccttcttattccgaatctcaccgccatacctcacaacaacaacaacaacaagttagttcaaaagggaaaagatgggaagattgcaaaaaggaggggtcccgagagattcctttcggctacatttgcagacttgcctgctcccgagtggcattggaagcagatgccctcggctccagtgcctcggctagatgggtactctatacagattaagaatatgttttatgtgtttgcaggatatgccaatcttgaccatgtgcactcgcatgttgatgtgttcgatttcagcagcaacaagacaatatggtatccaatgcagtgggcctactaccgcatccttttcgttagacactgcaacaaagaaatggaaacctttgccaccattgccagcccccagataaatgcggatgatgggacagaaattgtggtcataatgtggtatgctcctgcaactcaattatggaaaggaagactccatgtcatgggtggtagcaaggagaatcgccatacacctggaatagatcattggagtttggctgtgaaggatggtgaagcattggagcaacaatggcgggacgaagttcccattccacgcggtggaccacatagggcttgcattgcagtcaatgatcgactttttgttattggtggacaagagggtgattttatggccaaacccggttcgcctatattcaagtgttcacgcaggcatgaggtggtctatggagatgtttatatgctggatgaagaaatgaaatggaaaattttgccagctatgccaaaaccagattctcatatagagtgtgcatgggtaattgtcaacaattcaataatcatcactggaggtaccacagaaaagcacccagtgacaaaaaggatgatgctggttggggaggttttccaatttcgtttagacacaatgaagtggtcagtgattggaaagcttccatatcgcataaaaaccacattaactggtttttgggatggatggctatactttacatcaggacaaagggacagagggccagataacccacaaccaaaacaggttgttggagaaatgtggagaacgaaattacatttgtcatag

SEQ ID NO: 80261 - DNA, 474 bp, Glycine max
  Peptide Sequence Number=SeqID_197039
atgaagcactcaagttgggctgcattatacacaatattcaccagctgttacttgtttgaacaacttcctaaatctgtttcagccacattatattttactgaactaggttgttccaatgtagctgaagacaaggcttaccagctgacagtctccccaggtgcctggtcaagcttccaaatccaccaaatgaaacagaggcttcagaagtgtaaaacgcaatttacctgtaaaactctactaaaagcagctggtagcggactgctaggtgctccacatcatcaaacattgtacagtgtcatattaaaacaaatgacagtgccatctggaagtgacaggttagccaaagaaacatttgaaaatttccaagtgagacattatggaacaggcataaggaagttcaacttatttagtagcttccacagtgagttgccatgcacaatacatggttcaaattcttacaggaaccatgaatga

SEQ ID NO: 80262 - DNA, 459 bp, Glycine max
  Peptide Sequence Number=SeqID_197040
atgcagaacagatgtggatttgaaaggaaaggggatatctgggtcaacgacatacgtaatctcggagtctcacctgcaaagcttatagagattgtaaagacacggtttatctcccttggtggagtcatttttgaggggtgtggtgtttcctgcatcaatgtatatgaggatgctgcagttctgaaactttctggggacaaaatattgtcatcacgtcttataattgatgccatgggaaacttctcccctgttgtaaaacagataagaggtgggaggaagcctgatggtgtttgccttgtcgttggaacatgtgcacgtggctttgaaacaaactccactagtgatgtcatattcagcagttcatcaataaagaaagttggagattcaaaagcacaattattttgggaggtaacttccactgtatcaatagaaacacagtatccccatctctatttttaa

SEQ ID NO: 80263 - DNA, 2181 bp, Glycine max
  Peptide Sequence Number=SeqID_197041
atggatctcacccagagcaagcaagtgttagccatcataggcacaataacacacagtgaagcaaatctggcaagtgaatttgatgacaccataaaaaatattcctatcttgtctctaatttcacctgtagccagatcagagaaatcatctcctctattgccatacttcatccaagagggatatgatatcaaccttcacatgcaatgcattgcagccattgtgggagaattcagatggcgaaaggtgacagtaatctatgaacttgataactggttttcctctgatccagggattctactcgacctctcctattcccttagacttgttggatcagagattgataatcatgtagcgttgccttccttatcctctctattagatccaaaatctaccattgaaaatgagcttaataggctcaaaaacaaaagtaacagggtcttcttgattgcgcactcttctttagagctggcaaacatactttttgagaaagcaaagcaaatgagtttagtgggaaaaggttctgtgtgggttatcccagatggggttgctggcctacttgattcagttaactcttcttcaatccttaacatgcagggtgttattggatttaagacacatttcatggaaacaagcaaagcatttagaaggttcaaattcaaattccgaagaaggtttgtactggagttccctgaagaagagaacattaacccaagtttctttgcacttcaatcatataaagcaacccgggcagttgctcaagctgcaagggaatcgcaagggaagttaacccttgaacaattattcaaaagtaaaagttacagagagttagcattatggtctccagaactaggtttctccaaaaaccttattacacagcagctgacagagatgaacacaaatagtgcttctagtggaattttgagtactgtttattggcctggaggtatacaatttgttcctaagggatggactcacagcaccgaacaaagaaaattgcaaataggagtgcctgcaaaaggtgccttcactgagtttgtgaatgtgacatatgataagaacaggaataaaacttctatcacaggattctcaatcgatgtctttaaagaagccgttcataatttgtcttatgacttggactttgcgtttgttccctttaatgggtcttatgatgaaatggtagagcaagtctataacaagacattggatgctgctgtcggagatacatcaataatggcatacagatatcatttagttgacttctcacaaccgtatgttgactctggtattgacatggtggttacagagcaatcagctaaatcaaaagaaacatggatctttttaaaagccttcacaaaagggatgtggttgatgatggcagcattacacattttcgtaggatttgtcatttggttgatcgaaaggcaagttaatgaagaactaaaaggattcgggtccatgctttggttcttagtcactgtaatattctatgcacacagagaaccaattagaagccccttggctcgaactgtgctggcaccatggttatttgttatcctaattgcaactagtactttcacagcaagtttgacttccatgatgactgtttcacaactagagccatctgtgttagatatcaagagccttctgaagagaaattctccagttggttgtaatggaaattcgttcattgtaaagtatttgactgaggtacaaaaattcaaacctgagaacattaggagaattaactccataaatgattacccttcagcctttcagaacaaggatatcgaagcagctttctttattgcgcctcacgctaaggtatttcccaagggttccactttggctactgacatatccgaggcattgctgaaagtgctagagagtggggaaattgaacagcttgaaaaagatatgctaaccatagaaggcaatgccagttgttctcctttagagagcaaggcaaaagatgggtcaccgacaggatttcagccttttcttggcctattttgcatctgttcaattgttgctctacatacatctaacattaacacaattaaggagaatatggagatggacaaccagatattttgctcggagcagttcaaggttccaatcaggaagtttgagaagtgtgagtacagccacagtaacaagaaatgcagaggagacagtcattaa

SEQ ID NO: 80264 - DNA, 624 bp, Glycine max
  Peptide Sequence Number=SeqID_197042
atgagggttggattcaagggcggtgacgcggttgataaggctatcaagcttttccgaaacgtggatatggctagtagcgagtttggcaattgcctcctgaaggcgatcaaaggacttggaacgggtagattcagccatggctcaatgaaagcaccagttggtatgacccgaggattccttgctgattgtgctgacaaggctgctgctgacaaggttatcgagaaagttggaacaagtcagaggaaaggaaatcaggaactagggaaggtgggacttattagtactcttgcacaacgttttgagcatttttcaatcggaaggacctctaaaatgtcactcattatctgcttctttgtcctgcaattgttaacatggtcaagggtgcttctagctcatgaaagtagaaacaactgctcaaggtccattatgagcataggtgctgtgcttgatttgagttcacaaatgggaaagcatcagaagatagccatgcaaattgcactccaagagttcaatcggttgagttgttccaagctggatttgaagattgaaaattcccatgggaattcagctcacgcagttgctagtggtaaggttaatgacctcttccaactttttgtcttgtga

SEQ ID NO: 80265 - DNA, 141 bp, Glycine max
  Peptide Sequence Number=SeqID_197043
atggcgagtataaagatgcaccaggaagagggcaacgagcaaaaagcctcacctgggacagtgggttgccggaaaagtgactgtggccactatccagcagacactagtttatggacagataatattgattattacacataa

SEQ ID NO: 80266 - DNA, 300 bp, Glycine max
  Peptide Sequence Number=SeqID_197044
atgtcactcattatctgcttctttgtcctgcaattgttaacatggtcaagggtgcttttagctcatgaaagtagaaacaactgctcaaggtccattatgagcataggtgctgtgcttgatttgagttcacaaatgggaaagcatcagaagatagccatgcaaattgcactccaagagttcaatcggttgagttgttccaagctggatttgaagattaaaaattcccataggaattcagccaatgcagtagctagtggtaatgttagcgtccactttccaacttttgtctcacgagattag

SEQ ID NO: 80267 - DNA, 795 bp, Glycine max
  Peptide Sequence Number=SeqID_197045
atggctgaatctacccgttccaagtcctttgatcgccttcaggaggcaattgccaaactcgctactagccatatccacgtttcggaaaagcttgatagccttatcaaccgcgtcaccgcccttgaatccaaccctcattctccctcgtcttcctctgctaacccttcttcccacccccaaacactttccccccacagactcaaactcgacgtacccaggttcgacgggtctgacccctccggctgggtattcaaaatctcacaattttttgaataccacggggtaccgaactcggagcggcttacggttgcctctttttatatggacggacctgccctagcatggtttcaatggatggctcgtaaccatcaattgcccacgtggacaggcttccttcaggcgattgaagcccgttttgctctatccccgtatgaggacccaacaggacagctcttcaagttggttcagaaaggtacattgcgcgaatacctggctcagttcgagtccttggccaaccgcatcatcgggttgtcgccgtcttcgcttctcagctgcttcatatcaggcctcgaacctgatatcagacgcgaggtacaggccctccagcccttgactttggtgcatgcggcggggttggctagattgcaggaagagaaactccatgattctcgacgaagtgtccgcagccgaccttccttcactccctcaccctcgactccgcctcctctctcggtggttcctcctccctctcctttacccttacttccttcaccgcccaaacctccgcccttacca

SEQ ID NO: 80268 - DNA, 506 bp, Glycine max
  Peptide Sequence Number=SeqID_197046
tcgtcgacccactgcatccaccagccctggtagtagcgcacgccggcgatctcttcgaagccacagaccatcatgccgcggtcggagctgaaggtgagaagctggggttccaggaggtcagggatcgcgcttggcaccctggcgccgaacttggcaagggcgtccatgctcatgcgctcaacatgccgattcagccccttgtgaagaatggagtacatgtggaccgtgcccacgacgggctgacctggatcgttgtcgcggcggcgttcgccgaggtggtgtgccccgatttcggatactttggacgggccatggaatacaccttggaatgggtgcgaaggaacgagtactactgggccggtccacctggatggacaatctgccgagtgttcttggacgggatgtggcaatacgaattgtggttcagccgcggggatggtggcactatctacggcatgctcgcgtcactggctgcggcgcaagatctcttcgatcaaaagctctaa

SEQ ID NO: 80269 - DNA, 270 bp, Glycine max
  Peptide Sequence Number=SeqID_197047
atggttgagaagataaagaaaaaactggaggaagatgctcaatccgaaagcactgaaggcgtgattgaccctccatctcccatcacacgtgaagtggaagactgggtagatgacgattctttggaggagcaggcgtcacagggttcgtttgtcccccatggacgtcaggatctcctgactgctgccattgggcgaccagaacaccctggccgtgtgcgtgcttctagagtcggtgtgaccataaagcaatactttggattggctccatga

SEQ ID NO: 80270 - DNA, 702 bp, Glycine max
  Peptide Sequence Number=SeqID_197048
atgaaggtcggcgtccgcctgggcatcgcctttggtttagtggtggcactactggtggtgattggtattacctcaatcatgaagatcaacaacatcaagagcggcattacctcgattgtggaagatcgctatgtaaaagtgcggctcggctttgacgtgcgcgatggcgtcaacgatcagatcaaatacctgcgcggcatcgtcatcgataccacccgaccgcagttcaacgtgcagcgctttcagcagctggcagacgccaccgcccgcaccaacgcggcgatgaagaagatcgaagcgattcagattaccgccgtaggcaagaagaaaattgccagcctgctggctgccagtcagcagtttgaacagcagaaaaatgaggtgctggatctggtgcgggccggtaaagccgatgacgccagctactacgtgctgaaaaaaattaccgccgtgcagaatgcctacctcgacctggcggtggcgtttgctgattcccagtcctcgcagctccagcaggaaggcgccggcattatcgacgatggcaccacggcgattgaagtcacgctggtgttctccgcgctcgccattctcgctgccgtggtgatgggctggctgctgacccgttcaattgtgcatccgctgaatgaagcggatgaccatcgccagcaaagtggctgccggcgatctcagcaaacgcattga

SEQ ID NO: 80271 - DNA, 2355 bp, Glycine max
  Peptide Sequence Number=SeqID_197049
atggcagatcagagaaagaaagtattagccatcatagggacaataacacacaacgaagcaactctggcaagtgaatttaatgataccataaaggatattcctatcttgtctctaatttcacctatagccagatcaaagcaattatctcctttattgccacagttcatacaagtgggacatgacatcaaccttcacatgcaatgcattgcagccattgtaggagaattcagatggagaaaggtgacagtaatctatgaacttaataacttgttttcctctgatccagggatgctacttgacctcacctatgctcttagacatgttggttctgagattgataatcatttacctttgccttccttgtcctctctatcagacccaaaatctactattgaaagtgagctaaataggcttaaaaacaagagtaacagggtattcttaattgtgcaatcttctttggagctggctaacatactttttgagaaagcaaagcaaatgggttttatggaaaaaggttgtgtgtggattatcccagatgggattgctggccatcttgattctgttaacccgtctgttatcatcaacatgcaaggtgttattggatttaagacacatttcatggaaacaagcgacgccttgagaaggttcaagttcaaatttcgaagaaggtttgcattggaattccctgaagaagagaacattaacccaagtttctttgcacttcaatcatatgaagcaacattggctgttgctcaagctgctaaggaatcagaatggaagtttacccttgaacaattattcagaactaatctttccaggaatagaaaattacagcaatcaccaaccttcaatataattaatgtgataggtaaaagttatagagagttggcattatggtctccagcactaggtttctccaagaaccttgttacacagcaactaacagaggttatgaagacaaatactgcttcaactggagttttgagttcagtttattggcctggagggttacagtttgttcctaaggggtggactcacggcaccgaggagaggacactgcaaataggagtgccagcaaaaagtgtctttcatcaatttgttaaagttaataacacttccatcaccggcttctcaattgatatctttaaagcagctgttagtaatttgccttattacttgaaatacacatttgttcccttcaatgggtcttatgatgaaatggtgaagcaagtctataacaagacattggatgctgctgttggagatacatcaataatggcatatagatatcatttagttgatttctcccaaccttatgtagagtctggccttgacatggtggttagagagcaatcaactaaatcaaaagaaacgtggatattttttgatgcctttacaaaagagatgtggctgatgttggtggcattgcacattttcgtgggatttgtcgtttggttgattgaacggcaagttaatgcagaactaaagggattggggtccatgctttggtttttagtcactgtaatattctatgcacacagagaacaaattaaaagccctttggctagaactgtgttggcaccatggttatttgctatctacattgcaagtggtactttcatagcaagtttgacttccaggatgactatttcgcagctagaaccatctgtgttagatattcagacccttcaggaaagaaattccccagttggttgtgatggaaattcattcattgtgaactatttgactgatgtactagaattcaagcctgagaacattaggaaaattaactccttaagggattaccctgaggcctttcagaacaaggatattgaagccgctttctttgtttcccctcatgctaaagtttttctggcaaagtactcatgtcatggcctcatcaaagcaggcaacactttcaggcttggtggctttggttttgtatttcccaagggttccatcctggctactgacatatccgaagcattgctgaaagtgatcgagaatggaaaagctgaacaactagaaacagatatgctatcaatagaaggcaatgccagagaatacggagatggacaaccgcatattttgctaggaactgttcaagagactccaatcagggaacatgagaagtacacaccgtctgactctctatacatggacttatctgccaggaaaatttcaatacaagagattctcatatgcatggatttatcaccaattccattttactcatttgagtcaattaccaagtcaaaccatctttctgttgttccacggtcacgaaacatgcagcctgaccctctatatgtgaactatacgcctctaacaattgttgggaaatcaaaaggataa

SEQ ID NO: 80272 - DNA, 1755 bp, Glycine max
  Peptide Sequence Number=SeqID_197050
gttcaaattcaatttcaaagaaactttgcctcggagttccccgaggaagagaaaattaatccaagtttcttcgcacttcaattgtacgatgcaacctgggcgattgcacaggctgcaaaggaatcacaagggaagtttactcctgaacaattgttcaaaaattacctctccaggaatgacaaattacagcaatcaccaaccttcaatataattaatgtgataggtttctccaagaaccttattacacagcagctaacagaggtgaacacagatactacttctactaaagttttgagtactgtttattggcctggaggcttacagtttgttcctaagggatcgactcgcagcaccgaggagagaactctgcaaataggagtgcctgcaaatggtgtctttcgtcagtttgtgaatgtgacacatgatcagaacacaaataacacttctataactggtttctcaattgatgtctttaaagctgttgttaatactttgccttatgacttgaaatacacgtttgttcccttcaatgggtcttatgatgaaatggtagagcaagtccacaataagacattggatgctgctgtaggagacacagcaataatggcatatagatatcatttagtcgacttcacacaaccttacattgaatctggccttgacatggtggttaaagagaaatcagcaaaatcaaaagaaacatggatttttttggatgtatttacaaaagagatgtggttgatgatagttgcattgcacatttttgtgggatttgttatttggttcatagaacggcgacacaatgcagaactaaaaggattggggtccatgctttggtttctagtcagcgtgatattctatgcacacagagaaccaattacaagccccctggctcgaactgtgttggcaccatggctatttgttatactcattgcaactagtacattcacagcaagtttgacttccatgatgactgtttcgcaactagagccatctgtgttagatatccaaacccttcaggaaagaaattcccctgtcggttgtaatggaaattcgttcattgtgaagtacctgattgacatactaaaattcaagcctgagaacatcaagaaaattaactctataggtgattaccctgctgcgtttcagaacaaggatattgaagccgctttctttgttacccctcatgctaaaatctttctggcaaagtactcgtgcaagggcctcatcaaagcagggagcacgttcaagcttggtggttttggttttgtttttcccaagggttcgactttggctactgacttatccgaggcattgctgaaagtgatagagaaacgagaaacagaacaactagaaaaagatatgctattgataggaggcaatgccaattgctctccttccgagagcaaggcaaaaggtaggtcatcaacaggatttcagcctttccttggcctatttttaatctgttcttctgttgctattctggcattgttatataatatgatttgtgtgttcaagattagtgtagagatcttctctagctacatgcatgtaacattaacaaaattaaagagtatgtggagatgcacaaccacatgttttacttggagctgttcaagactccaatcagggagtatgagaagtattagtactgccacagtaacaagaaatgccgaggagactgtcattagtgatcagcaaagcacaatgaatgttgagcttattgatgtagtattggctgctcatgcttcgtga

SEQ ID NO: 80273 - DNA, 114 bp, Glycine max
  Peptide Sequence Number=SeqID_197051
atggagttaaggcttggttttagtccacaatcacaacctaatgtgggttgcatcaaccactgcacccaagatgttgattacccttttggtggttacagcggaaaatcaaaatag

SEQ ID NO: 80274 - DNA, 213 bp, Glycine max
  Peptide Sequence Number=SeqID_197052
atgagctcactcctcttgagcccattttcatttgctacagatacatctatggctcaggaggaagagacttctccagatcccatgctagagccatttcctgcacctatatctgaggacaccatgccatcagcaccagccatggagctagagcagcccattcttcaggatgtaccagctgctccagtgctggatttaaatgaagatcagccatag

SEQ ID NO: 80275 - DNA, 660 bp, Glycine max
  Peptide Sequence Number=SeqID_197053
atggcgggaaaattcagtgccatgagaacatttcgcgccatttctcttcctcttcctctatataaaccctaccctcaccttcaatttccatttctctcgtcaaatttatccattcaccacagagtttcttcaatggcccagcctcaaccagagtcccacgccaccaatggctcacacgagccattgctcaaaatcccaaagctccaccaaaacggcgacgtttccgcaaccgctccctttctccgcgtcaagaagctctccgacaaggccgttttgccctctagggcttcccctctctccgccggttacgatctctctagcgcggtggagacgaaggtcccggcgagagggaaggctctggtggccactgacatcagcatcgcgattccagagggcacatatgctcgcgttgcgccgcgttcggggttggcgtggaagcactcgatcgacgtgggtgcgggggtgatagatgcggattacaggggtccggttggggttatacttttcaaccattcggacacggattttgaggtgaaggttggggacagggttgcgcaacttatcattgagaagattgtgacaccgaatgttgttacagaggtcgaggatttggatgagactgttagaggtgaaggtgggtttggatccaccggtgtttga

SEQ ID NO: 80276 - DNA, 1651 bp, Glycine max
  Peptide Sequence Number=SeqID_197054
atgggtacttgtttgagcaagaagaatgggtcctctacctcacccaacaagtcagattctcagcataggaattctgagaacagtgtcactgtcaccttgtccaaacccactgagccagaagtgagcctcaagaacaagacactgcaagagaaacaacaaggctcagaatcagcaccacaagatgaaggtgaagtgaagaaagagatactcatcatcaaacacaggaagagccatgatgaaagggaaaaaacagcaacctccaagaccccatcaccttgcattgctccacaacaaggtgatggggttttcaccaatgaagaaacaatggttgttaataagattattgcaccatccacaccaagcattggtgttgtgggagtgaggacttcaagctgcacaaaagatgaggtggatgaaattctgatccagtgtgggaggctcagcagaagctcttctcggagaaagtactcaggctccaagagaagttttgattttgaccactgtgacaatgacactacttctgctgaggatgaccaaagaaagtccaagggcaatggcaatggcagggaggagaatgatgtggcggcggctgcttcagagagcggccgccaccaccaatccccgaggcggtctcagggaaggagaaggactccaagtagggaaagagaccaatccagtggcagagaaaggagagtgagtagatctcctggtagaagatcatctgacaccaacactacaaatgcaagcaacaacaacacaagttctaggcctgggaaaatggtgtctgttccagccactgtttcatctttggttatggataagagtaacaattgtggtggagaatctggcgccaagaggatcactgttaagaggaatgttggtgatgctggttcaaggggtactgcatcaccacgtgctcaatctcctgctagagttaatgggaatgtgggaagggataaagtgttaaatgagaatcagcagcaccaacaacaaccttctcttagtcgtaataactcttcaaggaaagcagaacaatctccttacagaagaatccctcagagtgaggtggatcataaatcttcaaggaaagctgaacaatctccttacagaagaaaccctcagagtgaggtggatcataactcttcaaggaaagctgaacaatctccttacagaagaaaccctctcagtgaggttgatactaatagaaaggtgcaacagaacaagccaaagattgaaggagaagccattcagaaaccaaatggcagagttgcattggagaagggaatgagtgtggattgcaagacaaaggagcaacatgaggaagagtcttcattgcctgttggtgctgttgtgaagacaacagtggtgtcatcaggggttgacaaccttaaacctcaaggcttaacaagaagcagatcttctagaagatctagagacttagacatcagcaatcctgaagctgtggtgaatcctacaaactcctatgcctccctactacttgaggacatccaaaacttccatcaaaagaacacacaacaacagcaatcttctatttctctcccagcttgtctcaacaaggcatgctccatccttgaagctgttgctgatctcaactccaccaccagttcaaatttcactgaggacaagagaa

SEQ ID NO: 80277 - DNA, 1665 bp, Glycine max
  Peptide Sequence Number=SeqID_197055
atggaacagctgaagccaagcgctcctaactcatcccctctcactccactcgccttcttggacagagcagccaccgtctacgcccacgtcccttccctagtctacaaccacaccaccttcacctggtccctcacgcgccgccgatgcctccagctcgcctcctccctctcctccctcggcatccgccgcggcagcgtcgtctccgtcctcgccccgaacgtccccgccatgtacgagctccacttcgccgtccctttcgccggcgcaattctcaacaacatcaacacccgcctcgacgcccgcaccgtctccgtcatcctccgccacgcgaactccaggctggtcttcgtcgactgcgcctcacgcgacctcgtcctcgaagccctatctctcttccctgaaaaccaaaatcaacgcccaaccctaattctcatcacagacgaaaccgtggagaaagagaaagccgcacccgccgttgataatttcctcgacacctacgaggggcttgtaagcaagggtgatccgggattcaagtgggtcctacccaactccgagtgggacccgatggtacttaactacacttctggaacgacgtcgtctcccaaaggcgttgtccactgccaccgtggaacgtttattatttcagtggacactcttattgattgggctgttccgaagaacccggtttatctctggactcttccgatgttccatgctaacgggtggagcttcccgtacgggatcgctgctgtgggcggaactaatatctgtgtccgcaagttcgacgctgagattgtttactctctcataaaacgccatcacgtgactcacatgtgcggcgcgccggtggtgctcaacatgctaaccaactcccctgataataagccgttggagaaaccggttcagatcctcaccgccggagcaccgccgcctgcggcggtgctcttcagaacagaggcgttggggtttgtcgtgagtcatggatatggcttgactgagaccggagggttggtggtgtcgtgcgcgtggaagggggagtggaacaagctgccggcgacggagagggcaaggctgaaggcgcggcagggggtaagaacggcggggatggcggaggtggacgtggtgggtcccaccggggagagcgtgaagcgcgacggggttagcatcggagaagttgtgatgagaggtgggtgtgtgatgttaggttacctgaaagacccttcaggaaccgcgagttgtttcaagaacggttggttctacaccggggatgttggcgtgatgcacgaagatgggtacttggagatcaaagataggtcaaaggatgttataatcagcggcggcgagaatttgagcagcgtcgaggtggagtcggttctgtacggacacccggcggtgaacgaggcggcggtggtggcgcggccgcatgagtattggggagagacgccgtgcgcgttcgtgagcttgaagagagagataaaagagaaagagaaacccactgagaaggagataattgagtattgcagggataacatgccgcattatatggttcccagaacggtgattttcaaagatgagcttcctaagacttctacggggaagatacagaagtttgtgctgagacaaatcgccaaggagatgggttccttcacgcaaagtcgaatctga

SEQ ID NO: 80278 - DNA, 1038 bp, Glycine max
  Peptide Sequence Number=SeqID_197056
atgagtaagatgaatgtatggctacacaagaaaagacaggatacagaatggttgtatattgatatttgtgtggcacctatggaagtaattatagaaaattggttaaggtggttagacatgcaaaaaaggccattgttggcactaatgaggactgaagagagcagtttgtatgattttaaccctggttctgattatggagaggataatcatgtggtttgtgtcatcccaggaggaccagcatgcaagtctaatctcttcaataaactaagttccttgcttagagtgaatgagatggatgtaatatgtgctgctttcagtggacagttagatctgtctattttgaaatcaccatgcgtactagtttcatcatcatgctcgacagatgagacaattgttgcagattcagatattgaagttgaaacagccacatcagtccgctcaaatgatgcattcagcaatgacaataatgtaaaatatgaaaaaacaaaagaattatatgttgattctgaccctttggataagagaaaacatgagagaatagaggcatcctctgatgatgttttgcatgacactaaacgtgcaaaaactgaaacatccttggatggtgcttctgtcagatcacattctaccagcttcaggaatgataatgatgatatcaaagtaaagaaagacaaagttaatgatgatgaaagtggaaattcagatatagtttatagccaatatttaattgttcgagatacaaacattcgtactagcataagtactgcaccaaacagcagtgttccaaattttaaacgcttcagaaaggcacaaactcaatctggtaatagctttgagaatcttgttccatttggaaaatatccatacaaggattctgactgtgggaatgaggacgtgactgagcttgtgaaggaggagaaaaggcgaaagaaaatggaagctatggcagatgacatgtttaataatgaggcaagaaaacgaggcacagctggttcacgaggcactgttggttctcttcgtggcattcttacttcatga

SEQ ID NO: 80279 - DNA, 1656 bp, Glycine max
  Peptide Sequence Number=SeqID_197057
atggaagacctaaccccaaaccctgcaaactcaccacccctcactccactcaccttcttggaaagagcagcaatcgtctacggcgactcccactccatcctctatgaccgcacttccttcacctggtcccaaactcaccgtagatgccttcaactcgcttcctccctcacatcccttggtctagggcgcggccacgtcatctctgttctctccccgaacactacctcaatgtacgaactccattttgctatacccatgtgtggtgccattctcaacaaccttaacctacgtctgaatcctcacacactctccgtgctccttcgacacagcgaatcaaaactcgtcttcgtccattctcactctctctcactaatcctcctcgccctctccaacttccctataaccacaccacgcccttccctcgtccttatcacagacgatgcagatgcaataacacgctctcccgtcatagacacatacgaggaccttataagaaagggtaacccgaactttaagtgggtccagcccaactccgagtgggacccaataaccctaaattacacttccggcacgacgtcgtctcccaaaggagtagtacaatcccaccgcgcaaccttcataatgaccctagattctctcatcgattggtgcgtaccgaaacaaccagtatatttatggacactaccaatgttccactctaacgggtggaccttcccgtgggggatcgccgccgcaggcggcaccaacatctgcgcccgtaaaatcgacgcgccaacgatctaccgtttgatcgaatcacacaatgttacacacatgtgcgccgcgccggtggttctcaacatgctcttaactagaaccgaaccggtgaagaatccggttcacgtcctcaccggtggatcgccgcctccggcggcgatcctcacgcgcgcggaggagttggggtttagggttagccacgggtacggcatgacggagacgctgggagtggtcgtgtcgtgtgcatggaagaaggagtgggataagtttccgtcgacggagcgggcgaggtttaaggcgaggcaaggggtgaggacggtggcgatgacggaggtggacgtggtggatccaaccaccggcattagtgtgaagcgcgatggtgtaacaccgggggagatagtttttcgcggctcgtgcgtgatgttaggttatttgaaggatatagaaggaacaaaaaggtgtattagaaataattggttatacaccggagatgttggagttatgcatggggatgggtatttggagataaaagataggtcaaaggatgtgataataagtggtggtgagaatttgagtagcgtggaggtggagtcggtgttgtacggtcacccagcggtgaacgaggtggcggtggtggcgcggccggacgagttctggggagagacgccgtgcgcgtttgtgatgttgaaggaggggctggtggcgccgccgtcggagaaggagttggtggagttttgcagagagaggttgccgcacttcatggtgcccaagactgtggtgtttaaggaggcgttgccgaagacgtcgacggggaagattcagaaacacgtgctgaggatgaatgcgaaggctatggggtccttggtggctccaccaccggctatacctagtcgcatgtag

SEQ ID NO: 80280 - DNA, 783 bp, Glycine max
  Peptide Sequence Number=SeqID_197058
atggcagaccctcagaaaattcaccctgtgcaccatgatgttgaggcacaaaaccacccttcagcaccattggtgccaaggagcatgtcaaaatctgatgctggtgatccacaaagagtagtagtagtacaacaacaacaacaacagcagcagcaacacattcctgtgaagcacaccaagccaccaacaaagaaaagaagaagctgctgctgcaggttcttctgttggctaattagcatattgctgattctgattgtggcaattggcatcactattggaatactataccttgtcttcagaccaaagcttccaaagtactcagtggatgaacttaaagtcacaaactttgatcttgcagacaacaacagtttatcagtgacattcaacttgacaatcactgccagaaaccccaacaagaagattggaatagactataggggtggcagccacataagtgcttggtacatggacacaaaattatgtgaagggtctttgccaaaattctatcaaggtcaccgcaacacaacgattcttagtatccctcttacggggaaaacgcaggatgctaccggcttgcaaaatacccttcagaatcagctgcaagagactgggaatgtgcctcttaatttgagggtgaagcagcctgtgaggatcaagcttgggaagttgaagctgttcaaaatcaagttcagggttaggtgcaggattgtggtggatagccttagtgctaatagttctattagaattcagagtagtagttgtaaattcaggtttaggctgtga

SEQ ID NO: 80281 - DNA, 633 bp, Glycine max
  Peptide Sequence Number=SeqID_197059
atgaaactggcgcaggctgctcttcaggcacggattccacgatattttccatggcagtttggtgccgattttgatgctattggacgcggcagtcctcaagagatcttcgacgcgcagattgacgtgcgtgatttactacgcagccaggatgaaactgagtgggtcatcatttcgaccggcatcttcatgagctatctgttcgaaccagacttcggtgtggtcgatctgcagaacaatactgttcacgcactgggtagtattgataacaccatgacgctgacaacacctgatgatattggaatgctgacggcagcgatcgtatttaaaactccgcgcatccggaatgaaattgtatatatcgcaggtgatacactgacctacgcagaggtagcagataagctgcaatcagcgcttggccgtcctttcagctgcacagaatggagcgaacaatatctgatggataagcttgcactcaccccgcaggacatgatgtccaagtatcgtgctgtttttgcgcaggggcgtggggtagcatggagtaaggagcaaacattcaatgaacgccataacattcccgtcaccaatgtagacacatggattaatgcaaaccttatccagagcaactcagattag

SEQ ID NO: 80282 - DNA, 790 bp, Glycine max
  Peptide Sequence Number=SeqID_197060
gctttactggactgacattgaaggcagtgagctgctcgctttagaagaaggtacagatatcgtcatgcgatgggcacttcctgaacgtcttggttcatttgcactgactgaaaaagataacgtcctgctgatggctctggcctcccggctggccttttgtaacatcgataccggtgaattcatcccgttagcagactcgccgggagagccgggaacccgtacaggagacgggcgatgcgaccgagccggtaattttgtcttcgggacaatggatgacggttttcccgcgaaagtcatcggtaaatttcacaggcttaacgcggtgacgctcagcattgagacgcttcctctgccagaggtagccatcccgaacagtatctgtttcagcccggacggcggaacgatgtattactgcgactccatgcagaaccgtataatgtgctgcgattatccctctctcgatcatcagcgtgtgttcactgaaacaggaggcgatggtgcgcctgatggctcatgcgtggacgcaatgggctatgtctggaatgctgaatggggaggaaatcgtgtagtacgttatcgtccggatggaacaacagactgcatcctgccatctccgggtattcagagcacctgcccggcactcgctggcgaagcattcacaacgctctattgcaccagtgccagcgtaggtctgtctttaccatcagagcatgatggagcattgttgaaagcggattcagctgtatttgccggtttaccggagagccggttttcagcgcacctgccgtaa

SEQ ID NO: 80283 - DNA, 552 bp, Glycine max
  Peptide Sequence Number=SeqID_197061
atggcattcaacctttggtggagcattatgcttgcatggtgggtgttcttagttgagctggtaagctctcagaagcagcaaaattcgtttctgaaataccaattgaaccaagtgctaaagtttggggtgctctgctacacggggcttctgtttatggtggtgttgaagtgggcaagtttgcttgtgtttgagatggagcctgaaaatactgggaattacatgattatggccaatttatattcacatgccgggaaatggaaacaagctggtgaggtaagggaaatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 80284 - DNA, 702 bp, Glycine max
  Peptide Sequence Number=SeqID_197062
atgcgggttcggaatgaagtggtcgatcagcacgatcacgatcacgcccagcaggaaggccagggtgccgtaggtgaagccggtgcgctcgccataggccagggcgaacgacgcaatggacttgttgaggatctccgacagcgacacatagaccatcgcgccgccggcgaaggccaggccgaaggccagcaggcgcggattgggtcggcgcgagaacagcaccagcaggctgccgatcgcggtggcgaggccggccgcgagggtgaccgccagcgcgatccagatgttttcgggggggatctgcagcatctaccgacgcggtcctggtcaacagacaaccgccccgggcagtgccggggcggcgagggcgaggcgggcgtcggctggcctcgtcggggtgcgcgcgatcagccgccgcggcgcaggcgttcttcgatggcgaagcactggtccggcttcggctgtggcgggttgaagctgaccggtacctggatggtggccggcaccggctggccgttgcgggtggcggcattgaattgccagccctgcacggcggtcttggccagctcgtccagctgcgggttgccggcgcctgtgagcagcgccacttcgctcggcttgccgatcgaattcctgcagcccgggggatccactagttctagagcggccgccaccgcggtggagctccaattcgccctatag

SEQ ID NO: 80285 - DNA, 222 bp, Glycine max
  Peptide Sequence Number=SeqID_197063
atggaagagggtgaaaaggtatatttgattgctcaaggaaagaagaaaggggatcaagccaagaataagggcaagatttctactcattcagttataaagaaagagtcgaagtgtttcttttgtaagaagaaagggcacatgaaaaaagactgctcaaaatttaagagttggctcaacaagaaaggtatggaaaacctaaggaagctagtgggaagtgagtag

SEQ ID NO: 80286 - DNA, 339 bp, Glycine max
  Peptide Sequence Number=SeqID_197064
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagag

SEQ ID NO: 80287 - DNA, 499 bp, Glycine max
  Peptide Sequence Number=SeqID_197065
atgagtatgacacaagaccatgagaagcttgattcagatttaattgcgacttgcgtagtaggcatgatcagagaagatccatcaataaaaatttctttgattcaagaaaggataaatagtgaattttcctataaggtttcatacagaaaagcatggatggcgaaacaaaaggcgattgcaattgaatatgatgattgggaagagtcatatgcaaaactttcgtcatggctaacacacatgcaaaatcattctcctgggtcttattttcaaatactacatgacaattttattgttggtaatagggtgagtcgcgaacatcgccagttttatagagtattttggacatttggtcaatgtaaagaggcttttaagtactgtaagccaatcatacaagttgacgacacacatttatacaggaaataccgtgggaccctgttaatggccacatcacaagatggaaatggtggtgttcttcctctagcattcgccgtggtcgaag

SEQ ID NO: 80288 - DNA, 309 bp, Glycine max
  Peptide Sequence Number=SeqID_197066
atgcgggggtaccgtatggttatccgcaccttttgtcatcccgagacggctagtccgatgacatgcaggggtatcgtatggaagtcaggtggcatgcgagggtaccgtatggttatccgcacctttcgtcaaccaagggaaagcgagcccgctgacgcgcagagactaaagtcatcttctgcaccttttgtcatccagggacaacgagtcaggtggcaggcggagataccttatggtcgtccgcacctttcgtcaaccaaggcgaacgagttcgacggtatcaggatgatgttggtcatccgattctga

SEQ ID NO: 80289 - DNA, 168 bp, Glycine max
  Peptide Sequence Number=SeqID_197067
atgtctctaatgactcatcaggattttcaagtgcaagccattggtcagggacaacccttcccttgtgttcaagaatcctctactacaagagacccacggtctcttaatcccttttcagaaataagaagaagagaagaagaggtctctcgtaaaaaaggtagattgtaa

SEQ ID NO: 80290 - DNA, 277 bp, Glycine max
  Peptide Sequence Number=SeqID_197068
gtgttgtgggtgcttcggatggtccgtggcggcgatgggcaatagcagtggcggtggaggatgatctctttctcttcttcgatggagtgaaaaagtggaagattgggctttacgacacgtgttttggtgaagatttgagtaagatacgaaggtttgaagatttagggatggaggaagcacgaggagaggccttggctgcacaacaacactggagtaataagccttctggtaatcgattacaggatgttgtaatcgattacaggctgcctgctcttgt

SEQ ID NO: 80291 - DNA, 387 bp, Glycine max
  Peptide Sequence Number=SeqID_197069
atggtggaggatgcacgaacagcgcttggcaatcaattcgtggggatccggactcaatggtggaggatgcatgaacgacaatcaattcctggggctccgaataagattagatggtggaggatgcatgaacaacgcttgacaatcaattcgtggcgctccggactcgatgtgctaggcaatcaattcgtggggctccaaactcgatggtggaggatgcgcgaactacgcttgagaatcatttcatggcgctccggactcgatggtggaggatacatgaacgacgatcaattcatggggttccgaataagatttgatgatggaggatgtacgaacagtgctaggcgttctattcatgggactccaaactcgatggtggaggatgcatga

SEQ ID NO: 80292 - DNA, 156 bp, Glycine max
  Peptide Sequence Number=SeqID_197070
atgaacacaatatgtcactggaaattgtatatgcatgttcccaaagccccggccgggctttccatgaaagtcatgaaggacaacataagaacaggagttgataatcaacacataaccagccttctgcatctatcatataagcaacacacaacatga

SEQ ID NO: 80293 - DNA, 507 bp, Glycine max
  Peptide Sequence Number=SeqID_197071
atggaggccatgaaagagaaaatggacacaatgatggaggccatgatgagcatgaagaagataatggaagccaatgcggttacagtttccgctaccagcgctgttgctaaggtgaatccgatgcccccatctggcatcaaccaaatgaatcatccaacctcagctatgaggaaagactcagggccattgaaaggaggcaaagattatgcctttgttaacctagaagagttgttactagtacctaatatcatcacccttcccaagtttaaggtgccagactttgacacgtacaaggggactacttgccccaagaaccatctaaagatgtattatcggaagatgggggcatacgcaaaagatgaggaattgctgatacattccttccaagaaagtcttactggggtagctgttacctggtacactaacttggaaccttcccgagtccattcttggaaggacctagtggttgccttcgttaggcagtgccagtataatgtcttcggatag

SEQ ID NO: 80294 - DNA, 261 bp, Glycine max
  Peptide Sequence Number=SeqID_197072
atggacccggtcaagtacatctttgaaaagcctgctctgacagggcggatcgcccggtggcaagttttgctgtctgagttccatatattctatgtcacccaaaaggcgataaagggaatcgccttggcggattatttggctcagcaatctctcaatgaccatcaacccatgcatcccgagttcccggaagaggacatcatggccttgtttgaggaaaaacctgacgaggactgggacaagtggattgtgtggtttgattga

SEQ ID NO: 80295 - DNA, 291 bp, Glycine max
  Peptide Sequence Number=SeqID_197073
atggtgcctttcattgccccaatgttgggctctgagcataaacttgaaaatcctgatgagtcattagagacatctaacaacagctttcaaaattgccccatgtgtggtgtcgctggctcatacagtgctcaatggaatgccccagggctcctccctgatatgcacatgttgcgttcgagtcgtatcctcgaaaaaatggaggttgaggaaccttggttggggttatggctaccattgaattatcaagtagatatgggagcaagtcagcataggacaccaaaattggggtga

SEQ ID NO: 80296 - DNA, 579 bp, Glycine max
  Peptide Sequence Number=SeqID_197074
catcctttccaagcttcttatccaaggcttatcttggtggtgaatctccttcttccatggcttattcaagatgaggctactacttcaccttcctctagtgaaagtgaagaagcaaaaggggaagaatctagtgaagaaatctacccccaagaagaaggacaacctttaatgacaaatattaaagaagcttcccctcttagacaacctccacatcttctcctttgtaaaaagacacttgttagcactgccacacctcttgggtttgaggttattcctcaagtaaatgagttattggatgaagaccctaagagaataaaggtcattcctgattggcctacttcactaagtataagggaaatctggggctgccatgacttaacaaacttttacaaaaggtttgtcccatatctttctatacttgtagcaccactcattgagttggtgaggaactatgttcccttacgggaagatgtccatgaaaggggtgtcgagggaaggatcccagagtatgaagaacctcaggatttaaggtcaaatcctttccaaggtggaggggatgatgcaatcctacccccaagg

SEQ ID NO: 80297 - DNA, 1038 bp, Glycine max
  Peptide Sequence Number=SeqID_197075
atggggctgcgggtgccgcaggatctgtcgatcgtcggctttgacgacctcaagctggcgcagtattgcgatccgccgctgaccacggtggcgcagccgcgcttccagatcggccagcaggcgatgttgttgctgttggagcagttgaacggccagacagtggccagcggctcccggctgttggacagacacagcggaataatagtggcacaaaaagactatgtaagccgtgggcgcgcagcaggagctaagcgtaaaacccccagccgtaaaaaacgcagttctccgaaggtttccaaaaccgtgctggcattagccgccgcgttgctggttgtctttgtcggtggcctctatttcattacgcacaacaagccggaagacgcgccgttgttgcctgcgcacaccacgcgccccggcaacggcctgccgccgaagccggaagagcgctggcgctacatcaaagagctggaaaaccggcagatcggcgtgcaaaccccgaccgaaccgacggccggcggcgagctcaattccaaaactcagctgaccgccgaacagcggcaactgctggaacagatgcaggccgacatgcagcagcgcccgacgcagttgaacgaagtgccgtataacgatccgggccaggccaacgcgcgcagcactcgccagcagcagcagatgcaacaacagcaaatgcagcagcagccggtgcagcaacagcagcaggtcagccagccgccgcgcaacccgttcaacaacggggccaccaccgcgccggtgcagcagcacccgcagccaaaaccgactacccagcaaccggtacaggtgaaacagcctgagccgaagccgcaaccgaaaccggagcccaaaccggaagtgaaacaggaaacggccaagcaggaaaccaaaccggaatcaaaacagaagtggatggtgcaatgcggttcgttccgcgccaccgatcaggctgaatccgtgcgtgcgcgcctggcgttcgaaggcatcgagagccgcatcaccgccggcggcggttggaatcgcgtg

SEQ ID NO: 80298 - DNA, 303 bp, Glycine max
  Peptide Sequence Number=SeqID_197076
atggagtcaccaactatcgcaatctacccttcggcgggagggcgatgcgagactaacgggtgcgtcttccatgggaggaaaatgcgcggagttaccaccaacgtttattccaggaaaacgtcggaaaaaactggaaaggtgtggtctacgatctataatcatgaaagagaaacgttaaggcattggaccattaacgatctcttggggtggttgacaaaagcggtaaagttacatattgattttatgttctttgaacggtccatgttaactgaaaaaagcaaagatgaccatttaaggcgttga

SEQ ID NO: 80299 - DNA, 480 bp, Glycine max
  Peptide Sequence Number=SeqID_197077
atggataggaagcctgctgtgactgccattcctacatggccaaatttcccaccagctcaacaatatcaatactcagccaatattagcccttctcattacccaccaccctatcaaccaagaacacttaatcatccacaaaggccacccctaaattatccaataccaaacaccacccttaacacagaccaaaacaccaaccaaggaaggaagtttccagcaaagaagcctatagaattcaccccaattctggtttcatatgctaacttactcctatatctactcaataatataatggtagccctaacccttgtcaaggttcctcaacctccattttttcaaagatacaactcgaacacaacatgtgcttaccatggaggagtttcggggaattccattgagcattgcatgaccctgaaacataaggtgcaaaatctgattgatgcaggttggctaaaatttgaggaggataatcgcttgtga

SEQ ID NO: 80300 - DNA, 339 bp, Glycine max
  Peptide Sequence Number=SeqID_197078
atgtgcaaaatgttcaaaagaggggcaaaatggtcactttggggacattttccagcccctaggcctactagaaagcttagggatgaagcaatcacctcacttgggcgagctgggttgcttctggaggaagaaagaagaagaaaaaagaagaaaaatcaaggtcgaggtgtgtcataccctaatttcgtccggggacctttgctcgatgacgtgcgaccattctttggtcctcgtgagaaggcggttgcttctggaggaagcaaccctgctcgcctgggcgagctgagctcgcctgggcgagctgggcggcaaccacctcccctattttgctataaatag

SEQ ID NO: 80301 - DNA, 294 bp, Glycine max
  Peptide Sequence Number=SeqID_197079
atgtcacaaaaccctatggattacacgacaattagtgttaagcagctcaattcggccgacaagaatccaaatgttggcaaagatcatccccggacgaaattagggtattacaaggagcgtcctaagggggttttaaggggttccaaggttcaggaggtgagtgaattgagagaagagagaaagaagaagaacaagaaagaagaggaaacaaagtcgaggtgctaccgaatcgtgactgcgatcattccctacatcgttttgttgttctgtgttcttcgtgcgaccgtcagttag

SEQ ID NO: 80302 - DNA, 129 bp, Glycine max
  Peptide Sequence Number=SeqID_197080
atgtgtttcagtgaagaaaatccaagccgaggtgctgtcgtaacgcttccaagacatttccgtgagcaaatccatgaagattttccgtcgttcttcaccgttattcgttcgttctgtggtcttcaatcg

SEQ ID NO: 80303 - DNA, 676 bp, Glycine max
  Peptide Sequence Number=SeqID_197081
tcctctgaaggtgagcgtgtgtagccctctgaaggcgagggtgtgtaggccatttaaggtgagggcgtgttgccctctgaaggccaagaccgttagtcctctaaaggtgagggcatgtagccctctaaaggcaaggctgtgtagtcctctgaaggtgagggcgtgttgccctcaggaggtgaggacgtgtagtcctctgaaggtgacggtgtgtagccctctgaaagcgagaatgtgtagtcctctgaaggtgagcatgtgtaatcctctgaaggggagggcgtgtagccccatgaaagcgagggcgcgtagtcctctgaaggcgaggacatgtagtcctctgaaggtgagggcatctagccctgtgcaggcgagggcgtgtagccttctaaaggtgagcacatgtagtcatctgaaggtgaggacgtgtagccctatgaaggcggggacgtgtagtcctctgaaggtgtgggcgtgtagtcctctaaaggggagggcatgtagccccacgaaagcgagggagtggagtcctcgaaaagcgattacattaggtactctgaaggtgagggcatctatccctgtgaaggcgaggatgtgtagccttctgaatgtgaggacatgtaccccctctgaaggcggggatccctctgaaggcgtgggcgtgtacgcttttaag

SEQ ID NO: 80304 - DNA, 462 bp, Glycine max
  Peptide Sequence Number=SeqID_197082
atggcgcctactaggcaccatctggacccaaataagtccaacagggccctggggtgtccgacgctaatcatgggcctctgccagtcctacggagttcccatcacccctagtaaggtaatccggccgccgatcacccgagccttcatcgagaagtgctgcacgcctaggcaggcgcagggtgatgcacatcaggccgtaggcgcaccgccacctcctcggcaagccgatccagctgggccactgggcatggagcagccaaccaccgtgggtaggtgcagatacatgagtgtctctaccggttcagcctcaatcagtaggggcagggtcgcatggcctggagactggcctgatgcccaggcaggggaggagcctgcaggatcccccggtgagacagatgaatcccgtatggatgaagatatgactgacctgctcggtttcttgggagggatcggagccgcgtga

SEQ ID NO: 80305 - DNA, 874 bp, Glycine max
  Peptide Sequence Number=SeqID_197083
atggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgaccagatggtcagaacttcatctgagttcgaatcctactggagag

SEQ ID NO: 80306 - DNA, 291 bp, Glycine max
  Peptide Sequence Number=SeqID_197084
atggctttgtgttcagtttttctcaatcttcatcttctgctttttgtttgtttgaccatagaagcattaggtgtggcaaagccttcagtagctagttaccttagccaggagatactagcagagcaaaaagctgatagagtgcatagattacctgcgcagcctccggtcaagttccacaatatggtggttatatcactgtctatgaaactcaaggaagagcactgctctattggtttttcgaggccactcacaaaccagaacaaaaacccgttctcttatggctcaatggag

SEQ ID NO: 80307 - DNA, 160 bp, Glycine max
  Peptide Sequence Number=SeqID_197085
gccagacaactaccttaaggggataattaacagtgctttaaaagttcttgataaaaaatcacagcctcaatcaaaggctcctgctaggtggattgtcgtcaagtattttaacgaccctagaacattggagccagagagattaaaggcgttgcagatctag

SEQ ID NO: 80308 - DNA, 480 bp, Glycine max
  Peptide Sequence Number=SeqID_197086
atggaggattcaatcgggaaaataacaaatatcacatttcccagtcaagagggtccgctcttgactgtgaagaacacattggagaatgtaggattcaatcgggaaaataacaaagatcacatttcccagtcaagagggtccgctcttgacggtgaagaacacattggagaatggaggaatccaatcgggaaaataataaagatcacatttcccagtcaagacggtccgctcttgacggtgaagaacacattggagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaaggctgcaccggtgcgtcagcagaatatgtga

SEQ ID NO: 80309 - DNA, 1728 bp, Glycine max
  Peptide Sequence Number=SeqID_197087
atgtctaacatccacactgcaaccaacagcatgaaaaagttatcaagttatttgcattccctatcccaaacccctcacaggctcagaaagagaatgctagccacttggaccccagaccaggaattcaaccaagtgaggcacagatctggtgctgacatgaagaggaagctcaagtggcatgatcttgtggctcttggtgttggaggaatgcttggtgttggagtctttgtcactactggctctgttgcccttcaccactctggtccctcagtcttcatttcctacatcatagcaggaatttcagcccttctttcctctttgtgttacactgaatttgctgttcaagttccagttgcaggaggagctttcagttatttaagattaacctttggggaattcttgggatattttgctggggcaaatatactaatggagtatgtgttctcaaacgctgccgtggcaaggagctttacagaatatttgagcattgcatttggagaaaatgatccaaatgtgtggagggtggaagtccctggcttgccaaaggattatagcatgttggattttccagctgtggctctcattcttattctcactctcttcttgtgtcatagtacaaaggaaagctccatgttaaacctcattatgacagccttccatgttattttcttcggattcatcataatcgctggttattgcaatggaagtgccaaaaacttggtttctccaaaaggactagctccttttggtgctagaggtgttcttgatggagcagcaatagtctacttcagttatataggctatgactcagcttcaaccatggctgaggaggttaaagacccttttaagagcctacccattggaatcgtgggttcagttctcataaccactttgctttattgcctaatggctctgtctttgtgcatgatggttccttacaacaagatatcagagaaagcatcattttcaatagcttttctgaaaattggttggaattgggcaagcaaccttgttggggcaggtgcaagtttgggaatagtggcttctctcttggttgccatgttaggccaagcaagatacctttgtgttataggaagggcacgacttgtgccatcatggttagccaaagtgcatccttcaacaggcacaccaatgaatgccacggtctttttggggctttgcacagcaacaattgcgctgttcaccgagcttgacattataattgagttgatcagcatcggcacactgttggtgttctacatggtagccaacgctcttatatatcgtcgatatgtaatcactagccatgccccacctacgcacactctcgtcttcctctttctcctttccctaagtgcactatgcttctcccttgcgtggaaattcaagcagcaatggtggggtctcgtactttttggtgggtttatgatcgccatcaccgccttctttcaacacgtggtatctactactactactactactacgactaattggtctgtgccattcatgccatggccacccgccatgtccatcttccttaacgttttcctcatgacaaccctcaagatcctctctttccaacgatttgccatatgggcatgtctcattactatcttctatgtgctctatggcgtccacaacacttatgaggctgaggagattgagaatgaagtggattcaagtgtaaacaacttgcaaaccaaggtagaaatcattcaagtgcactaa

SEQ ID NO: 80310 - DNA, 840 bp, Glycine max
  Peptide Sequence Number=SeqID_197088
agggctacacgccctcaccttcaacagactacacatcctccccttcagaggactatacgtcgtctccttcagaaagccgcatgccctcgccttcagaggactacacgtcctctttttcagaggactacatgtcctcggcttgagagggctacacgccctcgccttcagaggactacacatcctcgccttcagaggattacacgtcctctccttcagagggctacacgtcctcaccttcagaggactactcctcctccctttcagaggactacacgtcctctccttcagagggctacatgtcctcaccttcagaagactacacctcctcacctcagagggctacatgccctcaccttcagaggtctacatgtccatacctttagtggtctacacgtcctccccttcagtggactacacgtcctccttttcagaggactacacgtcctcgccttcagaggactacatgccctcaccttcagagggctacacgtcctcgccttcaaaggactacacatcctcccctttagaagactacacgtcgtcgccttcagaaagccgcaagccctcgccttcagagggctacatgtcctcggcttgagagggctacacgccctcgccttcagaggactacacgtcctccctttcagaggactacacgtcctccctttcagaggactagacgtcctatccttcagagggctacacgtcctcacctttagaggactacacctcgtccctttcagaggactacaggtcctctccttcagagggctacacgtcctcaccttcagaggactacaccccctcacctcagagggctacatgccctcaccttcagag

SEQ ID NO: 80311 - DNA, 393 bp, Glycine max
  Peptide Sequence Number=SeqID_197089
atgaagtccaaaggtgtgcttagcgcaagacttgccaatctattaacaaaggctcatccttttacacaccaatcccatacacgaccacaaatgattataatgtccctcattttgaacccatcgaattcgatacccatattagttcatacacagaactgcttggtggatcgtcaaagtactatgagaagactccccgactataggcattttttggaccaacaacaacaatctgactcgcacaatgacgagttgtatgttggtcagcgattctgtcaattggaggacttgaaacacacggtaaaaatgtggcatattaagaaccatgtaactttcaaagccaagaggtgtgtgaaggatacatgggtcttatgttgcccagttgaagggtgctaa

SEQ ID NO: 80312 - DNA, 278 bp, Glycine max
  Peptide Sequence Number=SeqID_197090
ggatcatgcccgcaagatactctatggacccgaagaagtccaacagggtcttggagttgccagctctgattatgggcctctgtcggttctacggggtgcctattgcccccagcaaggtcatcaggccccctactaatcgagctttcatcaagaagtactgcgcccccaggcaggtgcaaggcgaaacaccccagcagcctggggacggccggcagtgggcaacagacgcaccgccaccccctctagagttcacctcagctcatccacaaaaaggttag

SEQ ID NO: 80313 - DNA, 799 bp, Glycine max
  Peptide Sequence Number=SeqID_197091
atgacttattcagcgccactgattcacactattcaacaagaggttgaaccaattttccaagctgaaaatgttgtagccttcgacaagatggaagaactccaagaaagatttgatggtatgcaaagggaagtcgaagccctccgaggaagagatctgttcgggaaggacgcctgtgaattatgcttggtcccaaatgttactatccctcacaagttcaaggtgccagacttcaagaagtataaagggaactcttgtccccgcagtcacttggtgatgtacgcgcggaaaatgtccatgtatactgacaatcataagctgcttattcatttctttcaggacagcctaactggggccgctctgaagtggtatatgaatttggacagtgcgagcattcgtactttcaatgacctgggtgaagcgttcatccggcagtataagtacaatttggacatggccccagatcgtgatcagctccgtgcgatgacacaaaaagagaaggaaacgttcaaggagtatgcccaacgttggagggaagtggctgcccagattgtcccgccgttggaagaaagggaaatgaccaaaatatttttgaagaccctgagccagttttattacgagaaaatggttgcaagtgcaccaacagacttcaccgaaatggtcaacatgggggtgcgattagaggaaggtgtccgagagggacgtttgactgaggaaagtgtccctgctgcaagcaatgccaagaagtttggaggccactttgcgaagaagaaagatcaagaggtggggatggtagctcatg

SEQ ID NO: 80314 - DNA, 1059 bp, Glycine max
  Peptide Sequence Number=SeqID_197092
atgccttacaagcaaaatgctttgaacgtgtgggagttttcccaaattcacattgacacttgcatgttggaaggagtggagatagctccgaagaagctctccataaagaggtgcaggagggatgcccttggagaaggcttcagcgcccccgtagagtttgacaatcaccggttccggagtgtcgagcaccagcagtgtttcgaggccatcaagggatggtcgttccacagggagaggcgcgtccaactcatagaggatgagtacccgaacttccaagaggagatagctcgcaggcattgggaacctctagtgactcccatggccaagttcgaccctgagatagtcctagagttctacgccaatgcctggcccatggaggagggagaccagcagtgcgagttcagccagaagagttaccaggcctctggctttgatgaggagaccatcgcccagctgttgtgcataccagggcaggactttgcccggaccgctgtggggaggcgggtgtggatcatgcgcaccagcatgactactctgatccagatatggatgacgctgctactcagcaacattctgcccaacgaccataactctgacctccctctgcctaagtgccaactggtgtatgccatcctgacacagatgaccgttcatgtggcccagataattgctgacgccatttatttgtttgcagggacggcgcccactaggcaccctttggacccgaagaagtctaatagggccctggggtttccggccttgatcacgggcctctgccagttttacatagtacctgtcacccccagcaaggtaatccgaccaccaattacccgagctttcatcgagaaatattgcacccctaggcaggcacaggggggcgcacaacaggcggccaaccaccgtgggcagcccactgaggagggagccggaccggcaggatccccaggcgatgcggaggaagcccatatggatgaggatatgaccgacctgctcggttacctgggagggagcgagtcacacgaccaaggttgccgcacttgtaattccattgtgctctaa

SEQ ID NO: 80315 - DNA, 390 bp, Glycine max
  Peptide Sequence Number=SeqID_197093
atgagtcggcaatgcggcagtaaaaagagccggtttgatttgtttgactttccgcaagacccactcgccaaggacgcccaaagaggcttagggtcatatctacagtatgggcagcaacctggtggcatgatcctatgcgtctcttttctgctcatccctgaccctgcagcggatacaacacgcacagtctccggaattcgactctgctgctatgcaaataagctggcaaacaatagggatcaacatgggccactggtgtctagaatcgtgtctagaatctctgcgtgtcaggactcagctgtgcctcctctgatcgacaaggttcatggagcttatccacccgcacggtttgaacgtgccaagggttatctgactgttcaaacttcatag

SEQ ID NO: 80316 - DNA, 735 bp, Glycine max
  Peptide Sequence Number=SeqID_197094
atggctcattttgacatcaaagaacatgaagacttctactataacgaacagggatataaagtctttacagaaaagtttcatctgaagcgaggatattgttctgcggctactttaggtttaacctcctgcagcccttttcaggttcgttctgactatgccgaaactgctaatttcacttcttataaaacatacaaaataagaattgatgatttgaaacttaatgatattgataaagacagggttttgaatgaattatcaaaacagctgcagagcaaaggtctttcatcgggagaaaatccggatcttattgttaatgtaaaagctaatcataaaaaagtaacggatatcaacagttattcaccatacggaatgtggggatggggaggaccttttggatggggtatcggaatgaacagaacatggaccagtaactataatgaaggagcattaattgtagacctggtagatacgaaaagcaataagctggtttggcaaggtattgctaaagctcaggctcctgcaggatactattcttctgccaatggattaacaggggctgctttgaaaacagaactcagttccattattacgaatggtcaccaggacaaaggttatggaggactttggaccggatataaaactaccgatattgataaaacttatgaaaacgacggatctatcatggatatttattccgagaagcccaatggtgcggatccgtacaactatactccg

SEQ ID NO: 80317 - DNA, 207 bp, Glycine max
  Peptide Sequence Number=SeqID_197095
atgtgttggctgaagaaacaaaagggcagcttagcccctgaacagatagacgcagaaggagaaacagttagttggacttctggtctcatctttggaaaaggagagggaattgttgggcaggaaactgaatttggaactcttcgtgtaaaagtgactgaagcccttaaagaaaaaagtactaccattggatcaatgttgatggtgtga

SEQ ID NO: 80318 - DNA, 222 bp, Glycine max
  Peptide Sequence Number=SeqID_197096
atgactggtgacagtctaaagaggatgctgcatgtggctgcatttgcagtttcggggatgagaagtagccttgaaggagctggagagtcagggaagtccacaatatttaagcagataaaacttttgtttcaaatcggctttgacaaggcagaactaaaaagctacttaccagtcattcatgcaaacaatggcggatccaagaccctaagtcagtgggtgtaa

SEQ ID NO: 80319 - DNA, 500 bp, Glycine max
  Peptide Sequence Number=SeqID_197097
atgtcggccatcaatgaccaatacaaagagaagctagatctagatttaacccatgaacaaaggctagaggatgagtatgcaaaggtattagtcctacaagcagaaagggaagcaagggagagggttatagattcattacacagagaagcaatgatgtggatggataggttcgctttcaccttgaatggaagtcaagagcttcctagactgctagccaaagccaaggcaatggtggatgtgtactcggcccctgaggaagtgcaagaacaaatgaaggtcgatatggaggccttgaaagatcaaatgacctccatgatggaggccatgataagcatgaagcgaatgatggaaagcaatgcggccgcagtagccgccaccagcgtcgccgttgaggtggattcaacctatccctccaccataaaccaagcaaaccaacccatctcggacatggtgggacaaggaggagaggtgttgggtagcatcagtggtccacacatggg

SEQ ID NO: 80320 - DNA, 267 bp, Glycine max
  Peptide Sequence Number=SeqID_197098
atgacggaatggcattatggaatttcgaaaaaacgcctccaaatagcggtggcgttgcgggttgcgtatcgcgacaccatggcggtcatgcgcaacacacaactgcgagcacacacagaacagaacaaagcacgaatagaaaagtctcccgcacgaccagcagcacaacaacaactaacggcagcgacagcgaaggcaatgcacatgacacccgcacctgcacgcaaccagcagcataacgacgatgaacagcaacgaagcacatga

SEQ ID NO: 80321 - DNA, 248 bp, Glycine max
  Peptide Sequence Number=SeqID_197099
atgagcctgccagctccgccttggccctatgccttttggccagctcgtctggacttggctttgaccggtctgcccccctcttgcaaggattcggcgcctccacttgatgctttacgcccacgcttcgttcaggcagcgctactcggatatgtcttgccaatcgccaaagcagtgctacttccaggatttttttcggccaagctcgggaaccttccctttagtgaaaggctctatcccgggacgaagag

SEQ ID NO: 80322 - DNA, 531 bp, Glycine max
  Peptide Sequence Number=SeqID_197100
atgggatccaacccggtgcctttggttaaaaagaggttctatcaagtcaagatcaagaacctaggagtcactagtctgaaagagttaggacagttgatgggtcaactccagcggcaagccttccgcaaggcctatgttaacgcccacggtcgagagtttgaagagatcccgggatgcccgctgggaggaaggaagccatatcttttctcagggttctatccctctttggctagaatttcaaaaatagtcaaaatctcggcacaagaattagatcaggggaagcaagtcaaaaatggagtggttggcgtgccaaggaaatgtttggaagcaaaggcaagagccttggcaagtcaagacgaatgggctccgttcattgatgtcttggcactcttgatcttcagagtggtcctctttccaaacgtggatgggttggttgacctggcaacaattgacgcttttctcgcctttcatgactgcaaggaaagcccggttgtcgctatcttagccaacctatatgacacattcgattga

SEQ ID NO: 80323 - DNA, 273 bp, Glycine max
  Peptide Sequence Number=SeqID_197101
atgttggccattattagcaagtacaaagaagaatcagatttgaccaccgcccatgagcacaaggtggtggatgaatacgcccagatcgagaagaacgggagtcaagatcttccccgattactggcaaaggccaaagcaatggcgaacgcgtactccgcccccgaggaaatccatgggctccttagctattgtcagcatatgatagacttgatgacccataaaattaggaaccgtcagggagtttgtgttgtcactcagatcttgactagttaa

SEQ ID NO: 80324 - DNA, 360 bp, Glycine max
  Peptide Sequence Number=SeqID_197102
atggggatgaggggttgcattaattataatcccatcctcgccaaaagacaacttggaaaccccatgaggggggcaccgccagaggaaggcctcacaccttttattgcacgaggtttcaatagccccaatgttgggatccttcaaggagtctgcaaggcatgtgaaatggtgcaaaggaaggacaaagaacttaggggaagtagcaacggggccgtcggcagctaccgtaggtggttgaaagtctacgcacaaggtctggattggctcccgaggttgagagtcgttaaggaggaggaggttgaagcatcggaggaaagcgaacagatgcaagccctcaaaatggagcttgagaaagcctaa

SEQ ID NO: 80325 - DNA, 189 bp, Glycine max
  Peptide Sequence Number=SeqID_197103
atggatgatttacagggtacactagggtatagtgtgcatagagggcatcaagagtgttgtttgcctagaaaaaccatacgctatgcttatgagcagaggagtcacccatacaaccaacaactttcaggtaccgacgtcagaggaaaccatgatgatctcatgcctgcggagatagaggagtacaaatag

SEQ ID NO: 80326 - DNA, 2157 bp, Glycine max
  Peptide Sequence Number=SeqID_197104
atgattgtggagcaaagttcgtgtgatttcgttgctgctgctgctgctgaagatatggagagtttgtacttgaagaggcaagaaaaaaggaatgtccacgtcgacgagggcagaagcaaaaggagtccatttttggacaaacctctgatgcttccaccttcctatgattcaatccgtgtcataggggcctttgaacactttaaagttggtcgatttcatgaaattgatcactccacgctctcacccatttccccagtacaactaaaatctgttcgcattgtgatggtcagtgacataggggagcacctggtgtcgctaaggtacccaagcctccattcccttcgcaagcacttcagcgaccaaagctttgggaaaccagacgggaagaagatcccaactctggacgagaagtacgtgatggggatggacatggccatcaaagcccttgttaggagcatcccaaccgaggagtttgcacaaaggagaaactcttggagcttctgggtctcctctccctctaacgaaaaccctcaagagtatgagaatccagctctcattgatgctgcaaggagcctcatttgcaagcagggttcttgctggtctcagctcaagttcacagggatggtgcagtggggtgcacgccgccaagttcggttcttggggcgtcacgaggagcaaaaggttgaatctttaccaaaaatgagtaaagaaaaaagggtcggtgttgaagtcggagaaggagggggttgtgagaagaagaggaagaacggtgaagaagaggaggaaatggagggtacaaaggcagggtctttgggagttatgatgagggtgactcgtcaatgttggaaaaatcatattcaaaatgtgagtagtagcagcagcggggttaaaaaatctaacaaagcaaagaatgacgaccccattaagaagcaagtcgtggtttacaacgacaacaagcgaaaaatcacgatcaacagatggtctgctgagaggtataatttggctgaggagaacatgttgaaggtaatgaaagagaaggaagctgtatatgggaacccaatattgaggccagacttgagaacagaagcaagaaaatatattggcgacacgggtctgcttgatcatttgctgaagcacatggctggaaaattggcaccaggaggtgctgagagattcagaaggcgacacaatgctgagggtgcaatggagtattggttggaaagtgctgatcttgttgatatcagaaaggaagcaggggtacaagacgcttattggactcctccccctggatggaagcttggggaccgcatttcacatgattatgttactcagagagaactcagagaggtcatggatgaaatcctgaagctgaaacaagagatgcgagatttggcatcaaagaagggagaggaggaggcattggtccttgttactactcctagcttctgtttgtctagtttgaattcggatgactgtggttccttggctccaacgcaggagatttatgcagagttggtgagtaagaaggctaaactagaggaacaattgaaggaaatttcactgactttgagtggcatggaggagcaactgaaaatgctgaaaccaacaacagtagaagaacaaacagtgccagaattggcaactccaccagcacttttacctggaccaacatcagtggtagaaaacattgggggagagacaagaaaggaaaagaaaagccgcaacaagaacaaagcaacaaaatcagcagatgatacacaaatgcaagaaagtaacactactgcagcagaggacaaagcagcaaagataaaaaggctgaaaagtggtttccaaatttgcaacccacagggtacctttgcgtggccaaacatgggcttgtctccccaagttgtggtcagcaatgatggtaatgatgatcacactgtggtcccaacaacaccatcagtttcctcttcctccacctcagctccaaaactcagcatctccataccccaaactcaacctttgccactgcaaatcctgcaccttccttcttcccctgtgaagccacttgctgagaggcgccctgtgagcacagctactttgacccatgttactggcccattctcaccatcagggtcgaccccaagatccaaaatcacccaccatcactattaa

SEQ ID NO: 80327 - DNA, 315 bp, Glycine max
  Peptide Sequence Number=SeqID_197105
atgcaagccaacgaaaagaaaagaaagaatttgttaacaataaacaacagaacaaagcacgtgctagaagaacataaacatgcacagaccaaaaccaccaaacaacaaaaaactgactcgaaccttcaaccacaaaagaacggaaatcacgaactggaaaccacagcctcacgccaaaatgctaaacaacaaaacaggtatattgaagacggaagccaactaaaaacaaatgaaaaaagtgaaaccgaacaggacatcaaaatcaagaagaaacaatgcaaacccagcataaatcagcagcttggaacttgctag

SEQ ID NO: 80328 - DNA, 267 bp, Glycine max
  Peptide Sequence Number=SeqID_197106
atgaagacaacctttgttgattgtgcttcatatacaatgttatgcactttaagaatcacagtttattgtgtagttactatttttcttggcaattgcacgtcactagctatattcctgtttttatacgctggagttttacttttcagctatattcatgtttatcttctcttaaaacatttgattacatcaacgagttggtaccagcaacaccaagatgcaaccgcagatgataaggggtgtgactatgaagatgcgcagtatgtttga

SEQ ID NO: 80329 - DNA, 522 bp, Glycine max
  Peptide Sequence Number=SeqID_197107
atgataataaacacttggttgaaggttgccgtcccttgtgacggacgcgtgagactccgcgcgccttcctttcttggaagacgcactcgtgagccctgcgtcgccctcccaccgaagggttgtacatcgaagacaatccttcccgcttggtttcccctaggaagaatttatgagggatccacagcggttcacaacatccctttgttgcatggccaagttaaggtaggtgttgtggaggttaaagatgcagaggctctcgttcctgtacccactgacgagatagttgtgtctccaggaaaacctccagataggtcagatcatgaggtcgatgatcccctatatctgatgacattgaccatctcacaacttttcttgaagcctctccaggttatgtgggatgctactgtgttcagggtgcttaatcaagacttcccattgtacatcaagcacaaacatctctctgaaattgcacacggtagtcaatgtctcagcatatctgttatacagttgtggattctgtaa

SEQ ID NO: 80330 - DNA, 339 bp, Glycine max
  Peptide Sequence Number=SeqID_197108
atggagtcgtggcttgagagcaaaggtttcggaagatgcaaaccagcaaccttagagactataattgcacgcttatgtatgtttaaaagccaggttcttgacaaggaggtgtttcaaaagcagatgttggagaaacttatatggatttgttccgttatgcttgttggagcacctcatggaggggtttcagtaggtgtcatggacaaggaattccgcagtgaaagaagtgggtttggtgatacaaaactgagagcaccccatcctatttatagagtctgtccatcacagagctctctcaacttgttatcagaacgtgagataggaagttatcagacgtga

SEQ ID NO: 80331 - DNA, 462 bp, Glycine max
  Peptide Sequence Number=SeqID_197109
atgacgtccgggggtaccttatggttatctgcaccttttgtcatccagggaagagacgatgagtccgatgacatgccggggtaccttatggttatccgcaccttttgtcaaccaaatccaagcgagcttattgacatgcagagactaacatcgtcatctgcaccttttgtcaacctgggagacggcaagtccgatgacatgcggggataccttatggttatccgcaccttttgtcaaccagagaaaagtgagccagttgacatgcagagactaacatcgtcatctgcaccttttgtcaaccagggagacggcgagtcgaatgacatgcgggggtaccttatggttatccgtaccttttgtataccagaggcaagcgaacccgttgacatgcagagactaacgtcgtcatctgcaccttttgtcaaccaggggcaagtgagcccgttgacacacagagactaa

SEQ ID NO: 80332 - DNA, 542 bp, Glycine max
  Peptide Sequence Number=SeqID_197110
atggcagaatcatccaagaagcacaagggttcatcctcctccgctgcggcacatcgaacatcacgtttcggagccaccgaagcatcctcggctccaattccaccatccttgtcatcctctacactgttttcatctgataaacagcatattcggtattcctctctctttcaatctcgtcaaattcttgatcccaaatatcttgaccttgaattttttgatggggaaacatttgattgctatcaagtgtttcaaaacactggtctgattctttttatgtcattaaaattaccatattatcatgagttagtacgattcttttactcaaacttgaaaattcaggatggaactttaatttctgaggtgcatggtatccctatgattattgatgagtctcttttcttttctctgacacaactacctagtcagggtgcaccttttgatggtacccttgttgatgactggaagtttgattactctagtcatgatgctcgccgcatggtctgcattgaccaggcggatatgactggcagactgcttgccgg

SEQ ID NO: 80333 - DNA, 198 bp, Glycine max
  Peptide Sequence Number=SeqID_197111
atggttgccaaaaatcaattctatcaaatttcattggcattgcttttctgttcgggattcttggcttttcaagtcacatgtcgcactcttcaagatgcatccatgtatgagaggcacgaagaatggatgggtcgttatgccaaagtgtataaggaccctcaggaaagggaaaggcgtttcaagatatttaaggaaaat

SEQ ID NO: 80334 - DNA, 225 bp, Glycine max
  Peptide Sequence Number=SeqID_197112
atgcttgcggcacatgttcagcttagcgggcgctttcccgctaagccaattctacagaatctaaaaattctgcaacttccgctaagcggctccacatatggtgatgcaatcctccctaggaagggaccagtcactagagccatgagcaagaggctccaagagaattgggctagagctgctgaagaaggccctaggattctcatgaacctcaggatagatttctga

SEQ ID NO: 80335 - DNA, 1636 bp, Glycine max
  Peptide Sequence Number=SeqID_197113
gtattctgctggttgcctgcattacgctgctgttccgcgctcagccgcagccggtggcaacgcgggaagcattgccggcgctcagcgggcgcgaatggcggctgattgccctactggccgtcactctactgttgtggatgaccgacagtctgcacggcttatccgctgcgtgggtcgggctggccgcggcgtcggcgtcaatttccgcacctgcatctatatcgccggcattctcggcgtcgccacggtggtggtggactctggcctggggcggctcatcgccaatgcactgcttcacctgctgccgctgcatgactcgccgtcattcagagctggctgccgcttcgggctttccgctactgagcgtggtgatgttgcaggtttttgcctacgccaccccgctgctgccatatcaggcgtcgcccatcgtggtggcaatggggctggggaatgtgcctgccagagccggtttgcagctgtgcctgctggtgtttgtgctgagcgcgctgctgctgttaccgctggattatctgtggttccggctgctaggctatgcctgatacgccgtcagaggtcacgaattcgctatgagacgggcatcgaaagtgttaacgcgcacttctgcggccacgcttacgatccgcatgaccacgacgaactgctggtcggcgtgacgcagcaggggctgcagcgctttaactgtcaccgcgcgctgcacaccagcacgccgggccgcgctattctgattgagccgggcgcggtacacgatggtcacgcgcccgatgccgccggttttacctatgtgatgctttatctgccgcaaccctgggtggcggagatgatgcagcgccgcgggctgggcgatgtggcgaatattcagggcgcatttcgctccacgctcaccgatgatgcgcagctggcctccgcgattcagcaggcatggtttgcggtgcatcagcgggaagggcggctggcgcgcgatcagagcctggatcatctgctcacgctgctgtcccggcatctggaaaataaacccggcgtgcagctcagtgacgcccagcggcagatgcatctgctgcgtgattatctgcacgattttatggcgcaggatatcgggctggacgatctgtcgcgcctgtccggcatcgatcgtttccgcctgacgcgccagttcaagcaggcgtttggccagtcgccgcacgcttatctggttcggctgcggctgcgtagcgcgcgtgcgctgctggcacagggcgttgagccagtgcaggtcgcagcgcagcgcctgaatgtggtggcttttctggcgaccggcattgcggcagccgcgccggagatgatgggtgaaccctatgtcgacgcgcacggtcgtcagtacggcaacatggccggccagccgatgctggtgtttgccgccgatttagccggcctgcaacgggcgcatcgccagggcgtagagcgtgagttaacgctaattccttacgtcgaagcgatgttttccaccggccacgatgccgccaaccgcgcggtgtttctggccgaagacgccgataatctcaacctggtggggatcgcgctgcgcggcccgaaaaaggcggtggataaagccattaaagggctggcgctgcacggttga

SEQ ID NO: 80336 - DNA, 904 bp, Glycine max
  Peptide Sequence Number=SeqID_197114
tgaactggcggcaggcatcaccggcgcgtcgtcgctgagcggcttcacccataatgcctggcagcaaggccgttctccgggaggttcaagcagcggttcagccgtggcggtggccgcaggcttcgtaccgctggcgataggcagtgataccgccggttcggtacgcattccggccgcattcaatggcctgttcggcttacgtatgacgcgcggtgcactgagcagcgctggcatcgtgccgctgtcgcctacccaggatatccccggaccgctggtgcgctacgcggctgatttgcggctgatcagtgaaatactcacgggccagcgtttttcccgtcccgaccggccgttgcgcatcggcatctggcaggaaggatttgccgcagaggaaacggagattaaccaggcggtgcaggatgctgtggcaccgtttcagccgcgcatgctgagctggccgcagctggagacgctggcgacggaagccaatattattgcctatgaatttgctgacgcgctggccgcctggctggcggataaatcgcaggcaccgctgcgcacgctggcggcgattgccgcgtcaggacactatcatccccagctggaggccaccttcaaaacccgcgcgcagcatcccggcatgcagagtgacggctatcgcgaggtgcagctgcgccagcagaggctgtatcagcagctggcgcagttttttcagcagcagcagatcgacctgctcgcttatccggtcgtccgccatccgccagtgaagcatggcgagttgcagcctggcagcaacgcgctgatctcagccgttaccggcgcaccggcaatcagcattccggtcggcctgacttctggcactgcgcgaccgggaagatgtgctgttaaaggcggcagaacagattga

SEQ ID NO: 80337 - DNA, 207 bp, Glycine max
  Peptide Sequence Number=SeqID_197115
atggaagcttggggggctgctatttatgctgtttccgtgagcaatggggttcttgagagaggggggggagttttgggtgaagaaaactcacccccagccccttttcatctaacttttgcagggggtgctcgcccaggcgagctaaccctgatactaggatgcctctcagtagcacttctcgatcgtccggagccggacgtgggatag

SEQ ID NO: 80338 - DNA, 201 bp, Glycine max
  Peptide Sequence Number=SeqID_197116
atgagggaaacgaggtatgaagagacagaagagagaccgcctggaacgagcacattcacgaggctatcaggcaggcattaccgccccctcaaaagagatatgcccttatcaaatgatcgatgcccggtctcaccggttgggaggttggctacaaccatggaggacaggtcgcggtggcttaggcacgtcggatgtctgtaa

SEQ ID NO: 80339 - DNA, 471 bp, Glycine max
  Peptide Sequence Number=SeqID_197117
atggcgcgcgtcagcagtgacgcctccgccagccagccgatgatttgggttgaacaggtgagcgtgccggattatctcgctggcaacgggctggtttatcaaaccagcgacgtgaagtacgtgattgccgccaacaatctgtgggccagtccgctcgaccagcagctgcagcagacactggtgagtaacctcggccaggcgttgcccggccggctggtggccagtcagccgctgggtgacacgcacgatacgctcagcgtgcatgtcaccggcttccacggtcgctatgacggcaaggtggtcgtaagcggtgaatggttgttgcaacatcaaggccggcttatcaaacatggctttaatctgacgctgccgcagaccgaagatggctacgatgcgctggtgcgcacgctggcgctcggctggcagcaaacggcacagcagatcgctaacagcgtggtgacgctaaattag

SEQ ID NO: 80340 - DNA, 696 bp, Glycine max
  Peptide Sequence Number=SeqID_197118
atggatacctcagagccctacactggggcaatgaaaggcaccgtgcattatcctcaagcgaacctaagggcagatcaaaagttctcacccgtcgatgtacaagtaccaatcgccttcagaggactacacgtcctcgcctttagagggctacatgccctcgcctttagaggactacacatcctcgccttcagagggctgcatgtccttgcctttagaggactacacatcctcgccttcagagggccgcaccccctcgccttcagaggactacacgtcctcaccgtcagaggactacatgtcctcaccttcagaggactgctcatcctccccttcagaggactgctcctcctccccttcagaggactactcgtcctcgccttcagagggctacacgtactcaccttcataggactacacgtccttgcctttagacggctacacgccctcgccttcatagggctacacgtccttgccatcagaggactacatggctacacgccctcgccttcagaggactacacgttctcaccttcagagggcaacacaccctcgccttcagaggactatgcgtccttgcctacagagggctacacgtcctcaccttcagaggactacatgtcctcgcctttagtggactacatgtcctcgccttcagagggctacatgcccttgccttcagaggactacaagtcctag

SEQ ID NO: 80341 - DNA, 390 bp, Glycine max
  Peptide Sequence Number=SeqID_197119
atgcataaggcattacgtgccaatgcacctcttccatatcctcaattggtcaccctctttctccgtcattttcaaatttctcttgatgatgaaccttttgttcaagtcaagcgttcctttgctataggtgctggtgctgtcacttcatttggttaccgtaaggatcacaatggtcaatggctgaagaaagatgcacttcctccacaagacaagcatactccttctcctcctcctcagcgagatgattcagcccttatgactgaagttctttcagagttacggggtcttcgcacttatgtaggaatggatatccgtctcatgcagcttgaagaggatgtgggttatattcatcagagcttcgatcttccaccaccaccaccaccctcttag

SEQ ID NO: 80342 - DNA, 222 bp, Glycine max
  Peptide Sequence Number=SeqID_197120
atggtaaagtgtcttgtgaagttgcaaaccaaatttcgagaagatccaacggttaacgaaggctgggcaacgtttctaccgaggcagcttcataccaaatttcgagaagatccaacggttaatgaaggctgggcagcgtttttaccgaggcagcttcatgtagctttctctagaagcttcattaagaggcttcctctagaagcttcctcgtggcttctttga

SEQ ID NO: 80343 - DNA, 676 bp, Glycine max
  Peptide Sequence Number=SeqID_197121
atggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgacttcgcgcttactaggaattcctcagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 80344 - DNA, 1134 bp, Glycine max
  Peptide Sequence Number=SeqID_197122
atgcgctttacgataataacgactaaacccggccaccagccgccgcaaacccgctgtgactttatgccgcccggcggcaccattggccgcggagtggacaacaatctggtgctgccggatgacgatcgcaccatttctcgcctgcaggcgattgtgcacatcaccgccgctggcgaatgccgcctcaccaaccggggcaacgtgacgcgcgtgctgctcaatgacatcccgctggagcgcgggcgtcaggtggaattacaggatggcgacgtgctgggcatcgatgattaccagctgctggtcaacgatcttaacggcgcgcagcagccgcaggccgccacgctggcaccgcagccggtggtacaggcggcggtaatggctgatgcgccaccggcggaaaaagatgccagcaccgccgcgatccccagcgagatctgggacagtctcgccaaagagttttcgatctccgacgatctgtcgaagcgcaaagcagcggccgaggtgctgccggaggccaatccgctcaccgcgccggccagcctcgatcgcaacccggaggatccgctggctcagctggtgaacgatgcgccgctggatattggccagcagccgaaaaataccagcctgttcgatgaaggcgatgcgctgttcgcgcaggaaagtatcttcgacgatcgcacccccagcacgctatcggcgcagcagaatgccgccgcgcagccgcaggtcgagagtgccaccgagctcgatccgctcagcctgtttggcagccagagcagcagcgacgtgcgcaaccacgacgatccgctcggcctgatgatgggcaatgcggttccgctggcgcagccggagatcgcgccggcacagacggttcaaccgcagcctgtcgcccagccggaaacgcccagtgaaccctcgccggagacggcaccggtcgggctggcggatctcagcagttcgccactgtttgatgacaccgaaacccaggccacgtcgccgctgatcgaaccgcaggcggagcagccggagacggtcgcgccgcagatggattacggcggcattacgctgcccacgccgcaggcggtgcaacgtgtaccgtcgccgacgccgaaagggcggctgcgtatcgatccg

SEQ ID NO: 80345 - DNA, 500 bp, Glycine max
  Peptide Sequence Number=SeqID_197123
gcgaaacgattaacactcactgccctgatgtttgcgactttcagggctatcagtttaaaaacggggaatatgaatattcattttatcccagtgttaaggaggttaatctctgggattatattgtgacttacaaagataaggtcattgctcaggatgtagctttcgctgcagccctctgctccagcgaaccctcagatagcgccgtttatcagtgcacgcttcatgagaagcagttagctgaagacgcgttgaatcaggaatacacggcggcaaaaaaacggattgcatcatcataccgcgcggataaaaaactggcggatgattaccttagcacattaacaaatacccaacgtggctggctaaagtaccgtgatggacagtgtaagctggaagcttttgatgcagaggaagggagtatcgctcacgaagtagcgactaatatctgcattgtgcgcatcaataaagaacgcctggaatcattgaggcagattccttattaa

SEQ ID NO: 80346 - DNA, 1097 bp, Glycine max
  Peptide Sequence Number=SeqID_197124
cagaattgcaactgtggtcaaggattcagcaagaggtttggaccgcataaaacagactcggaacggcatagcgggcctaccacagaagtacctagaagataaggcgaaggatatggcaagtcaaggggattgggtcccgtttatggatgtgttagcgttgctaatttttggggtcgtcctctttccaaacatagatggtttggtggacctagcagcaatcgacgccttccttgcataccaccatagcaaggaaagtccggtggtagctgtcttggcagatttatttgacacgtttgaccgaagtaagacacgaggcatccatgtccgctccagagccatcgctcgtgaaggaaaagagggagtccttttctcatgtggagggtacccaaacattccgctaataggaatgaggggttgtattaactacaatcccgcgctcgctataagacaactagggtaccccatgaggggagcaccgacggaagaaagcatgtctcctttccttgtaagggattttggcgcgcaaaatttcaaggctatacaaagaatccataaggcatgggaaaccccgttaagaaaagatcaagaacttagggggattcgtaatggcatcattggtggctaccatgaatggctgaaagttcatatacgaggtttagattggctcgccaagttaaaagtcgtcagcgaagagagttttgaggcaccggaggaggacgaagaagtccaagctctcaacagtaagttaggaaaggcgaaacttgccaaggagaagttcaaattggctgctacacacatccggaaggagtgtgtcggattacaagaagaaaatgcaactaccgcaagagcccttgaacaagagaccaagagggctcgcaaggaagagtatggccggaataaatttcgcggggctctgtggggtagcaacaatgaactcaagctgcgaagggaagagagggaccagtcgcgagcacatagcatggttttgaaagaggagttagttgcctgttcaaggtccaaaagaagcttgtctcagtgtttatgcgagacggagaccaacatgctagctatcatcgccaagtaccaagaagagttag

SEQ ID NO: 80347 - DNA, 462 bp, Glycine max
  Peptide Sequence Number=SeqID_197125
atgaacttaatcattgttatcaaaaggaaagaacacgctttactgcgcccttaccaaacccttgttagagctagagtaatgggtgaagtagaggaggtgcaagagaaaatgaaggctgacacggaggccttgaaagagcaaatggccacaatgatggaagccatgataagcataaaggagataatggaggtcagtgcggctgcaatagccgctaccagtaccattgttgaggtggacctgaccccctcatatgtcctcaaccaaataaatcatccaacctcagatatggttggtctggaaggaaaagagttgggaggtacgggtggcactcatttggtgcgaaaaacaagcatgccttcccaccatatggcttgcctcccaactatacaccaccgaatatggcgtacactcctggtgaggatgtcaataacttcctctcccatactcattgagagccgataa

SEQ ID NO: 80348 - DNA, 798 bp, Glycine max
  Peptide Sequence Number=SeqID_197126
atggcgaagcgcgcgggctggattgccctgaatatcttcctgccggcgtgggaggtgtccagctggagccgccacgcggggagaaacgtctcacgcctgtggcagcgcctccgtgaggtgaccgcgggccgcggcgcgggagactaccgccccgcgagctgggcgcaggcgccgctggatctggtgggggctgatgtggctgaccggcctgccggtggcgggctttctgctgatgctcatcgccgccggcagcagcatcagcggtacaggctggctgcgcgtgggcatcgtgatgtgcgtgctgttactgctggcggccaccggcttcgtgcaggcgctcggggtgagctaccggctgtggcagctcacggaaaagcgggtctcggcgtcagagaacggcagttttcaggcgtttctgcaggagacgcgctggcgccgcctcgtgttaagcggcggtctgctcgggggaaaataagatgcgggaaatccggcgtgagcagcagcttatcgggctgtgcacccttcttgacgacaccgtgctgggcgagcgacgcgaaaccatcatgcacctgggcgcggcattcactgcgtgtggcgggggccggcgctgacgcgctgtcgccgctggacgccgccattgccggactgcagtccgtgtgtgatgaggcaatggcgcaggccatggaggctgcggatggcgcttctgtccgtgctgctgcctgccggcgtgaccgcggtgctgttcggggcgggcgtgctaatccatatcctttgcggcacgctgactttctgactaca

SEQ ID NO: 80349 - DNA, 654 bp, Glycine max
  Peptide Sequence Number=SeqID_197127
atgaagcgctgccagttgctgcagcgcgcgtgcgagaaaaccgtataccgacgtcagatcgtcgctttccatgcagcggatatccggcgtcaggaagaccacctgccccggccgcagtttcagcgtgctgaggctgaaccccggcgtgcccgtaaaggtctcggccacgtgcgggtgatggtaaatggccatgcggctgcggatggccgcggcggcgtcaccggcgccgtcatgcgtgagcagctcacgcgcggcctgaagggacggatgataagggtactgccggccccagcgcgccagggcaatccacagatcgtccgcccacagctgcccggccagcgcgccgaacccggcggcgtcaccgctgaagtgccccgtgtcatccgcaaatccgatgacgcaggccatcaggcgccgggtcagacgtcgccctcctgcgtctgccccggggcaaggcgccacgcctgccacagccgtgaccagcgcggcgtattccagaaggccgcccacatttcgccgcagggatccagcaccagaaccgggccggcgccggcgtccagcagtgaagaaagtgcgccggcgtccggcgcgaaggtaccgcttgttgtcatgaaattctcccggaggttactgtgcgcttacgccggcgcttag

SEQ ID NO: 80350 - DNA, 633 bp, Glycine max
  Peptide Sequence Number=SeqID_197128
atgatgcctccggatcagtggcagccgcacgagcgcgcgctgctggccatctttggcctgcaggtcttctccggagaccgtaaggcggccaccacgctgctggatgacctgaaccgctcgtgcgtcatccgccggccattccgggcgcccgaattccgcacggtgcccgactggcgggttgcagaaaagcacgtggcgcgcgtgctggccagcccgggcgtgagcgaatggctgaagacgcaccgcactgtgcgctccgcgctggccggactttacggccgcgacctgcgccttccgcccgcacggttccgctggctgaaaggctgcgaccgcacgctgtggtacgggctccacaccgccgacaccgccaaggtgtttgtggaaggcgcgggcatcgtcgcacaggcacgcgcggagcagctggccgcccggctcggcctgccgtgcccgccactgatgaccggcgaggcggtcgacgggctgcagctggagctcgagtcgctggggctcgtatacccgcgcgacgtccggccaaaacgcgcgaaaccgcagcgcgaaatgccgttccctgacgcactttatctgcccggcgagggcgaagacgaatttactgacggcgccggcgcgcgctga

SEQ ID NO: 80351 - DNA, 300 bp, Glycine max
  Peptide Sequence Number=SeqID_197129
atgactaaagcacgtcaaaagggggtacggaaagagtgctcaacgaaattcttcatttctccccctatttatagcaaaatgggggagatgcttgccacccagctcgcccaggcgagcaaggtgacttcctccagaagcaaccgtcttctggaggaatcttctggagggcccaagtgggcctggttgctatttgcacccccatttctgctaaatacaccccctgccttttttggtggttcttttttcgtaaagttacggaaacttacgaatttcgtaacgatacttgttttctttctgtaa

SEQ ID NO: 80352 - DNA, 417 bp, Glycine max
  Peptide Sequence Number=SeqID_197130
atggatccagctctcactgcctcccagccccctcttgtcctcacaccgtgtgtgtacaaggtcttgttaaggaattattcgtcacaatccttatcgactcggcctcatgtcatgctattttctgtgaattgtgtggaggacaagctgagtgtgcggggaaattccacgaaacttgtggaagctgctaaattgcaacctgacatcgcccaacttattcactatcatgcatcggttttcagcatcccagaaggccttcctcctcatcgcttacaagatcatcacattcacttaaatctcgagtctcaaccgtatgatgagcctgttagagttattggggcagtgcagaatgatgagcctgcgaaggaaaggaccaaaagaatgaggaaaaccccaagttggctgaaggattatgtgtga

SEQ ID NO: 80353 - DNA, 1866 bp, Glycine max
  Peptide Sequence Number=SeqID_197131
atggagtctcaaacttcttacaaagcaacagtgcaggaggaagaatctgacatctttctcacgagaaattctccagtaactctcaagttccatgatgttatctataaaattaagaccacaaagtggggatttcttaagaacaccaaggcagaagagaaagtaatattgaatggagtgacaggcatggctcaatctggtgaaattcttgccatgttaggtccctcaggaagtggcaaaacaactttgctagcagcactgggaggccggctcggagggaaactccatggaagcataacatacaacggcaaagccttctcaaatgtaatgaagaggaacacaggctttgtcacacaagatgatatcctctatccccacttgactgtggtcgaaactgtagtgttcactgctcttctgagattgccaaagagtttcaccacaaaggagaaaattgtgcatgcaaaatctgtgatggctcaacttggtttaaccaagtgcaaggatagcatcattggtggaccacttctgagagggatttcgggaggggagagaaaaagggttagcattggacaagaaatgctcataaatccaagcttgttgtttcttgatgagccaacctctggcttagactcaacaatagctaagagaattgtctcaactttgtgggagcttgcaaatggagggagaactgttgtcatgaccattcaccaaccttcaagtaggatgtactgcatgtttcacaaggtgttgctgctttcagaagggaaccttttgtattttggaaaagggtctaaagctatggaatatttttctagcattggatatgcaccaatgactatggccatgaacccctcagacttccttttggatctttcaaatggtgtctacactgatcaatcgaatgaggaccatgccttaaataagcgcaagttgatttctgcatataggaactacttcgacgcaaaactgcagccagtgcttcatgaaataactgaatatgataaatgtaagggtagaattgaagacaatggctttggggaatggcctaccagttggccacagcaattccttgtgctgctaaaaagagatgtcaaagagagaaagtacgcatcattctctggcatgcggatctgtcaggtccttatggttgctcttattgcaggactactatggtataagtctgacatttcacacttgcaggatcagattgggattctattcttcatttctagcttctggagcagcatggctctcttccaagcaatattcaccttcccccaagagctaacaattcttaagaaggaacgatcctctggaatgtacaggctctcctcatatttcatgtcaagaatggttggtgaccttccaatggagcttgggcttcctaccatatttcttgccatagtctattggatggctgggctgaaacctaatgtggcaaacttcatatacacaatgctcagtgtctttctcaatgtgctagtttcacaagggctaggccttgccattagtgctattgtaatggaacagaaatctgcatccacactggcctcggtgatcatgccaacttccattctgcttggtggatactataatcaacatgtgccaaaatttatagcatggctgaaatacttctccacccactactacgtgtaccatcttgtgatagggtctcagtatggcactagtgacacatacccttgttctaatggccagtgtttggttgcagaacatcctgtgattaagcaagtggggctacatttgcaagggaaaatcacggctgcattggctctgttcataatgctaataggcttcagacttgtggcttatcttgctctgatgaggattggggtgacaaagaaggcttag

SEQ ID NO: 80354 - DNA, 558 bp, Glycine max
  Peptide Sequence Number=SeqID_197132
atgaccggaaggcttcttgccggttcattggcttttgagagtcgcatccttcattatctcattgtgcgtatcttgcttccaagatcttcaaaccttgcacaggtttttgaagaagatcttattgtcatgtgggcttttcacacaggccgacaaattgattgggcattgcgattaaatgctccattgccatatccacacctagtcactctcttccttcaacactttaacatccctcttgattctgaaccttatgttccaatcaagagatcctttctaataggcgctgctgtgattgcatcctttggttaccgaaaagagcatgatggctcttgggtgaaaaagggtgctcaacccattgatgaagaaggacatttacaaggtggagaagattcctctattcttcaaaagattttggaaaggtttgatactttggagttacaagtggacatgcgattcgaggagatggagtcaaggattaccaaggtcgaagaagatgtctcttacatccgtacaagctttgatctaccaccaccaccgccaccatcatcttcatcatag

SEQ ID NO: 80355 - DNA, 402 bp, Glycine max
  Peptide Sequence Number=SeqID_197133
atgaaaccaggtgacaaactgtttgataagatcaacagggcaatcttggagtgcaagatagggttggcagtgatgtcaccgcgctactgtgactcatacttttgccttcatgagcttgcccttctcatggagtgcaagaagaaggtgataccaatctttgttgacattaagccatctcaattacgcgtcatcaacaacaaaaaatggaccctagaagatcaacggcgtttcaaattggctattgaagaagcaaagtacactgtgggactcaccttcaactctttgcaagggaacttctccggtattgtgacaagtgcttctgatatcatcattgagagcttgatagagtttgaggatgaagaagcgcagatgcatcaatattcgtacttgccaattagctaa

SEQ ID NO: 80356 - DNA, 705 bp, Glycine max
  Peptide Sequence Number=SeqID_197134
atgatttgcacaagactagacattgcctatgttgtaggagttgtgagtagattcctatcaaatccaggaaaggagcattggaacgttgtgaagtggatactaaggtacctcagagaaactgccaaatggtgcttatgctttgtcaatggagattcaatgcttcttggatatgcagatgaaaatatggcaggagatgtgaattctagaaagtctacatctggatatctgattacttttgtagggggagctgtgtcttggcaatcaaaacttcaaaagtatattgcattatcaatcattgaagtagaatatattacagcagctgaagcattcaaagaaaggttatggatgaagaaattcttaaatgacttgggacatgatgtagacgattatttggtaaactgtgataatcaaagtgtcatccacttagccaagaaccctatgttccattcacgctttagacacatgtacatttgtaaactgaagttaaagaaaatccatacagactttaagttgtcagatataatgacaaagacaataccaaccaagagggttaaagaccattgtcaaggtgctggttttgatgatgccaaaagtataatcaaacaagattgcttcaacaaacattcaaggttaagcaaacaaagattgcatcaaagattaattcaaggtcaagcaaacaagatcaagaaaaagataaggccttag

SEQ ID NO: 80357 - DNA, 213 bp, Glycine max
  Peptide Sequence Number=SeqID_197135
atggaccttttcatttccaaaacgtttagaccaaaattattacagcctttgggagttggtggcctctcatcaatgatgcaatcctaccctccaagggcattggatagaagactccaagaagattgggccaatgatgcaagagaaggccctaaggtagggtgccctagaaatataggatttttcagcccttgtattttagggcaccgagactag

SEQ ID NO: 80358 - DNA, 162 bp, Glycine max
  Peptide Sequence Number=SeqID_197136
atgattaagggatcttatgaaaccactagagatgttggagcccgcttaaaggttttgaggatgccaaagtattacctaaagatggttgtcatcatcaaaaaaggggagaatgtgaatgaatatcatgcatgttttgatgatgccaaaaaggttactcgatga

SEQ ID NO: 80359 - DNA, 825 bp, Glycine max
  Peptide Sequence Number=SeqID_197137
atggtatctaggcatgtcattttccatggagattgcttcccttctgcctctcctcgtgcctctcaatcttttcccacattccttgtgcattcgtatcataccatttatgatcatgacatttcttctaatccatcaaattcaccagttattgttgcttctagaagatttggcaaggaaagaaccagaccgacgaagtttcaagactttcacactacattcacattaactattactggtgaatcctctggtactcattatcctttagcctccgttttatcttacaaaaacttgtctccagcataccatagttttattatgactgcatcctctaagatagaacctaagtcatttaaagaagcttcccaattagataaattgatcaaagcaatgaatgttgaaattgaggctttagaggctaatcatacttggattttgactgacctccctcctaacaaatctactattggatgcaaatgggtttataaagttaaacataaggccgatgggttagtagaaagatataaggccaagttagtagccaaggggtatactcagattgagggtcaagactactttgatactttttccctagtggctaagatatctattgtggtattattacttgctttagctgctgttaacaattgtcatttaaagcaattagatgtgaataatgcctttatgcatggagaccttgatgaagaggtttacatttctttgcctcctggtatgcactcaaccaaatctaatcaagtttttagattacaaagatctttgtatggccttaaacaagtgagtaggaagtggtatgctttgataccataa

SEQ ID NO: 80360 - DNA, 297 bp, Glycine max
  Peptide Sequence Number=SeqID_197138
atggcacaacctccaccccgtgagaggactctaagggaaatggttgcacctgatttcacctacgaaagcttgtgcatccaataccctgatgaggatgtctcatatgttcttaaaactggactgatccatttgcttccaaagtttcctggccttgcagagggagtggcaaaggactggctatattaccttgctccaaggtccatcacgagctgggatgacctcaagagagtattcttagaaaaaaaatttccctgcttccatggccacgaccatcagaaaggatatttcaggcattag

SEQ ID NO: 80361 - DNA, 315 bp, Glycine max
  Peptide Sequence Number=SeqID_197139
atgccttccccgtgcgtaaaaacgactcccgaacctttcatacttaaagttcatagacccacttttggttttctaacgttttcctcaactaaacgttggtggcaactccgtgcattttccttccttggaagatgcacccgtgagccccgcgtcgccctcccgtcgaagggcaagttgcgacagttggcgactccactggggacaattagagaattaggccattcaatcattagaaatatttttttctacacacacatggcacctacacctcgcacacatattgagatatttggccctacacccgggtctatgtga

SEQ ID NO: 80362 - DNA, 287 bp, Glycine max
  Peptide Sequence Number=SeqID_197140
atgaagcttgcttctacagaagcctttaatggccctcctccatcccgagagtatatatgtttccttgagaaaacactactaagaaccagggaggcatttgttgaagctcttcatgatacaacacatgttgaaagagaaaccaaaagatggaaggtccttaggaagttcttctttaagatgtttgttgaagccccaatggatagttcatctgatcatgaatctgtgggtgagttctttcacaagcttggaaaggaagaagaagctgtcaaacaaaaggaggagaataa

SEQ ID NO: 80363 - DNA, 882 bp, Glycine max
  Peptide Sequence Number=SeqID_197141
atgggtgacgaggtgcgcatttacgccgtgcgcccggcacccggcgcaatggacaccacgtgcgtacagttcgcgagtgccgatctgggcgcttccgagtcgcgcgcgctgtttgtcgatccttataccctggcgatcaagggtgatatgacggtgtacggcacctccggcgtgctgccgctgcgcacctggctggacaagttgcacagcagcctgctgctcggcgatctggggcgcaactacagcgagctggcggcctcttggctgtgggtggccgcgctgggcggcatggcgctgtggctggcgacgcggccgaagcgcaagctgaaaaggtcaaaagggggcttcgccgccagccgccattggcatatcacgctgggtgtggcgctgctggccgggctgctgttcttctcggctaccgggctgacctggtcgcagtgggccggcggcaacatcgacgcgctgcgggccaacctgggctggctgacgccgcaggtcaacacctgcctgcaggccgatgcaccgcagacgccggccgatccgcacgccgagcatcgcgggatgatgccggggatgaagatgggccctgccgcgcagagcaatgcgctgaacggcgactgggatcgggcgctacacgctgcgcgcgccgctggaatagacgccgttaaggttgagctgcgccagccgaaaggcgagggcaaagcctggacggtaaccgaagtggatcgcagttggccgacgcaggtggacgcggttgccatcgcaccggaaatcttcgccgtcgtcgaccaggtgcggttcgacactttcccactcatcgccaagctgacccgctggggcatcgacgcccacctgggcgttctgttcggtgtgccgaatcag

SEQ ID NO: 80364 - DNA, 711 bp, Glycine max
  Peptide Sequence Number=SeqID_197142
tttggctttggcgtacaccgcatcgaagcccagaccgaagctgaagtgttgattcagacgatatgcgccgctgaggttcaggttgagggtggtcagatcggtcttgccgccgtaagcgccggcggtatagccgtcgttgaattctgtcgccagaccgtagttgctggtgaccgagccgcctacggcgaactgatcgttaatcgggtgaacataatgcaggttcggcacccaggcggtcggcgcgatgtttttcgaatccaaactggcgccggaaggggattgaccggtaatgtcaacgccgccgtatccgccatggcgccttcgccagaatacgaacgtcctaaaccagctgatgagaactcattcagctggaatcctgcggcagacacgtttgaagagataattgccactgcagctgcgagagctgatttagtcaatagcgcccaggaaaccgccgcgtgttgctgtgtggatgtcggcaccgtgatggataacaccgattgcaccgcgtcctacagccaggtgttcagcaatcaacaagatgcggaggcgatgctggccgccctgagcgaaaaggcgcgcgcggtagaatccgacccttgtgacatcagcagtagcattaaaccggttgacggcggcgtacagttggaggccgatttcaccttcgcctgccaggcggaaaccctgatcttccagctcggcctgcgttaa

SEQ ID NO: 80365 - DNA, 2169 bp, Glycine max
  Peptide Sequence Number=SeqID_197143
atgatgagcttcgaaaacgcattgcatgaacagcgcgccaaaccgtcggcctttcagctgacgattcgccccgacaacatcggcgtgatcaccatcgacgtgccgggcgacaaggtgaacacgctcaaggccgagttcgtcgaacaggtcaacgacgtgctgatccgggcgcagcagcatagcgcgctggaagggctggtgatcgtttccggcaagccggactcgtttatcgccggcgccgacatcactatgattgccgcctgcaccagcgccaaagaggcggaaacgctggccaggaaagggcagagcacgctggcgcagatcgccgcgttcccggtgccggtagtggcggccattcacggcgcctgcctgggcggcggcctggagctggcgctggcctgccacggccgcgtctgttcattggatgacaaaaccgcgctcggactgccggaagtgcagctgggcctgctgccgggctccggcggcacgcagcgcctgccgcgcctggttggcgccgccaaggcgctggacatgatcctgaccggcaagcacattcgcgcccgccaggcgctgcgcatggggttggtggacgacgccgtgccgcagtcgattctgttgcagaccgccatcgagcgggtgaagcagggctggaagcatcagcgcgagctgccgtggcaggatcgcctgctcaacggcccgctgggcagaagtctgctgttcagcatcgtgcgcaagaaaacgttggcgaaaacccacggcaactacccggcggcggagcgcatcattcaggtggtgcgcaccgggctggatcacggcagcgccagcggctatgaggccgaagcgcgcgcctttggcgagctggcgatgacgccgcagtcggcggcgctgcgcagcctgttcttcgcttccaccgcgctgaaaaaggagcggggcggcaatgcccagccgcacgccctgcatcgcgtcggtattctcggcggcggcctgatgggcggcggcatcgcctgcgtcaccgccacccgcggcggattgccggttcgcatcaaagacatcaatgaaaccggtatcaaccatgcgctgaaatacagctgggacgtgctcggcaagcgggtgcgccgcaggcgcatgcgcccggcggaacggcaaaagcagatgatgctgatctccggctctaccgattacactggctttgaacaggtggatatcgtggtcgaggcggtgttcgaagatctggcgctgaagcagcagatggtagccgaggtagaagccaactgcgcgccgcataccgtgttcgcctccaatacttcctcgctgcctatcggccgcatcgccgaaaaggcccagcggccgcagcaggtgatcggcctgcactacttcagcccggtggacaagatgccgctggtggaagtgatcccgcacgccggcaccagcgaagagaccatcgccaccaccgtggcgctggcgcacaagcagggcaaaaccgccatcgtggtgggcgacagcgccggtttttatgtcaaccgcatcctggcgccgtacatcaacgaagcggcgcgctgcctgctggaaggcgagccgattgagtcgctggacaaggcgctggtggacttcggtttcccggtcggcccgatcaccctgctggacgaagtgggcatcgacgtcggcaccaagatcattcccgtgctggtcgaggcgctggggccgcgcttcgccgcgcctgccgcgttcgatgcggtgctgaaagacgggcgcaaagggcgcaagaacggccgcggcttctatctctacccgagcgaagggcagcagcggcagcggcgcaaacgtgcggatacctcattgtatacgctgctcggcgtcacgccgaaggcgcacatgctgccggcgagcgtcgctcaacgctgcgtgatgatgatgctgaacgaagcggcgcgctgcctggacgaaggcgtgatccgcagcgcgcgcgacggcgacattggcgcggtgttcggcatcggcttcccgccgttcctcggcggcccgttccgctatatggacgaactcggcgccgagaaagtggtgaagacgctggactacctgcgtcagcagcacggcgagcatttcgccccgtgcgaacgcctgcagcgcatggcgcagcagggcgagcgcttttacccgctggggagctga

SEQ ID NO: 80366 - DNA, 207 bp, Glycine max
  Peptide Sequence Number=SeqID_197144
atgtcgctaagcggtagtgttttttacaaaggccagctaagcggaccatatcttgctaagcggctgtcgcaacctacccttcggcgggagggcgacgcggggctcatgggtgcgtcttctaagaaaggaaaatgcacggagttgccaccaacgtttattcgaggaaaatgtccaaaaaaccggaaaggtgtggtctacgaactttaa

SEQ ID NO: 80367 - DNA, 511 bp, Glycine max
  Peptide Sequence Number=SeqID_197145
atggcttcgaagatacaaatattaccagtcgtaggcgtggtggccatgtatatcatgaattcaattattacattcttgtatttcaacggaagagtatatgaagacaatgatggtgtaatatttgaaggcagaaaatatgttgcgttgcaaatttgtgatgacgaagatgttgaaactatgatcgaaagttttcaacaacaacaacaaatgtcaattctagaattgtacgtagaaaaggatgttgctgggggttctatgtttcatgctgcaaattctgttacgtcatgtggacgtaatgtatctcatcatgagtcggaactgccaagaaatataagcaatttacatgttgatgaagatgatgatgatgatgatgatgatgatgattatcttgcatctaactcatacgttgaagagtctttcgatgaagatgatagtgatgatggaatatctgatacagacgatgaagtcactgacatcgttgaaccagtttcaattgttcacccaaccgaag

SEQ ID NO: 80368 - DNA, 174 bp, Glycine max
  Peptide Sequence Number=SeqID_197146
atgcggggttactttatggttcctcgcacctttcgtcaaccaggggcaaacgagcccgttgacgcgcggagactaacatcgtcttctgcaccttttgtcgtcgtgaccatgaagtcagggttaccttatggttacccacacctttcgtcaaccgggggaaaacgagcccgttga

SEQ ID NO: 80369 - DNA, 1716 bp, Glycine max
  Peptide Sequence Number=SeqID_197147
atggtccaagagcgttcacttcccaaatcagtgaactcgaagccccacgcgcgcacggcggcactggcctccacgaagagcctcgatttctccgcgtgggtctccgacaacctcgtcaggatcgtggcagtggtgctccttgtcgccaccgtcgccgccgtgttcttcctccgcaacgccggcgacaccgccgcgctgctctgcttcgagaaccaggcgcgggagctcgagaggatcgcgtacccgcgcgtggactggtccgcgattgcgccgatcgcggaccggacctcgaagttctcgagctttcgatcggagaaatggatcgtggtgtcggtgtcgggttacccgagtgacgcgctccggcgcctcgtgaagatgaaggggtggcaggtggtggcggtcggagggtctaatacgccgtcggattggaccctcaaaggtgcgatctttttgtctttggaggaacaggtcaatttagggtttagggttgtagattaccttccatatgattcgtttgttaggaagagtgtggggtatttgttcgcgattcagcacggtgctaagaagatttttgatgctgatgatagaggggaggtgatagatggtgatttggggaagcattttgatgtggagttggtaggggaagctgctaggcaagaggttttgttgcagtatagtcatgataaccctaatcgaacagttgtgaacccttatgtgcattttgggcagcgttcggtttggcccagagggttgcccttggagaatgtgggggagattgggcatgaggagttttacactcaggtttttggagggaagcagttcattcagcaggggatttcgaacggcctgccggatgtcgattcggtgttttatttcactaggaagtcggggttggaggcgtttgatatccagttcgatgagcacgcgccgaaggtggcgttgccgcagggcatgatggtgccagtgaattcctttaacacgatgtaccattcgcccgcgttttgggccttgatgctcccggtgtcggtcagcacgatggcctccgatgtgttgagaggttactgggggcagagactgctttgggaggttggtgggtatgttgtggtttaccccccaactgtgcataggtatgataggattgaggcatatccgttttcggaggagaaggatcttcatgtgaatgtaggaaggttgattaattatttgatttcgtggcgatcggataagcataggttgtttgagaagatattggatttgagctttgcgatggcggaggaggggttttggactgagaaggatgtgaagcttacagctgcttggctgcaggatttgttggctgttggctatcagcagccgaggttgatgtcattggagttgggacgtccgagggcaaatattggtcatggggatcagaaagagtttgtgccacaaaagttgccatcagtgcatcttggtgttgaagaaacgggaacggtgaattatgagattgctaatttaatctggtggaggaaaacttttggaaatgtagtgcttatcatgtattgcaatgggccggtggaacgaactgcccttgaatggaggttgctctatgggaggatattcagatctgttgttattttgtcagaaaagaaggatgtagatcttgttgtagaggagggtcatttggactacgcatacaggcaagtctgtaagagtatggatattgagaagcattag

SEQ ID NO: 80370 - DNA, 144 bp, Glycine max
  Peptide Sequence Number=SeqID_197148
atgcaggtgtaccccctcgaatctccccaacaattgatatcagagccgatggttcaagttggtgaccggctcagacgagtatgcaagtaccgcagttggccagaatggctagcgacactgcgtgccccgtcgagcaccatataa

SEQ ID NO: 80371 - DNA, 549 bp, Glycine max
  Peptide Sequence Number=SeqID_197149
atgggatgggaaatcggtttcttcattattggggttgggaggaggggaaacaaagggtggaacttcaaaggcatggaaatgaatgttggaaatggtcttttggtctcaaagttttggcgaatgcgtgacttttccactcgaagacattgggaaaggtggctgctagaagctattattcaacttttggcagcggatttggcaatcaatgccttgggttggatgttgcttagaaagccttatcatgggtcatggagagggggaattaagaaccattcggtgttggtgatttcattgtcgtcgttgtcatcagaggcaacaaaggaggtcgataagaggggggttgagtcagaggcgacaatgaaggataaactgaagatgaaggatccaaagatgggggttgagtcaaagcttgaaggtgacaacaaaggaatcgaagatgaggagattgaattcatggaggaccttcttgcgatggtcttactttacggtggaggtggcctagccattggaggctatggtgcaattgaagctaaacgtctatttggataa

SEQ ID NO: 80372 - DNA, 603 bp, Glycine max
  Peptide Sequence Number=SeqID_197150
atgattgagcatatggaggagaggctgagggccattgaaggaggaggaaattatgcctttgctgacatggcagagttgtgcttagtactcaacgtggttattcctccaaagttcaaggtgccaaattttgataagtacaagggaactacttgcccaaagaatcacttgaaaattgaggagcaccatcaccgtttcaaagtgattaaagattggttttttctcaagggaaggcgagtcaagctagctgagggttttgatggcgagaccataggtcagctactttgctccccaagacatgattttgcacctcctaggcacccagtggacccagaaaagtccaatagagcactgagatttcctgcattgattacaggtacagtagccagggcaagattagcagcaccagctggcggcagacgaaccaccgccgcctccacatcaatcgtcatccttggagtccatctcagcccacatgcggaggatggagctccaaatgcacaaggacttgcagatgctcaaggagctgcccaaggagacgaaagtgaagctgaggatgatggagacatggaagatctacttggttacttcattggaggaggctga

SEQ ID NO: 80373 - DNA, 204 bp, Glycine max
  Peptide Sequence Number=SeqID_197151
atgacggtggcagagtatgcggcaaggtttgagaacctggtcaggatctttaatgaggatctgtgggagaaggtcgcattctgtgaaagcaatgacttccaagattattttgatgatgccaaagaatcaagagctaagcaaattcgaaagattcaagaatcaagtttcaagaatcaagattcaagattcaagaatcaagtttag

SEQ ID NO: 80374 - DNA, 261 bp, Glycine max
  Peptide Sequence Number=SeqID_197152
atggcttcactctctaacaactccctaatggagttgtcatttgtcgcaacctaccttacgacgggacaacaaaagaaagtaatggcattttcgtctcctatgaagaatacgtgtgggagtcgccatcaacgtttatttaaggaaaacgttagaaaaacaaaagagaggtatcagctcgtccaggcaagtcggttgcttaaggataaaggcattccatggcccaagcgagccaaatgctggcctgggcaagctcaggcatag

SEQ ID NO: 80375 - DNA, 171 bp, Glycine max
  Peptide Sequence Number=SeqID_197153
atgaaaaaggcagttagaataagtgtaatcgattacaccattcctgtaattgattacgcaatcgattacaacattcctgtaatcaattacagagcatctgtgtctataaattcgaaatttcagaaactgcgggaacgcgatttttgcagaaactcaaacccaaatccctaa

SEQ ID NO: 80376 - DNA, 303 bp, Glycine max
  Peptide Sequence Number=SeqID_197154
atgttcagatggttcgaggatcctttcgctgcacaagatcagaaccaacgagttgtcatatcttgggagagtagcacaatcagattctcctaccagtgcaatgatgatttatactctgtggtttctaaaagagaaataaaaacttcaacttcctctattgatatagtgcaaactgatgttaccaaatcttctaccacaaaattgccacgttccatccttcttcttcacaagcaagacgagagaagagtacaggctctgactcggccgtatgaggtggcgacgaagcatgtcctcgacctgtaa

SEQ ID NO: 80377 - DNA, 417 bp, Glycine max
  Peptide Sequence Number=SeqID_197155
atgacttccattggaccttctggagatgatccttttcaggtgcgtacccttgctgagacggttcgacttgatgcaagaaccaagctattgaaccccaagtggtatgaaggcatgctgtctactggatacgagggtgttcgcgagatagagaagaggctcactaacacagttggatggagtgcaacctcaggccaagtcgacaactgggtgtatgaagaagccaacacaactttcattcaagatgaggaaatgttgaagaagctaatgaacacaaatccaaactcctttaggaagctggtgcagacattcttggaagccaatggacgcggttactgggagacttcagaagacaacattgacaagctcaggcagttgtactcagaagtggaagacaaaatagaaggcattgatcgctga

SEQ ID NO: 80378 - DNA, 303 bp, Glycine max
  Peptide Sequence Number=SeqID_197156
atgcggtgttacctaatggttacccgcacctttggtcaactagtggcaaagaagcccgttgacgcacagagactagcatcgtctgctgcaccttttgtcgtcctgacccgtgaagtcagccgcacctttcgtcaaccagggggaaacgagcccgttgacgcgcggagactaacatcgtcctcaacaccttttgtcgtcctgacccgtgaagtcagtacctttcatcaaccaggggcaaacgagcccgttgacgcacggagactaacatcgtcttctgcaccattttgtcgtcctgacccgtga

SEQ ID NO: 80379 - DNA, 396 bp, Glycine max
  Peptide Sequence Number=SeqID_197157
atgacattgtcagggcaaaactcaaaaacttcgacatccttacctttaggaacactcgaaaggtggcaacgccactcaaaaaggcatgacttcggctacgtggcggtggtgggagcagcaggtccacttcggcttcaggtacttcacggtgggaaacaaaacgtcaggatgataacgggacggagttcacggcgggatgaagtagttcaggcaatagcgggggcgctaggtttttggagtgtacaagagagggtgtttaccgcgagactatataaactacaaaatttacgacggtgtttaatgacaccgactttgtatgtgactatttctaggacggtgtacctacaagcaccgtctttgatgacttccatcaaaactacaacgacggggttatag

SEQ ID NO: 80380 - DNA, 300 bp, Glycine max
  Peptide Sequence Number=SeqID_197158
atggtgcaaaaagggaagaggagggtagttgtaactcaggaagccgcaaccactcctgaaaagtctcctgaggccactccagagcttccagcaccaattgcagataccacttctccacaacaggcaacagatccttcaacgcttgaagatcaaaccacaccagtccagtctccgaatgcctctcttgtatctactcctgtactgcatttggctgacgaggaggaggttcagacacaggacacccaagagaccaatcacaggacttttaaattcatgttgattattttttgtgctttttga

SEQ ID NO: 80381 - DNA, 204 bp, Glycine max
  Peptide Sequence Number=SeqID_197159
atggagcataaagcctattgggatctcaagttcttgaattttgatgagtccttgtctagggagaagagaaagttgcaactgcaggaattggaagaaaatgaggctgaacacgtcaagccctatggggcaattgagttggtggacccttcttccaatgaaccagagcagagttggattgttaatggtcagaggttgaaggcttaa

SEQ ID NO: 80382 - DNA, 402 bp, Glycine max
  Peptide Sequence Number=SeqID_197160
atgtgggctaagtgctcgttgcgcactaagcctaaatgtccaattctcaagttttatgttttgcattgggcgagggctagctatgtggagaacattatactcaggaacattttcccagagaggaatgtggaacttggcactggggaaaacgatgaggtttgggaggagcttaagaggaggaactgggtcaaaaggttgaccaacttgccagacaacaacattaatgtggctttggtgaaggaattttatgccaacatctattaccctgaggacagcttccccaagcattgcaagcccctaagggcattggttagaaaactccaagaagattgggccagagatgcaggagaaggccctagggttctcatgagccttagggaattaatgaagcattgggcttga

SEQ ID NO: 80383 - DNA, 443 bp, Glycine max
  Peptide Sequence Number=SeqID_197161
atggtcattctgctccctttgtcattcggggacactaagtcgagaggtgggagaagacaaattatggtcattccgtacacctttttgccatccggaggcgatcatgtccggtgggacgcagagacaaattatggtcattctgcaccttgccgcccaggctcgttcacgtccaaagacacgcagacacaaattatggttccgctgacagggagattcaccgggggtgcatatagcaaccaggcccacttgggccttccaggaagttctccagaaggcggtgccttcaggaggaagcaacctagctcgcctgggcaagctggaaaatccaagccgaggcgcttccgtaacgcttcagtaacgtttccgtgggtgatttcgcgaagattttcaaccgttctttgtcattcttcgttcgttcttcagtgttcttcggtcttcaaccg

SEQ ID NO: 80384 - DNA, 144 bp, Glycine max
  Peptide Sequence Number=SeqID_197162
atggattctctttttccttcttcgcaagtgaagctccctcatcttatctctgtcaagcttgatgataagaatttcaagcaatggaagcaacaaattgatggtgttattcgtggccacaggctgcaacgatttgtcactgtaccg

SEQ ID NO: 80385 - DNA, 285 bp, Glycine max
  Peptide Sequence Number=SeqID_197163
atgaagcacttcactgacaccctcatcagtgccaacataggaacaaaagctggtaccgggccccccctcgaggtcgacggtatcgataagcttgatacctatgaatgccacggcgaagtgccggcttcgacccgcgcctatgccaaggtgcaggcgcccggcgtgtacagcgttacggtgacccacccggccgcgtttcgcgcctacctgctcgatcagctcaagcggggatccactagttctagagcggccgccaccgcggtggagctccaattcgccctatag

SEQ ID NO: 80386 - DNA, 714 bp, Glycine max
  Peptide Sequence Number=SeqID_197164
atgaagcctatcaagtccacttccagtgttcactatgggatgcaaatgaacttaattttcaaacactttggagtgtctaataacggagaacccaaagatgatgaaatcctttcttgggttgccaagaaagttgttgccttgaggttgaaccctcaacctaggatggaaactgcctgcacttgttttgatgaggagagtgctcaaaataaggagaagaagaagaagaagaaaaataaggaaaaaaagagaagaagaatagatcctcaccccctccttactaaactgatcaggagtgtgaagaggttggagtctagggtttgtaggagccctttgtccaagttagataaagtgaaggagaccttagaggaagctttggataagaaaattgtttcttccccaactgttgaagcatcttccttagaaaaaagtcctgagaagactcggaacttagaaaaacatactgaagatgattttgaggatgttcagaatgaggttgagaaagaagaatctcctcttcacaagaaggatgtatcaaaggaagaccctttagaagaaccattaaactatggttcctatcatgttgactcaaaacaccattataaggaagagcagaaggatgaggaagaccattatgagcctcaaaaaaaggaagaaagagctcaaaaagaggaacggccatggtacattgaccacggccgtggtcagtttcaatag

SEQ ID NO: 80387 - DNA, 159 bp, Glycine max
  Peptide Sequence Number=SeqID_197165
aggaggaacggagacggaggagaaagaagaagcagaagagagggagacgcaagaggtacacttcatcagaatcatctgattcagattctgcttcagactctgattccgatgataaaagcagccggagaaagaagaggaataatcgaagacgttgaatga

SEQ ID NO: 80388 - DNA, 363 bp, Glycine max
  Peptide Sequence Number=SeqID_197166
atggaggccataaaagagcaaatggccacaatgatgaaggccatgatgagcatgaagaagataatggaagctaatgtggttatagttgccgctactagcgctgtcgctaaggtgaacccgatgctcccatctggcctcaagcaaatgaatcatccaacctcaaatatgccgacttcgagccttggcctcggatataccactgaagggcaagcagttggtggtatacccctacaaaaccctttggagggccctcagtatcacccacaactgcacctcttgcattccacagcggttaaaaaccctcatgactatggcaggaatgggaaagttggatcatctagaggaaaggctcagggccattga

SEQ ID NO: 80389 - DNA, 126 bp, Glycine max
  Peptide Sequence Number=SeqID_197167
atggcgccaaaaacttgttcgcttccggcaagtgcaccggatcacacaagtagtataaaatggtgtgtaaactatctgtgcaaaaaggaaaatcacgcgagagaaatgatgtgtaaaaacaagtag

SEQ ID NO: 80390 - DNA, 264 bp, Glycine max
  Peptide Sequence Number=SeqID_197168
atgttgtttggtgctagtgacagctatgatggtgatacgataatgcaaatcacattggcattcaaccactttggcaagagattagtccaaaggatgccaaggtgcagatatggttttgtccatgtggttaataatgactacactcattgggaaatgtatgccattggtggtagcaagcatcctaccattattagtgagggcaacagattcattgcccctgacaacattaatgctaaagagtatctcaccatgataccatcttag

SEQ ID NO: 80391 - DNA, 354 bp, Glycine max
  Peptide Sequence Number=SeqID_197169
atgaccaaacttggtctctgcgtgccatcggacacgactgtgtctgaatggcaaaggggtgcagataaccgtaaggtatctccgcgtatcataatgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaagttatctccgcgtatcataatgaccaaacttggtctctgcgtgccaacggacacgactgtgtctgaatggcaaaggggtgcggataaccgtaag

SEQ ID NO: 80392 - DNA, 423 bp, Glycine max
  Peptide Sequence Number=SeqID_197170
aggcaaggaagaccaagcttagagcagctgatgttccctctttctttgcaacaataactggcatccctgcatcttctacttcatccccacttccagctttagcagacttatctgcccagagctttgagacttcagatgccaaatttcaaagcttgccaattatgagtgtagagcagttcattgagaaagtggcctggcctggagcccgaccttcttttgtgggacataatgaaagttttacagcccaggcacctcaaaagcatgagccagaaccagaaaacgatcactcatctgaagccaccatccctggagctgttgattttgcaaaaagaagattagagacgagatctaatgaggctgctcatcctggactagtgccagcatcagctgatgcaccattttatctttttgtgaaaaatggat

SEQ ID NO: 80393 - DNA, 333 bp, Glycine max
  Peptide Sequence Number=SeqID_197171
atgaaaaatattattctggaagtgtatacaaaattagcgtcttacaaattcatgtatctagaatggggttgcactttacacctcttcgttggttttcgattccattttcactttgttcctttcaccaaaatcatcaatggtggtgttgggtggtgctgtttgcgtgctggtggttgggtggaggtggggctacggtggtggtggtggtggtgtttgaggggtagttttgcctgcttagatttttgtgaggtgcaagaaaaaaaatggaatgtaggaagtaattcccttgatcacttgaccaataaaaagcctaaggcccaacgtgatacctaa

SEQ ID NO: 80394 - DNA, 228 bp, Glycine max
  Peptide Sequence Number=SeqID_197172
atggaaaatctcacaccccattcgcatatgccctactttatcccttcatttctcaccaccaattctacagataccttcttctccttctcctcatttctcattcatttgtgcattgagatccaagatatagaccaaggagcactgccagctacaaatcccatgagggcacaatggtgttcggagtgtgattgtgttgaggcacaatggttatggaggcttcatggctag

SEQ ID NO: 80395 - DNA, 405 bp, Glycine max
  Peptide Sequence Number=SeqID_197173
atgcacgtagccaggctttgtattccctacaaggggtttgttttgaatgctgagggccagccatggaaacttctcagaaaagatctgacgacactggcccagacatggagtgtcttctcttactccaacctagctcccacatcccacacctcagatttgaatatggatagagctaggttggtctatggcttggcgactaacatggacatgaacatcagagcctttatctcagttcagatttcttctattgctcagagtaactcctctaggctcagatttccagccttgatcactgccctatgcagagctagaggagttacctctaacagtctgacttatgagagcctgagcccgaccattaacttggcccatattaagaaaattgttggaatgtcgatgatctaa

SEQ ID NO: 80396 - DNA, 426 bp, Glycine max
  Peptide Sequence Number=SeqID_197174
atgatttgcgttttcgttcagacgcaccgtggacccggtggacccggagaagtccaacagggccctggggtttccagctctggttatgggcctctgtcagtcctatcgggtgctcgtccccccagcaaggtcacaccatcattacttagggatcgctcccacaagacacccagtggacccggagaagtccaacagggccttggggtttccaactctggttgtgggcctctgatcgcgcccgcaagacaccctgtggacccaaagaagtccaacagggtcctggggtttccagctctaagtgtgggcctctgtcagttctacggagagcccgtcgcccccaacaaagtcatcgggccccctattaatcaggctttcatcaagaagtattgtgcccccaggcaggcgcagggcgaggcatcacagtag

SEQ ID NO: 80397 - DNA, 309 bp, Glycine max
  Peptide Sequence Number=SeqID_197175
atgctggtgaagtctctatcaccttattctcatgccttctcaagtttttctgcaagttttggaacaaacccaagttgggttcccttaaagtcctcaaatagcctctgctgttcctccaagcctagaaatttaagcagatttttatgtctgagcactcaaaatggtggtggcttcagagaaaactctggtgaagttggacgtggagatgcagtgataattgtggatcatgggtcacgtcgcaaagagtcaaatctcatgcttagaattagcagaaccatcaataagagatgcttttcaatcttgcgttga

SEQ ID NO: 80398 - DNA, 2001 bp, Glycine max
  Peptide Sequence Number=SeqID_197176
atggcttccaaatatcattataacaaatacaacaatccatcatatgttgttgttatcttcatagtgttgtgtttcttctcccagtcagcactatctgatccaagaatctcagaagtgggacactactgcagcacacagaaatcacaaacaagtggtgactacttacccatattcaccaaagaaatggaaaaacttctagaacttgtgacaaaacaaaactgggggactcactctgagggcatgtcatcaacaacaaccactcctatctatggcttggcacaatgcttccaagacctttccagcattgattgccttcaatgctttgcagccagccggacgaagctccctcgctgcctcccttcggtttcggctcgaatttaccttgatggttgcttccttcgctatgacaattacagtttctacactgaaaactatgaccctttgagggacacagtgaattgcacctcagagtatggttctgagggtgagaggttggtgtttgctgagagtgttggcaaagtggttgagagtgtggtgagggtggctgtgaataataatgagggaagaggcttttttgcagttggagaaggtgggggagtttatgcattggcacagtgctggaaaactgttggggtaaaagggtgtagtgattgcttgaggaaagctgaaaatgaggtcaaaggatgtttgcctaagagggaagggagggccttgaatactgggtgctatttgagatactcaactgttaagttctacaatcaaggaggtcaagatggtcaaggagatgattcttccagaaaacgagtcattatagcagcagggtcagtcttggctgcagccgttgtagttctcactcttgcagtctcttatgtggccttcaccaaaaagagaagaaaaaacaattttattgaggttcctccttccttgaagaattctagcttgaattacaaatatgaaactctagagaaggcgacggattatttcagctcttcaagaaagataggtcaaggaggatctggttctgtatacaaagggactctgccaaatgggaatgatgttgctgttaagagattggtcttcaataataggcaatgggtggatgatttcttcaatgaagtgaatttgattagtggaatgcaacacaagaaccttgtcaaactattgggttgcagcattgaaggccctgagagcctcattgtgtatgagtacctacctaacaagagcttagatcaattcatttttgaaaaggacataacaaggattctaaaatggaagcagcggtttgaaataattcttggaactgcagaagggcttgcatatcttcatggaggctctgaaataagaatcatccatagagacataaaaagtagcaatgttcttctggatgagaatctcagccctaagattgcagattttggtcttgcccggtgttttggtactgataaaacgcatctaagcactggcattgctggaacactaggttacatggctcccgagtatctgattcaaggacaacttacagataaagctgatgtctatagttttggagtacttgttctcgagattgcaagtggcaggaagaataatgtcttccgtgaggattctggttcccttttgcaaacagtttggaaactttaccaatcaaacagattgggtgaagctgttgatcctggcttgggagaagactttcctgcaagagaagcatcaagggtgtttcaaattggattactatgcacacaagcttctgcttccctgaggccattcatggttcaagttgctagcatgttaagtaattcaaatttggatgtccctataccaaaacaacccccatttttgaactctagatttctagatcaaacatctccattaggttttagcatagacagctcctcatcaaacacatttaagaagattggtgtgtcctacagcccctctgagttctctagcacatgcagcttaattaggccatcaagaagtgaagaaacaattatggaagcttga

SEQ ID NO: 80399 - DNA, 204 bp, Glycine max
  Peptide Sequence Number=SeqID_197177
atgtcaacgtcttccggccgagactgtgaaaaagtctcatttgctatccttcagactcaagggtccgatagcatgcggagatacccagcggttatccgtacacacgtagttctgctaccccgacctatgagaagtcaagtagcgtgcggagatacccaagggttatccgcatgcacacacaaatctgttactccaacctgttag

SEQ ID NO: 80400 - DNA, 207 bp, Glycine max
  Peptide Sequence Number=SeqID_197178
atggcgagtttgctgtgcaacgcccacgtggcttggaaaccgccaccacgagtggcaagttgcgtgcaggtggaaaccgccagcatgactggcgcgtctggtcctggttttggaaaccgccagtcaaactggcgggttggcttgctggatagtctatatcttaatcagatttttccgcataaagttatggaatttggtcagatttga

SEQ ID NO: 80401 - DNA, 216 bp, Glycine max
  Peptide Sequence Number=SeqID_197179
atgttgaatccaactcagtttcaggccaaagaagagaaggttaaagttgttgatgcctcgcttaacgagccagatccgctcagcgagatgcatctgcttagcgaggcatccagctcgcttagcagatgggaaaccctagaagaggaagtcagagatctgcacgcccagcacgcaatcggcccgctcaatgaggacattgtctcttctcgcacttag

SEQ ID NO: 80402 - DNA, 336 bp, Glycine max
  Peptide Sequence Number=SeqID_197180
atgaccggagagatgagaggagcctttgagcttcttggcgaggccggcagtggcagagtcgttgggagcctccttgacgaggtagacgtaggcgaagccaccttccccgagctggcgcatgatgccaaagcggttctcgttgatccaaacatcacctccgccattcggagtcgtaaagagtggagcatcttggaggcgaggttgcggcatagggtgcgcgtcatggagctgcagggcccacgatgtggcgccgtagggggtggagttgatgttgtgttggttggtgctgacgatttttccgattgttggtatagatctgagaagaaagcagcgtaa

SEQ ID NO: 80403 - DNA, 282 bp, Glycine max
  Peptide Sequence Number=SeqID_197181
atgggaactgtattcagttatcttcccatatccatggcaactgaacctgctgcagatgactcaatactttcactgctaagggttttctggcccatcttggagaaattttttggctctgagcatatggagaatgggaatttatccgtagcagcttgccgagctctttcactagctgttcgatcttcagcttccattgtcattgaagaatttggtcatctagaggagtacatacctttatttgtcacttctgacgacattccagacattgataagaaaaagtaa

SEQ ID NO: 80404 - DNA, 327 bp, Glycine max
  Peptide Sequence Number=SeqID_197182
atgcccttcagcgtttttggcaaacttctttcgttgacactcgcggaagaaatcttccgcgcgactccacggaagaagaactgcggaagaaccttcttccgtggaattacgcggaagaacttcttctgcgagagtcaacggaagaaggttcttccgtggaattccacggaagaagaaatgacgaataaggccaaaggaaaaggcaaggaggtcgccgaaaaaggttctgccggcaagcgcaagggcgccttcgacgatgacaagactggtggcgaccgaaagagaaacaagcgaggtgtccttcagttttttctgacgatgaattaa

SEQ ID NO: 80405 - DNA, 282 bp, Glycine max
  Peptide Sequence Number=SeqID_197183
atgcacatgaacattgaaattttgtatgatttcaacaggagttgctattggagcagggtggcaaagcattgtagcataagagttgtgcttggtaacgttttgcatttgcaagtcaagggtatttggtttggaatgttgtttggaacatttattcaaactatagtgctaattataatcacctacaaaactaattgggatgagcaggtaattatcgctcgtaatcatattaataagtggtcgaaagtggactctcatcataaaataattccatcagaaaattag

SEQ ID NO: 80406 - DNA, 444 bp, Glycine max
  Peptide Sequence Number=SeqID_197184
atgggtgtgcttgttcagaaggatgcacgtctcctacgtgatttacgaataatggcttatttcaaacagtgcttttctagtgattcaaatatttctacaatcaaggaacttgcacatgccttggcctctcactgtccttatgaagttccaattgcaagcataaagattcgacatcttcattgtgaggtcccaagctctgaaatattcttcagtttgaatgctaccattgttggcttagccgttgattctgaaggacctgaaaatttaccttcgtgtcttggtcttgggattgtgaggggaattgacatagtcaaagctatgctttatgtcattactcccgtgccacataattctctcgaaaaagtcaacgtgttgctacagggttttgcaagagttgtcccaggtttcttgtggtctctaccagccaaaaaggggatcttgtag

SEQ ID NO: 80407 - DNA, 426 bp, Glycine max
  Peptide Sequence Number=SeqID_197185
atggctggtcagttagttatatctgttccctcatctggaaaaaaacgatgttatgacagagttaggtctcttaaaagggaggtacaaagagagattagacaagtctatgaagtttctgaacatagtgaggatttgaaatccactaatggtactgttttccgtgaacccataatatgccacaacatacagagaattgtttccggtgaagaagtaccattcagaacttattctttagttacaggatggaaaaaacccatttgtattggtaggcatgcttttggggaccagtatcgtgccactgatgcaataattacaggatctgggaagcttaagttggtatttggtatgttaatttccaaagccctgctttcaatggatttttatagacaaggaccactgggagttcttataaccgatatatgctga

SEQ ID NO: 80408 - DNA, 1593 bp, Glycine max
  Peptide Sequence Number=SeqID_197186
atggacactccaagctcccactctctcttcacccacatcgcctccagagaactcttccgagttccaaaacgacctcgtatggacggatttgtctccggcttcaacgaaactggcctcctcgccgtacagcacaatgcccaacacaccattcccctctctctctccttctgcaagacttctaaatttggacacattctcgctgtgtccgatgaggagggttacgtcaccttgtttgatactcgccgcaaattccctgttacttcaaactttgaagaaaactcagagaaagtgaagatttgtgattgggtttctcaccataatgctgtttttgatacctgttggaataaggaagatacccagattctcactgcttctggtgatcaaacaataaaagtatgggatgttcaagaacagaagtgtcttggactgttgactgggcacacaggaagtgtgaaatctatgtgttctcatccaactaattctgatattattgtctctggttctagagatggatcctttcgtatttgggacttgagatgcaagtccactgctaagagtaggtgtggagaagttagcatatgttcaatgggaggcgtcaaaggagcacatatttcatctcaagcaagacgaactaggagaggaagggttagtctctgctggattaaggttccttcatattttgaaaaaccaaactttctaacaatttctatttgtcaggctgcttcaatgagcattacatctgttctttgtctcaaggaccaggtttctatagccactgctggggcggtggatagtgtgttgaagttttgggacaccagaaatttgaaaagtactgtcactcagacttctcctagtcctcagtcaactgaaaagcaaacattacatggaatatcaagcttgtcccaagatgaaagtggactttttctttcagcctcttgcatggataatcgaatttatttgtataacactcttcaacttgaaaaagggcctttaaaatctttttctgggtgccgaattgaatcattttttgtaaagtctgcaattagccctgatgcatcgaacatagtcagtggttctagtgatggaaatgcctatgtttggaaggttgacaaacctctggaagatcctactattttgaaaagtcatgatggcgaagttacagcagttgactggtgtagctctgaaattgggaaattagcaacttgttctgatgatttcacagttcgtacatggaataaaaacagttatgtctccagtacacaatgtgcatctgccatccgaagaagagtaatggcaattcctagtatagagtgcaaaatgcttttaaacaatggaaaaaggtactctaagacaaatgaagatgctttcttaccatacgatgcactacacccaattacgtcgcccactccaatcacaccacctaaaatgaatatatctgaaggcaaccaactttcttcaggattagatctaaatgcatcctctgaaaaaactccagaatctgctttgaagagcccctcatctgtattgaaccctccatcctccctaaaaagaactatccgagactactttttagcatcttcaagaaccttgtag

SEQ ID NO: 80409 - DNA, 495 bp, Glycine max
  Peptide Sequence Number=SeqID_197187
atggcctcaagaaagaaagcaagagctgaagacatcccttcatcatccaacccacctcctccaacagcaaccatggaaccagatggcctacaagcacaacctatagttcctatgttgcaaagcctattccgagggcagttgattattgtctacaaccagcagcaattggctcataataagccaatagtatccatggagcaatttttagataaagtggtctggcctgaagctcagctatcgttaggaagatctcccgaggttgtgccccccagtcccataccaacaaggacagagcctgcaccagctgagtcgcaaccaccagtagtagacccaccggcttccccggagattgagattctaccacctccactagctccaccggcaccacctttgatactcattcccgatgactcaaataatgaagttgcagctcctcctgactcaccagcctactacctagaggatggttcagacttttctgactggatggactag

SEQ ID NO: 80410 - DNA, 291 bp, Glycine max
  Peptide Sequence Number=SeqID_197188
atgtcgcggaatttcacaaattgcctaatgatgggtgccaagcacctcacaaggaccaaacaaaagtcgcatgtcatcaaccaaaggtccccggacgaaattaggaagacacctacttatggattcacaaagcctattcagttgaatatctttattgatgatttaagaccgcagtccaagcaatcattagacacttctgctagggggaaaattaagttgaagactccagaagaagcaatggaactcatagagaatatggctgctagtgatcatgctattgttagtcgatga

SEQ ID NO: 80411 - DNA, 120 bp, Glycine max
  Peptide Sequence Number=SeqID_197189
atggccctcggcgttcgcctactcgaatccactcaagcggcgttttccactggtcccgagctgggaagggatgacgatttgtcggtcgtgaccctagcctctatttgcgtccgttcctaa

SEQ ID NO: 80412 - DNA, 1287 bp, Glycine max
  Peptide Sequence Number=SeqID_197190
atggaccaatcggttctgaggtttgaggttgatacgactgcgtgtttatgcagagtagatacaggcctaaaaactgttgcaggagcaaagaaatatgtccctggaacaaagctctgtcttcggcctgacattaaaccatccattcacccaactagaaacaagccagcacgtggtgacagaagccgtagtcaatcccctctacttccaggactccctgatgatctggctattgcttgcctaatccgagtcccacgagttgagcaccgtaaacttcggcttgtctgcaaaagatggtatcgtcttttggttggtaacttcttttactttctccgcaagagtcttggaattgcagaagagtggatatatgtcattaagagggaccgagacgggaaaatatcatggcatgcctttgatcctgtgtaccaactatggcagcccctgccacctgttcctaaggaatattctggagctcttggttttggctgtgctgttctcaatggctgtcacctttacctgtttggagggaaggacccactaaagggatccatgagacgcgtcatattttatagtgctaggacaaataaatggcaccgtgccccagatatgcttcgtaggcggcacttctttggctcctgtgtcataaacaattgtctgtatgtggctggtggggagaatgagggtgtgcaccggtccttgcgatcagctgaagtgtatgatcccaacaagaatagatggtcatttatttcagatatgagcactgcaatggtgcctttcataggagttgtctatgatggtaagtggttcatgaagggactcggttctcatcggcaggttctgagtgaggtctatcagccagagaacgatagctggtacactatttatgatggaatggtttctggctggaggaaccctagctgtaccctaaatgaaaagctctatgccttagactgcaaggacggctgcaagattcgggtttatgatgaggttgctgattcatggagcaagcatattgacagtaaaatgcatttggggagctcacgggctttagaggctgctgctcttgtccccctgaatgggaaactctgtatcatccgtaataatatgagcatttctctggttgatgtttcaaaacttgaagatttgaaaggatcatccgctgaacagttatgggaaaccattgctgggaaaggacagttcaagaccttggtcacaaatctatggtctagccttgctgggagaaatcgactcaaaagccacatagttcactgtcaggttcttcaagcttag

SEQ ID NO: 80413 - DNA, 132 bp, Glycine max
  Peptide Sequence Number=SeqID_197191
atgactaaagatcttgcaattctgattcatggacccaaggtatcaagggaattttacttgaatgcggaggaatttattgatgctgtggcacatactattgagagaaagctccgagagcctgcagtggtctag

SEQ ID NO: 80414 - DNA, 216 bp, Glycine max
  Peptide Sequence Number=SeqID_197192
atggagtcatcaatcacacttgaaacgatgaagtatgcgaagaatttacggaaatgtctgctcatctttagtcatggaggccaggtaacttcagttgagttctcctccgtctgctcagcttcaatcaaaatgacgcttgcacccccacaaccttttgtaacgtcgtcactgctgcgaagaccgagagtgacagaagtttcgatgccacaagagtaa

SEQ ID NO: 80415 - DNA, 303 bp, Glycine max
  Peptide Sequence Number=SeqID_197193
atggctactgctaggtgcacccagcaaaattgctggtgcacccagcaattacatgaagtgaccaaaatgccccttaataaaaattataaaaaagaaaaatttgaatggtactctgcattcgttccatttcttctacacgcctgtgctgactcctttctcccgccaacttcgagcttcgtcttcttcttccttccagaggaccttagggtagatgatgtgaacctgagtaggagcggatcgcttgatacaggttacagagtttggatgacaccacttccggtgaaggaagataagtcaagatag

SEQ ID NO: 80416 - DNA, 234 bp, Glycine max
  Peptide Sequence Number=SeqID_197194
atgggatgttacaagggagggtacatctcctgtggatctttgcttgtaaaggattttacaaggttgaaaagaaatctcaagaaccgcaagtcgcttggggactgcatgttgtgtttgaataagcaccccaaagtggagatttggtggcacagtctcaatgctcacataactcaaagtgcagctgttgcaccagtgagaaccttgatgacatgtgttccagctttgccacaatag

SEQ ID NO: 80417 - DNA, 241 bp, Glycine max
  Peptide Sequence Number=SeqID_197195
gtacacgatgaattcggttataacagtgttgtatttcaatggaaggatatatgaagataatgatgatgtaatatttgaaggcagtaaaaaagcgattcagattaaacgtggaattagtttcaatgctttgaagaaaaaaattggagacaaggaaaatatattgctttgcaaatttgcgatgacgaagacgttgaaacgatgctggaaagttttaaacaacaacaagaaatgtcagttctag

SEQ ID NO: 80418 - DNA, 387 bp, Glycine max
  Peptide Sequence Number=SeqID_197196
atggtttggtgtatggattccttgagcctcagtccatatacaatacaaaagatagacgtgcttaatgtcaacattacatcgaaacatgggttaaggaatcccaaagagagtgcaatgatgacattaaagactactttggatggtcaatctattcaagttgaacctcaatggattaaagtaaagagtcatgtgctaagtggaggctatgagtgtggctattatgtcatgcattggatgtggaacatagtaagcggggagttgaagaatgattggaccatgtggtttgatgatggcacgccattaaacatcgagaccatgacaacaattcggaagaagttggcagcctattttttaaaagttaaaaacatatgctctagaaagctttag

SEQ ID NO: 80419 - DNA, 474 bp, Glycine max
  Peptide Sequence Number=SeqID_197197
atggaactgatgaccaccttcagtcagggcaagttctcgaggagtttcacaataagccatagtctcgacaccacacctcaaaatgaagttccctaccttgacaggagaaattgtcactatcaaggtagaccagaaacaagttcgacaatgctatgcccaaagtttgaaggtggtcccttatcctcctatcagagagccaggaaaaccttatcctccctctggggcagcaacagtcaagtcatgagcattgtcgaagaattccaagtaaggaccttgtctgtctatgagacaaccatgggaaaccttagtgacacattcaatgttgaccctcgagacgacaccatcgaaaaaggccctagaccaatagaagagctctccaagctacaagttggacctaagcctggaaaatgcacgcaactcaggaaagacctcaccatccatgagcacaggtatcatggcattcgtaccatatga

SEQ ID NO: 80420 - DNA, 1452 bp, Glycine max
  Peptide Sequence Number=SeqID_197198
atgaaagaagctgtagttttctaccctgcacctcttataggccacttagtctccaccatagagctatgcaagttcatcctcactcaccaaccctccctctccattcacatcctcataaccatagcaccctacgacacatcctccacttccaactacatctccaccgtctccaccactctcccctccattactttccacaccctccccaccttcaatccccccaaaacccttctctcttcctcactcaaccacgaaaccctcttgttccacgtcctccaccacaacaacccccacatccaccaaaccctaatttccctctccaaaactcacaccctccatgccctcatcgtagacatcttatgctcccaatctatcttccttgcttcacaactcaacctccccgcttaccttttcgccacaacaagtgcttcactcttaggtgcttttctttaccacagcacactccatgaaacctaccacaagagcttcaaagatctcaacaacacctttctcgacatccccggtgtccctccaatgccagcgagggacatgccgaaacccttgctcgaacgcaacgatgaagcctacaaaaactttctgaattgtagtcttgcagcacccaaagccgcaggctttatcgtcaacacattcgaagctcttgaaccaagtagcaccaaagcaatttgtgacggtttatgcatacccaattccccaacctcacctctttatagttttggtcctctagtaaccactactgaccaaaaccaaaacaaaaacactagtgaccatgaatgtttgaggtggctggacttgcaacctcgtaagagtgtcgtgtttctatgttttggaagcttgggtgtgttttctagagagcaactaagtgaaatcgctattgggttggagaaaagtgaacaacggtttttatgggtagtgcgaaaccccgttagcgaccaaaagcataaccttgctttgggaacacaagaggaccctgatttggaatctttgctaccaaagggtttcttggacaggacaaaaggaaaggggttggtggtgaaaaactgggtcccacaagcagcggtgttgaatcatgactcggtgggtgggttcgtgagtcactgcgggtggaactcggtgcttgaagcggtgtgtgctggggtgccattgattgcgtggccgctttacgcggagcagaggttcaacagggtggttctggtggaggaaatgaaggttgcactgtggatgcgtgagtctgcagtgtcgggttttgtggcggcgagtgaggtggaggagcgagttagggagttgatggaatcggagagaggtaagcgagttagggaccgagtcatggtttttaaggacgaagctaaggctgctacgagggaaggtgggtcttcgcgcgtggcattggagaaacttctcaagtcatggaaagtgggtcagttaagtgaatga

SEQ ID NO: 80421 - DNA, 591 bp, Glycine max
  Peptide Sequence Number=SeqID_197199
atgtggtttgaccacaaggcctgtaggaacttggtcaagaacatttggtctaaacaggttgttggctgccccatgttcgttctaaagcaaaagttaaataacttaaagatttcactgaaaacttggaactctgaagtttttgggaatgttcacttgaaagtttctttggtcgttgataatctctcaagcatccagcatcgcattcaagaggacaatttgaatgatgaactttataagttggaagcttcaacccaagtcaatcatcaacaagccttgttttttgtgaaatccttctggaaagaaaaagcgagaacctgcaaccacattaacttccttaagattgatgggatgctcacccaatctcaggaccaaattcagcagcatattgtcaattactatagcaacctatttgcatctgacaatgacattacagacaatgattttgttaggccaaggagaacgatgaacatcaaagtgaacgaccaggagctagacagtcgtaacaccactgtcctcgaagcgccaacccgtgctggtcgtggtggtggtggagatggtggcgggtgtggcgggggacatcaacgccgatga

SEQ ID NO: 80422 - DNA, 543 bp, Glycine max
  Peptide Sequence Number=SeqID_197200
atgtgtgtgagaggtgttgttttcgtccatggtattgttggtctatcgaggcgacaactctccttgggcttggagttgtcggagtggatcgttgttcatcatggtggtcatcgaagtagggtggccacggggggagttttattgcggccacacggtaggcgccaaatgcacttgctaaaatttggagtcgatctaacgtcaaagttcaccatcgtcaatgttgacttcggtgatctttgtagtggtgaatttgttggtatccttcgcctgagtattggggagggtgtacctgcaaaagggactctaatgctcaaggaaaaaaaagattttgggacaagaagaaagaaaaacgaaattgagaggaagacaaagcgtacaaacgtgaatggcaagccttgtttcatggttgttatttacggttcaactagttgcactcttaggaagcatctttggaaacatctcactgatctccaatataagcaccctggctcttggacttttattggagatttcaacgcgaccctcgaagcccatgagaaatag

SEQ ID NO: 80423 - DNA, 150 bp, Glycine max
  Peptide Sequence Number=SeqID_197201
atgaaagaagatgatggagaatgtcttctccagcctctcaaccctaaatctcccagtttttcacgaagcgagcttgggcgtgctaagcgtgagcagagacaacgtcctcgctgggtgggctggctgcacgctgggcgcacagatctctga

SEQ ID NO: 80424 - DNA, 324 bp, Glycine max
  Peptide Sequence Number=SeqID_197202
atggcaccgaggaagctctccgcaaagagatctaggagggacgccgaggccgaaggaaccagcgccgctcctgagtttgacagccatcgtttcaggagtgtagagcatcagcagggttttgaggccatcaaaggatggtcgttccatcgagagagacgcgtccagctcagggatgatgagtacacagattttcaggaagagatagctcgccggcgttggacgtcgctggtcactcccatggctaagtttgacccagatatagtcctagagttttacgctaatgcttggcccacggaggagggtgcacgggacatgcaatcatgg

SEQ ID NO: 80425 - DNA, 270 bp, Glycine max
  Peptide Sequence Number=SeqID_197203
atggcggagaaaaaggaaatgtacattgaaaagaaggaggaaatcgaaagaggggcttctcacatagaacacctgactttacttgaagggatgaaaaacatgctcacccttggtaaactctcagttctaacccagacaacgtttgtccatgctggagggcttgacaagcccgcaacccttaaatttgtcaaggttgccaccctcaacattggacaaactctttcgccaaaaagtttgactcagagcttggggggattttgtactgtctag

SEQ ID NO: 80426 - DNA, 601 bp, Glycine max
  Peptide Sequence Number=SeqID_197204
atgcatgttcgaggtcctaaaattgactcttccactgaacacattccaatgtggcacttgaacatggttccttcccaacttcatcccaacaactgggtgatgctgaccgggaagattggttgggtgttgttaaacagtgcgtccaagaagatgtttgagttcgactcaaacatgtttcgtatattcaaggactgtttcttcaaggtcaaggtaggacttgttggagatgatgtgccttctcctcccccatcattcctaacccttgtgccggggaaagaggatgaggttgttgaggttacactcgatgtgcctcttcttgcaccaaccaagaggaaacgcaatgaaggggttgaggggtctagtcagcgtcgtcgttcccctgccagctcccaaagtccacctttagccctcttagttgttcaagttgctattgctaccgtgcttgtttttcatccccttatatctttgtctctgcctattcatgtagttcttgttccttcttccactgcatcggccacgtcagccccctcggtggttcctatttctactcctccttcttctgttacagtgccactgctaagtgctggtgtgacaatagcag

SEQ ID NO: 80427 - DNA, 333 bp, Glycine max
  Peptide Sequence Number=SeqID_197205
atgattggtttcgtccagcctaggtctgggaggaggtatgggggtagctgtatgggtatctctgcattaaaggcttcttcaagaatggtggctcaatttgctatcaaggtgcgatcagctcattgcatactgggaactaaagtgttcgacaagagtatcaaagttgtcaatggaccagggaaggagtcctccataccacgtcaatgttgcccctatgagggacattggaaagactcaacacaagattgcatcatcattggtgtagagattagcctaagtgaggaaaacatccaggtgctcctctggatcagtagttccatcgtaacgctttag

SEQ ID NO: 80428 - DNA, 645 bp, Glycine max
  Peptide Sequence Number=SeqID_197206
atggcagacttcctagcaaaatttattggcgacattcgacctacccaggatagatggaacttgtacgtagatggcatgtccaatgagaaaggaagtggggctagtattatcctagaaaggcccaataatgttactttggagcgggccctcaaatttaattttatggcatcaaataatcaggccgaatatgaagcacttatagaaggcctaaaactgcaagacaagttggggcaaggaaactcagatgctacaatgactcgcagcttgtccaaggatagggaaagcaacactagagcaaaattgctctctaagttggcaagcactaagaagactggacacctcaagaccatcatccaagagacactccaagcaccaaccataggcatcgaggaggtcatggcaggtgtcgcaacctacccttcgatgggagggcgaggcgaaaagcaaaggtgcatcttccaaaaaggagaacgcatgggagtcgccaccaacgtttattcgaggaaaatgttagaaaaaccaaaaagaggtttgcgaatattgaaaagaagggttcgggagttgtttacgcatagggaaggtattagcaccctacgcgcccgtcacaagggacgacaacctttaatcaagtgtgcaaaaacgtga

SEQ ID NO: 80429 - DNA, 639 bp, Glycine max
  Peptide Sequence Number=SeqID_197207
gagccaagtcttaggtttgatgaagaggccataggccagctactatgctccccgggacatgattttgcatggagcgtagcgaggaggcaggtgtggatcatgcgcactagcatgaccactttgactcagatctggatgacgcttctgctcagcaacatccttcctaatgactataattctgatcttccgcttcctaaatgccaattgttcgacgctatcttgacccagaccagtgttcatgtagcacgacttatctcagatgccatctaccagtttataggtattgcacctctgagacacccagtggacccagagaagtccaataagggattgggattttcagcattgatcacaggcctctaccagttctacgggcagcagccgacaacagatgtgccatcatcgcctccacatcagccaccatccctagagtccatctcaactcacatgcagaggatggagctccagatgcacacttacatgcagtatttggctgaccaaaccactatcgcatggcctgggaacaggcctaattttcaaggaggtgcaggtcccacagaggcccaaggagatgaagacgaagctgaggaagatggagatatggaaaatgtgatggattttttccttttaggagactga

SEQ ID NO: 80430 - DNA, 303 bp, Glycine max
  Peptide Sequence Number=SeqID_197208
atgaaggatacgactaacaaaataaatgggaatttggtgtttcctatcttcctaggagaaggtcgagctgatggccttttctatcatcgaaagtatggatgtgcacttgtcaaagttagcttctattccacggtgggtaattatgaatcgtacaaaatttctgtcgccaaccccaaaggtgcatttttcaaggttgaggtgcatgtcatagttttgaatttctctgaaagcctcctacaaatctgccacatgttgggtcacgctgtgagacttgaccaccattttgtcctatttgttgtttga

SEQ ID NO: 80431 - DNA, 411 bp, Glycine max
  Peptide Sequence Number=SeqID_197209
gatgtgcggaaaaaaacacaagccatccagaagcaaaacactgccccccatgtgttgtctcatcggggttatgaatatttacaaaagaagctgatggatgagaagacaaagaaaaaactggaggaagctgctcaatccggaagcactgacaccctgattgatcctctttctcccatcagacgacacgtcaaatggaagatggcccgcacgaagaaaactggccagatgacgtctaaggcaacaaagcaaattgctaacaagattgatgtactgactgctgccattgggcgaccagaacaccccggtcatttgcgtgctactggagctggtgtgatgatcaagcaatactttggaccggctccaaggacctcccgcacgtcttcctccatggctcccgaagacctagaatag

SEQ ID NO: 80432 - DNA, 564 bp, Glycine max
  Peptide Sequence Number=SeqID_197210
atgtcttccatcttccgctggcatccgcgaaagaaacgttcttccgcccgacctccaacggcacattcacacacgcggaagaaggctcgtcttctacctcgcgcaaccaagcccagcacagaccaaacatgtcttctaccctatggccatcataagcgattaaaggagaaaaatgaggttagaacactaacctatagggcggaacacgaatgcaaggcaggttcaaagcttcaatcggccggcaatggaggacgacgcgcgcgtggagaggaagaagaactcgaacctggacgcaaggagctttggtcgcggaagaagaagaactcgaagctggaagaagaagagcttttggtcgcggaagaagagtttgaaccgggcaattatgttgatagaacacgatggttcagtacaatcttaagaagattaccgttgtgccaaatgggaaggacgtggtcgacatcatcctctctcgcacccagcgtcaaacaccaaccgttgtgcacaaatgtatttttactatcagaaaaagatgaaattgccacttcttggttgcaccatgtctaa

SEQ ID NO: 80433 - DNA, 231 bp, Glycine max
  Peptide Sequence Number=SeqID_197211
atgctggtggtggtgcgaaccatcgtgaaaggctatttcggtgaggaaggacttgccattgacatatcgttgggtgttactatgggatctgcaactcaaatttctatgtttgtggatggaacttcacgctacatgaaaggagttactctctgttacattgtcattggagcatggcaatctcctaaggacagttttggagctaaaccatcctttgaagccatcaccacttaa

SEQ ID NO: 80434 - DNA, 210 bp, Glycine max
  Peptide Sequence Number=SeqID_197212
atggattgtaggtgcaagttttataggattttatcaacaccaaaaaaacaatgtaaagctcgaagaaacaagattaaagatatgaagctgctcgctgaacgtgatgcaatcgcgcttagcgtgagtgacgcgctaagcatgagattaccgccattctcgctaagcgcagcaatcgcgcttagcgtgaaggttgtgcgaaaaccaagataa

SEQ ID NO: 80435 - DNA, 306 bp, Glycine max
  Peptide Sequence Number=SeqID_197213
atggccttgtcggccgcgattgacgaagggcgccgaagacgacatagcaagaagaatttttatacggctaaccactcgggtatttccgcctctcatcgtgactcaaatgtcagtatgacagatcttgtgagcgcggaagatgacgtaaatctccgcgtgtcaacgtgcttgtcggccgcgtttgacgaagggcgcagaagacgatatagcaagaagaatgtttatacggctaaccactcgggtatttccgccggtcagtgtgactcaaatgtcagtatgacagatcttgtgagccgcggaagatga

SEQ ID NO: 80436 - DNA, 297 bp, Glycine max
  Peptide Sequence Number=SeqID_197214
atgcatcatcaaaagaggaaaactctaaatgagacttcactattatcaagtgagtcggagacccagcatgaccacagatcgacctccactccctctatctcacacagacccaggcttagcgcaacattggcgctgagctcaaattcacttactcgcgctaagcatgagaatggcgctaagcgtgacgttgagatcaggaagccctttttaagcctgatttgcacagaattgaaaggggagtcaagagaactgtacactactcagaagcctgaagagtgtgaatttcagatagcgtag

SEQ ID NO: 80437 - DNA, 237 bp, Glycine max
  Peptide Sequence Number=SeqID_197215
atgaagtcaggtaacgtacggagatacccaagcagttatccgtacaaacggtttctgtcatccagacccgtgaagtcaggggcaaacgaacttgttgacacgcggagacttacatcgtcttccgcgccttctgtcatcctgacccgtgaagtcaggcgaagatacccaagtggttatccgtataaacactctttcgctatccgtcagactcagagtccggtagcatgcagagactaa

SEQ ID NO: 80438 - DNA, 396 bp, Glycine max
  Peptide Sequence Number=SeqID_197216
atggcattcttgggagagacaagcattcagacagttgtgaactccacattaggttttatttttccaaatggatccattgttcacaacgacagtggtgtttcctttcaagcttccactccagttcccattcaattattatgtagcattgctagaaccccatatggtattttaaacttacttcaagctactatgacccctactcatgatgccctgctatattacaatggaaggtggaacatgtcacgccaaaatgagtttgttggttactcgttcacaggaaaaaatcccaaaaagtttgacattcccactggatgtatcatggatgaactgaaggatttgatcaagcaaattgcgcctactgggattcccccttatggtattgatgaaacacaaatg

SEQ ID NO: 80439 - DNA, 207 bp, Glycine max
  Peptide Sequence Number=SeqID_197217
atggtagaatccttcacaacagcagtagcaacagcaatagcctcagaaacagcaaacagtgaggtccctccgcaaccttccctcgaaagaacttgtgaatctaaagacaagcagcatatccctcttccattccctccaagagcaatttccaacaaaaatatggaagaggcagagaaggagatcttggaaacatttagcaaagtagag

SEQ ID NO: 80440 - DNA, 1046 bp, Glycine max
  Peptide Sequence Number=SeqID_197218
catctaccccacatgagccgcgccgccagtgggaccagtcgctgcagaccatcaagcagctgtgcgccaagcacaacgtggagctgatcgcgatcggcaacggcaccgccagccgcgaaaccgacaagctggccggtgaagcgatcaaggccgctggcaacccgaagctgcagaaggtggtggtgagcgaggccggtgcctcggtgtactcggcctccgagttcgcggccaaggagtttccgggcctggatgtgtcgctgcgtggcgcggtatcgatcgcccgccgcctgcaggacccgctggccgaactggtcaagatcgaacccaaggcgatcggtgtcggccagtaccagcacgacgtggatcagtaccgtctggcccgggcgttggacgcgcgcgtggaggactgcgtgaacgcggtcggcgtgtacgtgaacaccgcgtcggccgcgctgctgtcgcgggtgtccggcctgtcggccacggtggccgagaacatcgtgcgccatcgtgacgacaacggcccgttcaagcgtcgcaaagacctgctgaaggttgcgcgcctgggcgagaagaccttcgagcagtgcgccggcttcctgcgcatcgccgacggtgatcagccgttggacgcctcggcggtgcacccggaggcctatccggtggtcgagcgcatcgttgccagcaccgcgcgcccgatcaaggcgctgatcggtgatggcagcttcctgcgtggcctgaaagcagaacagttcaccgacgacaccttcggcgtgccgaccgttcgcgacatcctgaaggaactggaaaagccgggccgcgatccgcgtccggagttcaaggcggcgcgcttcgccgagggtgtcgaggacatcaaggacctgcgcgagggcatggtgctggaaggcgtggtgagcaacgtggcggcctttggtgctttcgtcgatatcggcgtgcaccaggacggcctgatccacatttcggcgctctccgatacgttcgtgaaggatccgcgcgacgtggtcaaggccggcgatatcgtcaag

SEQ ID NO: 80441 - DNA, 288 bp, Glycine max
  Peptide Sequence Number=SeqID_197219
atgcggaaattgattaaggaaaggatggaaaataaggtggttaatttcgtgggtcttaataaggtggtttctggcataaaatggatgaatgggatgaaatatagaaatggcaataacggaagctacagggctccaaatgaggtgattccaaaacgagaggtggattttctggaattgtggtttgaaagaacaagggtggagatgataggaaggaaagaatcactctttccagcgagggcaacacacaaaggttgtgaaagtcctttgatacagccaaggtgttcttga

SEQ ID NO: 80442 - DNA, 174 bp, Glycine max
  Peptide Sequence Number=SeqID_197220
atgggagtggattttgtggccaatttaggggtggcctttgtggctaattgggtggccttggttggtagggtggtgggtaatgggctggactattgttggatgagtagtgatatatctggggaggatattggtacatgggattataaggggctagtgggaaatttggccatgtag

SEQ ID NO: 80443 - DNA, 327 bp, Glycine max
  Peptide Sequence Number=SeqID_197221
atggctccagatagaatgcaactacaaaatatatgcaagagagacaatgaatctttcaaagaaaatgctcaaaggtggagggatctggcagctcaagtaatgcccccgatgacggagagagaaatgataacaatgataatggacatattgtcggtgttctactatgagaagatagtaggttacatgccttcaagttttacagatttagtgtttgctggcgagaggatagcagtgggtctaggacgagggaaatttgattatgctgctattacgggttctagtaatagaaaaattgggatgggtggagggaagaagaaggagggataa

SEQ ID NO: 80444 - DNA, 768 bp, Glycine max
  Peptide Sequence Number=SeqID_197222
atggtggcaattggcccagcaaagattcctcaacctccgtttcttagagggtacaacccaaatgtgatgtgtgcttatcatggtggagctctggggcattccattgagcattgtatggccattaaacataaggaagacaatcccaatgtgcaaactaactcgctcgtaaaccatgagagttcttctgtaaatgctatagaaaatgaggaaatatgggaattgaagagaggggtggaggacatctcaacttctaagagatttatcttgaaggcattgtgcaaagctggtatggttgactacgagggcgatgaggaggatcgatgcccgttgcatcccaagacacttcatgatgtggaagaatgtttagtgtttaaggaacttttacaggatttgatgaatcacagccaaattaaaattagtcatagaaggaaggaggaaggtaaggccccatcatcattcccgtatgataatagcaaagcaataccgtggagatacgatgtacaagtatcaaagggaggtcaagaggtatccctcgtgcatgatgggcataacgcgtcaacccctaaagtcacaaacatttttggcatcagtggcatgacgtgtagtgggtgtgtttttacaactcccgatttgcgagctgaatcaaaagataagggtaagagttaccaattgaagggagggggcataataaggccctgcatgtgtcggtcaaaatatggggattatatgggtggccaaggtgcttgtggacattggttcttctcttaa

SEQ ID NO: 80445 - DNA, 417 bp, Glycine max
  Peptide Sequence Number=SeqID_197223
atggttgccttcattaggcagtatcagcataattctaatatgtctccggatagaatgaaactacaaaacatgtgtatgaagaagcatgaatctttcaaagtgtacgcccaagggtggagggatctggctgctcaagtagcaccctcaatgatggagagggaaatgataacaatgatagtggacacattaccggtgttctactatgagaagatggtgggttacatgccttcaagctttgaaaatttagtgtttacgggtgagaggatccaagtaggcctaagaagaggaaaatttgattacgctgcttcgatgaattctggtgataggaggcctagggaaaatggagggaataagaagaagggagaaacccatgttgtggctgctgttcctacatggccaaattttccattagcctaa

SEQ ID NO: 80446 - DNA, 727 bp, Glycine max
  Peptide Sequence Number=SeqID_197224
atgggatctcttcttcatcttcaagcattgctattgagaaacaacaacttaacagatgagatacctatctccttgaggagttgtacaaatctagtaatgctagatatttcagaaaacagattatcagggcttatccctgcttggattgggagcgaattacaagagttgcaatttttaagtttgggaagaaataatttccatggaagtttaccattgcaaatttgctacctaagtgacattcaactcttggatgtgtcactaaaccgcatgtctgggcaaattcctaaatgcataaaaaattttacttcaatgactcaaaagacatcttcaagagattatcaaggtcattcatatcttgtcaataccattggcatttattattattatacatatgatttgaatgcactcttgatgtggaaaggttcagaacaaatgttcaaaaataatgtgttactacttttaaaaagcattgatctctcaagcaatcacttttctggagaaattccactggaaatagaggatttatttggattggtttcattgaatttatcaagaaaccatttgaccggagcgattccttcaaatattggaaagttaacattacttgactttcttgatttgtcaagaaaccatctaattggttcaattccatggagtcttactcaaattgatcgactcggcgtgttagatttgtcacataacaatctatctggagaaattccaactg

SEQ ID NO: 80447 - DNA, 216 bp, Glycine max
  Peptide Sequence Number=SeqID_197225
atgcccaacgaacacctagttgtgtggatttgttcattgcataacaagccagacaactaccttaagaggataattaatagtgctttaaaaggtcttgatgatgctccacagcctaaatcaaaggctcctgctaggtggattgtcatcaagaccattggagccagagagattaaaggcgttgcggatctagtgggcacagtattatctccgagttag

SEQ ID NO: 80448 - DNA, 264 bp, Glycine max
  Peptide Sequence Number=SeqID_197226
atgtttaaaagagggggaggggaacattttctgcactcaaaaactcccccccccccattcaaaaaagaaaagctcacgggaattaaggggttttcacccctacgccaccatttttgcgcttttgcttccattcttagtgttgttactcactccatcaaggatggccttaggcctagggtgcatcctgaagcaatggggcatgccacattgcccccactctcttgctattcatgccttaacatgcgcccaccaagtgctcggtga

SEQ ID NO: 80449 - DNA, 498 bp, Glycine max
  Peptide Sequence Number=SeqID_197227
atggaggaagcttctcaattcggaagcattgaggccgtgattgaccttccatctcccatcagatggcacgtgaagtggaagatggcccacacaaagaacactggccaaatgacgtctgagtcagcaaaggaaattgttgagaagattgactcattggaggagcaggcgtcacagggtttctttgtccctcatggacgtcaagatgtcttgactgctgccattgggcgaccagaacaccatggtcgtgtgcgtgctattggagccagtgtgactgttggatttcccttgcagttactttttggaccactttttctttatgcaaatatgttcaagggaaatccggtttgccggaaagcacaccagatcgtcaagtatttaaaattaaaatggatgaatccgagtatcaaactcatggatctagtcttagacagggttaaattcataaataaggcattgttgaaagaaacattgataattgatgatttagaacagaattaa

SEQ ID NO: 80450 - DNA, 258 bp, Glycine max
  Peptide Sequence Number=SeqID_197228
atgagccatgggcgcctgtatcaacaaagaatgaagaatgtgttcgacaagaaggggcagaatcatcttaggccgtggtcagatgtcgggactaagctgaaggcagaaaccaatcaaggtaagacggtacttagggacagacgcaagtataggctagggtcacaaccgatagatcgtcatcccttgcctagctttggacaaacggaaagcgtcgctgcaaggcagcctaacttgcgctcccgattaagggtccagtag

SEQ ID NO: 80451 - DNA, 228 bp, Glycine max
  Peptide Sequence Number=SeqID_197229
atgttggccacccattccgggtatcgcgccacagctaagaaacctgcgtcaaactgctaccttacttcttctttaatccccagtggagtcgccaactgtcgcaacgtgccctacgcgggcgagcgagggcgaggctcatgggtgcgctttaggaaagatgcgcggagtcgccaccaacgtttatttgtggaaaacgtcgggaaaaccgaaggaaaccggtcaaaatga

SEQ ID NO: 80452 - DNA, 348 bp, Glycine max
  Peptide Sequence Number=SeqID_197230
atggctaaatcagtacttcatgatgacgcaatggtacaactcctgaaagattctccggatttcgcgcccgtctatcttcaccaggctttcattgaaattgacgagccaggaggctatgaggcgttcatgctcgccttacggcatgtgatcgaagcctctggcgggatgactgttattgcaaaacgtgctggcatttctcgcgaatcactttataaatcactctcaccaaacggtaacccctcatttaagcgtatcgcagaagtggcatctgcaacgggatatccgatttctcgaattgcaacagcagggttaaacgataatacaaggccgcatcaggcggccttgtaa

SEQ ID NO: 80453 - DNA, 231 bp, Glycine max
  Peptide Sequence Number=SeqID_197231
atgggtgttaaacattttgaggcggtcaagagaaggtcgcatgccaacaaacaatggtgcccggacgaaattaggataggtggcctatggatggagtttccttcaggaaacaaagaatttgaggaggccatgaatcttgaagttgtgaaacttttctacaagatacttgctctgataccacttgttggatcaagtggcctcggaataattaagaagggggggttgaattaa

SEQ ID NO: 80454 - DNA, 636 bp, Glycine max
  Peptide Sequence Number=SeqID_197232
atggcagacaattctcaagcagcatatggtcataggcaacaaccagtagaacaacatcatgcctggcagatgaatcagaacatgtctcttgttgatcccaacttttcttgtttttctaattccaatgtccaccactacgccctccataagaacgttattcaacctttagcctcatatcctcaaagcttggctattgtgtttgatcaacagagggagattgatcactgtatcagatcacagaatgaaaaattgagtattttgttgcaagagcaaaggaaacagcatgtgtcagagttattgaagaaggtggaagcgaatgctcttcatttgttgagacagaaagatgaagaaattgcccaagcaacaaagaaaaccactgagttgaaagaatttctgacaaggttggaggtggagaaccaatcatggcggaaggtagccgaggaaaacgaggctatggtactgtctcttcataacaccttagaagagatgaaagaaagagctctgtatagggtgacagcagaggatgcagagtcgtgttgggatgaaaacatgagaaacagggcaatggaagaaggaacgggagaaaacagattgtgccgtggtggtggggtggaagaggcacctctgttcgtgtaa

SEQ ID NO: 80455 - DNA, 638 bp, Glycine max
  Peptide Sequence Number=SeqID_197233
gccaccctgagaagattctcaggaaagatttaacaactcttgctcgggtgtggagtgttctctcatactccaacctggctcctacttcccacacctcagacctgacagtagatcgagataggctgatctttggcctagtctctcagatggacatgaatgtgggagctctcatctctagtcagattacatctatggcccagtctaactcttctagacttaggttccctgctcttatcaccgctttatgtaagtccagaagggttgcttctgacagcctagtcttcaaacacctgagcctggtcattaacttggcctatatcaagaaaaactattggaaccctgatgaaggtcccacagcccaggtaccacagcagatgaagaatgagtcatccaagactaccactccaaagcccttggtcagaaggaagaaggcagatgaaacacaagaagctgtagccacttctaagaaatctcttgaggccacatctaagccttcagaaccagtggcagatacaacttcacctcagcaggcagcagacccttccactgctgaggatcatactacaccagtcctgtctccgaacacctctcctacggctacccttgtgcttcacttaacagacgaggaggatgtttag

SEQ ID NO: 80456 - DNA, 294 bp, Glycine max
  Peptide Sequence Number=SeqID_197234
atgttgcatatttcaatgaacgttgccaagtgtgcatatacagctattaggctcagccttttctcattctcattggcaggagaagccaagaggtggctccacacattcaagggtaacagtctgaaaacctgggaagaagttgttgaaaagttcctaaagaaatacttcccagagtccaagactgcggaagggaaagctgcaatctctttatttcatcagtttcctgataaatctctgagtgaagcattggagaggttacaggttgtaccatctgtggtgaggctcatgaaatag

SEQ ID NO: 80457 - DNA, 417 bp, Glycine max
  Peptide Sequence Number=SeqID_197235
atggggttgtgtggtggtgacaatgaggctaaagagggaggctggttgacagggtctatgaaagtgaaaaggctagagaggggaggctggttgacaggacacgccgacaacaacatggtggaggaggtggatgacaactttgcatggggaggtggctatttggttggaggtgtggtggttatggtggttgatcgtgggaaaaaggtgggaaccacaatgttgcatcttgttaccacacctgttcttatgcccccacatgtccccaatgtttatggagaaattacggttgattggtccttagtcaagcttcaattctatggccagaacatggaatttgagagggtcactgtggataaagagcatttttttcatcacagttcctgtggtttatccacaacagccaaactcaaatactag

SEQ ID NO: 80458 - DNA, 726 bp, Glycine max
  Peptide Sequence Number=SeqID_197236
atggttccctctgcctttctgttccatttcctcttcttcttttcactcctcatctcgttttccttctccgattccgattccgattccgattccaattccgtaggccccactttccaccgcgtgttcccgcggccgctgatcgtggagtacccggagttcgaggcggggctgcggtgcggcgcgtggcgcgtggcgggggaggcgaacaacctgggcgcgtggaggacgattccggaggaatgcacggagtacgtgaaggagtacatgaccgggaaggggtacgcggtcgacctcgaaatggtctccaaagaggcggaggagttcgcgaggagtgtgcctctcggcagcgacgggaaggacgcgtggattttcgacatcgacgagactctcctctccaatctcccctattatgccgcacacggatacgggcttgaggtctttgaccacgagaagtttaacaattgggtggagaagggtgtagctccagccattgaacccagtttaaagctctatgaagatgttttgaatctgggattcaaggttattctactgacaggacggagtgaaaggcacaggagtgtcactgttgataatttgatcaatgctgggtttaaggaatgggaccagctcatactaaggaggaatcttgcaaacaacccattgattccagcctccttttttcgatggacagcagaatctgcttacctgaaatcatcttggcgctaa

SEQ ID NO: 80459 - DNA, 275 bp, Glycine max
  Peptide Sequence Number=SeqID_197237
atggaggaattgttgggttgggttcccctcttaggagaatcgaaagaggggaaatgtaaaatgaggagaaaaggaaacgaagagaggggaaatgcaaatttaacctatggagaggagagagtggcgggacttaacgacgacgtaacgtgtgatagaggagaacgcggtgacggagttttggaatattccgtcttcagcgtggaattgaattggggagtacgaaaacgtggggttggtttggttggacggtggactaaggaagatactgaaaaaag

SEQ ID NO: 80460 - DNA, 340 bp, Glycine max
  Peptide Sequence Number=SeqID_197238
gaaaaatgccataactaaacgcgccccaaggcatccctatcgcactagatccaaatctaggacgatgggtgaccaagaggagatacaggaacagatgaaagccgacatgtcggctttgaaagagcaaatggcttccatgatggatgccatgctaggaatgagacaacttatggagaataacgtggccaccgctgccgctgttagttcgactgtcgaagcagacccaactctcccagctactgcgcatcatcctttcccaaacatggtaggacgagaaagaagcacactggggcacatcagcaacccccatcagggatacaaccgagtggcttacccttaa

SEQ ID NO: 80461 - DNA, 252 bp, Glycine max
  Peptide Sequence Number=SeqID_197239
atgggttttgaacatcagaggatcattgatctatttgaagaaaacaagcctataccatatcagaatgtctgcttgcaagtgatggagggtgataaggagatatttgggctagctaagctgatcatgggtgagctaagcgaaattcagctcggtctgaattgggctaagccagagccatccgctaagcgtgtcatgtttagtggcttagcgcaatcaccatgcgctaagccctattctttgcggcctatatag

SEQ ID NO: 80462 - DNA, 199 bp, Glycine max
  Peptide Sequence Number=SeqID_197240
gggaaggagtgaagaacaaaagggttcagccttcttggcacttcttattctctcaaaattgctgaggaaaattgtttctgtgaagaaatccaagccgaggcacttccgtaacgtttccgtgagtaattacgcgaaggttttcaaccgttcttcgacattcatcgttcgttcttcgttttcttcagtcttcaactggtaa

SEQ ID NO: 80463 - DNA, 1392 bp, Glycine max
  Peptide Sequence Number=SeqID_197241
atgaaggagacacttcgtacgcagcagcaacttctggaaaagctatatgctgagttggatgaggaaagagaagcttcagctaccgcaacgagtgaagcattggacatgatactgcgtttgcagggagagaaggctgtggtgaagatggaggcgagtcactacaagagggtggcagaggagaagataggccatgccgaggcctctattgaggcttttgaggagcttatgtaccagaaggaaatgcaaattgcgtctcttgagtttcaaggccaggcttatagactcaaacttatgagctttgggtgtgaaggttttaatgagtttgagttcctagaggatctgctgttgaagaggggtgatcaaagaaatggagaaaatgggggtaggggtagcactattagaaggctacattcaatgccccccattcagtttctgagttccctgactgctgcaaagagggaaagatcaactagtccagttcttgatgtgattcctatgataatggaggagagtactgacaaggaagttgctcaacctggcttggatttgacacgaaaattagttgactttgcatgtggcagtggaactcttgattcatatttgaacaagataaaggagtcggatgaacaggtgagggtgatttcagattgtgatgaaggagaaaaaagtgcaaatttgagtagtagaagagggaggtcttcttcaattttatcaaaggctagcactaagatggcctgtgatcaaacagaaagattgctctcaactaactttgatgaagtgagtccaggtgaaagcacacacactagagtagttgttaatgattctccttgcttgcttaatgtccatgatgtgtatgaagtcccacaaactagtgaaaagcatgaagtcagtgaacatagagaaaaaaggcttgaaagattgaattctgatgcattgaacaaattaacaaaaccagattctgtgtctgagggaatggtagaatcacttgttaaacatggtgcagaaaagaaaaagggtatgtttaaagtatatggtgaaatcaaaactccttgtcctaaagatatgatgactatcattggccacatggattgtaattctcaagctgagattcaaaagctgaatcagagaattgagaggcttgagagggagagaattattgcaaggcaagaggttacccatgaagggaatggtgaagagaaattgaggctgttaaagggcatacaacgtcaactccaaataatacaatccgagatgaaaagcttgaaaaccgaaaaagccactactatggatgatgtttctttggcttccctccaagaggatttttttatgatagaattgaatttagtaccagcaaatgtatgcaattcaacaacaacgtctggtatatactag

SEQ ID NO: 80464 - DNA, 126 bp, Glycine max
  Peptide Sequence Number=SeqID_197242
atgttgctttctttaagacgtttcgtggttcagccaaaaattgtgcaagcagactatcaaccacgaagtccctatgataaaacagctcagatcactgtgtttggcaccacttatttggaaaaataa

SEQ ID NO: 80465 - DNA, 339 bp, Glycine max
  Peptide Sequence Number=SeqID_197243
atgagaaaaggagaaaattcccaatcaaaagaatcagaagaaagcaaaaatggaaaattcccaatcaaggaaaatgggggaaagcaaaaaagaaagagaattctcgatcaaagatcggaagagaaaagaagaaatatgcagaaaggtcttaggaccagacaatatctgaatgatacagatttgtcaccaagtaaacaagaaaagaaaggaaaccacgacctaaagtggtcctctcccatgatcacgcatgtaatctttgatttgataggaaatgatttgcaagatcaagtcatggcatatctatggttcggaattaggacgaaacacttacctgtgtga

SEQ ID NO: 80466 - DNA, 438 bp, Glycine max
  Peptide Sequence Number=SeqID_197244
atgggggtcgcgttcgtgcagcgggctcagccttcatgggaacatggtggtgatgtcataccaatgatgggactgtatgtgcagcgtaaggatggtacactagggttggtggccatggggaaaataatggagggggattcagtcatgcacatagtggcttatgaagatgatgttgtaagggatgtagaaattattccgcacaacgaggatgcacatgtgccaaagccggctaatgtggacgcagatgatccgttgcgtggcctgataaagtacagttttgatatttatgagaagccagttgaaatcaactttgatgggagctgctttggaattgcagatgcacctacatcgatattcataacatattcagatgttagtgaaataatagcaggagacaaaagtctgaacatatctgtacaacaattatggttaatgtaa

SEQ ID NO: 80467 - DNA, 672 bp, Glycine max
  Peptide Sequence Number=SeqID_197245
atgaaaaccgtgaaagtagtcctgataaacaccctgatgaatgttgcaaagaaattcaaagtgttaaattggaagaatcaagtagagatgaccttgaatatgctgatccatcataagtcaggagcaatgcataggactccggccagtagttttaaaaaatgcttccctagaagaccagatggattgcagagaaagttccttccattaacttatggttcttccacaaaatttccaatgaatggctctccatcttctattggaagcccttttatggatgagttaagaaccaacaacatgagatcatatgctaatgaagatgtttctagcctccaaacttttgttgctgggatgaaggaaatggatcaacaagcagagacaacaacttttagatttgaaaataatatgaaagatgtaggtgtgggatcaatgttagaggcacctgaatctcctgtagaatggcctatgcaattcaagcaacaacaaacagaaatagtggaattgtggcgagcctacaatgtatcattgtttcataggacttacttctttcttttgtttagaggtgatccaactgactccatttacatgggggtggagcttagaagattatctttcctcaaagaaacatttgcctgtggaaatcagtccatgaacgacactcacacctcacattag

SEQ ID NO: 80468 - DNA, 570 bp, Glycine max
  Peptide Sequence Number=SeqID_197246
atggctaaggtgttggcattgaaggaaggactcatggtagggatatcaactggagctaacatagttggagcactcagattggctcagctgcctgagaacaaaggcaaacttattgtgcatgttaggcaacaagctttacagaatgttaagaacaattatgcacctaaagctttggacacgagctttgatgaggtcactacttgcaagagcattctagagaaggttggacttaagggatatcaggacatgaccaagagcaagggcaaggatccacttgaaggacttggaggacctatgacaagggctagagcaagaaaagcaaaggaagctcttcaacaagtgttgtccatactatttgaatacaagcccaagtttcaaggaaaaaagttcaagcattcatctgagtggctgagtggtggagagaacttttggtgtgaagatcttgagggacaacagagattgaagaggaagttatcatgcagagtattggatgagagtttaagtgattgtgaggtttctagagcttctcagctatggagagctaaatcctcagttggttcttcctacggg

SEQ ID NO: 80469 - DNA, 483 bp, Glycine max
  Peptide Sequence Number=SeqID_197247
atgcagattattatttctgttccaccaataacttgtgatttttgccgaagggagcattaccaggataattgttatatgtactccacaaataactctaggtggagacaggagttaactccctataatcagtatgaagaggaaagagccctcgatcttgacattgtgtttgcagaattcatggcatatcatgctagttattatcaaggggaaccagaatcacaattcttctaccaaaatgaagcgaaaaagagtttcaatctggagattttgttcatgcaattcaaggatacaattggatttattcaacgggcatttaaaagtgcagaaattcaggttgaggatcaaaagatctcctttgacttaattgaagcaataaaacacccagatgacagtgaagattggtatgaagcagaaatatcggagcaggagatggaattaacaacgtcagccatggtattacagacacccggggagagaatttga

SEQ ID NO: 80470 - DNA, 297 bp, Glycine max
  Peptide Sequence Number=SeqID_197248
atgaaatcaaacagagaagaggatttggcagaggaagtattggaaggagacgacaatgtaaaaataaaaatatactataagagggtcggaaagggtaaaacaggaaaagaggacacgttcattggtattggtgatggctatggcccaagaaacgagatgggggagaagaacactgcgcaggcttgtgttgtgagcgcaaaacgcaacatcccctctctctctctctctctctctctttctgctacccttgcctctctgtcttgttcttgtgccaattgcaatttcgaaagaatataa

SEQ ID NO: 80471 - DNA, 1980 bp, Glycine max
  Peptide Sequence Number=SeqID_197249
atgggtagcttcagcgaagacgaggaatgtcggtttttcgatgctcaagaggatgttgttgtgtccattgcagatgatgaaggggtatccaatggttttgattatgaaatgtggattcggagtccaaggagtgtgagtgagcgtaggggcacgtttatgaagaggatgggactgagtagtgtggatttggttgcccttgagaatgaaaactcagtagatgtgtgtagtgttgagtgtaaagaggaagtgatggatagagtaaatgttaacagtggcgctgtgacccgaaattgtgttatggaagaggaattctgttcaagcaggacatcaatgtcttgttggtctagggagaattcttcaggggggtttggtatagtggataactcgccgtgtcaagatggaaatttggatcaggaggggctgcagtgtagggagatgagtgagggaagagatctggattcagatcggtcagtggttgcagaggaacataaggaatcggagaatgcctttagggaaacggatgctaatgtttctgttgggaagatgaacaagtataaaaagggttggctcagaagattgcggtcgataacgtgcatgcttaataggcaagatgaaggtgataatgggagagaagaaggtcttggtgaaatgtcaggaacttgtaggcttcagaaagttaaggtccgtcagtccaagaagcaaatgaaggaactttcggctctttacattaggcaagatttccaagcacatgaaggttcgattttgaccatgaagttcagtcctgatgggcagtatcttgctagtggtggtgaagacggggttgtgcgcttatggcaagtggttgaggaggataggtgtaatgaagttgacattccagaaattgatccatcctgcatttattttactgtaaataatctctctgaattgacaccactgtttatggataaagaaaaaataagcaaactgaagagcctgaaaaaaacatcagattcagcttgcattgtttttcctcctaagatctttcggttgttggagaaaccattgcatgagtttcgggggcacagagtgacgtgcatacaattcaatcctgtggatgataattatttcattagtggatctatagatgggaaagtgcgcatctgggcaattcctgattgtcatgttgttgattggattgatatcaaagatatagtgacggcagtatgctatcggcctgatgggcagggagggatcattggctccttgactggcaattgtcgattttataatgtatcagagaatctcttgcaattggattcccaactatgcttaattggtaaaaagaaacttcctggcagagggataactgggtttcagtttcttccacaagattctaacaaagttatggtctcctgtgctgattcacaagtcagaatccttgacgggcttaatgtgattggcaagtacaaaagccttagcacggggagcccaatgtgtgcatcaatgacttctgatgggaaacatattctatcagcatgtgaggactctaatgtatatctatggaatgttagtcaagaagagtctaatcccttaaaagctaagaagattacgtcttgtgagcggtttttctcaaatgcatccgtagcagtaccttggcatggtttgaaatctcaaaatattgaaatcgaacatcaactggatgccttggataaaacatcatctcaagttatacaactcagtccacctgcttcgttctctctgagtcaagagttcttcttggagtcttttccaaagggatctgcaacttggccagaggagaagcttcctgtttcaagccccaaggctaaagcatcagtgatgcgtaaatccgaatacaagttcttgaaatcttcttgcaagagtacctcctctgctcatgcgtggggtatggtcattgtcactgctggctgggatggtaggataaaatcattccacaattatgggctacctataccggcttga

SEQ ID NO: 80472 - DNA, 633 bp, Glycine max
  Peptide Sequence Number=SeqID_197250
atgacggaagggtgtggtgaagggttttgccttgcaaaccttcccggtgatgcttttagtctatgggggaacttctttgaggcaaagaaacaaatgatggctgatgccaaggtcggcggtgctgggttatggccccgtgctaagtttcggattggttgggcccctcctccccccgtgatcagtttgttgccaggattttgccaactttggcttgcgccccgttggctaagtctgtgcctcggtggtggatcatcatgggagggacgcatcaaagagacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattttgggaatcaacggttcctctcgtactag

SEQ ID NO: 80473 - DNA, 225 bp, Glycine max
  Peptide Sequence Number=SeqID_197251
atgactaccagaagaattatcagttttaactttatcttgcgaattatgtgtgttgctcttcttttgacgtcaggatccgcacttatggagagttgcacgaaggctggaaattgtccagatgataaagcttgtaacactttgtgtaatttgtttggcttcaaagattatggcggtttctgcgtttattatgggacaatagattattgttgctgccaatatcgatga

SEQ ID NO: 80474 - DNA, 2007 bp, Glycine max
  Peptide Sequence Number=SeqID_197252
atggagaggtctagatctaagaggaactactactatgaccaagactatgattccgagaccttagcgaggacaaggccgcgctataaccaccactacaccaccgccgggaaccagcgccaccgcggaggcggcgccgcccgccacgcgaagactcagcaggactcaccgttgacggtcaccaccagctaccgcattctctgccacgacctgaaggccggcggcgtcattggcaagtccggcagcatcataaagtctatacggcagcacaccggcgcgtggatcaacgtgcacgagctcatgccgggggacgaggagcggatcatcgagatttccgacacgcgccgccgcgatcccgaggggagaatgccgtccttctcgccggcgcaggaggcgctgttgctgatccacgagcggattctcgagagcgacgccgcgttcggggtggcggaggacgacgaggagtacggtgccggaaggggcggaggggccggaagggaccgcgtggcgacgaggcttgtggtgtcgagaatgcatgtagggtgtttgttggggaaaggagggaagattatcgaacaaatgaggatggaaaccaagacgcaaattaggatactccctagagatcacaaccttcctcgttgtgtttccatgtctgaagaaattgttcagctaaagagctggaaaggaggaaacatgttcatagcaatatttttttggattgggggttcggaggttgtaggtgatgtaaatgctgtaaagaatgctctagtaattatttcatcacggttgagggagagtcagcaccgtgaccgcagccatttccatggacgtgtacattcaccagagcgttttttctctcccgacgatgattatgttcctcacgtgactagtggatctcgtagatcgtctgtggatggggcctcttttggatcacgaggatctaacacaaatagtagaaataataatcacccctcattgagttatgcaatggagcctggggctgctcctgttgttgatgatgcgcagggcttttatggggaggaacttgttttccgtattctctgtccagttgagaaagttgatcttattattggggaatcagatggaattgtagagttccttcagagtgaagttggcgtagatgttaaggtcactgatcctgttggtggttctgatgaacagataatcatcattacttcagaggagggtcctgacgatgagctgttcccagctcaggaagctttgttacatatacaaactcgcattgtcgatcttgttctagataaggacaatacaataaccaccaggcttgttgtcccatctagcgaaattgaatgcttagatggaaaagatgtttcactatcagaaataaggaggttgactggtgctaatattcaaattttgcctagagatgacctacctctctgtgttgcaaaaactgatgaactggtacagattgtaggagagattaaagcagcccgagatgctgttgttgaggtgacatcaagattaaggagttacttgtacagggatttctttcaaagggacccaataccactaccagctcccttacctggtgcagaggcatcttcttccaataatatagttccggttgctgaaacttccacaacttatcaaaatgtgcaaactgttgcagcagcccttccgccaaaggaaactggaggatctagcactgaggtaggaaagcagaaagaaagtggccgccgcgatgatgtgcttagtggtttaaataggattgccgtgccgctcgttacgaggagtacacttgaagttgttataccagagtatgcagtaccaaagcttatagctaaatccaaaagcaaacttgctcaaataagtgagttgtcaggagccaatgtaacccttgtagaggatagaccagatgtgacacagaagattattcagatatctggtactccagagcaagcagagagagcccagagcttgctccaaggatttattttgagcacacaagaagacgtcccttaa

SEQ ID NO: 80475 - DNA, 501 bp, Glycine max
  Peptide Sequence Number=SeqID_197253
atggagctaagaggtggaaattcgcgcctctgggttagctcacagttctcgtgggcgtcagcctcaactggaaaagtttttgcttttaagtgcaacttgatggtgccatcaaaggttacagtcttctcttggaaagtggtgctagatagagtgcaaacaaggctgcaatttcgtaaaagaaaacttttgaggcatttcgatgatatctcatgtcctttttgcaaacaacatgtggaaaccgcaaatcacttgctcttcttatgtcaggtctctcactatgtttggatgcgcggctgtaattggcttgaacttgacatagtattgcctaacgaagttattgcacacttttggcagcatgcagggctaatagcaggcactaaaaaactaagaggatggagattatggggaatgcagtgctatgttaggtggagggttccgaggtggcaaaattactatgtgaatacatttgttgggttattcaagagggaatacactttctga

SEQ ID NO: 80476 - DNA, 762 bp, Glycine max
  Peptide Sequence Number=SeqID_197254
atgaatggagaggaggatgaatcaggtgctacatcaactgccgtgttcattggagatgatgagctgctaatttcacatattggtgactcatcagcggttctatgtagatctggaaaagcagaagttctgactagtcctcaccgtccaattgggagcagcaagacttctcttcatgaaattagaagagtcagagaagcaggtggatggattaacaatggtagaatttgtggagacattgctgtatctcgtgcatttggggactgtttcctaaaggatatctaccttttgcatgtgaaaaggatgctgcaaaaaggagttcaggaaggaagatggtcagcaaagttcatttctcgtgtacaactcaacaacgacttggttgttgcataccctgatatttatcaagtaactcttggctcagatgcagaatttgtagtattagcatccgatggcttatgggattacatgagcagagaattaccttcacactcttcttactattgcagctcagaagcagtttctttagtgagggatcaactacgaaaacacggaaacattcagcaagcatgtgaagcgcttgcagaagccgctttggaccgacgtacacaggataatgtcagcattataattgctgattttgggaggacagactggcagaatgcgccattggagcgacaaaatactatacttgagctggtccaagctcttgcaaccattggaattgtgtccattggaatctggttttcatcacagctttctttatag

SEQ ID NO: 80477 - DNA, 2616 bp, Glycine max
  Peptide Sequence Number=SeqID_197255
atggcaatggaagttacccaggtgcttttgagtgctcaatcaattgacggaaatgtacggaagcatgctgaggacagtctacgacaatttcaggagcaaaaccttcctggattcttggtctctctatctggagagttagcaagtgaagataaaccggttgatagccgaaagttggcgggtttgatactgaaaaatgctttggatgccaaggatgaaagcagaaagcaggaattggtccaaagatggttgtcgctggaccctgtggcaaagacccaagttaagtcatgcttgctacaaacactctcttctcttgtacctgatgctcggtctacagcaacccaagttattgctaaagtcgctggaattgagcttcctcagaaacagtggcctgagctgataggatcacttttatcaaatattcatcaagtaccttctcatgtcaaacaagcgactttggagaccctggggtatttgtgtgaggaggtatctcctcaggttgttgatcaggaccaagtaaataaaatacttactgccgttgttcaaggtatgaacgcgtctgaagggaacaatgatgttaggcttgctgctacaagggcattatataacgctcttgggtttgctcaggctaattttggcaatgatatggagcgtgattatatcatgagagttgtttgtgagacaactgtgtgccctgaagtgaaaatacgtcaagcagcctttgaatgtttggtctcaattgcagccatgtattatgaaaaattggctccttacatccaggatatatataacatcacagaaaaggctgttaggggtgatgaggagcctgttgctcttcaagccattgaattttggagtacaatttgtgatgaggagactgatatcttggaagaatatatgggtgattccaatggagactccgatataccttgtttttattttattaagcaagctcttcctgcacttatccctctgctgttggaaacattactcaaacaagaagaggatcaggatctggacgaaggtgcatggaatattgcaatggcaggtggtacatgccttggtttagttgctcgtactgttggagatgatattgtgccactggtaatgcccttcattgaggagaatattacaaaaccagattggaggcaaagggaggcagcctcatatgcttttggatctatcttggaggggccttcacctgacaaattagctcctcttgttaaccatgccttaccatttatgcttagtgccttagtgaaggacccaaacaaccatgtgaaagacaccactgcttggactttgggacgaatgttcgaatttcttcacagttcagttgttggtacatcaattattaatgagggaaattgccaacagattattactgttctccttcaaagcatgaaggatgttcccaatgttgctgagaaggcctgtggtgctctgtattttcttgcccagggttatgaggatgttggaccaacatctcctctaactcccttttttcaggaaattgttcaatcccttctaactgttacccacagagaggatgctacagaatcacgattgagaactgcagcatatgaaacattgaatgaagtagtaaggtgttcaacagatgaaacagcttctttggtggtacaactagtttctgtcatcatgatggagctgcacaaatgtcttgaagtacaaaatctttcatctgatgagagagaaaagcagagtgaattgataggccttctttgtggatgcatgcaagtaattattcagaagctagggtctttagattctaccaaatatctgttgttgcagtattctgatcagataatgggacaattcttcagggtctttgcttgtagaaatgccactgcacatgaagaggcgatgctagccatcggagcccttgcctactcgattggccatgagtttgccaagtacatgccagaattttacaagtttctcgagatggaccttcagaactttgaggagtaccaagtttgtgctgtcactgttggtgtggtaggggacatatgcagggcattggaggaaaaaatactgccttattgtgatgggattatgacacaacttctcaagaatttgtcaagtgataatttgcaccgttctgtgaagcccccattattctcatgcattggtgatatagcacttgcaataggagataactttaataaatacttaatgtatgcaatgaacacactacaacttgctgcagagatgtatgcccacacatcaggttttgatgatgaaatgacagagtacattaattccttgagaaatgggatattagaggcatattctgcgatttttcaagggtttaagaattcatcaaagacccagctcttgattccttatgcacctcatatcctccagtttttggatagcatatacgtggaaaaagacatggacgaggtagttatgaaaacagcaattggagtccttggagatctagctgatacacttggaagcaatgctggttctttaatacagcagtctttgtcaagcagagactttttgaatgaatgtttgacctctgaagatcatttgattaaggaatctgctgagtgggccaggttggctatcaatcgtgctatatctgtttga

SEQ ID NO: 80478 - DNA, 918 bp, Glycine max
  Peptide Sequence Number=SeqID_197256
atggccgagtggcagtccctcctccaatcgattctcgtcggcctcattttctcttaccttctagccaagctcatctccatcgtcgtttccttcaaagacgacaatctcaccgtcacgcgcgcctccgccgccgaaaccaccgccacgcgcgcggaacaattcgaggatgctctgaagcgcgacgacgccgtttcctccgatgcgcgccccttcgaggaggagtcggtcgtggccgagcacggcagcgtgaggatcgacagcgatggcgactacgacgacgactgggagggcgtggagagcaccgaattggacgaggcgttcagcgccgcgacggctttcgtggccgccgccgccgccgatcggctatcgcagaaggtgtcgagcgacgtgcagctacagctttacggtctttacaagattgccaccgaaggtccctgcagcacgccccagccttcgcccctcaaaatgaccgcacgtgccaaatggcaagcgtggcagaaattgggtgctatgcctcctgaagatgcaatgcagaagtacattgatattgtgaccgagatctatcctacttggcttgatggttcatctttgaggaataaaagcggcgacagtggtggacatggttcagaggctaagggaccaatgggccccgtattcagcacttttgtttatgaagaggaatatggcagtgactcacaaatggaagccattcatggatttgccagggaaggagatatggctaatctgctcaagtgtattgaaaatggtgtttcaatgaatttaaagggattggctccatcagacggagaatcctttcttctcttggctataagtcatatcatattatctcatccttcaatgggtctctatcttgctgatagccttctccgtgttccattggctccatctaatgggtag

SEQ ID NO: 80479 - DNA, 339 bp, Glycine max
  Peptide Sequence Number=SeqID_197257
atgcaacaatctgcaccatcagaggaaggcctcacaccttttattgcacgaggtttaaatagccccaacgcaggggtgcttcagggggtccgcaaggcatgggaattggtgcaaaagaaggacaaggaacttagaggaagtagcaatggggccgtcggcggctaccgtaggtggttgaaagcctacacacaaggtttggattggctcacgaggttgagagccaataaagaggtggagtttgaagctctggaggaaggcgaagaggtacaagtcctcagaatggagctcaggaaagcccaagcggtcaaggaaatgttcaagtcaacagccagcctttag

SEQ ID NO: 80480 - DNA, 378 bp, Glycine max
  Peptide Sequence Number=SeqID_197258
atggtggtgagcttgttcttgactcatcttctccttgaagtgacgtctccaatcatctttcttcttatccattccactgacattgatcttcaagaagaaaaggactccattgatgaagaagatccaaggcctacaagctccacatggagctacatcataaaaagctatgtcttaagctcatgtgctacttcatcgccatccgataccaaaagagttccagtggcaactggccagactagatggtggacacaaccagtgtacaaggaggttattgctgaaaaagattgggaaacacttgatcgggtgataattagtagtggcgtgacaaccagtggatgggtttcagggaattggttgcttggtcgaggagagcagtga

SEQ ID NO: 80481 - DNA, 426 bp, Glycine max
  Peptide Sequence Number=SeqID_197259
atggttatgggagatttcatcagcagactctccttccccgcatgtttgcattttagtggagaaaacaccgagactttttcaagtctcacaagttatccagaactacgtaggtctgagttcctcattggaggatacgtaggagcaagagcctcgcttttgtcgaccacaccgccttttgttgccatgactcaagagctggtagcccgcggagacaccttacggttatccgcacctcgtaattcagtgaccccaagtgtgattcacgagcagagaccaatatggtcatctgcgccctttccggagatgtcagcattttccgatggagacttttcaagtctcacaagttatcaagaactacgtaggtctgaattcctcattggaggatacgtaggagcaagagccttgcttttgtcggccgccccataa

SEQ ID NO: 80482 - DNA, 198 bp, Glycine max
  Peptide Sequence Number=SeqID_197260
atgagactcaggcgaagcaccgacagcagcgcaccatcttcattcttcggttacgatttgaaagaacagcgtggcttctgtgttcttagggtttcagagaggaatgaagtgaacggaaagggattagggcttcaggcttgctctttgtatggcctgatgatgaaaatggttgggagaaagcaaaggcctccaatttaa

SEQ ID NO: 80483 - DNA, 636 bp, Glycine max
  Peptide Sequence Number=SeqID_197261
atggccaagacggacgacagtgactcagcactcacgctaggtcgtatgcgggcagatgacctcacgtctccaccaccactagctctccttgcacccccaaaagcagaagggaaaggattacagggaggactcgctatcagaggtacctcagcaagtatcctcaaacgaggaatcacctatcgagattacctcttagtccatgatgagctgctcaatcgagcccccagaatcgctaccacccagaccaatggcggaattagacaagaaggaagacattatagtggaagggagtaccttaaacatcgacgaaagaagaaggggaaaactggaaatcaaatagcacaaggaagcaaggagagtgcaaggaaagtaagaatgcaaggaagcaagccaatcacagaagacttgacagaagcatctcagacaatgcatgtctcggcttgggggcttgacaagccacatcgacctgtaattctcacactcgtcaaggcgccaccgtgcccgacaccggacaacactcgtccacacatggggggctcaacaaactcgtcaccctctgcttgtcaagactactaccccagacataagatagactcctgttcaacggacgacaagtgcaccaaatcgcgcaagtag

SEQ ID NO: 80484 - DNA, 363 bp, Glycine max
  Peptide Sequence Number=SeqID_197262
atgcttatgactggcgaggtccttactgagccacatgcactgtttgggtttaggtctaagttgcagcttgacaagctttttgataggttttgggcctttgttagaggggtcatctcatggatttatgtcaaattcattgcccaggcctgtttggtagacggtcagggctcagatttgagagcctttgtccacgcttataacttgagtgccttcagccgctatagggtgaggcctagcaggttccctggtgggaggatatgccttgacggttacaatctccctggtcagagtaaggaatttcattttcaaatggggcatggagactgtggctctaagctcgttgagtgtcttcctgttgattaa

SEQ ID NO: 80485 - DNA, 1053 bp, Glycine max
  Peptide Sequence Number=SeqID_197263
atgtcatgggagacctcgactctctggaaagttttccaaatacatgatatcagtggaactaccttggtcgataaggaccctggacaccatgaagtttgcaatgatgatggagacgaccacgaggtcgtcctagttgatgaggttgtcgcttgcgttgttgttgttgttgtctttgtctgcctcgatcttccactcttcttctgtctacttcgtggttcctatgttgttcctcttggtgtcctccagtatttgattgcatttgacctcgacttggaaggtttcatcgggggtagcctaatgggtacctccaagttgaaagcttcctccagactcgtagtgcaattagtcgttagtcttggtacttccttcgcacttgtcacgcttctatctgacttatcagacttcattcctgaatttcaacatttcttccatttggatactgtctgtgaacttgttgaggcatatggcgaggagcatgaaatgcaatgctacctcagggttaagatttcagatatggacgtgagatctactggttgggtactacggattgaatcgtttgacgagggtgtcatagctacctatggacctaggcatgagtccaccgtaccaagtttgcctaaggcaagaaggcatttagatgctcgtttggatctattgtaccatcatacccctcgatgttgtgtagtttccaccccaagggaaagacataagtcacctggagtgttgattgtgcgtcagggacacgagcctccaattgatcatggtcagcctttagccttctcagcttctcctcatggcgtcgctccatcatcgcaatgcagctgccggatgaggatgagagtcttcgagagggggtgggcatcgccaaagtgggcttcaggacttcacacatcggctttgagaatgacctttgctgagaggacaggaggggggacctggaaaacaaaggactctgacgctcaagtaggaagaatctggaagaaggatgagctatgcatgttcgctgagcgaagggtcatcccgctaagcgcaccgcttcagtccatccactga

SEQ ID NO: 80486 - DNA, 294 bp, Glycine max
  Peptide Sequence Number=SeqID_197264
atgtcgtggccgatggcataccacttatgtttaatagggacggggagccccacttcccagtctaatcctaccaggtttaagtcatatgacgaggatctgttgaccctcgtggaaagagtcgacaaagcaattctagagaagttgtcggccttgttggacacatgggccattttgtctcttttgtcagtgagcgatcctctcgcgtccttggatgagggagtttgtcccatgtcaagggagtctgtctttccttatattggatctttcttcaataacaaacaaggtttagattga

SEQ ID NO: 80487 - DNA, 222 bp, Glycine max
  Peptide Sequence Number=SeqID_197265
atgcacgaaacacaatgtggaccactacgggtacatagaatgaatcgaaaagcttggttcgagcaaaataggggaggtggttgccgcccagctcgcccaggcgagataaaaatcgcccaggcgagccaggttgcttcctccagaagcaacagccttctggaggaatattctggagggcccaagtgggcccgccccaccaatatgcacccccatttttactaa

SEQ ID NO: 80488 - DNA, 745 bp, Glycine max
  Peptide Sequence Number=SeqID_197266
atgggagaaaagaaagaagcaatgatgtggtgccacgtgacatatttatccgcggataaagcattggcggagtggtctggaagctccaacactgaagtgaagagagaaacaatggccaatgtttcaattccactcccacgaaacggagtggctgagtttgatggatctcatcagaaaaaaggaggtttgtttaatttcaatggaatcaagggcgtggcttgtggtattcttgcagcttgtgctgttacttctgctgcatttcctgttactgctgctactcagaggcttcccccattgtcaactgagcccaatcgctgtgagcgtgcatttgttggcaacacaattggtcaggcaaatggtgtatatgataaaccattagatctccggcaatgtgatttcacaaatgagaaaaccaaccttaaggggaagtccctgtctgctgcactcatgtcagatgctaagtttgatggagctgatatgacagaagttgtaatgtcaaaggcttatgctgctggtgccagctttaaaggggtggacttctcaaatgcagtcttggaccgtgtgaactttgagaaagctgatcttgaaggagctatatttaagaacacggtattgtcaggatccacctttgatgatgctaagctggacaatgcagttttcgaggacactatcattggttacattgatctccagaaactatgcacaaataagaccattggtgatgaatggagagttgaactaggat

SEQ ID NO: 80489 - DNA, 114 bp, Glycine max
  Peptide Sequence Number=SeqID_197267
atggcagacaacatcgcatcaacattctgtggccgtgttcatgaatcgctctccttgaacagccacaaaacagagaagcagcacagaactgaattaagcatagacctcatatga

SEQ ID NO: 80490 - DNA, 379 bp, Glycine max
  Peptide Sequence Number=SeqID_197268
actcgatggtggaggacgcatgaatagcgctaggcaatcaattcatgggtctctgaataagattgagaatggagaattggggaaccgcgctaggcaatcaattcgcggggctccagactcgatcgtggaggacgcatcaacagcgccaggcaatcaatgcatgggtctccgaataagattggagattggagacttggcgaacagcgctaggcaatcaattcgcgggtctccagactcgatactcgatggtggaggacgcacgaatagcgctaggcaatcaattcatgggtctccgaataagattgagaatggagatttggcgaatagcgctaggctatcaatttgcggggctccagactcgatggtggatgacgcatga

SEQ ID NO: 80491 - DNA, 174 bp, Glycine max
  Peptide Sequence Number=SeqID_197269
atgaaagctaagaaaaagggcaagtatggggaaggaatgaatgaaaaagtgaaggtgaaaaagaggctaagttttgaattgcaaaaagtatcagttgggctaagctcagctgttgggctaagcgcaaggtcacaaattctgagcctatttaaagcctattttgtgcagaattag

SEQ ID NO: 80492 - DNA, 2373 bp, Glycine max
  Peptide Sequence Number=SeqID_197270
atgccggcctggaaacgcaccattcccgccaggttcatggcaggtagccgcatcgatccagactcggaatgttggctgctgttcgtggacgccatggttatcgccgaacatattcaaaggcagctggcggaaagcgcacagcgcgtattgaccgtctggcgcggcactcactatgaggaggatgcggcgaacgggtgttacgttatcgatccctccaaacgcgaagactacgttcgcctgctgaaaagtgtgaagaacctggcgctgcgtcccactcgcatcattaatatgtggaacctttctgccgataacggcgcaccgcagtgccatggtgatggctatgcgctgcaggtcgacgcattttacagccctctttatttgcagcaggcattggtcagtgaaaacctgctggaaaacctgcacctcttgtttgtgaccaacaatattttcaatgtgacggaggaacggctgtattcaccgcaaaaagcgttggtcgttgggcctgcgcgcgtcttttatcacgagtatcccgaagtgcggtgccacgttgtggatgtggatttattcggctacacggcgccccatgatttagcacagcaattgattgacgaaagccatatcgatacgcatggcaatctggtggcttatcgcgggcgcaaccggtgggaggaagattatcaggccgttcatctgaagcaagatgatacgggaattgctgcggagctgaaggatgagggtgtctacctcattaccggtggtttgggcggactgggcatgttggttgcgggccatgtgtcagaggtcagcaatgcgactttgatcctgacttatcgcactgagctgccgccgcgcgatcaatggcaagcgtggctgcagcagcattcggtggacgattcggtgagtgagaaaatcgcgggggttttacggctggaagaacgtggaaacaccgtgcatcttgcgcaggttgatgtctgcgattatgccggtatgcgcgatgtgctggccgggtttacccgcatagatggcgttttccataccgcggggattgccggcggcggaattattccgctgaaaaatgacgccgattgtgctggcgtgttgaatcccaaagtgaacggcagtttgattttggacgagctgcttaaagataaacagcctgatttcttcattcttttctcttcgatcacttcgattgtcggcgatgaggcgcgcatcgattattgcgcgggcaatgcgtttatggacgctttcgcccattaccgcaaccagcaacgttctgggcatacggtttctctcaactggggtaagtggggggatatcggtatggcggtgcgttggagcaatcatctgattgagcaaaaaaatagtaaatccgcacagtttgaagaagtagagggcgatttgttgacgttgattggccgtgagggaatgcaagagcgttatcgggtcaacctggcggtgcaaaaagactgggtcattgatgagcatcgcttgacgcatcagccgtcattggtcggcgcgacgatattatcgatgctgtacgaatggatgagccattttaaacctcaagagagattgcaggttaagaatctgctgttgacgcaacccgtcatttatcatcatgcctggccgcgcaacatgcagttgctggtcaccgcagagagtcatggttacaagtttagcctgcgaagcagaggcctgttggatctggcctggcaggagcatgcgctgggtttagtcagctcaaaagtggctgagtcagaggatgaaccggcatcgcttgagtctcttcgccagcgctgtacgaaagcattggcgtacgagccgctggagtgcgagctgggcaacgccaatactggcgatgtcttcctttcgctgagcccgcggtgggacaaccaccaagacattttgcaaggggaaaacgaatggttgatgcataaagttatcggttccgatttccatgacgattttgcgcgctatccattccacccggcgatgatcgacgccacggcgatccgctgcctgacttatatcacccaggaaaacttcctgccgatcagttacggcaaaataacctaccacgcgccgctggaaacggattgctatgcgcacctcaaactgaaggggccgtatcagcatacggacaatgccattacgatggatattgtcttcctgtcacatgccggcgtgccgttattgacgttggaaaattacactctgattaaaatgacccaagtcaatcaggtggtggagtcggacgagaaggcggcgcccgcggcggtgaaagtcaatcttgcggacaaggatattttgttcaatgaagggctcgatgcgctgaaacgccagctggcgcatttggaatttgaacaattg

SEQ ID NO: 80493 - DNA, 192 bp, Glycine max
  Peptide Sequence Number=SeqID_197271
ttatacggagtgcgcgtcgccccctgcaaggtcatcaagcatcgttctaaccaagcttttttcaagaagtattacgcccccaagaaggcgcagggtgagacaccacagcagccagggcgtggccggcagcggacaacagacgcactcccgccctctccaaagtttacctcagatcatccacaaaaagggtag

SEQ ID NO: 80494 - DNA, 423 bp, Glycine max
  Peptide Sequence Number=SeqID_197272
atggtggatgtagaaaatctttattgtgatgggttctgtgcaccatggcaggatgcgctggttgtgaagcttctaggaaaaatcattgggtaccacgtgatgatggatagactaaacaagaattggaaactgacgacaagctttgacatgttggatattggcaacaatttctatatggtcaagttcgacattgaagcagataggacgaaggattttatctccacggcgacaaagattgatgaaaccctagtgtggatttggctaaagggtcactggcatagagtagaatatgaaggtttataccacagctgtgcctcatgtggtcgttatggtcatttggctcgaaactgccctacttcattacatgtagacacccatcatcctactccggcgaaaactcatggtggcacaaaagggaattaa

SEQ ID NO: 80495 - DNA, 330 bp, Glycine max
  Peptide Sequence Number=SeqID_197273
atgatgcactgggactggaaagcctgtaagatttgcaacacatttgaaggtcccaactcccaacacgggaaacctttaacattgcaggtggttttaaggattgcgcgcgcgagagagagagacaacaacaagtggtggggtttcaaggaattgctaaggtggagaaggaaaagggttgagagtggtgacactgatcatatggtggcaaagtttcagagaggagaaagaaggtggtggcattatgatagagtgctcaaagctacactaccactactcctaagaaaatattataaaagactagagaaaactataaagacacaaacaagataa

SEQ ID NO: 80496 - DNA, 492 bp, Glycine max
  Peptide Sequence Number=SeqID_197274
atgaatagtctcaccctaagagtcttcagcttccccttattcctcaggaggactagtaccttggaggatgtcaaacatgtcattttttccatgagttcttacaaagctcccagagttgatggatttcagcttatctgccttgaaacttattgggaggtggtggctattgatgtgtggaccatggtttctaacgcattttctatagggacctttgatcctggccttgtagagactctcattgtacccattcccaagatagatgctcctaagtcttttaaggatttatgccctatcatcctatgcaatgttcttctcaaagtcattaccaaggtcatggtgaatagaatccaccctcatttgggcaagctcattgatccccttcaaaaaaaattcattcctaagaaagcaaaagcgtctcaagttaggttggtcaaagaagttcttgatgagttttgtaatgcttctgggctaaagggtctaaagttgatttaa

SEQ ID NO: 80497 - DNA, 393 bp, Glycine max
  Peptide Sequence Number=SeqID_197275
atggagatgtcgaaaaaggatgatgattctcagttggtgggccaggatgatatggttcaagaaaccttcttgggagaccaatctgcaacactttctagaatagccttggctttatactcatgttccttcaggaagctactagtcattcttgagaaaagagatgttgtgtggtattgcacttcactcgtgggagcacctggtgaatatgagaaatcaaattatgggcctgtgctagatatgatgaatgtatgtggggttatggatatggatgctcttggagggaaaaagcttgacaaatgcttggtggactcagactggtgtcttatgttccctcatgcactccttgaacttttacccatgcataattctggtcataaccctcttgcttcttag

SEQ ID NO: 80498 - DNA, 291 bp, Glycine max
  Peptide Sequence Number=SeqID_197276
gacaatgcggtaacaatagaaggaggggagaacatggaaggagtgcagaccactgatgcggagatagcacaatatgaccaggagagccaagaggatatttcagttacggaggagcacttgcataatagagatgatccaaaatttatggaagtaaatgctaagggacccacaaagaggaatctgccaaccgctctagtgcgaaagcatcacgtgcaacacacaaaaggtcgtggggtggaaatgatccaagccaagccaagctttactaggcttcagctcggcttgagttga

SEQ ID NO: 80499 - DNA, 958 bp, Glycine max
  Peptide Sequence Number=SeqID_197277
atggataaaagctttgtggagaaaactaaaagagaactcgggaagaataagaaggctaatgacacaagaggtcttgtggcaataaatacaccaattgatgaaatggatttatctacatctaaggatgctaaagttgaggcagggcaattggataacggacaagaaattgctgtaaaaagactttcaaaagcatctggacaaggattggaagaatttatgaatgaagtagtagtgatttctaaacttcaacatcgcaatcttgtaagacttcttggttgttgtatagaacgagacgaacagatgttggtatatgagtttatgccaaataaaagtttggattcgtttctctttgatccactccaaaggaaaatactagattggaaaaaacgcttcaacataattgaaggaatagctcgaggagtactttatcttcatcgagactcaagactaaggattatacatagagatcttaaagcaagcaacatcttactagatgatgagatgaatcccaaaatatcagactttggtttagctagaattgttagaggcggcgatgatgatgaagctaacacgaaaagggttgttggaacttatggttatatgccgcctgagtatgcaatggagggaattttctcagaaaaatcggatgtttatagctttggagtgttattgctagaaattgtaagcggacgaagaaacaccagcttttataacaatgagcaatcacttagccttgttggatatgcatggaaactatggaatgaagacaacattatgtctataatagatcctgagatacatgatccaatgttcgaaaagagtatattgagtgagattacacatcttcctcctccaagacaagttgcatttgttcagaaacaaaattgtcaaagttcagagtcttctcagaaaagccaatttaactcaaacaacgatgtaactataagtgaaattcaag

SEQ ID NO: 80500 - DNA, 159 bp, Glycine max
  Peptide Sequence Number=SeqID_197278
atggagtctaaagatgctattcatgcgctcctaatgaaggttgggtggaagttgtggaatcaccctaatgatttatgggatgatgaaagcaatatgttctggagagttgggaatggaggacaaccaaattttgggaggatgcttgggttcctaatacgg

SEQ ID NO: 80501 - DNA, 729 bp, Glycine max
  Peptide Sequence Number=SeqID_197279
atggctgacaacttggacgacggcgagttttggctccctcctcagttcctcaccgacgaagacgacgacgacacatcgttttgcaacaacctcactgcccaaaactacgccgtttcgaggtctctgttcttcagctcttcctccagcgagacggagagcgacgaggaggaccacctcgccgagttgactcgccgcgtcgctctcgaactcgatctcaacaacaagggcgtgtttggggatggtggtggttctcctcagtcaaccctgagcgtgtttgagaacagcggcaaagggtcgagtccaaacgacgccgttccaccccacgtgaactcctcgtccacgtgggatctcctccgcgccgccgcaggagaagtcgagaggatttgcgacgaaagctgtaaccgttacggtcaaaactttctgacaccctcttccattgatgcttctgttcaacaacccaatgccgttaattgcgctaacggcgttgggttgggattttaccctcaacagaagcagcaccaacaacaaccatcgctttgtcaccagcagttacagattgctcaatttgagatgatgaagaagcagcaacaacagaggcaaatggtccctcccaacagaggaataaacaataacaacaacaacaacaacaacgttgttacggttgggaacgttgttaatgggttgggtttgtctggttctgcatgggttcctcctcctggtctcgcatga

SEQ ID NO: 80502 - DNA, 1171 bp, Glycine max
  Peptide Sequence Number=SeqID_197280
acgccgcctcgtcataggcgcgttcgggcagcaggatgatgtgcggcgcttcgtcatcgccgttgccggcaaggccggcggccgcagccagccagcccgcgtggcggcccatggcctcgtagatgacaacgcgggtggaggtctcggccatcgccgccacgtccagcgccgcttcgcgcaccgagacggcggtgtacttggccgccgagccgaagccggggcaggtgtcggtcactgccaggtcgttgtcgatggtcttgggcacgccgatgcaggtcaggtcgtagccggaggccttggccagctgcgagaccttcagtgcggtatcggccgagtcgttgccgccgttgtagaggaaccagcgaacgtcgtgcgcgcgcagcacctccagcaggcggtcgtagcgggcgcggtcggcgtccagcgatttcagcttcacccggcacgagccgaaggcgccacccggggtatgggccagggcgcggatcgcggcggcgctctccttgctggtgtcgatcagctcctcgcgcagcgcgccgaggatgccgttgcgggcggcaaggaccttgatgcccttggcccgggcctgctcgatcaccgctgccgccgtggcattgatgaccgcggtgacaccgccggactgggccgataccggtccgtccgggacgcgaaccttctttgttttcaacacgttggagtcaggtcaatgcgattggttctgttgggaccgcccggttcgggcaaggggacacaggcgacgcgcctgaaggaaaagctggggatcgcccacatttcgaccggtgacatgctgcgcgcggaaatcgccgccggcacggagctgggcaagcaggccaagacggtgatggatgccggcaacctggtgtcggacgacatcctgctgggcatgctggagtcgcgcctgacccaggccgatgtcgccaagggcttcatcctcgatggctacccgcgcaatgtggcccaggccaatgcgatggacggcctgctggccaagatcggccagccgctggatgccgtggtgcagctggacgtggccaccgagctgctggtcgaccgcatcgccggtcgcgccaaggagcagggccgcgccgatgacacgccggaagcggtgcgccagcgcctgcaggtctacaacgaccagactgccccggtg

SEQ ID NO: 80503 - DNA, 315 bp, Glycine max
  Peptide Sequence Number=SeqID_197281
atgaagacattaaccactactttggaaggaaagtcagatcaacctgtacctcgatggattgaaccaaacgtatgtcattatttcatcaataggtttgaattagtgtcatgtgttactttgaaagtactagctttggtcaatatatttgatattgcatttagagtcatgttcaaactggaggctaagtgtggatattatgtcatacactggatgtggtgcatagtgagcggcggtttgaagaatgaatggaacgggtggttttttgatggaacaacgttagacattgaagccatgacaacacttcgcaagaaatag

SEQ ID NO: 80504 - DNA, 270 bp, Glycine max
  Peptide Sequence Number=SeqID_197282
atgtcaaagtgtagcgataagctgggacctagtcttgaactaggttcctttgctgctggagtgatgattgcaaccattgatctggctcaacatacactagagcaacatatgctggacaatgttaggtgggatacatcgggaagattcatagaaagaagtactgcttatgaaccttggatatggagtacagggaaccatgaacttgactatgctcctgaaattcttatggtaatattggatacacccctttctttggagattaccttataa

SEQ ID NO: 80505 - DNA, 354 bp, Glycine max
  Peptide Sequence Number=SeqID_197283
atggctgctcgtagtgaggtatgcttcaatttgcaaactcatgctgctattgtcattcagccactgccagaaatacctgacacaacatcattttacaaacttaaagaaggttgcaattgcaacacaatgtgcacggaaaggaaaagttgctcggctaaaattacgaaagctcaagatggaaaaaactatcaagcttatatacctagcagtgccccttattccacaagaactatagtaaggctccctttatttaaagctcacccatacacattggagcattgcatgaatctcaacacacttaaactttataagcttgcattaaatctgagttgcagtcggaaacattttcactag

SEQ ID NO: 80506 - DNA, 258 bp, Glycine max
  Peptide Sequence Number=SeqID_197284
atgacaccggtggcgttggccttgtacgcagctagcacctgtgcccctaccatgtcaatgttggtggggttgatcccccaagacacccagctaccgagattggccgccaccaccgccaaggccaccgagggggaggcattgacggggtcgtgggtgaggcaggaggtcgtggcggcaaagagagcgagcaagaggaggaagaacataaaaggtggtggtgacgacaacgccattggtgaagacgagagaaagagataa

SEQ ID NO: 80507 - DNA, 195 bp, Glycine max
  Peptide Sequence Number=SeqID_197285
atgtctttttgtttacaggtaagtaaagaagggcaactatcataccctaatttcgttcggggactatcattcatggatgttttggtcaaggatgcggaaaatacccaaggggaggggcaaaagggtcatttgaagccattttctggaccccaagtcgcccaggctagcctctggctcgcttggacccccaaatag

SEQ ID NO: 80508 - DNA, 279 bp, Glycine max
  Peptide Sequence Number=SeqID_197286
atgaaggttgatattagaagaagcagacacatccctcttgctgatcaagatgatattcaacaaaggaggcaaaagaagttggccagaactatggctgatgaagataaagctctagagagctttggactcgctaaaaagaagaggaagaccagagttggacaaaagtcattgacacccaaggaacccatcaagatcccatcctctgatggctctagttcatatgataataaggcaacaccaactcctactccacagccatccaatccattaccagtgtag

SEQ ID NO: 80509 - DNA, 537 bp, Glycine max
  Peptide Sequence Number=SeqID_197287
atgtatcccaacctagccaggatgagtcctcaatggttacctaatggtaccaccagaaccactcatccatcacctgcaacaactgaggagaagcaaaagcaagcaaccaagtctagtcatccatttgagaaggcattcaagctcactccacttgcaacaattcatagtatggacccctcaaaagagaaccccactcctcagccattatggtccaaagagatgtatgtactggacgaagcaattgcttatccccctaaactccacatcagcagatgtactgacatcaagatggtgtctgatagagtttgcccaagacttcccatctgtaatgaagggaagaagaaggagtcggaagttgaagaatccaaaatggatgagtccactctagtcataattgttgagaaaccaaaagctaagggggatgaggctccaattgaatcaacctcacatgaagacacctctaaagaagcaactacaatcattttccacactatcagctctggatccactccaatcaactttgctcctccagagata

SEQ ID NO: 80510 - DNA, 327 bp, Glycine max
  Peptide Sequence Number=SeqID_197288
atggcaatacaaggtatcctgcctaataaagtcggggttgccataaccctgagggagattagactatgtgggcctgtttatttaaggtggatgtactcaatcaagcgatacatgaaggtcttaaaagggcataccaagaaccaatattgtccagaagcatccattgttgaaaggtacattgtagaagaacctatagagttttgttcagaatacatggaaaagccaaaatctgtggggtttgttgagtctcgtcatgacaacaaatggggaagtaagggttcacagggttttgaggttgtaactatgggtcatgaggaactgaattaa

SEQ ID NO: 80511 - DNA, 834 bp, Glycine max
  Peptide Sequence Number=SeqID_197289
atggcattagaatgcgttggtggtgctgttctttcttctttcctcggggctctatttcagaagctggcttctcctcaactctcctctctcaagaaattgattcttctagactgccccaacctccagcagttaccagaaggtcttcccaactccatttcatatcttaatattggtggctgtgactctctaaagacttttccgctagatttcttcccagcactcaggacccttgatcttagtggctttggtaatctacagatgattacacagaatcacacccttaatcatcttgaatttctgtcaatcaaagagtgccctcaattagaatcgttgcctggaagcatgcatatgctgcttccatctctgaaggagctacgaatatatgattgtccaagagttgagtcgctccctcaaggaggtttgccatcaaatctaaaagagatggaactctctaactgctcgtccgaactcatggcctcgctgaaaggggctttggtagacaatccctctctggaaaccttgaatatagaatggctgaatgcggaatcttttcctgatgaaggtttgctgccactctctcttacttgtatacgcatccgttattctccaaatctaaaaaaactggactacaaggggctctgtcagctctcctctctcaaagtattgaatcttgaattctgcgaccacctccaacagctaccagaggagggtcttcccaaatccatttcacatcttactatttttttctgccccaatctcaagcagcgttgccagaacccagaaggcgaagactggccaaagattgctcacattccaaccctgcatatttggtag

SEQ ID NO: 80512 - DNA, 2229 bp, Glycine max
  Peptide Sequence Number=SeqID_197290
atggcattagaatgcgttggtggtgctgttctttcttctttcctcggggctgtatttcagaagctggcttctcctcaagttctggatttctttcgtggaacaaagatcgatcagaagctgcggaaggacttggaaaacaagctcctctccatccaagctgtgcttgatgatgctgaacaaaaacagtttggaaatatgcaagtgagagactggcttattaagctcaaagttgccatgcttgacgttgaagatgtcttggatgaaatacaacactccagactccaagttcaacctcaatctgaatctcaaacctgtacttgcaagctacccaatttcttcaaatcttcccctcttagttcctttaacaaggaaattaattccaacatgaaaaatgtccttgatgacctagatgatcttgcaagccggatggataatctaggtttgaaaaaggctagtgatcttgtagttggatcaggatctggtggtaaagtgccacaatcaaaatcttcagtggttgaaagtgatatttgttgcagagatgctgataaagaaatgatcattaactggctcacttctgacactgataacatgctatcaatactttctatttggggcatgggtgggctggaaattgttcatacaaaactgaaagataaattgagaggaaacagatttcttctcgttttggatgacgtttggatcgaaagcaggcctaaatgggaagctgtgcagaatgctcttgtttgtggagctcagggaagtaggatccttgtcacaacaagcagtgagaaatttgcttctaccatgcggtcaaaagaacacgagctggagcaattacaagaagattattgctggaaattgttcgctaaacatgcattcagagatgataatcttccaagagatccaggatgcccagagattggtatgaagattgttaaaaaatgtcaaggacttcctctggtcttgaagtcaatgggaagtctattacacaacaaatcatttgtttcagattgggaaaacatattgaaaagtgagatatgggaaatagaggatagtgatattgttcctgctttagcactgagctatcaccaccttcctccccatctcaagacatgctttgcttactgtgctttattccccaaggattatgtgtttcacagggagtgtttaattcagttgtggatggctgaaaaattcctaaactgccatcaaggcaataagagtccagaagaagttggccaacagtacttcaatgatctaatatcaaggtccttctttcaacaatcaagcaaatatgaagatggatttgtcatgcatgaccttctaaatgatttggcaaaatatgtttgtggagacatctattttaggtttggagttgatgatgaaggaaaaagcattgaaaagctgcctgactctgtttgcaattttaaacatcttcgttcgttagacctttcctatactggcattgaaaaactacctgaatccacatgttcactctacaacttgcaaatactgaagctgaattattgtagatgtttgaaggagctgccctcaaatttgcatgaactcaccaatttgcatggccttgaatttgtaaatactaaaattataaaggtgccaccgcatctgggaaagttgaagaatcttcaagtagccatgagttcttttgatgttggcaaatgtagtgagttcaccattcagaaattcggagagctcaattttcttcacgaaagattatcatttagggagctgcagaatattgagaatccctcagatgcattagctgcagatttgaaaaataaaacacaccttgtggaactagaatttgaatggaattcgcaccagaaccctgatgattctgccaaagaaagggatgtaattgtaattgagaatctacaaccttccaaacacctggagaagttatcaatcatcaactatggtgtgagcattggtgctgattttcatggtaatagcacttcttcatttccatcgttggaaagattgaagttctcctctatgaaagcatggaaaaaatgggaatgtgaagctgtgacaggtgcttttccatgtcttcaatatctttctataagaaaatgtccaaacctgaaaggtgacctcccagagcaacttcttcatttaaagcagctagcaattagagagtgcaaacaacttgaggcttcagctcccagggctctagaactagacctacaagactttggaatactttga

SEQ ID NO: 80513 - DNA, 120 bp, Glycine max
  Peptide Sequence Number=SeqID_197291
atggcgagtccgatgacatgcgggggtagcttatggttttactttcgtcatccagagacattcaagcctgacgacgcacgagattcttctctgctaggcagggatgatcgagttcgatag

SEQ ID NO: 80514 - DNA, 1323 bp, Glycine max
  Peptide Sequence Number=SeqID_197292
atgggttcgctaactcaagttaattacttgatttttttgctcatactttccagcttctattttggtataatctctgtgaatgataccatcacatcaaccagattcatcagggaccctgaggctataatctcaagcaatggtgacttcaagctcggattcttcagccctgaaaaatccacaaatcgctatgtggcaatctggtatctctctgaaacctacatcatatggatagccaatagagaccaaccacttaatgattcatctggggtgttccaaattcacaaggatgggaatcttgtggtaatgaatccacaaaataggatcatatggtcaacaaatgtgtcaatcattgctaccaatacaagtgctcaacttgatgattccggaaatctgatcctgcgtgatgtttcagatggaaaaatactatgggacagtttcacacaccctgctgatgttgcagtgccatcgatgaagattgctgccaacaggctcacaggcgagaaaattgcatatgtgtcatggaaaagcagttctgatccttcttctggatacttcaccgggagccttgaacgcttggatgctccagaagtgtttttttggttcaacaaaacaaagccatattggagaactggtccatggaatggaagggtcttccttggatcaccaaggatgttaactgagtacctatatggctggcgttttgagcctaatgataatggaacagcttatctaacctacaattttgaaaatccctctatgtttggagtcctgaccataactccacatggcacacttaaattggtagagtttttgaacaaaaagatatttctagaacttgaggtggaccaaaataaatgtgacttttatgggacatgtgggccttatggaagctgtgataactcaactttaccgatttgcagctgttttgaagggtttaagcccagcaatcttgatgaatggaacagggaaaattggactagtgggtgtgtgaggaatatgcaactgaactgtgacaagttgaataatgggagtgatgttcaacaagatgggtttttggagtaccataacatgaaagtgcctgactttgcagagagatcaataaatggagaccaagacaaatgcagagcagattgcttagcaaattgctcttgcttggcctacgcatatgattcttacattggttgcatgttttggagtagggacttgattgatttgcagaaatttccaaatggaggggttgatctcttcattcgcgtgccagcacaacttctagttgtaggtatgtttttctctccttctacacaatattttggagttatttag

SEQ ID NO: 80515 - DNA, 186 bp, Glycine max
  Peptide Sequence Number=SeqID_197293
atggaatctctaacatttcgacttagaccttgcaagcatgttagctgggagcctcctccaccaccgagaataaagatcaacattgatggtagctcatttggtaaccctggacgagttggatttggaggtttatttcgagatcattgtggcaactggatatcgggattctcagggtactcagcataa

SEQ ID NO: 80516 - DNA, 99 bp, Glycine max
  Peptide Sequence Number=SeqID_197294
atggaatgcgttagtaggaaggctaccatgcaagacccaggggcagtgctctctttgtgggatataggagacggattctcggcagtaagccatctatag

SEQ ID NO: 80517 - DNA, 495 bp, Glycine max
  Peptide Sequence Number=SeqID_197295
atggaccaattcttaaggcctcatctagcctatttcaaagcccaggctgaggagttgctgttaaaggatccatctgctccccatggagttcaacttttgattgaggactatccttatgcttctaatgggctagagatatgggatgctatcaagtcttgggtggaagaatatgtctcattctactacaagtcagctgaggaacttcaaaaagaccccgagctccaagcttggtggaaagaacttgtagagatgggtcatggggatttcaaggataagccatggtggcaaaagatgcaaactcgtgaagagttggttgaagctttcgctaccctcatatggattgcttcagctcttcatgctgctgttaactttggacagccattagaggcctttaagaggtttggaaagaatcttgaagagattgaaaagaagcttatagagaagaacaatgatgagacattgagaaaccgctatgggccggctaaaatgccttag

SEQ ID NO: 80518 - DNA, 657 bp, Glycine max
  Peptide Sequence Number=SeqID_197296
atgctccaatcatgtgagatcggcacaagcttaaaggagcactcaaaccaggtgaccaccaaggcctacactccaaagaattcgtcagggcctctccctcctgattcagatgaatatggtaacatcggttttggcaaaaccgatgttaacttcgtagagttaaaacttgacatttcacaacccgcgccctcaaaaaccttgcactccctcttctctttgtcctcctgcctaaaatcgctcttctctttctcctcccgcctgaaatctgccggaaaccactccctcaacatccacattgttttgaatactgccggaaacccctcgctcgaacccacagaaccccctacagtgctattggaactgtggctcaaagaaaaccctacatacactcctccgctaggtactagggtgctgaaacactcgtgggttcttaaagctttctccacgaggtacgaggaaagcttcaagtttcatgccattgttactgtttgggttcgagggtctgagcagaaagctggtccatatattgtctgtgttgccttttttagtttcttcgacaattttcaggatagcaataactccggtaaggctacctactttgctgtttttgttcgtctggtcaattgcctgagtcttttggtcaattgtgtatattag

SEQ ID NO: 80519 - DNA, 102 bp, Glycine max
  Peptide Sequence Number=SeqID_197297
atggcttctgatggtgctgggcaaggtgatagtgggacaagggctcatggtattggggcagcatatgtacatcaaagctttcatttgaagttaatgaactaa

SEQ ID NO: 80520 - DNA, 4029 bp, Glycine max
  Peptide Sequence Number=SeqID_197298
atggcggaatccacacgctcgaagacttccgttgatcgtctcgaagacgccattgctaagcttacaacgtctcaatttgccatgaactcaaagatcgatgatctccttcatcgcatgtcacagctcgaagctcatcagcaacagccacaaccactcacgccaccgtcgtcgtcgacaggtcacacgccatcacacaatccacagtaccgcatgaagctggatgttccatgctttgatggctctgatccaacaagatggatcttcaaaataacgcaattcttcgagtattatgcaacgccggagcaagaaaggttaacaatagcttccttctacatggaaggacctgcactggcttggttccagcggatgcatcgcaacgcgcaattgtcttcatggtctgcttttcttcacaccattcattcacgtttctccacgacgacgtatgaggatcctacggggttactctgcaagcttcaacaacgctcatcggtatcagcatacctctcggagttcgaatcacaagcaaacaagattatcgaattaccgacgccattcgtattaagttgctttatttcgggattgaacccatcgattcgaagggaagtgcaggtattgcaacctctctctttaactcaagcagtatcatatgtgcggttacaggaagaaaagctacctgatgctcgtcgttcctcaacctatcgtgccctaactcccacggctggatcaattactccacgatcttcatctacgaacgcacctccgccactgctgtccacaccggcacgcagttcatcaaccattcctttgaagaggttaaccccggaagagttagcaagccgccgagagaaggggctatgctttcagtgtgatgaaaagttctcgcgaggacacaaatgtgcatcttccttgttcctgctagtcatggaagatgaggagaatgtggaggatgtcgagctcattctccacacattatccggtcacttggcacaagaaacattgcgtctgagaggctttgtcaacaaccaacctatcagtatactgatagatggagggagtacacataacttcctccataatcgtgtggtcatgagattggggctaacaccaacggagacaacaccactgcgtgtcacagttggaaatgcggatgtagtgctaggagtccaatggttaaaaactcttggaccagtgctaacagattacgacgccttaacaatgaagttcatcatgaatggtaaactaatcgagttgcagggagatcgcgagaaggaatttgagcaggtgtcaccctcgcaattacgcaggtttgctcacaccaatcctgcaagcactttttttcatattcgcattgaagcaacaactgaaactacacctcagatgactcaccctataccagagattgagactttaataaccaaatatgcttcccttttccagcccctcacgaccttaccaccatcgcgagccacagaccatactatcaacttactaccaaactcaattccagtaaacgttcggctgtatagatacccatactttcaaaagaaggagatcgaagagcaggtggcagccatgcttgcaagaggatttatacaacctagctctagtcccttttcatcacccgtcctgttggtgaggaagaaagatgactcatggcgcttttgtgtggattatagagcccttaatgccatcaccgtacgtgatcgttttccgattccgacggtggatgagcttcttgacgagttaggaggggcgtggtggttttctaaactctatttaatgcagggttatcatcaaatattgatgaaccctaacgatatcagcaagacagcatttcgaacatatcaagggcactacgaatttcgcgtaatgccctttggattatgcaacgcgccttcctcatttcaagccacaatgaaccaattgtttcagccttacttaagaaaatacattatcgtcttttttgatgacattttgatatatagtaaaaccattcacgatcatcttctccatctagaaacagcttttcagcaacagctggagtatcttgggcatgtggtggctggtcatggagtcacgccaataccagagaaggtgcaggccatacaacaatggccaacccctcgatctccacgagctctatgcgggtttctcggtttagttgggttttatcggagattcatccaaggttatgccacgctagcagctccactcaccaggcttctgtgtcaggggcaatttaattggaaccaagaagccaccgacgccttccagaacctcaagaatgccctcactgcggccccagtgctcgcgctgccggattttagtgctccatttgtggttgaaacagacgcgtccggcgccggaatgggagcaatgctcatgcagaaaggccaccctcttgcttactttagtaagcaattctaccctcaactcttaaactcatccacgtatgtacgcgaattagcagcgatcgcagcggcgtaccgcgccggcaaagccaacattgtcgcagatgcgttatcgcgggccatggaataccaaactgctaccctctacctcttgttcgtaccacgattcgtcttcctcgaagaccttcgtaaagaattggcttcccttccggccttcctggccctacgtgatagtattcagaaggatcctaaggcacatgaagactacgccctaaaggaagggctcatattgcaccaaggacgtatctggttaccctctacctcctccttcatcaaactcttgctcgaagaattccaccagtcaccaacgagggggggggggcacatgggggttcaaaagacgctacaacgcctccaggataacttcacgtggccctcgatcaaggaggatacgcggaagtttgtcgccagctacgtcacatgtcatttcactaaatacgataaccgcaaaactacagggtttctctgcctcatctcggttccgacgcagccttgggaagacctcttcatggatttcatcaccggtcttccagtgtaccgcgacaacacttgtatcttcgtggtggttgatcgtttttccaaagggtttcatttaggtatgctacccactcagcacaccgctcacaccgtggcgcttctgttcattaacatggtgggtcgtctccatggtatgcccaagagcataattttggatagagaccctttatttgtgagtaagttctggcgagagctcttcaccttaagtggtaccaaactccggctaagctctgcgtaccttccacagtctgatgggcagacagaggctgagtggtcttacaatacatcgtgccactccgccacggggatgtcgcccttcgaagctgtctttgagcttttacgtcgtaagctgctcaaggcccaagatcgtatgaaaacaagtgttgatcgccaccgtcgtgagcaagaattcatggtgggagactgggttatggttaaactcaggccacgaaggcaaacttcagtaacgggtacagcgtattcaaaattggaaaaacgctattatgggccatttcgagtggttgaacgcatggggaaggtcgcttacaagttacaacttccggaatattcacgcattcatcccgtcttccatgtttcccttctcaagctagctgttgcgccgatcaccgcggctgccattgaccttccgccattaaccaccgacaaccacccagttgtcacgccactagccattgtggcatccaaaattgtaccatcagaaacaggacctaagcacatggtgctagtccaatggcgaggattgccacccgaggagacatcatgggaagactggtctatcttgaagactattcaccaccttgaggacaaggtgttcctcgaagggcaagggaatgttacgcgaggaggtactgagggggtaccatctgcaagggaggtgcaggaagcatcacggaccaggccgttacgggggagagagaaagagaatctgtttgttatttctgttagaagggtgggttgttcagttgttaggaagcttcgagaatcctctcctcatctataa

SEQ ID NO: 80521 - DNA, 330 bp, Glycine max
  Peptide Sequence Number=SeqID_197299
atggagcaaaaaacacattttacgtcacgaaaaactaagagttcatctggtgaaggatctactacttcaactgcaccttcagctaagcgttgcggaaatttgaaaaaacgccaccaaatagcggtggcgttgtgggttgcggatggcggcgccatggcggaattgcgcgcgagcaggaacagcaacatggaactccagcggcaccacgcgaacgcgacgcagcacaccgcaccagcacctgcaccacgacggcaaactcagcacccagcaccatgctcgcgacacggcaccccgcaccagcgcaccacacacacgacgaacggacggtga

SEQ ID NO: 80522 - DNA, 228 bp, Glycine max
  Peptide Sequence Number=SeqID_197300
atgatggaagaaggatttgctgtgaacaagcctcccatgttcaagggagccaactatgactactggaaggaaaaaatgattgcctttgaatcaactcacattgatatgtgggatgttgtagaaaagggcagtcacattcctttagatgctcagaagaacgagctctgtaacgacccaccttgtcgttatgatatcaccactctaaatcgcgagaatttcaatttttaa

SEQ ID NO: 80523 - DNA, 213 bp, Glycine max
  Peptide Sequence Number=SeqID_197301
atgtggaaaaataagaattcttccaggttcaacagttcgtccaaaagatccttctgtaaaaaaaaaagcctcatgagcacttgcgaggacttggatgattcatcgtctgatgaggacaatgaggaagaagacaaccagtatttgatggttgatgcatccactagtaaagttgaaccagcattggacgcaagtttagatgatgaggatccttag

SEQ ID NO: 80524 - DNA, 570 bp, Glycine max
  Peptide Sequence Number=SeqID_197302
aatctttggaaaatctaacgaatatggtgttgctcatatatattcagttccaaactacacatttatgcacaatgcaacgacagcaccagacgtatcatactacgactacatcgtaattggcggcggcaccgcagggtgtcctttagctgcgacactgtcccaaaattacagcgtgttgctccttgaacgcggtggttcaccctacggcaaccctaacatctccgacttagctgctttcggtgctgccctctcagacacctcccctacctctcccgctcagcgtttcatctccgaagacggtgtcatcaactcaagagctcgcgtcctcggtggtggaagttgcttgaacgctggcttttacactcgcgctagccctcaatatgtaagtaaccttgctcgcccaggcaagctcagctcgcccaagcgagctggttacttcacgcccaggggtcagaaaaagcttcaaaatgacccttttgccctcccttatgggtattttccgtattctttaccgaaatgtcgaaaaacctttggcattgcgcgacaactagtgtcaagcagctcaattcg

SEQ ID NO: 80525 - DNA, 240 bp, Glycine max
  Peptide Sequence Number=SeqID_197303
ggtacatcctttgtggtacaagtagagggtacatctacttgggtttgactgagaacaagagagggtacatctcttgtggatcagttctagtggagggtacatccactaggttcaaagagaacaagggagggccactcgatccaacagactctgacgagcaagtcagaggtgctctgagttctatatatggttacgatgttgctaccgctgttggtgccagtgatggtgcttcttctctat

SEQ ID NO: 80526 - DNA, 293 bp, Glycine max
  Peptide Sequence Number=SeqID_197304
gtcatatacgatgggatcacgttgtcgtcaaacaccgaccagagagggatatgcggaaatctggatatgttcagaccattccttcagagactacgggttcaatgtcaatgtgcatcagattcatgcactggtttttcatgatttcccatccattcataacaccgacacaacctattgatccggccagacatccacctgtgatgcagaatgacacatatatggagccacatatccctcaagtcccactatcaccagcagcaacaccgacacaggccccttctgatgtggagtag

SEQ ID NO: 80527 - DNA, 414 bp, Glycine max
  Peptide Sequence Number=SeqID_197305
atggtgttggtggtggcaccaagcggtggcggtggtggtggcaatggcagaggtggtactgttggtagtaatggtggtggtgcattatcgatggtgatgttaatggcgacgatggtgttggtggtgccaccatgtggtggtggtggtggtgacggaggtggcagtggtggtgacaatgatactggaaaccacattaatggtggtggcaatggtatccatgctagtggtgatggtgatgttgatggcatggtggtggtggaggtggtaacggtgttggttgggctcgacactagttcagatttagggaggagatggtgtgatggtggtgagttgggtagggatgagaagggttgggggcatagggaaagagaagagggagggagaactgagaggggtaagaaagtcttttcttag

SEQ ID NO: 80528 - DNA, 1452 bp, Glycine max
  Peptide Sequence Number=SeqID_197306
atgctagaaaagaatgggcagattctaagagtggcgtatgcaaaaagtatcctaggccctggatcaggaacatcaggaacttcccaatcaagcagtcttgcagctgctgctattgaggctgcgacatttgcccaacagtatgattctgtgggatgggctccaaaagaatacaatccagatgccaaacaatctactggtccagaagttggtgctccacaatcaggctttgtttgggatgaagcatcgggctattactatgatgctgcttctgggttttactatgatggaaatactggtctttactatgatggtaataatgggatttggtattcatatgaccaccaaactcagcagtacacaccttgcactgatcaaaatcagaataaaacgtctaataacgagtctgaaccttctaaggtatctgatagttctgaaagtaaaaaggtcatttctgcaccagctactactgttgcttcagttgagaagccagcttcattggcagatgctgtacaggctgcagcagctgctgctttagctgcagagaagaaagagaaagaaaaatcaaaggaaataaaacttgcctcaaaaagcagtatactggcaaacaagaaaaaaatgaacaatgtgttgaccatgtggaagcaaaggagccatgaggggcaggctactcgagtggctctggaagacaatcagccttctgtttcagctgatgataggtcatattcttctgggcattctgcaaagaataagttaaaaaatgagactatggtaagggaaagtaatgcttctaatccgggaagtcacacaactcttgcccaggttgctgctattgattctcgggcacagccacggcctgttagtaatagccttggaggcactgtgatgggggttataaggggctcaggaagaggggttgttaaatcagatacttattcaggttctacatctgttgcatcatctatgccaagtttaccttcagcgaatgctgatgcacagacatttgctactccctttagaacagatgtatctgccctgggttcatatacaccatctgcgactgttggaagtggtcgaagaaggttttcggaaatgcctcaatctgcttcaactcacaaggaacaacctcaaacaacttacagggaccgtgcagctgagaggaggagtttgtatggctcatcatcttcagttggaaatgatttagctgaccttgaaattggggattcaaatcgagattttgcatcaaggaagggtgatcccatgccattccctcctggggttggtggaggacgcatagttggagatgccaaccttgatacttttgaggtgattacggccgaaaaagcaattgacgaaaacaatgttggtaatcggatgcttcgcaacatgggctggcaggaaggattgggatatgctagtactttgatcctagacctagataatattttcctctag

SEQ ID NO: 80529 - DNA, 192 bp, Glycine max
  Peptide Sequence Number=SeqID_197307
atgagagagcaacccgcacgcacacttcagcagcctgtggagtggatactacctacgccaactccatatcgactagttgagcctgttcaattgataaaggtgtcatcctctgaagaggatcttgaagaggacccagaggagttatctcctgaacctgctatggatgcccctgacttatcagaggatgattag

SEQ ID NO: 80530 - DNA, 177 bp, Glycine max
  Peptide Sequence Number=SeqID_197308
atggttaacgaatcggggatgaggactttactgaggcttggaggggttgatggggacccggtgctgagaggaatgaggaaaagggctacgtacggggtcaggagaccttggggacgtcagatggggagctattggccaaaaccaagcttggccaatctcgacccaacccgggcatag

SEQ ID NO: 80531 - DNA, 291 bp, Glycine max
  Peptide Sequence Number=SeqID_197309
atggaggttaaagaattgatttgggcaagattggatgagaggaagtgtgattttcgaaatctgcacttatgcagaatttttgctgtgaaattgtgcagcagaattttgcacaagtgcagaaaaatgcttcttaggaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgcccgaccgccacctag

SEQ ID NO: 80532 - DNA, 393 bp, Glycine max
  Peptide Sequence Number=SeqID_197310
atggatgactctagtgcatatatctttctgaacttggcaaacctggctgaaggagacgacataattgttgcagtcatttctcaagtcaatgttgtgaccaataaatgtgtatacctcctacactgtgtgagggatggagaagaacaagtttatgttggtgattcaaagactacactaattctaggaaaaggaaaagttcttctcaagctcacatttgggaaaacattggctttgagtgatgtactacatgttcgcaccatcagagtcaacttggtctgtatagcactgttgagaaaggttggggtgaaagtgtcctttgaattggataaaattgttatgactaagaataatgtgtttgtgggaaagggatattatgatcaatacattttgtag

SEQ ID NO: 80533 - DNA, 120 bp, Glycine max
  Peptide Sequence Number=SeqID_197311
atgatcgaaggtgaaggattgaacttttatcacatagttaagggtggtcctggtggagggcttgattttggtcgtggttccggtggttatggtgcaccaattagtccaaacattccttaa

SEQ ID NO: 80534 - DNA, 594 bp, Glycine max
  Peptide Sequence Number=SeqID_197312
atggcaacagttgatgcagccaaggaaagagatgaagctaacttggcaaatcttgccatgaaaaagatgcaaaatgtaaagcttagtgagcttgtagaccaatcctttgggtttgagtcagaccaagtagttaaaaggatactaacttcagtagcagggttggcctttcggtgtgtgcaaagagacaatgaattaagtccttctatggatgaagttctggaagcactcaacaattttcaaaatgagaattatgagtctgagaatctagagaaagaagatgatgatggtgttatctcttccacttcatccaccgaagtacatccaccccagccagcttcacaggactcgggtcaagttggaattttaatgaataataagctaccaagttcactgaattccttgactgagaaactggaagggtggtacgtggatctagaactggctaaaagagttagaatcatgcatatacaaaaaaaagggaagcacgaagtatggtggattttgcataatgttaaccttacaaaggcagtcctcacagtcaaccgtcttagtgactattactttctaagacggttttcaggacacccgtcttaa

SEQ ID NO: 80535 - DNA, 1497 bp, Glycine max
  Peptide Sequence Number=SeqID_197313
atgggaaagcccggagaagaccacctctctctgccctccgccgaggatccgcggcggaatgcggcggcggcgtctggatgcgccgtgggactccgatgcctcgtcgtcttgcttttctcggtcgcggttttcctctccgcactcttctggctacccccgttcgctcacttcgcagatcccaaggatctgtatttaaattcaaagtacaaagaaaataatattgtgagggaaaatgtggagtatatagggaaagggattcagactaatccggagttcggttgggaggtaggttatctcttccagtttggtattggcactatggtgcattattattttcccgtgtcttttgacattgttgaatgtgatcatgatattgttgcaagcttttatgtgcagaagccagtttctttgctagaagacaacatcttgcagctttctaatgacatttttgaagagataggagctccctctaccaaagtgatcatcttgtctctagatcccttaccacggtcaaacacgacaaaagtggtgtttgcagttgatcctgatggtaaatattcagaaatgtctgcagctgccattagtttgataagagcatcatttaaatacctggttatacgccaatcatatctccagctcactacattcttgtttggtgttccctccgtttttgaggtgctgaaatttaagggagggattactatcattccacaacagagtgtgttccctctgcaaacagtgcaaacattattcaactttactttgaatttctccatttatgaaatacaatcaaattttgatgagctgacaagtcagctaaagtctggactacatttggcaccttatgagttggaagatttccaaactggtcacaccaagctgatgtggttttccttgttggaaaggctaaagcaactggcacaaaccataatgggacatcattcatggaacctcgggttgaataacactcaatttggtagggctaagcaggttcgactttcatcgatcttgcaacactcccttcatggcagtggtggtagtggctcgccttccccttcccctctgccttatccccatcatcactaccaccatcatcatcaccaccaaagtcaccaccacaacacccatgtatttcctgaaacttcacctgcacctacacctacaactggggaaggtgctactttacacaattttggtgctccagcccctgcaagaagtgtgcctgccccagggagaagttcttatgctcagcctcctaattgtcgatttgcgcatgtaacacctgcagctccccctactactgctccacactatcctgttgcctcaccatgggttggacccccagcacatggctttgattcttcggttcctgctttgagtcctttaccaaatgtagcatttgcacatgctgaaccccctcctaagaatgaagcagctgctgagcatctgaactctcattttcatggaccatcaccatcttcatgtaagtatttttaa

SEQ ID NO: 80536 - DNA, 483 bp, Glycine max
  Peptide Sequence Number=SeqID_197314
atggtggttatcaagacaatctttggtgataatgcaagaatgctcaactatccaactaggccaagttctcgagtcgagtacccgagtacttctagtgggattacctttgatgtcaagttgagggaaatattcaggttttcgggagttcaagtatttggcaagggcaagtaccttggtacttttataaggatcacttatcgcgtcaagctagaatacttctctaatgatcacctacagtgtcaaggtgagggaagtaaccaggtcgagtatctgagtacttctataaggatcacctatggtgtcaaggtgagggaaatacttaggtattcggctaagccaagtacccgagtacttctaaatggttttccattggtgttaaggaaaaatgaagggtattacctggtattcgacctagccggatacccatactctatacaagccccacaagcctcgaggagtgtagtaaacaagaaagccttttag

SEQ ID NO: 80537 - DNA, 657 bp, Glycine max
  Peptide Sequence Number=SeqID_197315
atggctagtcttatgcataaaattccttctccacgcccttctccaaccaacacttgtcctcctcctcaaaagaaaaaagacaagagaaaaagaggcaagggaaaaaaacctgaggaggtggtattcaaattgaagaaggctttagaggaaacaaataaagaaaagaatcatgctctagaggctaacgctcaatcggtcaccaaaaaaaccaatcttaaggttgatgttaagaagggtgctcgtgacatggtgataaaggagaacatggttggttttgagaagggtctttgtcaagtgagatttaagtttgaaatcctagatgagttcgaatttgacctctctaaagacgtgcatgaaggagttttgatgtctataaatgacattccaaagaaaaatcgtcactctagccgtccacctaccccgcctactgagaccttcatgactaatattgcttctgccaaagaggaaaagaggcatcctgatgatgaaaaggttaacaaccatgggtctattgaatggtgtttggaagggaagctttgtaaacgagttgaaggagggaaaccttataaagaaattgaaggtgcatctgtggctaaggaggtgtacttgggaaggataccttgtaaagagagtaaaggtgaatccttggtcgagtag

SEQ ID NO: 80538 - DNA, 1392 bp, Glycine max
  Peptide Sequence Number=SeqID_197316
atggctactccacctgcctcgcctcctcctctttctcctccttctccttctcctgcaacagcattagcgtctccgtctaccttaaagcggacacgcaaagccacacagctacgatccttggccactagaccacctggggcagagagaccaatggtccacgtcaatcctgcgaccgggaaggccgacggtccccacaagaagaaattaagaacatatttggggattgtcgctcatgataaggcaaaatttgatatcccggaagcttatgactgtaggacaaacaagaaagtacttcagactatcggcgagcaagacccctcgtgggaggatgtgcgggaaaaggcacaggccatccagaagcaaaacaccgacccccatgtgttgtctcatgggggttatgaatatttagaacagaagctgatggctgagaagataaagaaaaaacttgaggaagctgctcagtctggaagcattgagggcgtcattgaccctccatctcccatcagacgacacgtgaagtggaagatgggacgacaccgagaaaattgggcagatgacgattctttggaggagcaggcgtcacagggttcatttgtcccctatggacgtcaggatctcctgactgctgccattgggcaaccagaacaccctggtcgtgtgcgtgctgagccattcttcctccatggatcccaaagaactggagcagctgactcaacaaataaaggactagctagaggagttgatcacataaaaagtgactcggcagctgatgttatccttcaaccagatcctgaggttggtccctcagctgctcgtgtcagcacaaaggggagttatgttgatccctcactgaccgatccagacacgggtgactcagacaaatgcggattgtacatcaaagaaaatctttcctgcctggttgccctaggaagattttatgagggatccacagcggttcacaacatccctttgttgcatggccaagtgaaggttggtgttgaggaggttaaagatgcagaggctctcgttcctgtacccattgatgaggttattttagtgggacagacacttaacaccttccttgcttggctgacacatctcgtgaagcgtttatcagatcagcctttcgcctttgaaacacaaaaagcttacaacaccttgaccaccgctatgaccactgtcatggttgtcgttgcatccaccaaaatgtttggtagccccgccattgtcgtgaccaccacccgtgccacctccatgactatcgctgtggatagtatagaagagtatagaaggtttttgtggaatattctcttaaaggtcgctttcgctatggacaagaaaaaacatggcactatctgtgctatgattcattcctctccaaccagagcatga

SEQ ID NO: 80539 - DNA, 159 bp, Glycine max
  Peptide Sequence Number=SeqID_197317
atggtgcgacaaaacacgacgacggaaggaggcggtgtcagaggagaattagcggaagtatgggaagactatcttttatcaataccttcgagggacagcgatttggttgaggcaagggaaggtgtggcagcaagacgtttggtgtggaatgtgttgtag

SEQ ID NO: 80540 - DNA, 333 bp, Glycine max
  Peptide Sequence Number=SeqID_197318
atggtaatgccaaaacgtgctaacacaccactgagagttgacccctcaaagcactgtcaataccacagaaacctaggccactcaactaaagaatgcacaacacttaaagacaagatcaaagaactcatcaataaggctccaagtattgagaccatgacaaaggtcatgacacagaccaagataggacgagaagagaagatcgaccaagaagtcgctctagagagagaagaaaacaccgatcaaccaagaagagtgataaacaccatcgccaaaggcttgcaagtgaaggatgtacctcttcgacaaggaaagaagcacttgggcaatgtttga

SEQ ID NO: 80541 - DNA, 297 bp, Glycine max
  Peptide Sequence Number=SeqID_197319
atgattcttctaaatactcgagtacttggcctagttgaatgcccaagtactttccttaccttaacagcaaagaagtacttaggtactcggcctagccaaatacctgaacacttccctcacctgacaccaaaggtacattttggtgcccactatggggcccaagaaaactatcatgtaccccaagaagagcatggttgctaccaagtcaatggtggaagccatttgagtactccgcgaagagatagtgaacatgtaatgaaaacatgtcgaggacatagtggcgttgcagcaagataa

SEQ ID NO: 80542 - DNA, 294 bp, Glycine max
  Peptide Sequence Number=SeqID_197320
atgctaagggcaccatatccactgcaacttccaccctctgtcacagaatgcctaatccactgtggtgaccacatgacaatcctgagaagattcggacctccactacaatggaatgtagttgtgcttgacaagggaattggtgataagtatatcactcagccttggtataaattccttcaagaaggtgattttagccatggagatgaactgtcattctactataggcgtgttgaaaaaatctgggaagttgttattagacgtgcaatagattgggacgacaacgacatagattag

SEQ ID NO: 80543 - DNA, 324 bp, Glycine max
  Peptide Sequence Number=SeqID_197321
atggaggcgcggagtgcgcgatatgtccagaggaattgcaagatggcgaaagatgaagatgattccatactgcaagcacgtgttccacccgcttctcttacccaaaccaaactttcaaccttgtgggagaagaaggtattgatgattgtgattccgcttcaggttctggctaacttggcttccgttgtgattggggaaaccggaccttttatcaaatattgggttacttggaatcaggttcttgtgttaagaggtgtggttggagatggggggtttgccagcggcaaaggtggagatgacggagcggtgaggcggaaagagtga

SEQ ID NO: 80544 - DNA, 354 bp, Glycine max
  Peptide Sequence Number=SeqID_197322
atgtcaccttccccatttgtgaagttgaacgtagatggttcaagtcttggcaacccaggtgcatcagaatttggaggcattctcagggaccacgaagctttaaatttgattcttcataatggcaatgcttcgcatccatacaatgctctgatatctctcatccgcaactgcattaaccaaccttggaatgtgactttcatgcacactttgagagagggaaatgcatgcgcggactggttagcaaaacatggagctacccatgaagacaatctcaccatttggcacgcttgttctcctcagcttgacacccttgttttagctgataggataggagtggttcacttcaagacttag

SEQ ID NO: 80545 - DNA, 174 bp, Glycine max
  Peptide Sequence Number=SeqID_197323
atgttgagagtgaccacaatgatggtggtggcaatagtggtggagcccgtggcggtgacgatggtgatatgggggtgttttaaaatccgaattaacctggctgatcgaatcgattcaagcccaacccgaaggtctgactgggtcaagttgcctatcagatcgaccatgcattga

SEQ ID NO: 80546 - DNA, 966 bp, Glycine max
  Peptide Sequence Number=SeqID_197324
atgaccagcgcgctaagttcaattccacctaaaggaaataatttgctcagtgcgaaatgtcgcgctcaactcgaaatttcacacttttttccaaaagttgaatttcgattagcgatacaagctgtagattataaatatgtccatcaatgcaagaaaatgtgtttttctttctcttttcccaaaaccctcgcccaaagccctaacccacatcctccaccacccataaccaccggcgaccgccacaagctgtcgctgctttctataagaccaccgaacaaagaggaacactttaatcgaagcagaatcttcaaaactcacctcaaggatttggtagagaatgaagctctcaaccctccttttgtggtttcttcgagctctgcgtttaaactaatggatgtgaacatgagagatcttcaaacgacgcagagaggagctaacaaagagatatcgataaagaatagggactttaaacacgggtgccaccacgcattggtggcggttagaggccaaacacaaaatgcccgcgagaaagaaagaatcgtgtgtgaatgctttcgcaacaatgttgtcgcagaccatgcaagtgtcattcttgggcatattcttgtgtccattgatggatgcgcaaagcaggatgccaacacacatatcacccccatttttccgttgatttgggtgtttgagggttgtggtgcacgattcactgtcgaacaagagtgggactcggagcagaaccggggtacatcctttgtggtacaagtagagggtacatctacttgggttgttgtaactgagaacaagagaaggtacatctcttgtggatcagttcaagtggagggtacatccacttggttgtttaaagagaacaagggagggtacatcccttgtggatctttgcttgtaaaggcttttacaaggttgaaaagaaatctcaaggaccgcaagtcgcttggggactggatgtag

SEQ ID NO: 80547 - DNA, 420 bp, Glycine max
  Peptide Sequence Number=SeqID_197325
atgactttcgaagagaaaacaatttatcaaaccactttagcctcaattccccactacacccttctagagtgtgtcttggggatttgcttcacagtgatcaccatcctccttcagcttccttatgagtacatagacaacaatccagttcccaccatagtcttcaagggtcgcccgagaacattccatgccttcataatatgcataatcttcgccttctcgggtgccaccaatgcacttgtggcattcaataagtcaagattttctaggctttgtgggtattatgcaatggcttctatggcttcggctttggcaattctcttgtgggcattgtgctgcacatatttttggcttcaacctcttaggaaactattggtttgtgagagccagtatgataaaacttttgatcaaaatttgaattaa

SEQ ID NO: 80548 - DNA, 159 bp, Glycine max
  Peptide Sequence Number=SeqID_197326
atggtgacgacgacgacaacattggtggggtggaatagtgatagtaacagcaacaacgatgatataaactacgaaatagtgatagtgacagtggtggtgataatggtgacggtggcaacaacgggatgtgtggcggtggagacggcaatagcggtgtga

SEQ ID NO: 80549 - DNA, 447 bp, Glycine max
  Peptide Sequence Number=SeqID_197327
atgatttgtgatcttggacaagagtattttcatcaagctcatgcccctatgtttgatacattggaaagtgattcgaagaagcctttgtatctagggtgcaagaagtcattgacattgttttcagcggtgttaagtctggttaatgtgaaggccagatatggatggagtgacaaaagttttacttcactacttaaggtagtgtatgatatgcttccagaagaaaacaagttgccaaaaagttactatgaggtgaagattttgtgtccaatgggtatggagtatcagaaaattcgtgcatgccctaatgattgcatactgtacaaatatgagtacaaagaaatgcataaattccccaggtgtaaggtgtcacggtacaaagtgaatgatgatgacgagtgtagctgtgacgaaaacacaaagaaaggccccctagcaaaggtgttatga

SEQ ID NO: 80550 - DNA, 231 bp, Glycine max
  Peptide Sequence Number=SeqID_197328
atgcatgcagtacccaaactgccagaaccactggcgatacgcacatgcacagtgaagaaatcaccacttcgaatggcgacatgcagagagcatagggaaccgccaagatcaggccgtggcagtgcaggaacgtcaggtcagcagggtgcagagcaaatcgccatctgtattggcggtttgcgtttcacaggaatcgccaacatggctggcgggctgtgctttgttctttaa

SEQ ID NO: 80551 - DNA, 222 bp, Glycine max
  Peptide Sequence Number=SeqID_197329
atggaggttgatgcactgtgtcgaaaaggcttatcttcattgcagaagtgtgcaactactcttcatatattggcttatggctcacttgctgacagtgtggatgaatatgttcgaattagtgaaaccaatacagtggaatgcttggagcaatttgtatcaagcatctgcaccatatttgggaatgagtacttgaggagaccaaatagcaaagacactgaatga

SEQ ID NO: 80552 - DNA, 186 bp, Glycine max
  Peptide Sequence Number=SeqID_197330
atggatagggtcctacacaatcgcttgatttggtggaaaacaaagaccgattcagtctgggctacaaactatcaaaagctggaagacatttctgaggacatgtctttcaacttagtccgcgcttgtccaccaaacctcaagctcaataataggaagattatcgagctccctgtagttgtgagttag

SEQ ID NO: 80553 - DNA, 402 bp, Glycine max
  Peptide Sequence Number=SeqID_197331
atggaggagaatcatactaggagtgcgtcaatgttcaccaaaaacatcaggatcacaatgttgcttaataatctacaagaggtaaaacaccaaaatggaaaactgtttccccaacatccttatagaacgtgctcccaagtcaagatcatgaatgagtttgaagagtgtaatgaagagttggggagtgacattgatcaattgaagcagcaaatggagcagattctaaagatattacaagctctccagatgaaggcttcagagaggactcaagcacaacctatcactttgcaccttaataggcctggacaatatgttgaccctgctcaagctcacttgtatggtctttcgcctaattatattccccttattgcacacaataaaacccactcagccaatggttga

SEQ ID NO: 80554 - DNA, 1920 bp, Glycine max
  Peptide Sequence Number=SeqID_197332
atggatgaacttgctaataaaattccaggtgacttttatgctgtagatgaagcttttgaacaaccctactcactccaggggttctcaactaaagaaaatgatgtgcaagaaatatccctgcaagctttaacagatatagaccatcgcttagcctatttttctgagaaactggtgaacttgcatgtgctttatgtttatctattgggcgaggaaagtgatcttgaagcaatggattcaacgaataactgcatcctggaaaacttatttgagaaggcagtgacatttgatctactgtctggcattttagattctgaggtaagagagctggacagtttcatggacactctccaagaagaaattgttgatgctcgtcataaaatattttcatgcaaacatttaactgaggttttctttatgatggacaaaaaattgcatggctctaaagagtctgtgaagcagtttcaacagcagttattggagttgaaaattcagtcatcccagctacagaaaaccattgaggcttttcgacatgagaattgcaaaacagggaaggccttgaatttatcaggaaatggtcaactgacagatgtcaaagcaaaatccaatgatcagatggttgaacaacgaagatatattctgcgaatgcttgagaaatctctagcaagggaactcgagcttgaaaggaagttagcagagtcaaaaaacaatgaagacctaaacttgaaactctgctacacagaacaagtggcattttatatggaagaggctgcagaagtagtttggggaagatttctagaggcagacaatactgcagaggtgttaatggggatttctaaaggtataatgggacaccttcaagtaactgagttcaacctcaatggttatatacaacgagaaaatgagctgagatcaaaagttcagattttgatagagcagctcaaggctaaagatgcttctttagagaagcttgaggcatgtaatgttgagagtgctaaggaaaagtctgaggtgttggcattgagggaaaaggtgaaattgcttgaagaagaacaaaaagattttgagcttcggataaataatgtgatggcagagaatgaagcatgtcacgagcacctaattgaaatggaaaattttgttgagtctttgaaagaaagcattgacatagcagaaaatcgggctgagagcgcagaagcgaaggttacacagttaactgagaccaacttggaacttactgaagaggtgaattttcttaaagggagtgccagtactgcagagaaaaaggttggttcacttgagaagcaactaagggaactagatatccaactacaaaatgcaaaggcgtcttctgaagcaagtcaagaacagcagaacatgttatatacagctatatgggatatggaaatattgattgaagagctaaaatcaaaggttgcaaaagctgaaactaataaagaaagtgctgcagagcaatactttgtgctatctgaaactaacttggaacttaataaagaactggatatccttaggtccagaacagtaagcttgaaaacatctttggatcaagctagcaatgcaaaatcatcaagggcaaaagaaattgatactaaaaccaaacttatcatggatatggtaatgcaactagcctctgaaagggagcgcatcaataaccagttacatgctttaaaacaggaaaataaacatttggtagaaaagttaaacaatactaaaattgatgcctcttttgatgcatgcaacaatggactaaataacagaaatgaagatcaagcttccaacaatgactcaagcaatgatagctgtgctaaatcatcagatgaagaaggaatagatctctttaataagacctttcaggcaggtagggggaaactacagaccatacccaagttttggtatatcaactga

SEQ ID NO: 80555 - DNA, 309 bp, Glycine max
  Peptide Sequence Number=SeqID_197333
atgtcaggcttgagtctaggtgttgaatacatttgtcaggtagattttgggtttgtagcaagtgccaagtcgattatgggcttgaatgttggtcctgggctgttttcggaattgaatgatggtgtcgagtcgactccgaccttgccagctggggtcgaacttgactgttggtgccaggctttggctgctggtgccgggtcagcttcgggctttgaagatggaatgttgatgttagaccgcttggtcattgaaactaaaatgatcgtaagttgtgccaggtggtattgggcttcaagaaaaacaatgtaa

SEQ ID NO: 80556 - DNA, 201 bp, Glycine max
  Peptide Sequence Number=SeqID_197334
atgtcttacactgagttaatgccccttttacttcaaaacttattggtggttccaatcccgatgcaacctcaagaattgccatatcccatgggacatagagagccatcggttagtgttattgaacaaggtggagagcaactcaaaagaatgagggtagaagatgtgaaaactccaatagatgacatttttgaggaaatgtga

SEQ ID NO: 80557 - DNA, 357 bp, Glycine max
  Peptide Sequence Number=SeqID_197335
atggagccacattacaagggaatcaatcgttcttactacatgtacaagattatgatggaagaagagtacagactagtgagacagctacagaggaagctcaatccatccatgaaagaggaggtgccaaaagaagttctcaagttacttaaggctaaacttatctaccttatttctaacagtgattgggttagtccagtccaagtggtgcccaagaaaagaggaatgattatggtctgcaatgaaaagaatgatatcattctgactcagactatcactggatggaggatgtgcatagactaccacaagctcaatgattctacaagaaaggattactttcctttgccattcatggattag

SEQ ID NO: 80558 - DNA, 498 bp, Glycine max
  Peptide Sequence Number=SeqID_197336
atgggactcatcacgcgcatcgctggcaaaaccggcgcgctcggcagcgtcgtttccgcgatgggctgcgccgcctgttttcctgccatcgccagctttggcgcggccatcggactgggcttcttgagccagtacgaggggctattcattggcatcctgctgccgatgttcgccggcatcgcgttactcgccaatgctatcgcttggctcaatcatcgacagtggcgacgcacggcgctcggcacgataggcccgatcttggtgctggcagcgcacatcgccgctgcgggccggacagctgtgaattgccagaacaacgtggctgacggcaacagccgtagccaccacagaaaaggaaaaatacatgaccaccctgaaaatcaccgggatgacctgcgactcgtgcgcggctcacgtcaaggaagccttggagaaagtgcccggcgtgcaatcggcgctggtgtcctatccgaagggcacagcgcaactcgccattga

SEQ ID NO: 80559 - DNA, 348 bp, Glycine max
  Peptide Sequence Number=SeqID_197337
atgcgaacatgctttagtaaagagacaaaacttccaactgatcagagcaacatatgctttttggatgaaaaacaatgtgtctatcggggaaggagacatttcgtttctaaacgaccatttagaggaaacactgggtccaacaaaaataggagaaaaccactcaaagtgtatcaatctcacacagggcaaggattgacattctcacccaaggtcaaggtttatgataagttaggattttggctcaaggcttgtagaacagctggtcatgatatatgtcagggtttggccagcggttcggggataaaggggatgtcctacattatttccatgatacacatgcaacaatga

SEQ ID NO: 80560 - DNA, 177 bp, Glycine max
  Peptide Sequence Number=SeqID_197338
atgggtcgtaagcaacgctctaacctttttgtggatgagctgaggctgctatggtgtttcgccctgcgcctgcctggagacgcagtacttcttgatgaaagctcgattagtagggggcctgatgcccttgctggaggtgacagacactccgtagaaatgacagagacccgtaattag

SEQ ID NO: 80561 - DNA, 1014 bp, Glycine max
  Peptide Sequence Number=SeqID_197339
atgtctagagcattggaacatgattacatagggttggcagagaatccgtcaatggatggtaaaaactcatcatcactgaacttgaaggagacagagctgaggcttggcctccctggttgcgagtctccagagagaaaatcaggttctgcactctgtctttttggcaaagagttgcagaacaacaataacaatgtttgttctttgaaggctggggccaagaggggcttctctgatgccattgacacctcttctgtcactgagggatctcaaggagcttctgctttgttctctccaagaggtggcaatgttgggaagcctcttattggtttagacactcaaactaacaccaccatcaaagaggttggtgcagttcctcaatcagccaaaccggttcaggaaaacaatgatcagtttgctgcaacaaatgcccatgcaattgctcctgctgctaaggcacaagttgtgggatggccaccaattcgatctttccgaaagaacacgatggcctctaatttgacaaagaacaatgatgaagctgagggaaaatcaggatttggttgtctctatgtgaaagtcagtatggatggtgccccttatcttagaaaggttgatctcaaaacctataacaactatatggaactttcctcagctcttgagaagatgttcagctgcttcaccattggtcaatgcaattctcctggacttcctgggaaagatggactaagtgagagctctttgagggatcttctccatggatctgaatatgttcttacatatgaagataaagatggagactggatgcttgtgggtgatgttccttgggagatgttcactgattcatgtcggagactaaggatcatgaagggctctgaggcaattgggctaggctcttctaaggaagttctccaagggccatggaaaaatctaggagccaaaactaatgcagaaaaaaccccattagaccaaagcggggggtattcattgaagcatataaagatttccaagggtgtttga

SEQ ID NO: 80562 - DNA, 186 bp, Glycine max
  Peptide Sequence Number=SeqID_197340
atggctacatacactactggcacaagggagggagattactggaagataatgaagatagttgctgcaccatttgcactgggagccttgatggggtcttcaagctttggcgtctcactcataacaatcactgctcatccccacctggggccaagtactttgatctctgcaagggactttcatgattaa

SEQ ID NO: 80563 - DNA, 525 bp, Glycine max
  Peptide Sequence Number=SeqID_197341
atgctggctagtttaacagacacagggattttcatcagcattcaaataaccgttcaggaacaacacatgcaattaaaattaaaggatcaggaaataatcagaacaaagagacttacagcagggcacgccgagggatccgaaatcggagtcgaggccatcgaagccgaagaagccggcgcgggagacgggggtgtaggaagaggagatgcagacgaagccgcgagatgtgaagaggaaggagaaagcgaagaagacgaagaggacgatggtgacgcaggggaggtagaaggagccggaaccggcgattcgggagaggtaattggaggctctggtggtgatgcggaagagaatgtgttggttcttcttagtcttggattcgtcggcgtctacatcggcgtcggcgtcgtcgtcagcgtaggagttgacgcggcgggaggagagtgtccgctccaacatggagggcgcggagagattgggatggcggtgagtaggggtgctgctgctgctctgtgtctgtggagatga

SEQ ID NO: 80564 - DNA, 1179 bp, Glycine max
  Peptide Sequence Number=SeqID_197342
atggaacagcagaaaatgaattctatctggagaccaattgccaccaatgccagttcttatgaagaaagcttgatgaaggatgcacttgttaagtcagtagatggaggcaaagttcaagaaactggctgtagcacatctagcaatatttcaaatgaacatctcacgaaggtagttgctgactcagctactagttcaagccagttgcaggataatgctgaaaacagagtgctagaaggagattcatctgtctccaccgaaaagcattcaatttcttgggattgttacgatcgtgctgggttttatgaggaccagcccctccagaagctggataacgttgagcaagaatgtcgttggaagaagattttcgaagattctgtgaatgactcagcatttcctggtgttgtcgctattctcagacgaagtcatccagccactgaaggcatttcaatcaacagcgggaattcagcttcagagaagatacaggctataattgatgagacggttaatagtcgaagtcttgattattcacacttcatatcccttccattggccattcatcctgagttagttgataaactcatcaattttcaacattcaatattggaaattggttcttgcatggatgagaatactgatactgagactgattccaatgaggatgagagtactactactgacaccaaaaaagtggatcaactatcaaaggaaaattctggtgttgcagttgagcttaaagttaatgacaacagtaaatcggttaaagttaatgttactaacataccccttgtcagttatgcacctaaagcatccaagtcttccgctccgtctgacctgggtattgacaaatccatattcatcaagcctaaaacatttcaccttacagtactcatgcttaagctatggaacaaagagcgaattaagacagcctctgaggtcttgcaggaatgcatcaaaggttctttggcaaaagcccgtgttctgtatgctcctgtggaagagactggcgaagtcatcattgatgcatatgttgaagctggacttgtattagagaatgatgctaaacagaaattgaagctacacgccactgtgatgaatgcaaggcataggaaaaggaacaagaacaagtggacaagaaaggtcgattcttttgatgcacggggcatattcaagcagtattga

SEQ ID NO: 80565 - DNA, 267 bp, Glycine max
  Peptide Sequence Number=SeqID_197343
atggatatgccggatgacaaagacgctcctcccacttcaaagaaaacttccacgaaacccatatattcaaaattctcacagcaagaacttcctgcatggaaaccaattctaacacctggatgggtggaggaagctgatatgaggagagttgccttcctccctcacatgctcaaaatgcagtggcttatattcaaagcgataccaccaacaagacctgcatcaccaaatggactgttagtacacttcctcccaaataagacatgttga

SEQ ID NO: 80566 - DNA, 2757 bp, Glycine max
  Peptide Sequence Number=SeqID_197344
atggcccaagtttcaaagtttgggtacttccttcttcattcttctctccccaaaccctccaacatccagttccgttctcttctaacagttctggcctcgtcctcgaaacgacaccgcagaaaaagcacgacgccaaagccaatggaagtgaaggaggagtcttctagcttcaacaagagaagggcccagggcagagacaaaaacgacatctccaagaagaaccttctactcaaagttcgcaagctcaacccaatcaataccatctcttatgttcagatattgggaactgggatggatactcaagatacctctccttctgtccttcttttcttcgacaatcaaagatttatattcaatgctggagagggattgcaaaggttttgcactgagcataagattaagttatcaaagatagatcacatttttctttctcgcgtctgttctgagactgccggtggccttccaggtttacttcttactttggctggcatgggagaagaagggatgtctgttaatatatgggggccgtcagatcttaagtatttggtagatgccatgagatcttttattcccaatgctgccatggttcacacaaagagcttcggccccatctccaacattgatggacccattgtgcaatgtcaaagcaagcttttggaccccattgttcttattgatgacgaggtggtcaaaatatcagccattatcctacaaccaaattgcattgaaggtcagctgctgacaccttcagaaagctcttcacggaagagtatggatcataatttagaaacccttgactctcccaatggcaaaaagctatctgctgcaaaacctggtgatatgtctgttgtatatgtttgtgaactgcctgaaatcaaggggaaatttgatccagagaaagctaaggctcttggtctcagacctgggcctaagtatcgtgaactgcaacttggaaactcagtgaaatctgatcgccagaatatcatggttcatccaagtgatgtcttgggtccttctgttcctggtcccattgtactccttgttgattgcccaacagaatctcatttggaagcattattgtctgtacaatcacttgctagttattgtgatcaagcagacaaccaaccagaggctgggaagagtgtcacttgtgtaattcacctaactccttcatctgttgtgagttgttcaaattaccaaaaatggatgaagaaatttggttctgctcaacatatcatggctggacatgaaaagaagaatgtagagattcctattttgaaagctagtgcaagaattgcaacacggcttaattacttgtgtcctcagttctttccagctccaggattatggtctcttcctaatcacaatagctcaaaatttggctgtcttgcttcaagtgagggttcattttcagaactttctgaagtcatttctgctgaaaatcttcttaagtttactttgcgtccttatgctcatcttgggttggatagatcttgtattcctacaacggcggcttcctcagaaatcattgatgagttgctgtcagaaattccagaggttttggaagcagttaggcatgtaagtcagctctggcaagaatgtagtcagacaaaagaggatttaactcctgtggcagatcatgggatgatgattgaggaaccatggctatgtgctaatggtattcctgcttgtttggaaaatataaggagagatgatttggagatagttcttcttggaactggctcatatggtgttactggtgctgatgatgctgtgagaactttaaggtgcatttggatttcacatattcatgctgatcaccatacaggcttggccaggatccttgctctgcgccgtgatttgctgaggggggtgcctcatgaaccactgcttgttgtaggaccaaggcagcttaagagatatttagatgcataccaaagactggaagatttagatatgctatttctcgattgcaagcacaccacagcagcttcattggaagcttttgaggatgattttccaggaaattcagttaattctcggaatctgaacaataataatggggacttaattgcatcaaaagttgattctactttatttgctagaggatctcgcatgcaaacctattttaaaagaccaggtagtcctgttgacaaagatgtagtttctcctatcctaaagaaatttaaggaggtaatccaggaagctggtctgaaggccttgattagtttcccggttgtacattgccctcaagcatttggtgttgttttaaaagcagaagagaggactaatactgtcggaaaagtgatacctggctggaagattgtatattctggtgacacaaggccctgccccgaactaatagaagcatctggtggtgcaacagttctcatacatgaggcaaaagtatgcgagtattctagtcttaactttttaagggcaactttcgaggatgctatggtagaggaggctatagcaagaaatcacagcaccacaaatgaagccatagaaatgggacagtctgccaatgcatatcgaaccatactgactcatttcagccaaagatatcctaaaattcctgtattcgatgaaacacacatgcataaaacatgtattgcatttgacatgatgagtgtcaatgtagctgatttgtccgtgcttcccaaggctcttccatatttgaaattgcttttcagaaatgaaatgatggttgacgagtcagatgatgttgtagaagctgtgacttcagcttcttga

SEQ ID NO: 80567 - DNA, 917 bp, Glycine max
  Peptide Sequence Number=SeqID_197345
atggacgactccgccaagtcacctgatcccaccgcatcctttgcttttagatcctcaagcacaacaccacctcagagcaacttgttgagaagccattctactaaagaaacccctttcacaaacttgattcactccccaccacgcctctcttgtcccactctttctcgcagcctccaaaactctcctcttcaccaccgtcgtcagttctcaccccctccctctcctccttctcccacaaaactctctgattctgaccctcaaaccacttaccactgtgcctcttctgtcctcagaaacgatggccaaatcctctccatttccctctcatcaaatggcttggtctacactggctctgactccaaccttgtgagggtgtggaagctccctgagttcactgaatgtggacaactcaggaccaaggcttgcagggtggtggctctccaagtgtccaatgacacggtttatgcagcatatggtgatggcaaaataagggtgtggagaagaacttgggataaggtgttgaagcatgttcggttggctaccatcccaaagacactaggctatgtccgcagctacatcgccggcaaagacaagacaatgcacaaggggctaataacgtcaatggtaatcaacacagcggaggacattctatacacagcttcactcgacaaaacggtgaaagtgtggagaatctcagacatgaagtgcatagagaccatcaaggcacacactgagccaatcaacgccataatcgtggctgatgatggggtcctctacacagcctcagatgatgccacggtgagagtttggcgtagaaatttttgcagccatgaccagcctcattctctcacagtaacattacacgccaagtactccccagtgaaggccttaacactaaccccagatgctggaattct

SEQ ID NO: 80568 - DNA, 426 bp, Glycine max
  Peptide Sequence Number=SeqID_197346
atgcgaacggcagcactacctacattcagaaaactatatgggaagatagaggttgaccttgaagtgaatgatgagatagaaatagcaatagaaaacaattataacacgtatgagtttggagggaaaaagaagctggttctctcaacaacaactgtcatgggaggaaaaaatcctttcttggggacagcatatcttttcgttggtggcctatccttactctgtgccataggattcatacttctctatgtcatcaagccaagtatattgctcttcatgcagacctcttggggacccgtcctacctgccttggaacagaaatccagggagtatcaaatgacaagcatgaattccaatctttcgaatttgacaattctctatatttcactttgtgaggcaaggccttcattcagggactactactactag

SEQ ID NO: 80569 - DNA, 750 bp, Glycine max
  Peptide Sequence Number=SeqID_197347
atgactgaaacagcaaggtgtcacgaaactccaagcagcagcaccagcaactcctccacctcaaaacccctgaaaacagagaccccgaaacagagcaaagcaaagagaaacagagaccccaccaagcattccgattaccacggcgtgcgaatgcgcaattggggcaaatgggtatccgaaattcgcgagcctcgcaagaaatcacgcatctggctcggaactttcgccacccctgaaatggcggcacgtgcgcacgatgttgcggctttgagcattaagggccacacggcggttctcaactttccaaacatagtaaacatgcttcccagacccgtcacgtgtgccccacgtgacattcaagccgcggccgccgaagccgcggcgatggtggagttcgaccgggagagctcggaggcggagtcgacggagctgagcgagattgtggagcttccgaacattgaagagagcttcgactcggttgagtcgagaagtgaattcgcgttgatcgactcggtggatagttgggtgtaccctcctccaatgacagtggggagcatttgtgacatgatgatgcttggggaacatgagtgtggattgttccaatttggaaccgatcaccaaacatataaaaataaaatcggatttaatggaaaaaatgaaatgagtgctttctctccaatccgttatggacggtggtgggatagaatttctttcttatcactttctgtgactactaaaggtgttggatag

SEQ ID NO: 80570 - DNA, 264 bp, Glycine max
  Peptide Sequence Number=SeqID_197348
atggacatgaacatcggagcccttatctcaggtcagatttcttctattgctcagagtaactcctttaggctcaaatttccagccttgatcactgccctatggaaagcaagaggagttgcctctgacagtctgacttatgagagcctgagcctggccattaacttggcctacattaagaaaaactattggaatatggatgatctaacagttaacttcagaggggcgaggaaggcaagggtgagttgttcgacggtcggcaagtag

SEQ ID NO: 80571 - DNA, 231 bp, Glycine max
  Peptide Sequence Number=SeqID_197349
atggtcattccccacaccttttcgccatccataggcgattatgtccggtggcacgcaaagacaaattatggtcattctgcgccttgccacccaggctcgatcgtgtctgtggacacgcagaggcaaattatggtcattctgcaccttgtgtcaaccaagaggaacgaattcgacagttccgctggcagggagattcactggtcgaatggtgtttcgcttgaacgaaattag

SEQ ID NO: 80572 - DNA, 450 bp, Glycine max
  Peptide Sequence Number=SeqID_197350
atgactcaaaagctggtaacccgcggagacaccttacggttatccgcacctcgtcattcagtgaccccaagtgtgattgatgagcagaggccaatgtggtcatctgggcccttttcggagatgtcagcatcttccggtggagactttttcaagtctcacaagttatctagaactacaggcggcgggcccgatgacacgcggagacaaaatttggtcattccgcacccctttgccattcagacacagtcgtgtccgatggtacgcagagacaaaatttggtcattctgcaccctttgtcatccagaggcggcgggcccgatgacacgcagagacaaaatttggtcattccgtacccctttgccattcagacacagtcgtgtccgatggcgcgcagagaccaaatttggtcattctgcaccctttgtcatccagaggcggcgggccccatga

SEQ ID NO: 80573 - DNA, 162 bp, Glycine max
  Peptide Sequence Number=SeqID_197351
atgttaggtattgatgcaatcctcccaaggaagggacccatcaccaaagccatgactaggagactccaaaaagattgggccagagatacgggagaaggtcctagggttctcatgagccttagggtagatgttgggcccatggactacgactccatagtgtag

SEQ ID NO: 80574 - DNA, 231 bp, Glycine max
  Peptide Sequence Number=SeqID_197352
atgcctaagcctctaaaaaggttggactgggaggttgaaaagtcggagaattttgtagcctcttggggaggaggtggagatttcgaagtcactcatctacattctggtcataatatgaagaggtgtccattgccacctccagtagtacctgaagaagaaaatgaagaacctagtggagctgctgaagaagtagctgagggtgcaactcaaggtgcagctgctggagtttag

SEQ ID NO: 80575 - DNA, 354 bp, Glycine max
  Peptide Sequence Number=SeqID_197353
ggttatcaaaccgtggtcgccgccgatggcgcaccgctttccggcgggcagaaacagcgcatctcacttgctcgggccttcttctgctaccccaaattcgtggtgctggacgaaccgaactcaaacctcgacacccagggtgagcaggccctggccaaggcgctgctgcacgccaaaagacagggcatcaccactgtcacaatcacccagcggcccgcgcttctgcaatgcgtcgacaagatcatggtgctgaaagacgggtcggtcgccatgttcggcgaaaggatggacgtgctgaaagcgctctccggcaatggccgccaggccagccagtccccgcagatcgagggttga

SEQ ID NO: 80576 - DNA, 380 bp, Glycine max
  Peptide Sequence Number=SeqID_197354
atggacaagtacttacacaagagaaactttgtcaagtttccatatgacttgatcttcacatgtagcaatccaagcatgttcgatgaatttaagaaagaaattatgaaagagtttgaaatgattgacattggtctcatgtcttactaccttggcattgaactaaattgctacatggagaatccaacaaccactcatttgaaggcggcaaagagaactcttcgctacatcaaaggtacaacaaattttggcttgcactattctacttttgattattacaagcttgttggatatagtgatagtgattggagtggagatgtggatgaccgcaagagcacaaatggttttgtgctctacatgggagacactgcttttacatggat

SEQ ID NO: 80577 - DNA, 391 bp, Glycine max
  Peptide Sequence Number=SeqID_197355
atgtgggcaaaggctaagccagatgttgatccttatggtgcaaaacgcaaagcagggaaacctcctacaattgatgacaatcatcattctggatttagtgtggagaagaaacctaagcgggagtggagttgtggattatgtcaaattactaccacaaatgagaaagggttgaataatcatcttgagggaaagaagcacaaggcaaaagcatcactgagaactaaaaagatagggttggatgcaagactagatggtcaaaaacttcaacgtggcataacctccacaaacataggcatactggaacctagaaaggaggatcaagttgtgcaaaacagtcaaggtttaggtggtctggataatgaaaatgaaatagctactagcaaagaaacag

SEQ ID NO: 80578 - DNA, 1065 bp, Glycine max
  Peptide Sequence Number=SeqID_197356
atgaccgctttaaatccactatttaccattggcgagcaaattgtcgaaaccatcgtggcgcatcagcccttgtctcgcactgaggcgactcggaaaacgctggaattactcacgcggaccggtatccgccagcctgaaaaaaacatcaacagctatccgcatcagttgtcgggcggccagcgccaacgcgccatgatcgccatggcactctcatgcaaacccaagttgctgattgccgatgagccgaccacggcactggatatgaccatacgcgcgcgcatcgtcaagttactgattgagctgcaggaagaagacgtgcgtgaacatggtgagcaaggcatggcgattctgctgattacgcatgacctcaacctggtgcgtaaattcgcgcatcgggtagcggtgatggagcgtggccgtctggtcgagaccgccgaaacacagactctgtttgcgcagccgcagcatccttataccattaagctcatcaacagcatccccgaacgcaatgtatcgccggtggctgcggatgccagaaccttgttggaagcacataagctgcgcgtggaatatccgttgccacgcaaaggctggcgcggtttgttacggtcacacactttcactgctttgcacggtgcagacgtcaccctgcgtgaaggcgaaacagtgggtatcgtaggtgagtctgggtctggcaaatctacgctggcgcaagcagtgcttaacctgatcaaggtcaagtctggcagcatagaagtcgatggtgcgccactgtatcaactgagcaagcgcttgcagcgcgaactgcgggccaggttgcaagtggtgtttcaggatccgtttggttccttgtcaccacgccagaccgttcgccagattgtcggcgaagggttggcgttgcattttcccgagctgacggagcaagagcgttacgcgcgtattgtgcagatactgtccgaagtcggtctgagtgcgcaggtgctggattcttatccgcatgagttctctggtggccagcgccagcgtatcgccattgcacgcgcatttgtgttgtcaccaaaagtg

SEQ ID NO: 80579 - DNA, 354 bp, Glycine max
  Peptide Sequence Number=SeqID_197357
atgtttgcacattcgattaaaggctgccgtcccttgggacgggcgtgtggggtgctaataccttccccatcgcgtcttttccggtttttccgacgttttcctcaaataaacgttggtggcgactccgcgcgtattcctttcgtggaacacgcatcccgcgagtctcgcgtcgccctcccgccgaagggtaggttgcgacaatcctcaatctttggattgaaaaagactaactgcaagtggtactctcaatgcattgatcaaacattggtgataagtcctgtcaaacaaaggttgtctttggagactccattggtcacatggaaaacttatatgatgattattccggtcaaataa

SEQ ID NO: 80580 - DNA, 645 bp, Glycine max
  Peptide Sequence Number=SeqID_197358
atgcctgctctcctccaacagatgttcccgcagcttttttaccgccacaggcgtgattttttcgattgccgcgtcaacgacgccgggctcgatcagccggcgggacgcaaatacctgccgcgcctcgtcgggcgtcggattggaaacgaaagcgccccgattgcgctcggccttcacgaggccctcataggcaagcatctgcagcgccgcgcgcaccaccgtgcggctgacatcgaacaacccggcgatcgacaatggcgtcgcgcaaagtgtctcgaatggcctgggcacgatcctcatgcgatgaatcgggagatacggttatgtgggcaaggctcatgggcgcgtcctgtttgctcccgagttttagcgcgaagcgtgggacgcaggcaaacgggaattatgggcgacagccggtctgccacaattcattcagcgaccgttcagcaggcgggctgtatttccttaaccatcgaatttgcaactggcagcagcctgccacctggatggaaaaacaccatgtcgtcctttgcagctaaaaccgttatggctatcgccgtcgccgccgcaaccatcgctcccttcaacagcgcatccgccggtgactgggaccgccacgaccgccgcgacgcggcgcttctggga

SEQ ID NO: 80581 - DNA, 426 bp, Glycine max
  Peptide Sequence Number=SeqID_197359
gatgtgcagaaaaagacagatgtcatccagaagcaaaacaccgccccccacgtgttgtctcgtgggggttatgaatatttagaacagaagctgatggctgagaagacaaagaaaaaactggaggaagctactcaattcaaaagcactgaaggcgtgattgaccttccatctcccattagacaacacatgaagtggaagatggcccgcaccaagaaaactgggcagatgacgtctgaggaagcaaaggaaattgctgagacgattataagtcatttccaattaagaattgattctttggaggagcaggtgtcacaaggttcatttgtcccccatggacgtcagcatctcctgattgctgccattgggcgaccagaacaccctggtcgtgtgcgtgctgctggagctagtgtgaccataaagcaataa

SEQ ID NO: 80582 - DNA, 285 bp, Glycine max
  Peptide Sequence Number=SeqID_197360
atgaccgatttccttcggtttttccgatgttttccacaaataaatgttggtggcgactccacgcattttcctcctttggaagacgaacccgtgagcctcgcctcgctcgcccgcaaaaggctccatgtagagcttggaggccttggatcttcttcaccaatggagtcctttgcttctagaagatcagtgacagcagaatggagaaggaggaaaggtcattggagatgccacttcaaggagaagatgagtcaagaacaagctcaccactatagaagccatggataa

SEQ ID NO: 80583 - DNA, 342 bp, Glycine max
  Peptide Sequence Number=SeqID_197361
atggatggtattaaaaactccgataatgatattgaggaccaaaaccgaaagatggctttgggtggagcaagtcggcaagttggttgcttgaaaatgacatcattgaggcatatttctgttgagtaccaacatgtcatctccctaatagatatcaagtttgaaatattgcttgaactttccccagattcttgggtgaagctcaacgatcacaataatgacaaagctggatgtggaggtttaatccgtgatagcctagggcgttgggttcatggatttgcaagaaacctggggtgttgctctattgtagggaataatctcggacctgcaactaaccagggataa

SEQ ID NO: 80584 - DNA, 3015 bp, Glycine max
  Peptide Sequence Number=SeqID_197362
atgttgagactttacgtgtgtgtattggaagccaaggaccttcccgtgaaggatacttacgtgaagcttaggctgggaaagttcaagtgcaggacaaggatattgaggaacacaagcaaccccgtttggaacaaggagtttggtttcaatgtgcatggtgctgaagacatgcttgttgtctctgttgttaatcatgataatattaatgagtgcagagtgaccaatggttctgtggagtttgtgggtgaggtacggattccggtaggttcggttgcttttgaggataagcaaacgtttttgcccacgtggttctctcttgaaagccccaagagtgggaagtttttcaatgaatattgtgggaaaattctccttaccgtttctcttcatggtaaaggtcgttcttcttttatcaatcataagcattcttcaaattcaactattgcggttgacaactcaagagacttggaaggtctgcacgttgcgtgtcaggtaccttgtgataaaatgggtgcaggcaaacaattgttgaaggctattgctaatggtctgcataggattttcaaaaagaaagaagaaaactcaaaatctggtgattcttcagaactatctacttcattatctgattatgaagatagtgtacaggaaaattcatctccttgtagctttgaagaagccattgcactaatggaatcaggagatgacaaaccagaaatgcctgaaaatttgcctggcggtgttctagtagatcagatttatttagtctctccgaatgaccttaatgtgtttctttttgcacccaattcacagtttagtaaagatatggttgaactgcagggaacaacaaatgtgcaagagggaccttggacatggaaaaatggagacatgtcgtgtttaacacgagttgttacctatacaaaagcggctacgaaattgattaaggcagttaatgcaattgaggagcaaacctacattagagtgagcagaaaggaatttgctatacttgttagtgtaagcacaccagaggtcccatatggaaattcatttaggattgaattgctttacaagataatgccaggggaggcatcttcaggagaggaatcctcccatctagttgtgtcttggggaattgtcttcctccaaagcacaatgatgaaaggcatgatagaaggtggggcaagacagggattgaaggagagtttggtccagttctcggaccaacttgcgctgaattttaaggtgctagataaagcagatttaccagacaaggaacatttgttggcaactttgcaaactgaagaccagtggaattggtggcagacaattacatacttttggaatttcactgtggcttccaccattttcatgtgtggtccaagtctacctcagggcttggaatttagtgggcttgaattgccagatagttttggggagctcattacaagtggaattttaatcatccagttgcagcgtgtttataatatggtgtctcactttgtgcaagctagatttcaaatgggaactgaccatggcctcaaagccaatggtgatggatgggttcttactgtggctttaattgagggggttgacctggcctccttggagtccgaaggattgtcagatccctatgtagttttcacctgtaatggacaaacaaggtcaagctctgtcaagcttcaaatgcccgatcctctatggaatgagatattagagtttgatgctatggaagaaccaccatcagttttacatgtggaagtttttgattttgatggtccattcgaccaggatgtttcacttggacatgctgagatcaattttctaaaacacacatcaactgagttggcagatatgtgggtcatgcttgaaggaaagcttgcccaatcttctcagtcaaagttgcacttgagaattttcttggataacaataatggagttgaaacaatcaaggaatatttggagaagatggaaaaggaagtaggcaaaaaattgaatcttagatcacctcaaaggaattctacattccagaaattgtttgctttgcctccggaagaatttctcatcaaagatttcacttgttacctcaagagaaaaatgcctttacagggtcggttgtttctttcagcaaggattctggggtttcatgccaatttgtttggacataaaaccaagtttttcttcctttgggaagatattgaagagatacaagtgcttcctccatcattggcaacattaggaagccctacattggtcataattctgcgaagaggtcggggtcttgatgcaaggcatggtgcaaagactcaagatgaagaagggagacttagatttcattttcaatcatttgtttcatttagtgctgcctccagaacaataaaggccttgtggaggacaagaatactgaacccctatcagaaagaacaaatttcagaagagcatgaagatcaagaaagctttgtaattctggaagactctgcatctatcttagaggatgaagaaaaaatgtccagaattttctctgcagaacttccaattaagatgaaatcagtgatgggaatatttgatggaggaaacctggagcataaaattatgcagagaacaggatgtatgaactatgaaacaacatcatgggaacaagtaaagcctgatttcttcgagaggcatgtttcttaccaattcaatcgacatgtgtcagtttttggtggtgaagtcacatgcacacaacaaaaatttccaaatacaaacactggaggttggactgtgattgaagttatggctcttcacagtgtcccatttgctgatcacttccatattcattttaggtatgaaattgagaaatcctctcttggtgactgtgcatgcaagtgtgatgcttacattggtattatgtggctcaagagctctaagtttcagcagaggatcaacaggaacataacagccaagtttaacctccgattgaaggaaatatttgaactggttcagaaagagattttgttaatgtctcagaactctcacggataa

SEQ ID NO: 80585 - DNA, 171 bp, Glycine max
  Peptide Sequence Number=SeqID_197363
atggagaattggcaaacagcgctacacaataacttcgcggggctccagactcgaagtgaagaacggagaattggcggacagcgctacgcaataacttcgcgcggctctagactcgaaggtggaggagacatgaacagcgctaggcaattacattcatgggtctccgaataa

SEQ ID NO: 80586 - DNA, 570 bp, Glycine max
  Peptide Sequence Number=SeqID_197364
atgggaagcttggatcatctagaggaaaggcttagggtcattgaaggagttggagattatgcctttgctaacctagaagagttgttcctagtacctaatattgtcacccctcccaagttcaaggtgccggactttgacaaatacaaggggactacttgccttaagaaccatctaaagatgtattgtcggaagatgggggcatacgcaaaagatgaggaactactgaacatgggtaaaaaggggcatgaatccttcaaagaatacgccaaaaggtggagagacctggcagctcaagtggcacctccaatgacggagaaggagatgatcacaataatagtagacacattaccaatgttttactatgaaaaaatggtggagtatgcaccttcaagctttgcagatttggtcttcgtcggtgaaaggatcaaagtgggtctgaaaagaggaaaatttgatcatcctgctttgatgaattcgaaaactagggcaaatgaagaggatgagaatgagggagaaacccttgccgtgactaccattcctacacggccaaatttcccatcagcccaataa

SEQ ID NO: 80587 - DNA, 690 bp, Glycine max
  Peptide Sequence Number=SeqID_197365
gcttttcgtcttacagacagcaaaaagtttatacgaataaccactcgggtatttccgcccgtcagcgtgactcaaaagtcagtatgacagatcttgtgagcgcagaagataacgtaaatctccacgtgtcaacgggattgtcggccgcgattgcgaagggcgcagacgacgacgttagtctctgcgtgctatatggcttttcgtcttacaaacaacaaaaagtttatacgaataaccactcgggtatttacggccgtcagcgtgagtcaaaagtcagtatgacagatcttgtgagcgcggaagatgacgtaaatctccacgtgtcaacgggcttgtcggccgcaattgaggaaggcttttcgtcttacagacaacaaaaagtttatacggataaccactcgggtatttccgcccgtcagcgtgactcaaaagtcagtatgacagatcttgtgagcgcggaagataacgtaaatctccacgtgtcaacgggaatgtcggccgcgattgacgaagggcgcagaagacgactcagtatgacagatcttgtgagcgcggaagatgacgtaaatctccacgtgtcaacgggcttgtcggccgcgattgaggaaggcttttcgtcttacagaatgcaaaaagtttatacggataaccactcgggtatttccggccgtcagcgtgactcaaaagtca

SEQ ID NO: 80588 - DNA, 510 bp, Glycine max
  Peptide Sequence Number=SeqID_197366
atggcctctggtttccatgttctgaagatgtgtaactcgagtttggcctctggtaatcgattaccaatgttgtgtaatcgattaccagagaagaaaacccttgagatcgcgatggcagcggaattaatccatgatcgagtggagatggagtgcctagagggagtttgggagaccctcgaaggcaatgagaggtgccgatttcgtggaacgattcgactcacggctacttcattgcgaaatgtggagtggatactacctacacctgctccatatcgactagtggagccagtcgaagtgataaaggtgtcgtcatctgaagaagaccctgaggaggacccagaggagttacctcctgagcctgctgtggatgctcttgactttcctgagggtgatgaggacccactccctgatgtggattctccagaggacgtcatgtcagcatctgaggcagactctatggaggagagcggtccaggagggatagcgactagtggagactcttcatcatag

SEQ ID NO: 80589 - DNA, 657 bp, Glycine max
  Peptide Sequence Number=SeqID_197367
atggcggcctcgggtctggatgcggaatcagcgcagggtgatgtcgatggcggcgccagcggctggcacgttgacgcgtgcttcgtcgaaggtcggcttgcgcatcacctgcgggttgttgctgaagccgtagccttccaccggcatgccgaccaggttggtgtcgagcttgccgttgtcgttctcgtcgtgggtgagcagcacggcatagctgccggccggtatacccttgaacgtgaagtgagcgctgtcgccgctgggcgccgcctgctgggcctgcacgggcttggccttgccgtcccaggcggcagcgctgtcgaccagcgcaacgcgcagggtgccgctctgcgcgtggacgtcgtgcacggtcacggccaggtcggcggcgtgggcactggcggccagggccagtgcagtcagggcggtgctgagcagggcggtgcggatcatggcagtggctccggaagtgtgtgtggcggtgtggcgccagtctgggtggcgcggtgcacggggttcagggccagtggtcatcgattcgacgtgccagaagtcactttctgcgctggacccattgccgccggcgtgtgcggcggtcagcatctggccatgcccagcctgttccgccatctcttgcgtcctctcagccttgccggcctg

SEQ ID NO: 80590 - DNA, 1299 bp, Glycine max
  Peptide Sequence Number=SeqID_197368
atgaaggtggaagataacgtttctttcggcctgcgggcgcagaagcagcccagggggcttatcgccgagcgggtgaccgaagccttaaaaatcgtcggtatggcggattacgccacccgctacccgcatcagctttccggcggccagcagcagcgcgtcgcgatagcccgcgcgattgccgtgcgtcctcgggtactgttgcttgatgaaccgctgtcggcgctggatgcgcaaattcgtcataacatggtggaagagattgcccgtctgcatcgcgaactgccggaactgaccattctctacgtcacccacgatcagaccgaagcgctgaccctggcggacaaaatcggcatcatgaaagacggttcgctgatcgcccacggcggaacgcacgagctctatcactatccgccgaaccgctttagcgccgaattcctcggccgcgccaatatcctgcaggcgacggcgctgaaagacagcaccgagccggggctggttagcgtgagctgtggcggcggcctgattaacgccttcagccggggcggcctgcatgggcgatctgacgcatctgctgtgcgatgttgccggcgaagcggtgcggattgtgatgacccacgtgaacccgctgccgcgcgcgggggacaagctggcgctctacttcgaacctggcgatgcggttctgatcgaggtgcaatgatggcgcaaaccctcacgcttgcgcgtccggcgcgaaacttacgcccttacctgtggctggcattgccgctgctggtgctggcgacgctatttttctatccgctactgttgatcgccgaacaggcattacgtgacgccagcggcaacctgagcctcgagactttctggcaggtgattgactcaaaacgctttattggcgcgctgctcaataccttacagattgcagtgttcgccacccttggctgcctggtgctcggcagcgtgctggcgctgattctggtctttattccgttccccggcagccaactggtgagccgggtcattgatacttttattgcgctgccgaccttcctgattaccctcgcattcacctttatttacggctcggcggggctgctcaacggcaccctgatggcgttgtttgcttttgaactgccgccggtagactttctctattcaataaacggcgtgattctggcggagattaccgtctttacgccgctggtgatgcgcccgctgatggcgggactgcggcagatagataagagccagctggaagcggcgagtattctcggcgcccatccgctacgggtgattacccag

SEQ ID NO: 80591 - DNA, 1572 bp, Glycine max
  Peptide Sequence Number=SeqID_197369
atggatcctggtcgctatgctctgcatcaaggctgggataataacagcgtaattgtggctcttgagggatacggcgccgtccacgaccccaacttccgggttggtggttcctatgacgagcgaaggtttatagatgaaagatatccaagggatgctgtttaccagagaaataatttccaccgtgacattttggatagggaggcctatctgccacctggacctcctgttggccactggagtcaagccaaacggagaggttatgatgaagattatgcacttgacagggaatctagacgttttcagaggccctatcatgaatcgtataatcagattgatggtttcagggatcgtgagattgacacctatccagaatatgaaaggtttcgggatggctatactggcattgaaaactatggtgatcgaggatatgataaacctgccaggtttgttggaaatgaccatggtgatgattatgcatatgatgatgattatgactacaagtctcgagcgtcctctcatcatcatagggaggatagccatgagagggattatgatcatagtcgacatagttatgattctgattatgaaagaggtagtagaagagatagtaattggaggcaacgcgaatcacgtgatcgggaaagagataagagaggtcatagtcgggaaagagatctgagtccacataggagacgtgagcgttctcgttcccattctcgttctcgatcccggtctcattcccattctcattcccgatctcaatctcgtggacatgatgaccatccaagatctaggtcccctcgaggtcgaagccatggtcgaagttataaggcagatagctattctgacagtcgatatgacaaaagcgaaagacgtagggatcgtgatgataaacgtcagcgagagcattattctgtggccccatctgcaactgttgttgtgaaaggtctttcacagaagacaactgaagaagatctataccaaatccttgctgaatggggtcccctccgtcatgttcgtgttataaaggagagaaattctggcgtctctcgtggatttgcattcattgattttccttctatgggagctgcacaaggaatgatggacaaactaggagatgatggccttgttgtggatggcagaaaacttttctttgaatatagtagtaagccaaccggaggtcctggtccagatggagctatgaaatcaggtcataattataagagcattacggttccatctgattggatgtgtactatatgtggctacattaattttgcgcgccggacttcctgctatcagtgtaatgagccacgaactgatgatgcacctgcagcagatatttcattgtcaaattcagcagctataggaaagaaaggttcagaggcaggtccaactcatgtgcttgttgtccgtggattggatgaaaatgctgatgaggaaatgctccgctatgagttttccaaacatgctccgattaaggatctgcgtcttgtgagagacaagtttactcatgtctcaaggggatttgcatttgtacacttttattcggtaggtacaacttgtgattaa

SEQ ID NO: 80592 - DNA, 153 bp, Glycine max
  Peptide Sequence Number=SeqID_197370
atggatttggtccctgagctcatctctttcgaattcagtctgatacaccatctagagaaagaaagagagagcttggaagaaccaaaaacaagaaactcttcatggcaatggttggagtttgtaacatcacaggttaagggccttgtttcttaa

SEQ ID NO: 80593 - DNA, 603 bp, Glycine max
  Peptide Sequence Number=SeqID_197371
atgtctgtattgtacatttctctcggtagtttcctttctgtgtcatgtgcccaaatgaatgaaattgtttcagctttgaacacgagtggtgtttgttacttgtgggtggttcgtggagaagtttcatggttaaaagagaaatgtggggataggggtttagtggtgccttggtgcgaccaattgaaggttttgtcacatccttctgtaggtgggttttggagccactgtgggtggaattcaactctagaagctgtttttggtggtattccaatgctgacattccctcttttcttagaccaagttccaaatagtaggcaaattttggaagagtggaagaatgggtgggagcttaaaagatcagatttgggaagtgcagaattgataacaaaagatgaaatagtgcaagtgattagagagtttatggatcttggaaagcgaaaagaaattcgagacagggcactagaatttaagggcatttgtgaccgagcagttgcagaaggtggatcctccaatgtgaaccttgatgcatttataaaagatgttttgtgtgttcaaaggtcattgagaggcaggggatatgtgatgtacaaaataggcaaataa

SEQ ID NO: 80594 - DNA, 378 bp, Glycine max
  Peptide Sequence Number=SeqID_197372
atggaacctcccttcgaccacctcctccgccgccttcaccctcccgtcaccgccctcgtcgccgacgtcgagcttcacttccctgtcgccgtcgcccgccgcagtaatattccggtcgcgctgctttggaccatgtcggcttccttttacctcacgttgcatcaactaggaagcttggttcgtaaccactctttgaaggttgatgttttaggtagggtttctaaggtcactgcaaaatatgattatgaagagcatataccaggaatttctgcagcacaattagctgatcttcgaacggtgcttcgtgaaaatgacttgaggtttttgcagcttgagttggaatgcatttcagtagtgccaaaagcagattgtcttata

SEQ ID NO: 80595 - DNA, 363 bp, Glycine max
  Peptide Sequence Number=SeqID_197373
atgaaaaatgcaattatgtggggttttgccaatgctcgacattggctttgtgcatggcatctcctttgtaatgcaaattcaaatgtaggtcgagaacctagcaagctacgattaaaacaagttaaccaccagcaagcagaagatgttgacactggaactattaatgaggcagtacgtgatcttgttgtggtgaaactaaagggtttggtggaagtggaaaagctggaacatctaccaataagagaagccatcattgtcaaaattgtggtgcaactggtcacaataaaaggtcatgcacaactaggaaagaagtatcccaagtgtctggaaccagtgctactaatgagtccaatggtgacatga

SEQ ID NO: 80596 - DNA, 498 bp, Glycine max
  Peptide Sequence Number=SeqID_197374
atggctagattttgtagtgtggttctctcaagacacatacctgattacctgaaggaagaagaagagaaagattcaaggtctgaagttagggttagggttgggggtaggagggtcggggtcggggtcggggtggatacaggaatcccatacccgtacccgtacccgacttttggttatcggggaaaacccgaacccgaacccatacccggtcaactcgggtattacccgtcaaagtcgggacgggttcgtgcgggtacccacaggaagttgagatttttcgaaaaatggattcctattcgaagggtgtataatcatatggtagttagggtgtatacatttgtgcaagttgctttgacctaccacaaagggtttgttgatgattgtttacggtggtgcgggaggggtgttcctgaacagtctttggggggtgtgcctaaggaactggaatcagacattcgtgttagtcggaggtgtttgtacgtatatcagaggagataa

SEQ ID NO: 80597 - DNA, 276 bp, Glycine max
  Peptide Sequence Number=SeqID_197375
atgcaggagactccattcaagctaacctacaacactgaagctatgatacttgtagaaatcggcgaaccttcactacgaagaggaatgttcaacatgaccaacaactcagaatcattggcagtggagttggacctggctgaggaagttcgaagtgaagctagggttcacgaagaagcatgtaaaaagagaaacgacgtgtacaagcttcaagacatggcaggaatggttgtccctaggacctggaatgtaacttacttaaggccttactatagttag

SEQ ID NO: 80598 - DNA, 705 bp, Glycine max
  Peptide Sequence Number=SeqID_197376
atgggtataggagagtcagggagtgaaggtgacttgtctttttcatcttcttcaatgtctaattctgagagaaaggaggaggtcgcagtgaggggtaatgtaagggtagaggttagtgagaggatgggaaagaaggataagggcgtagtggacgagggtcctggagaagtgaaagtgcataagagagacgatgttgcgatgggtggagggaaggttaggaaaggtaaagaaggtaagttttcccttatcactattcttgggtatgagagggtcttcgccgaggtcaactcgtaccttactcaatttcaaactcacgagtcagtcaagaggttgaaaaaagggatcaacatgacaatctcccatgacgctgagttgttaatcgtagaatcgtgtggcaccaataagtgtgtgtttatgagaatggccaaggaagtcatgaagggctatgactacaaaaagttgaagagtttggttgttgatgaccaaaatgatctcgagaagacaaagaagaggaaacatgtggtggacaggggagtggaggagaataatgccaacaagggatccgcttgtgagattgaaaatgagaaagaggtggaggaaaggaaccaagcggaggtggttcggagtttgaccatgaccgagaaggagacaggtaccgaggccgttcagaagtcgaccgagaaggagaaatgggtcgaggtttag

SEQ ID NO: 80599 - DNA, 231 bp, Glycine max
  Peptide Sequence Number=SeqID_197377
atggatttaagtattaaaattctccctgccaccaatgatgtacatggaggagtcattgtggacttaaaagagcctatggactctgaagattttgctactttgcttagatcttcacttttacattggaagcaacagggaaaagatggtgtttggatcaagctacctattgagcttgttaatcttgctgaaactgcagttaagaaaatcatacagttcaagaaattcaaatag

SEQ ID NO: 80600 - DNA, 870 bp, Glycine max
  Peptide Sequence Number=SeqID_197378
atgagtgttccaatggagacggagctctcaaccgaccaaaacggcgcttcttcccaacactcactttccgttcccgaggacaaagttcttgtccctgtcgaggtaaccctaaaactttccagcacagctaaaatcgacgacgttcgttccgccgttgaggggatgttagaaaagaggagtttgagctataacgatggacccattccggtgcctcttgatgacgcgtttctagcagataacgtgcaaagaatttgtgtttgtggatgtgatactgatgaggggatgcacaatgataatgttcttttgttctggcaagtcaagcctgttgtacatgtctttcagcttagcgaggaagggccatgtgaggatataagctctgatggccaatcttccagcttcaatgaatggattcttcctgcaaaagaatttgacggcatgtgggaaagcttaatatacgaatctggtctaaagcaacggttattacgatatgcagcaagtgctttgctctttactgaaaaaggggttgatccattccttgtttcatggaaccgcataattttgttacatggaccacctgggactggaaagacgtcgttatgtaaagcattagctcagaaattatcaattcgattcaattcgagatacccacaggcccagcttgttgaagtgaatgcacattctttgttcagtaaatggttctctgaaagtggcaagctgtcaggttttgaaagccagtctggactgtggagtattgactgtggacttcttagacatagggtttgcaaaatgaaagcaagcagaagactgcttgctttgttagaagatgatgctggatgtggatggtttcttttggtgcaggaatctgggtag

SEQ ID NO: 80601 - DNA, 885 bp, Glycine max
  Peptide Sequence Number=SeqID_197379
atggagtactacaaccgcgtttcagaactcaacaccaccacgaccaatgatgagcaaactaccaccccaatgcccactgtgtcctcaacgagaagagtcaaggtggtggagtatgagcaagttcctgagaggcgcgttgtctatgaagagaaagtggctatgacaacgatcgttactactctccaaagtattgaaattgcacaaacaatggaacaagacctacaacactaccgcacccacgtttcagaagttgagagggagtctagtactactgaattccctaatgcttatgtttccctcaacaaaaaggttgtttacgaggaaagtgagcatgagggatcccatcaccaccacctcttccataggcatcaccaccctgagactcgtgagagtgttaaggtggtcgagtatgaacaagtgcctcagaggcgtgtcggtgaagttgtctacgaagagaacagcaggacagttgccgagggaagagggtattgttccggtgaggaggttgctgacaagcttgagggttttgaggcgggagagggcagcgaggctcgccggaatgtcgtcggagaggtcctagccggagaggtcgaggtgctggagcgtgaccattccggcgagggagtcccaaatggggcccacgaggttgttctgggagaggtcgaggatgacgaggttgcgtcacgccgcagcaacgacggcggagagggtggagttgatgagggagacgatgcggcagagaacggcgggaaaggggccggagagggaggcgaaggggaggctcacggcggtaaccgtggcggtgagagggtagcaggtgacgccgcgccaccggcatgggttgataataggcgtgatagggatccgatgagttcaagaaattga

SEQ ID NO: 80602 - DNA, 711 bp, Glycine max
  Peptide Sequence Number=SeqID_197380
atgacgaaggagtgcaattcgccaaaggaacagcagcctcaagttcttgccataaggaagaacctggagaagctgaagctagaattgcacaacatcaaccgaggaattcagtcctatatactgaggcagagagtgaatggaacttggggagctccaagatatgttattggggaggaagacgatactgagtctaatggagatgatgatgatgatgctcgatctcttcttcaatgtccttcctgtgattttgagattgatttttcgtcagcccatacccatttggaagagatgcactgctatgacccaaaaaatctgctatgtcctgtgtgtgatgaaacattaggggaggaagcaatctgggttgcacagaattcaagtgcacaaaagagagcttggaagtctgacaaatctagcattagcatctcgtcaggtgattcagtagtagtgcttgaaaagaaacttcctgccaggggaagcaaacatgaaccagtgcctgatccagttttgtcaccgtttgtcggcaatgtgtctgttccaaactccagtggcatccatcctggtgaaggttcctccaggaatgccacgtacatttccaatgcaaaaggctctgggacagatgcaccccaggattcaggtgatgagcaggatattgaagagagaaggctgagggcatcttttgttcaggagttgttatcgtcagctttaatctag

SEQ ID NO: 80603 - DNA, 405 bp, Glycine max
  Peptide Sequence Number=SeqID_197381
atggtgatgtcagcagtagtggtgacagtggcggtagaagtggaaatatcgatggtagtggcagtgacaacatggtggtgtgacactaacaatggtggtattgttggtagtggtggtggtcatgacaatgacagtaacattgatggtggtgacggtaacaatgttggtgatgatggtgatgaaaatgttagtgatagtaatgctagtggtgttggtggaggttgtaataaagttggtggtggcgaccatgatgataacattgatggtggtggtggtagctatgctagtattgaaggtgatgtcggtgacaatggtggtagcaatggtggtagcggtgttggtgtttgtggtaatgatagcgatggtgacaagaaaaagtctcattgtcaaaagtggaaaatgtaa

SEQ ID NO: 80604 - DNA, 213 bp, Glycine max
  Peptide Sequence Number=SeqID_197382
atggggactacttcgcgtgctgttcggctcttgttcgccctgttgccgatggctagccaaacaggggccgaagcgatgtcgaagatgtcccgacccagtctagacgctgtcccgaatcagttccggaccgttgccgaatactgtagggacttgaggggacttgaagggactttaggggatttgaagggacttatagccttttttgtacgctga

SEQ ID NO: 80605 - DNA, 174 bp, Glycine max
  Peptide Sequence Number=SeqID_197383
atggattttccatgctaccgtattggtgaaatacttgatggtcgatatgaagtcacaactgcacatgggaggggtgtcttttcgacagttgttcggacaaaaaatctaaacatgggaaatggtgagctagaagaagtagcaataaaaattattcatagtaatgacaccatgtga

SEQ ID NO: 80606 - DNA, 726 bp, Glycine max
  Peptide Sequence Number=SeqID_197384
atggccgagctgccctcggagatccgcgacatcaccgatccactggatgcggtgggcaacaccaccaaggcggtgaccaagggctatgcgatcggctcggcggcgctggccgcactggtgctgttcgccgactacacgcacaacctgcaggccgcgcatcccggccaggagttccgcttcgatctcagcgaccacacggtgatcatcggcctgctgatcggtggcctgatcccctacctgttcggtgcgatggcgatggaagcggtcggtcgtgcggctggcgcggtggtagaggaagtgcggcgccagttccgcgagatccccggcatcatgcagggcaccggcaagccgcagtacgacaaagcggtggacatgctgacccgttcggcgatccgcgaaatgatcgtgccgtcgctgttgccggtggcggtaccggtggtggtcggcctgctgctggggccgcgcgcactgggcggcctgttgatcggtacgatcgtgaccggcctgttcgtggccatctcgatgaccaccggcggcggcgcctgggacaacgccaagaagtacatcgaggacggccacttcggtggcaagggcagcgaagcgcacaaggccgcggtgaccggcgataccgtcggtgacccgtacaaggacaccgccggcccggcaatcaacccgctgatcaagatcatcaacatcgtcgcgctgctgctggtaccgctgttgtag

SEQ ID NO: 80607 - DNA, 495 bp, Glycine max
  Peptide Sequence Number=SeqID_197385
atgtcctcgccttcagaagacttcgcgccctcgctttcgtggggctacacgcccttccctttagaggactacacgtcctcgccttcagagggctacacactcttgccttcagaggagtacacgttgtcgccttcagaggactacatgtcctcaccttcagaggattacacgtgctcactttcagaggactacacattctcgccttcagagggctacacaccgtcaccttcagcggactacacgtcatcacctctagagggctacacgccctcacctttagaggactacacgtcctcgccttcagagggctacacgtccttgccttcagagggctacacgcactcaccttcaaaagactacacctcctcgccttcagaaggctacacgtccttgccttcagagggctacacgtcctcaccttcgatggacttcccgtgctcgccttcagaggactacacggcctcaccttcagagggttacacgccctcaccttaa

SEQ ID NO: 80608 - DNA, 303 bp, Glycine max
  Peptide Sequence Number=SeqID_197386
atggatggtaaagttgatgatgaagatattcaagaagattttgaatttgaagagcaggaagaagtgttgcagcattaccctcaagggtatcatggagttgacaaggaaggtaggccagtttacattgaaaggcttgggaaagctcatccaagccgcttgatgcgtataaccacaatagatgggtatttgaaataccatgttcaagagttcgagaaggctctggaggagaaatttccagcatgttccattgcagcgaagagacaaatttcttcaaccacgacaatactgaatgtacagggcttg

SEQ ID NO: 80609 - DNA, 456 bp, Glycine max
  Peptide Sequence Number=SeqID_197387
atgctcgagctcgacttggtcacgaatcgacagagcgaaaaaagagctctgagcatcatcgtcgacgaaatgtccctccccttcatctccggcatcgatctctccctaatcctccgcaagactgttgtcggaaccgacgaagtcagtttcgcatggttcctcgtcttcatgggagtcgtgatttccatcacagccttcctcgtcctcacgcgtattctaatcgagctcaagctcctcactcatcacgtcagcagcatcgccatggtcgtggcaacgttgttcaacggcgtcgatgcatggatcctcctcgccctcgccatcatgctcgccagtgacgacgtcaacggccacgttcacaagagccccttagtctcgctacaagtgctcctctccggcatggcctttatcgccttcatgatgataataatttggttaggagacttgaccaaacgatag
